(12) United States Patent
Bentwich

(10) Patent No.: US 7,696,334 B1
(45) Date of Patent: Apr. 13, 2010

(54) BIOINFORMATICALLY DETECTABLE HUMAN HERPESVIRUS 5 REGULATORY GENE

(75) Inventor: Itzhak Bentwich, Kfar Daniel (IL)

(73) Assignee: Rosetta Genomics, Ltd., Rehovot (IL)

( * ) Notice: Subject to any disclaimer, the term of this patent is extended or adjusted under 35 U.S.C. 154(b) by 1083 days.

(21) Appl. No.: 10/604,942

(22) Filed: Aug. 28, 2003

Related U.S. Application Data

(63) Continuation of application No. 10/310,188, filed on Dec. 5, 2002, now abandoned.

(51) Int. Cl.
*C07H 21/04* (2006.01)
*C12N 15/00* (2006.01)

(52) U.S. Cl. .................. 536/23.1; 435/320.1; 536/24.3

(58) Field of Classification Search ........................ None
See application file for complete search history.

(56) References Cited

U.S. PATENT DOCUMENTS

| 6,007,988 A * | 12/1999 | Choo et al. ................. 435/6 |
| 2002/0086356 A1 | 7/2002 | Tuschi et al. |
| 2003/0165843 A1 * | 9/2003 | Shoshan et al. ............... 435/6 |

FOREIGN PATENT DOCUMENTS

| WO | WO 01/68836 | 9/2001 |
| WO | WO 02/44321 | 6/2002 |
| WO | WO 02/094185 | 11/2002 |

OTHER PUBLICATIONS

Lee, R. C., R. L. Feinbaum and V. Ambros. The C. elegans heterochronic gene lin-4 encodes small RNAs with antisense complementarity to lin-14 Cell Dec. 3, 1993 843-854 75.
Wightman, B., I. Ha and G. Ruvkun. Posttranscriptional regulation of the heterochronic gene lin-14 by lin-4 mediates temporal pattern formation in C. elegans Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus-infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.
Engdahl HM, Hjalt TA, Wagner EG. A two unit antisense RNA cassette test system for silencing of target genes. Nucleic Acids Res. Aug. 15, 1997 3218-27 25.
Smith, D. S., P. A. Humphrey and W. J. Catalona. The early detection of prostate carcinoma with prostate specific antigen: the Washington University experience Cancer Nov. 1, 1997 1852-1856 80.
Dsouza, M., N. Larsen and R. Overbeek. Searching for patterns in genomic data Trends Genet Dec. 1997 497-498 13.

Moss, E. G., R. C. Lee and V. Ambros. The cold shock domain protein LIN-28 controls developmental timing in C. elegans and is regulated by the lin-4 RNA Cell 1997 637 88.
Fire, A., S. Xu, M. K. Montgomery, S. A. Kostas, S. E. Driver and C. C. Mello. Potent and specific genetic interference by double-stranded RNA in Caenorhabditis elegans Nature Feb. 19, 1998 806-811 391.
Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.
Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.
Verma, S. and F. Eckstein. Modified oligonucleotides: synthesis and strategy for users Annu Rev Biochem 1998 99-134 67.
Wuchty, S., W. Fontana, I. Hofacker and P. Schuster. Complete suboptimal folding of RNA and the stability of secondary structures Biopolymers Feb. 1999 145-165 49.
Mathews, D. H., J. Sabina, M. Zuker and D. H. Turner. Expanded sequence dependence of thermodynamic parameters improves prediction of RNA secondary structure J Mol Biol May 21, 1999 911-940 288.
Chang, P. L. Encapsulation for somatic gene therapy Ann N Y Acad Sci Jun. 18, 1999 146-158 875.
Zhang, M. Q. Large-scale gene expression data analysis: a new challenge to computational biologists Genome Res Aug. 1999 681-688 9.
Grisaru, D., M. Sternfeld, A. Eldor, D. Glick and H. Soreq. Structural roles of acetylcholinesterase variants in biology and pathology Eur J Biochem Sep. 1999 672-686 264.
Fire, A. RNA-triggered gene silencing Trends Genet Sep. 1999 358-363 15.
Tabara, H., M. Sarkissian, W. G. Kelly, J. Fleenor, A. Grishok, L. Timmons, A. Fire and C. C. Mello. The rde-1 gene, RNA interference, and transposon silencing in C. elegans Cell Oct. 15, 1999 123-132 99.
Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.
Olsen, P. H. and V. Ambros. The lin-4 regulatory RNA controls developmental timing in Caenorhabditis elegans by blocking LIN-14 protein synthesis after the initiation of translation Dev Biol Dec. 15, 1999 671-680 216.
Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

(Continued)

*Primary Examiner*—Tracy Vivlemore
(74) *Attorney, Agent, or Firm*—Polsinelli Shalton Flanigan Suelthaus PC; Teddy C. Scott, Jr.

(57) ABSTRACT

The present invention relates to a group of novel viral RNA regulatory genes, here identified as "viral genomic address messenger genes" or "VGAM genes", and as "genomic record" or "GR" genes. VGAM genes selectively inhibit translation of known host target genes, and are believed to represent a novel pervasive viral attack mechanism. GR genes encode an operon-like cluster of VGAM genes. VGAM and viral GR genes may therefore be useful in diagnosing, preventing and treating viral disease. Several nucleic acid molecules are provided respectively encoding several VGAM genes, as are vectors and probes, both comprising the nucleic acid molecules, and methods and systems for detecting VGAM genes, and for counteracting their activity.

6 Claims, 20 Drawing Sheets

OTHER PUBLICATIONS

Reinhart, B. J., F. J. Slack, M. Basson, A. E. Pasquinelli, J. C. Bettinger, A. E. Rougvie, H. R. Horvitz and G. Ruvukun. The 21-nucleotide let-7 RNA regulates developmental timing in Caenorhabditis elegans Nature Feb. 24, 2000 901-906 403.

Pitt, J. N., J. A. Schisa and J. R. Priess. P granules in the germ cells of Caenorhabditis elegans adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in Drosophila cells Nature Mar. 16, 2000 293-296 404.

Slack, F. J., M. Basson, Z. Liu, V. Ambros, H. R. Horvitz and G. Ruvkun. The lin-41 RBCC gene acts in the C. elegans heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in Drosophila Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. Arabidopsis SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995 1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale C. briggsae-C. elegans genomic alignment Genome Res Aug. 2000 1115-1125 10.

Kennerdell, J. R. and R. W. Carthew. Heritable gene silencing in Drosophila using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in *Nicotiana benthamiana* Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson, Evidence that processed small dsRNAs may mediate sequence-specific mRNA degradation during RNAi in Drosophila embryos Curr Biol Oct. 5, 2000 1191 1200 10.

Anandalakshmi, R., R. Marathe, X. Ge, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1, are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22- nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in *Nicotiana benthamiana* using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Puss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of C. elegans adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Landeckel, A., Yalcin, K. Weber and T. Tuschil. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in Drosophila using a GAL4-driven hairpin RNA incorporationg a heterologous spacer Nucleic Acids Res Jun. 15, 2001 E55-55 29.

Vance, V. and H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control C. elegans developmental timing Cell Jul. 13, 2001 23-24 106.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P.

Robinson, A. P. Gleave, A. G. Green and P. M. Waterhouse. Construct design for efficient, effective and high-throughput gene silencing in plants Plant J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: it's a small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in C. elegans Genes Dev Oct. 15, 2001 2654-2659 15.

Ruvkun, G. Molecular biology. Glimpses of a tiny RNA world Science Oct. 26, 2001 797-799 294.

Lee, R. C. and V. Ambros. An extensive class of small RNAs in Caenorhabditis elegans Science Oct. 26, 2001 862-864 294.

Lau, N. C., L. P. Lim, E. G. Weinstein and D. P. Bartel. An abundant class of tiny RNAs with probable regulatory roles in Caenorhabditis elegans Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tucshl. Functional anatomy of siRNAs for mediating efficient RNAi in *Drosophila melanogaster* embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubuneko, K. M. Routzhan, D. S. Waugh, D. L. Court and X. Ji. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Ben-Arie and H. Soreq. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in *Drosophila melanogaster* Genetics Feb. 2002 637-648 160.

Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K., L. Tang and E. G. Moss. Two genetic circuits repress the Caenorhabditis elegans heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the silencing pathway in Neurospora Genes Dev Apr. 1, 2002 790-795 16.

Boutla, A., K. Kalantidis, N. Tavernarakis, M. Tsagris and M. Tabler. Induction of RNA interference in Caenorhabditis elegans by RNAs derived from plants exhibiting post-transcriptional gene silencing Nucleic Acids Res Apr. 1, 2002 1688-1694 30.

Pasquinelli, A. E. and G. Ruvkun. Control of developmental timing by micrornas and their targets Annu Rev Cell Dev Biol Epub 2002 Apr. 2, 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes Cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. BLAT—the BLAST-like alignment tool Genome Res Apr. 2002 656-664 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U. Landegren. Making ends meet in genetic analysis padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwarz, D. S. and P. D. Zamore. Why do miRNAs live in the miRNP? Genes Dev May 1, 2002 1025-1031 16.

Brantl, S. Antisense-RNA regulation and RNA interference Biochim Biophys Acta May 3, 2002 15-25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.

Lee, N. S., T. Dohjima, G. Bauer, H. Li, M. J. Li, A. Ehsani, P. Salvaterra and J Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21-to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 mice with a dominant Th2 biased immune profile via immunostimulatory [correction of imunostimulatory] oligonucleotides—relevance to AIDS vaccines in developing countries Vaccine Jun. 21, 2002 2684-2691 20.

Tabara, H., E. Yigit, H. Siomi and C. C. Mello. The dsRNA binding protein RDE-4 interacts with RDE-1, DCR-1, and a DExH-box helicase to direct RNAi in C. elegans Cell Jun. 28, 2002 861-871 109.

Bettencourt, R., O. Terenius and I. Faye. Hemolin gene silencing by ds-RNA injected into *Cecropia pupae* is lethal to next generation embryos Insect Mol Biol Jun 2002 267-272 11.

Hooper, N. M. and A. J. Turner. The search for alpha-secretase and its potential as a therapeutic approach to Alzheimer s disease Curr Med Chem Jun. 2002 1107-1119 9.

Liu, Q., S. Singh and A. Green. High-oleic and high-stearic cottonseed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins Rna Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates *Drosophila* growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the Arabidopsis FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002 2591-2598 148.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J. Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.

Park, W., J Li, R. Song, J. Messing and X. Chen. Carpel Factory, a Dicer homolog, and HEN1, a novel protein, act in microRNA metabolism in *Arabidopsis thaliana* Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of Arabidopsis miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A Drosophila fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short Integuments1/Suspensor1/Carpel Factory, a Dicer homolog, is a maternal effect gene required for embryo development in Arabidopsis Plant Physiol Oct. 2002 808-822 130.

Merkle, I., M. J. Van Ooij, F. J. Van Kuppeveld, D. H. Glaudmans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and down-regulation of micro- RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446 277.

Jones, L. Revealing micro-RNAs in plants Trends Plant Sci Nov. 2002 473-475 7.

Schauer, S. E., S. E. Jacobsen, D. W. Meinke and A. Ray. Dicer-like1 : blind men and elephants in Arabidopsis development Trends Plant Sci Nov. 2002 487-491 7.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairmans Mol Psychiatry No date in pubmed 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell No date in pubmed 2002 S289-301 14 Suppl.

* cited by examiner

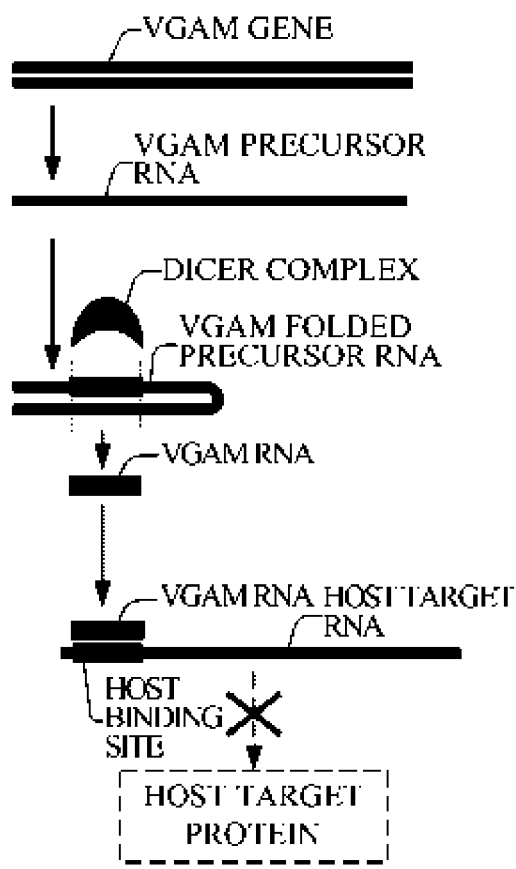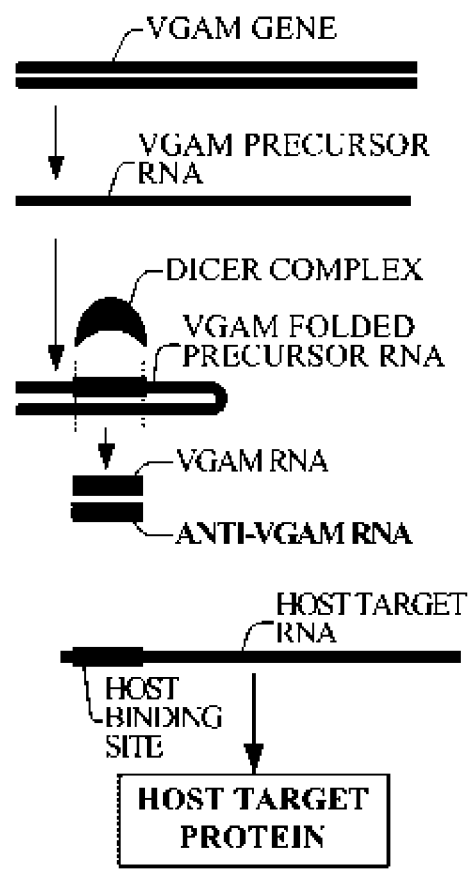
FIG. 11A
FIG. 11B

EST72223 sequence:

FIG. 12A

CCCTTATTAGAGGATTCTGCTCATGCCAGG**GTGAGGTAGTAAGTTGT
ATTGTTGTGGGGTAGGGATATTAGGCCCCAATTAGAAGATAACTAT
ACAACTTACTACTTTCCC**TGGTGTGTGGCATATTCACACTTAGTCTTA
GCAGTGTTGCCTCCATCAGACAAAGTTGTAGATGTTCCTTGGATAATT
TGGACTGGAAGAAAAGAGACATGGAAGGGGACAGATGGTGTTTAGG
GTGAGGCAGATGTCATTATAAAGTGACTTGTCTTTCATTAATTGGAGC
ATATAATTATTTTACCTTTGGGCATGAACTCATTTTGCTATTCTTCAAC
TGTGTAATGATTGCATTTTATTAGTAATAGAACAGGAATGTGTGCAAG
GGAATGGAAAGCATACTTTAAGAATTTTGGGCCAGGCGCGGTGGTTC
ATGCCTGTAATCCCAGCATTTTTGGGAGGCCGAGGCGGGTGGATCA
CCTGAGGTCAGGAGTTCGAGACCAACCTGGCCAACACGGCGGAAACC
CCGCCTCTACTCAAATACAAAAATTAGCCAGGCTTGGTGACACTCGC
CTGTGGTCCCAGCTACTCAGGAGGCT**GAGGCAGGAGAATTGCTTGA
ACCCAGGAAGTGGAGGCTTCAGTGAGCTGAGAACACGCCACTGCA**
CTCCAGTCCTGGGCAACAGAGCAAGACTCTGTCTCAGGAAAAAAAA
AG

MIR98

GAM24

FIG. 12B

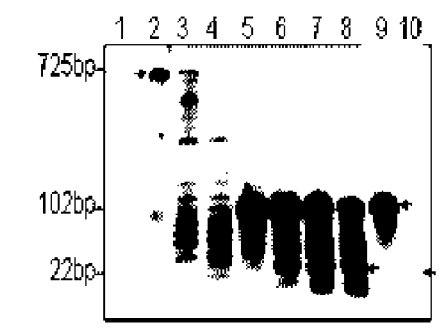

MIR98

FIG. 12C

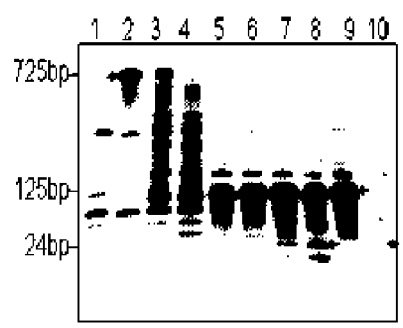

GAM24

FIG. 12D

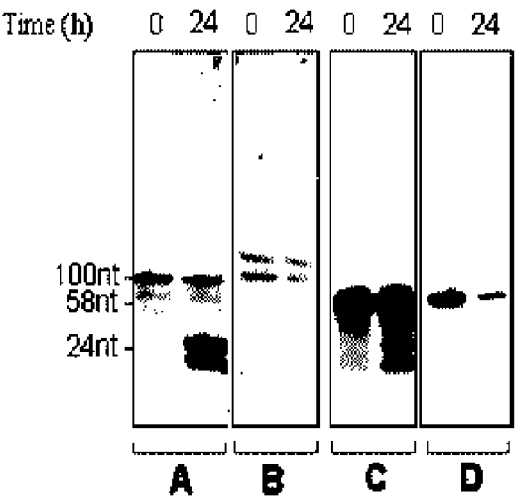

dbEST Id.7929020(Image4514344) sequence:
GCAAAACTGGAAGCATTCCCTTTGAAAACTGGCACAAGACAGGGATGCCCTCT
CTCACCGCTCCTATTCAACATAGTGTTGGAAGTTCTGGCCAGGGCAATTAGGCA
GGAGAAGGAAATAAAGGGTATTCAATTAGGAAAAGAGCAAGTCAAATTGTTCCT
GTTTGCAGATGACATGATTGTATATCTAGAAAACCCCATTGTCTCAGCCCCAAA
TCTCCTTAAGCTGATAAGCAACTTCAGCAAAGTCTCAGGATACAAAATAAATGT
ACAAAAATCACAAGCATTCTTACACACCAACAACAGAAAAACAGAGCCAAATCA
TGAGTGAACTCCCATTCACAATTGCTTCAAAGAGAATAAAATACCTAGGAATCC
AACTTACAAGGATGTGAAGCACCTCTTCAAGGAGAACTACAAACCACTGCTCA
AGGAAATAAAAGAGGATACAAACAAATGGAAGAACATTCCATGCTCATGGGTAG
GAAGAATCAATATTGTGAAAATGGCCATACTGCCCAAGGTAATTTACAGATTCA
ATGCCATCCCATCAAGCTACCAATGACTTTCTTCACACAATTCGAAAAAACTA
CTTTAAAGTTCATATGGAACCAAAAAAGAGCCCGCATCGCCAAGTCAATCCTAA
GCCAAAAGAACAAAGCTGGAGGCATCACACTACCTGACTTCAAACTTTACTACA GAM23
AGGCTACAGTAACCAAAACACCATGGTACTGGTACCAAAACACAGATATACATC
AATGGAACAGAACAGAGCCCTCAGAAATAACGCCGAATACCTACAACTATCTGA
TCTTTGACAAACCTGAGAAAACAAGCAATGGGGAAGGATTCCCTATTTAATA
AATGGTGCTGGGAAAACTGACTAGCCATATGTAGAAAGCTGAAACTGGATCCCT
TCCTTACACCTTATACAAAAATCAATTCAAGATGGATTAAAGATTTAAACGTTA
GACCTAAAACCATAAAACCCTAGAAGAAAACCTAGGCATTACCATTCAGGACA
TAGGCATGGGCAAGGACTTCATGTCCAAAACACCAAAAGCAATGGCAACAAAAG
ACAAAATTGACAAATGGGATCTAATTAAACTAAAGAGCTTCTGCACAGCAAAG
AAACTACCATCAGAGTGAACAGGCAACCTACAAAATGGGAGAAAATTTTCGCAA
CCTACTCATCTGACAAAGGGCTAATATCCAGAATCTACAATCAACTCAAACAAA GAM25
TTTACAAAAAAAAAAAAAAAA

FIG. 13B

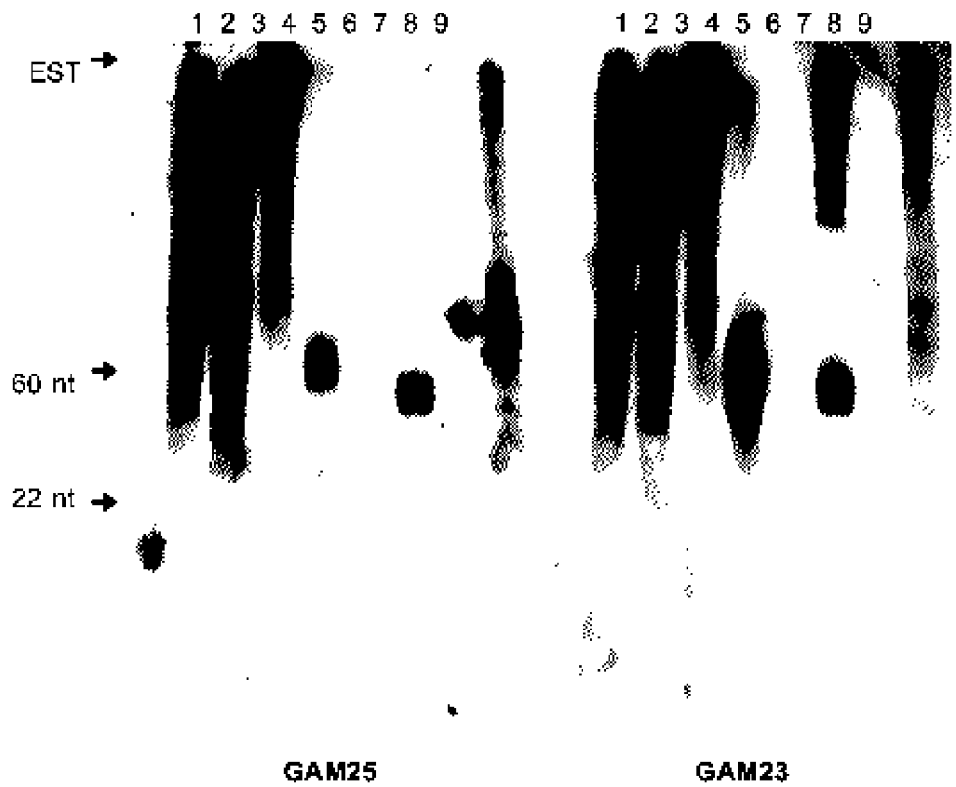

GAM25　　　　　　　　　　GAM23

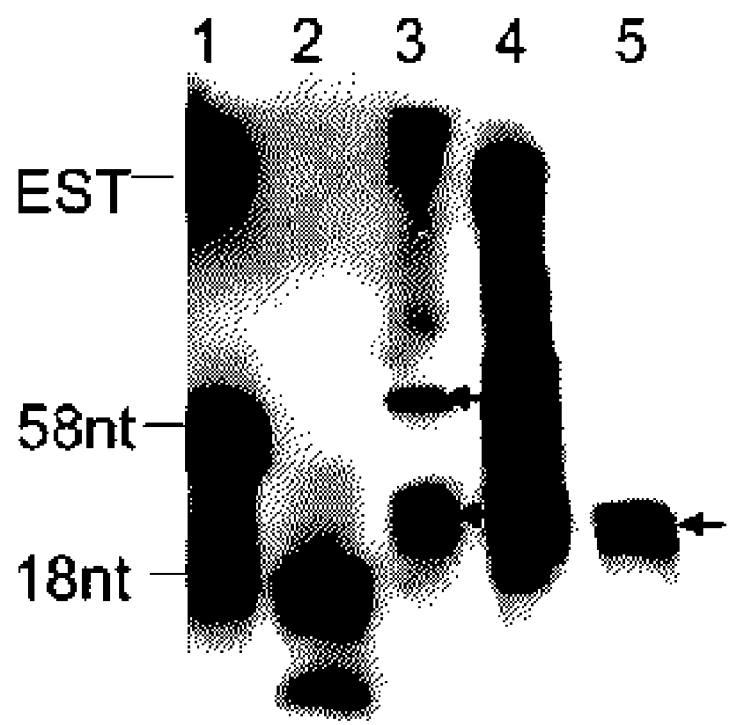

FIG. 14A dbEST Id.1388749 (Image1020185) Sequence:
ACTCCTATCAACAGTGTAAAAGCATTCCTGTTTCTCCATAATCTTGCCAGCATCTT
TTCATTTTTTTGAATTATAGCCATTCTGACTGTTCTGAGATGGTGTCTCATTGTCG
TTTTGATTTGCATTTCTCAGATGATCAGTGATGTTGAAGTTTTTTTGTTTGTTGGC
TGCATGTATGCCTTCTTTTGAAAAGTGTCTGTTTGTGTCCTTTGACCACTTTCTAA
TGGGGTTGAGTTTTTTTTTCTTGTAAATTTGTTTAAGTTCCTTGTAGATGCTGGAT
ATTAGACCTTTGTCAGATGGATAGAGTGCAAAAATTTTCTCCCATTCTGTAGGTTG
TCGGTTTACTCTGTTGATAGGTTCTTAATGCTGTGCAGAAGCTCTTTAGTTTAATT
AGATCCCATTTGTCAATTTTGGCTTTTGTTGCAATTGCTTTTGGCATCTTCGTCAT
GAAATCTTTGCCCTTGCCTGTGTCCTGAATGGCATTGCCTAGGTTTTCTTCCAGGA
TTTTTATAGTTTTGGGTTGTAGATTTAAGTCTTTAATCCATCTTGAGTTAACTTTT
GTATATCGGTTAAGGAAGGGGCCCGTTTCAATTTGCTGCAAATCGCTAGCCAGTTC
TCCAGCACCATTTATTAAATAGGGAATCTTTTCCCCATTGCTTCCTTTGTCAGG
TTTGTCAAAGATCACATGGTTGTAGGTGTGTGGTCTTATTTCTGGGTTCTCTATTC
TGTTCCATTGGGCTATGGGCCGGTTCTGTACCACCACTATGCTGTTTTGGGTACCA
TAGTCTTGTAGAATGTTTGAAGCTGGGTAGCATGATGCCTCTAGCTTTGCTCTTCT
TGCTAAGAAATGTCTTGGCTATTTGGGCTCTTTTTTGGTTCCATATGAATTTTAAA
ATAGCTTTTTCTAGGTCTGTAAAGAATGTGAATAGTAGTTTAATGGGCCTAGCATT
TAATTTACAGATTGCCTTGGGCAGTGTGGTCATTTTCACGATATTGATCCTTCCTG
TCTGTGAGCATATGTTTTTCCATTTGTTTGTGTCATCTCTGATTTCTTTGAATAAT  GAM
GGTTTATAGTTATCCTTGAAAAGGTCCTTCACTTTTCTTGTTAGCTGTATTCCTAG  26
ATATTATACTCTTCTTGTGGCAATTGTGAATGGGAGTTAATTCATGAGTTTTCTCT
CGGCTTGCCTGTTGTTGGTGTATAGGAATGCTAGTGACTTTGCACATTGATTTTG
TATCCTGAGACTTTCTTGAAGTTGCTTATCAGCTAAGAAGTTTTTGAGCTGAGATG
ATGGAGTTTTCTAGATATAGGATCATATCATCTGCAAACAAAGATAGTTTGACTTC
CTGTCTTCCTATTTGAATAGCTTTTCTTTCTTTCTTGCCTGATTGCCTTGGTGA
GAATTTCTAATACTGTGTTGAATAGGAGTGGTGAGCTCGTGCCAA

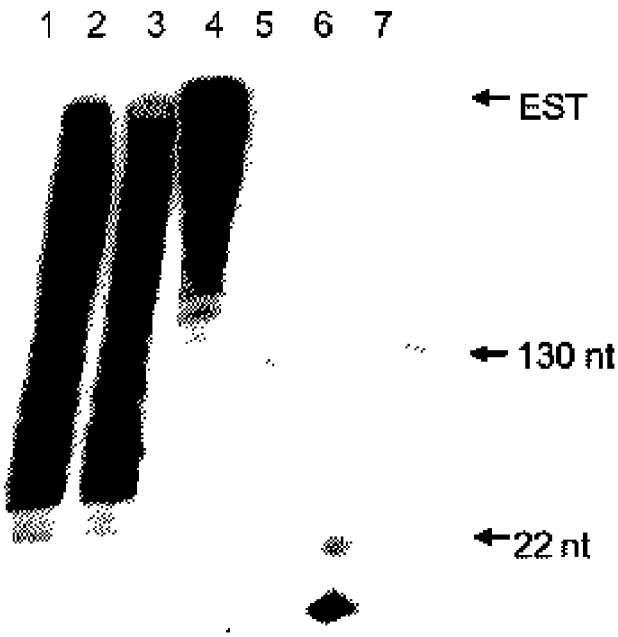

FIG. 14B

GAM26

GTGTGACGTGAGTCTGATCCAACACTGAACGCTTTCGTC    SEQ ID: 37404
GTGTTTTCATGCAGCTTTTACAGACCA<u>TGACAAGCCTGA
CGAGAGCGTTC</u>ATCGGGGCATGAAGTACGCATTACAC

TGACAAGCCTGACGAGAGCGTTCA    SEQ ID: 37405

```
          --   AG - A  AACAC                       T    T   CAG TT
GTGTGA  CGTG  TC TG TCC      TGAACGCTTTCGTCG  GTTT TCATG  CT  T
||||||  ||||  || || |||      |||||||||||||||  ||||  |||||  ||
CACATT  GCAT  AG AC GGG      ACTTGCGAGAGCAGT  CGAA AGTAC  GA  /
  AC    GA   T  -  GCT--                       C    C   CA- CA
```

Fig. 15D/1

```
                       CAA         CGA
               5' TGA     GCCTGA     GAGCGTTCA  3'          SEQ ID:37405
C7                ||| ||||||     |||||||||
BINDING SITE   3' ACT     CGGACT     CTCGTAAGT  5'          SEQ ID:37406
                       ATC         TAC

A          ACGA  G
               5' TG CAAGCCTG    GA CGTTCA  3'              SEQ ID:37405
DUSP5             || |||||||||   || ||||||
BINDING SITE   3' AC GTTCGGAC    CT GTGAGT  5'              SEQ ID:37407
                  -          CA--  G

A          AC
               5' TG CAAGCCTG   GAGAG  3'                   SEQ ID:37405
ATP6V1F           || |||||||||  |||||
BINDING SITE   3' AC GTTCGGAC   CTCTC  5'                   SEQ ID:37408
                  C          CC

CAA          AGAGCG
               5' TGA    GCCTGACG       TTCA  3'            SEQ ID:37405
DKFZP564C103      |||    ||||||||       ||||
BINDING SITE   3' ACT    CGGACTGC       AAGT  5'            SEQ ID:37409
                    AC-          GAGAG-

CA   C         C
               5' GA  AGC TGACGAGAG GT  3'                  SEQ ID:37405
KIAA0561          ||  ||| ||||||||| ||
BINDING SITE   3' CT  TCG ACTGCTCTC CA  5'                  SEQ ID:37410
                   AC   A         C

A         A G  A
               5' TG CAAGCCTG C AG GC  3'                   SEQ ID:37405
KIAA0935          || ||||||||| |  || ||
BINDING SITE   3' AC GTTCGGAC G TC CG  5'                   SEQ ID:37411
                  C         C -  C

AGC
               5' GACAAGCCTGACGAG    GTTCA  3'              SEQ ID:37405
MIC2L1            ||||||||||||||||   |||||
BINDING SITE   3' CTGTTCGGACTGTTT    CAAGT  5'              SEQ ID:37412
                                ---

C   C-
               5' TGACAAG CTGA    GAGAGCG  3'               SEQ ID:37405
PPP4R1L           ||||||| ||||    |||||||
BINDING SITE   3' ACTGTTC GACT    TTCTCGC  5'               SEQ ID:37413
                         A   AC

TGACG    GC-
               5' TGACAAGCC    AGA    GTTC  3'              SEQ ID:37405
ZAK               |||||||||    |||    ||||
BINDING SITE   3' ACTGTTCGG    TCT    CAAG  5'              SEQ ID:37414
                       -----    AGT
```

Fig. 15D/2

```
                              CC    ACGA
                   5' TGACAAG   TG      GAGCGTT 3'          SEQ ID:37405
LOC149566             |||||||   ||      |||||||
BINDING SITE       3' ACTGTTC   AC      CTTGCAA 5'          SEQ ID:37415
                              A-    CCA-

A        AC  G   CG
                   5' TG  CAAGCCTG  GA  AG   TTC 3'         SEQ ID:37405
LOC150368             ||  ||||||||  ||  ||   |||
BINDING SITE       3' AC  GTTCGGAC  CT  TC   GAG 5'         SEQ ID:37416
                         C        A-  G   A-

A      CGAGA  C
                   5' TGACA  GCCTGA      G  GTTC 3'         SEQ ID:37405
LOC255718             |||||  ||||||      |  ||||
BINDING SITE       3' ACTGT  CGGACT      C  CAGG 5'         SEQ ID:37417
                         C           -----  C
```

US 7,696,334 B1

BIOINFORMATICALLY DETECTABLE HUMAN HERPESVIRUS 5 REGULATORY GENE

BACKGROUND OF INVENTION

1. Field of the Invention

The present invention relates to a group of bioinformatically detectable novel viral RNA regulatory genes, here identified as "viral genomic address messenger" or "VGAM-"genes.

2. Description of Prior Art

Small RNAs are known to perform diverse cellular functions, including post-transcriptional gene expression regulation. The first two such RNA genes, Lin-4 and Let-7, were identified by genetic analysis of Caenorhabditis Elegans (Elegans) developmental timing, and were termed short temporal RNA (stRNA) (Wightman, B., Ha, I., Ruvkun, G., Cell 75, 855 (1993); Erdmann, V.A. et al., Nucleic Acids Res. 29, 189 (2001); Lee, R. C., Feinbaum, R. L., Ambros, V., Cell 75, 843 (1993); Reinhart, B. et al., Nature 403, 901 (2000)).

Lin-4 and Let-7 each transcribe a ~22 nucleotide (nt) RNA, which acts a post transcriptional repressor of target mRNAs, by binding to elements in the 3"-untranslated region (UTR) of these target mRNAs, which are complementary to the 22 nt sequence of Lin-4 and Let-7 respectively. While Lin-4 and Let-7 are expressed at different developmental stage, first larval stage and fourth larval stage respectively, both specify the temporal progression of cell fates, by triggering post-transcriptional control over other genes (Wightman, B., Ha, I., Ruvkun, G., Cell 75, 855 (1993); Slack et al., Mol. Cell 5 ,659 (2000)). Let-7 as well as its temporal regulation have been demonstrated to be conserved in all major groups of bilaterally symmetrical animals, from nematodes, through flies to humans (Pasquinelli, A., et al. Nature 408 ,86 (2000)).

The initial transcription product of Lin-4 and Let-7 is a ~60-80 nt RNA, the nucleotide sequence of the first half of which is partially complementary to that of its second half, therefore allowing this RNA to fold onto itself, forming a "hairpin structure". The final gene product is a ~22 nt RNA, which is "diced" from the above mentioned "hairpin structure", by an enzyme called Dicer, which also apparently also mediates the complementary binding of this ~22 nt segment to a binding site in the 3" UTR of its target gene.

Recent studies have uncovered 93 new genes in this class, now referred to as micro RNA or miRNA genes, in genomes of Elegans, Drosophilea, and Human (Lagos-Quintana, M., Rauhut, R., Lendeckel, W., Tuschl, T., Science 294,853 (2001); Lau, N. C., Lim, L. P., Weinstein, E. G., Bartel, D. P., Science 294, 858 (2001); Lee, R. C., Ambros, V., Science 294, 862 (2001). Like the well studied Lin-4 and Let-7, all newly found MIR genes produce a ~60-80 nt RNA having a nucleotide sequence capable of forming a "hairpin structure". Expressions of the precursor ~60-80 nt RNA and of the resulting diced ~22 nt RNA of most of these newly discovered MIR genes have been detected.

Based on the striking homology of the newly discovered MIR genes to their well-studied predecessors Lin-4 and Let-7, the new MIR genes are believed to have a similar basic function as that of Lin-4 and Let-7: modulation of target genes by complementary binding to the UTR of these target genes, with special emphasis on modulation of developmental control processes. This is despite the fact that the above mentioned recent studies did not find target genes to which the newly discovered MIR genes complementarily bind. While existing evidence suggests that the number of regulatory RNA genes "may turn out to be very large, numbering in the hundreds or even thousands in each genome", detecting such genes is challenging (Ruvkun G., "Perspective: Glimpses of a tiny RNA world", Science 294, 779 (2001)).

The ability to detect novel RNA genes is limited by the methodologies used to detect such genes. All RNA genes identified so far either present a visibly discernable whole body phenotype, as do Lin-4 and Let-7 (Wightman et. al., Cell 75, 855 (1993); Reinhart et al., Nature 403, 901 (2000)), or produce significant enough quantities of RNA so as to be detected by the standard biochemical genomic techniques, as do the 93 recently detected miRNA genes. Since a limited number clones were sequenced by the researchers discovering these genes, 300 by Bartel and 100 by Tuschl (Bartel et. al., Science 294, 858 (2001); Tuschl et. al., Science 294, 853 (2001)), the RNA genes found can not be much rarer than 1% of all RNA genes. The recently detected miRNA genes therefore represent the more prevalent among the miRNA gene family.

Current methodology has therefore been unable to detect RNA genes which either do not present a visually discernable whole body phenotype, or are rare (e.g. rarer than 0.1% of all RNA genes), and therefore do not produce significant enough quantities of RNA so as to be detected by standard biochemical technique. To date, miRNA have not been detected in viruses.

SUMMARY OF INVENTION

The present invention relates to a novel group of bioinformatically detectable, viral regulatory RNA genes, which repress expression of host target host genes, by means of complementary hybridization to binding sites in untranslated regions of these host target host genes. It is believed that this novel group of viral genes represent a pervasive viral mechanism of attacking hosts, and that therefore knowledge of this novel group of viral genes may be useful in preventing and treating viral diseases.

In various preferred embodiments, the present invention seeks to provide improved method and system for detection and prevention of viral disease, which is mediated by this group of novel viral genes.

Accordingly, the invention provides several substantially pure nucleic acids (e.g., genomic nucleic acid, cDNA or synthetic nucleic acid) each encoding a novel viral gene of the VGAM group of gene, vectors comprising the nucleic acids, probes comprising the nucleic acids, a method and system for selectively modulating translation of known "target" genes utilizing the vectors, and a method and system for detecting expression of known "target" genes utilizing the probe.

By "substantially pure nucleic acid" is meant nucleic acid that is free of the genes which, in the naturally-occurring genome of the organism from which the nucleic acid of the invention is derived, flank the genes discovered and isolated by the present invention. The term therefore includes, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other sequences. It also includes a recombinant nucleic acid which is part of a hybrid gene encoding additional polypeptide sequence.

"Inhibiting translation" is defined as the ability to prevent synthesis of a specific protein encoded by a respective gene, by means of inhibiting the translation of the mRNA of this gene. "Translation inhibiter site" is defined as the minimal nucleic acid sequence sufficient to inhibit translation.

There is thus provided in accordance with a preferred embodiment of the present invention a bioinformatically detectable novel viral gene encoding substantially pure nucleic acid wherein: RNA encoded by the bioinformatically detectable novel viral gene is about 18 to about 24 nucleotides in length, and originates from an RNA precursor, which RNA precursor is about 50 to about 120 nucleotides in length, a nucleotide sequence of a first half of the RNA precursor is a partial inversed-reversed sequence of a nucleotide sequence of a second half thereof, a nucleotide sequence of the RNA encoded by the novel viral gene is a partial inversed-reversed sequence of a nucleotide sequence of a binding site associated with at least one host target gene, and a function of the novel viral gene is bioinformatically deducible.

There is further provided in accordance with another preferred embodiment of the present invention a method for anti-viral treatment comprising neutralizing said RNA.

Further in accordance with a preferred embodiment of the present invention the neutralizing comprises: synthesizing a complementary nucleic acid molecule, a nucleic sequence of which complementary nucleic acid molecule is a partial inversed-reversed sequence of said RNA, and transfecting host cells with the complementary nucleic acid molecule, thereby complementarily binding said RNA.

Further in accordance with a preferred embodiment of the present invention the neutralizing comprises immunologically neutralizing.

There is still further provided in accordance with another preferred embodiment of the present invention a bioinformatically detectable novel viral gene encoding substantially pure nucleic acid wherein: RNA encoded by the bioinformatically detectable novel viral gene includes a plurality of RNA sections, each of the RNA sections being about 50 to about 120 nucleotides in length, and including an RNA segment, which RNA segment is about 18 to about 24 nucleotides in length, a nucleotide sequence of a first half of each of the RNA sections encoded by the novel viral gene is a partial inversed-reversed sequence of nucleotide sequence of a second half thereof, a nucleotide sequence of each of the RNA segments encoded by the novel viral gene is a partial inversed-reversed sequence of the nucleotide sequence of a binding site associated with at least one target host gene, and a function of the novel viral gene is bioinformatically deducible from the following data elements: the nucleotide sequence of the RNA encoded by the novel viral gene, a nucleotide sequence of the at least one target host gene, and function of the at least one target host gene.

Further in accordance with a preferred embodiment of the present invention the function of the novel viral gene is bioinformatically deducible from the following data elements: the nucleotide sequence of the RNA encoded by the bioinformatically detectable novel viral gene, a nucleotide sequence of the at least one target host gene, and a function of the at least one target host gene.

Still further in accordance with a preferred embodiment of the present invention the RNA encoded by the novel viral gene complementarily binds the binding site associated with the at least one target host gene, thereby modulating expression of the at least one target host gene.

Additionally in accordance with a preferred embodiment of the present invention the binding site associated with at least one target host gene is located in an untranslated region of RNA encoded by the at least one target host gene.

Moreover in accordance with a preferred embodiment of the present invention the function of the novel viral gene is selective inhibition of translation of the at least one target host gene, which selective inhibition includes complementary hybridization of the RNA encoded by the novel viral gene to the binding site.

Further in accordance with a preferred embodiment of the present invention the invention includes a vector including the DNA.

Still further in accordance with a preferred embodiment of the present invention the invention includes a method of selectively inhibiting translation of at least one gene, including introducing the vector.

Moreover in accordance with a preferred embodiment of the present invention the introducing includes utilizing RNAi pathway.

Additionally in accordance with a preferred embodiment of the present invention the invention includes a gene expression inhibition system including: the vector, and a vector inserter, functional to insert the vector into a cell, thereby selectively inhibiting translation of at least one gene.

Further in accordance with a preferred embodiment of the present invention the invention includes a probe including the DNA.

Still further in accordance with a preferred embodiment of the present invention the invention includes a method of selectively detecting expression of at least one gene, including using the probe.

Additionally in accordance with a preferred embodiment of the present invention the invention includes a gene expression detection system including: the probe, and a gene expression detector functional to selectively detect expression of at least one gene.

Further in accordance with a preferred embodiment of the present invention the invention includes an anti-viral substance capable of neutralizing the RNA.

Still further in accordance with a preferred embodiment of the present invention the neutralizing includes complementarily binding the RNA.

Additionally in accordance with a preferred embodiment of the present invention the neutralizing includes immunologically neutralizing.

Moreover in accordance with a preferred embodiment of the present invention the invention includes a method for anti-viral treatment including neutralizing the RNA.

Further in accordance with a preferred embodiment of the present invention the neutralizing includes: synthesizing a complementary nucleic acid molecule, a nucleic sequence of which complementary nucleic acid molecule is a partial inversed-reversed sequence of the RNA, and transfecting host cells with the complementary nucleic acid molecule, thereby complementarily binding the RNA.

Still further in accordance with a preferred embodiment of the present invention the neutralizing includes immunologically neutralizing.

BRIEF DESCRIPTION OF DRAWINGS

FIGS. 11A and 11B are simplified diagrams, which when taken together illustrate a mode of gene therapy applicable to genes of the novel group of genes of the present invention;

FIG. 12A is an annotated sequence of EST72223 comprising novel gene GAM24 detected by the gene detection system of the present invention;

FIGS. 12B and 12C are pictures of laboratory results, which when taken together demonstrate laboratory confirmation of expression of the bioinformatically detected novel gene GAM24 of FIG. 12A;

FIG. 12D provides pictures of laboratory results, which when taken together demonstrate further laboratory confirmation of expression of the bioinformatically detected novel gene GAM24 of FIG. 12A;

FIG. 13A is an annotated sequence of an EST7929020 comprising novel genes GAM23 and GAM25 detected by the gene detection system of the present invention;

FIG. 13B is a picture of laboratory results, which confirm expression of bioinformatically detected novel genes GAM23 and GAM25 of FIG. 13A;

FIG. 13C is a picture of laboratory results, which confirm endogenous expression of bioinformatically detected novel gene GAM25 of FIG. 13A;

FIG. 14A is an annotated sequence of an EST1388749 comprising novel gene GAM26 detected by the gene detection system of the present invention;

FIG. 14B is a picture of laboratory results, which confirm expression of the bioinformatically detected novel gene GAM26 of FIG. 14A;

BRIEF DESCRIPTION OF SEQUENCES

A Sequence Listing of nucleotide sequences of the present invention designated SEQ ID:1 through SEQ ID:86841 is attached to this application, enclosed in computer readable form on CD-ROM, and include nucleotide sequences of 3815 novel genes of the present invention and their respective gene-precursors, and of 79292 target binding sites of these novel genes.

DETAILED DESCRIPTION

Figure 1:
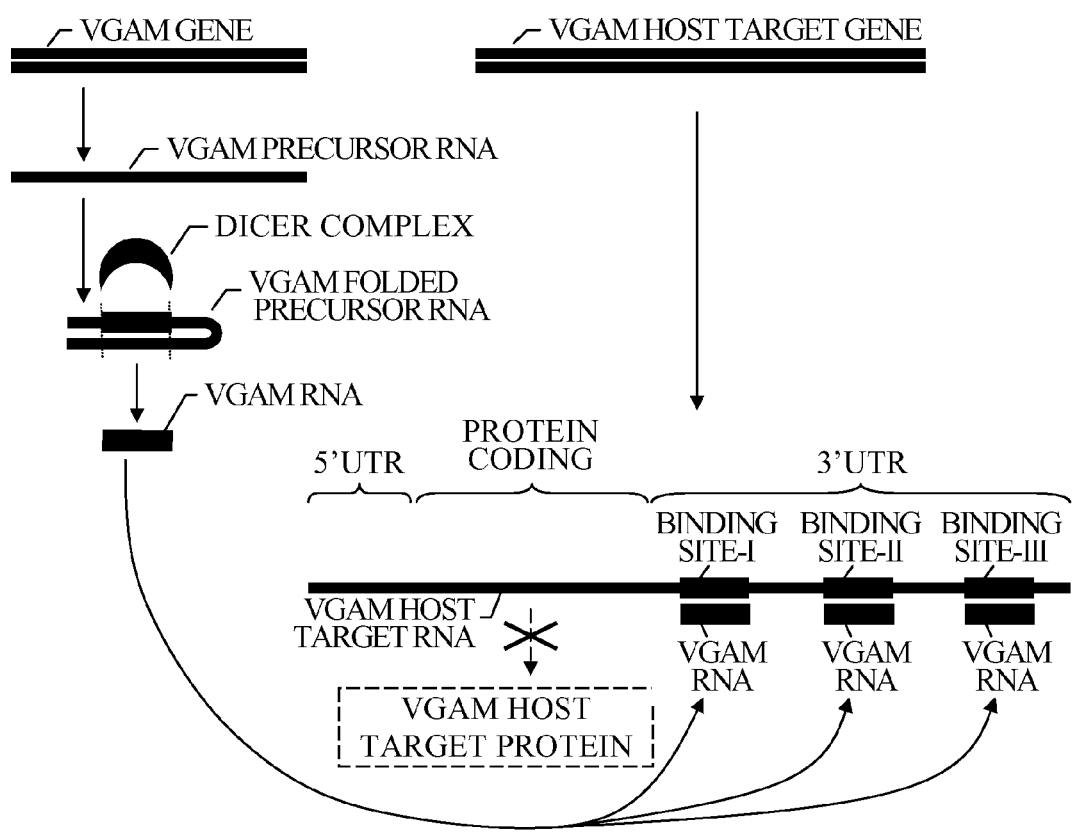
FIG. 1 is a simplified diagram illustrating a mode by which viral genes of a novel group of viral genes of the present invention, modulate expression of known host target genes.

Reference is now made to FIG. 1 which is a simplified diagram illustrating a mode by which genes of a novel group of genes of the present invention, modulate expression of known host target.

The novel genes of the present invention are micro RNA (miRNA)-like, regulatory RNA genes, modulating expression of known host target. This mode of modulation is common to other known miRNA genes, as described hereinabove with reference to the background of the invention section.

VGAM GENE and TARGET GENE are two human genes contained in the DNA of the human genome.

VGAM GENE encodes a VGAM PRECURSOR RNA. However, similar to other miRNA genes, and unlike most ordinary genes, its RNA, VGAM PRECURSOR RNA, does not encode a protein.

Figure 8:
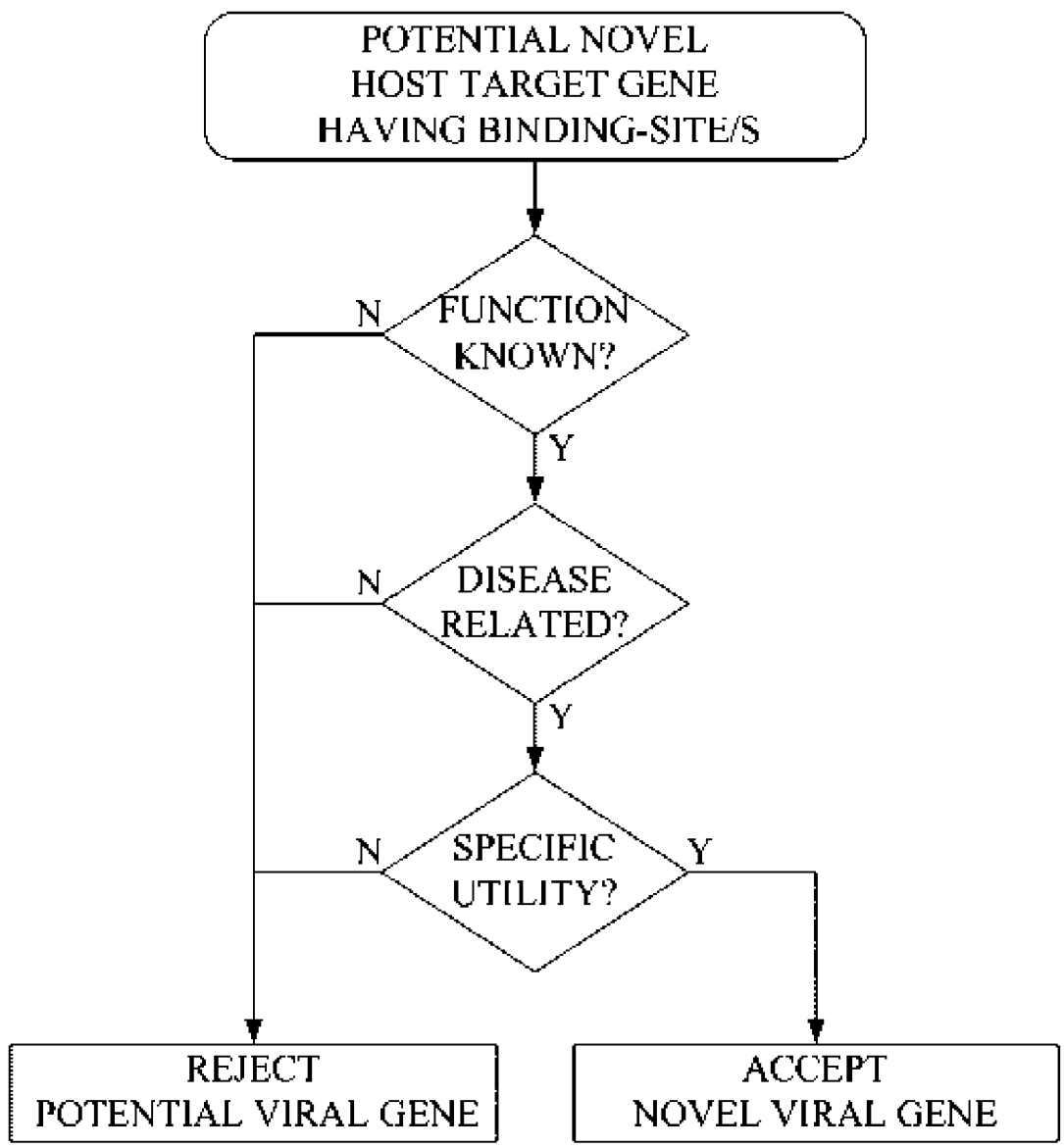
FIG. 8 is a simplified flowchart illustrating operation of a function & utility analyzer constructed and operative in accordance with a preferred embodiment of the present invention.

VGAM PRECURSOR RNA folds onto itself, forming VGAM FOLDED PRECURSOR RNA. As FIG. 8 illustrates, VGAM FOLDED PRECURSOR RNA forms a "hairpin structure", folding onto itself. As is well known in the art, this "hairpin structure", is typical genes of the miRNA genes, and is due to the fact that nucleotide sequence of the first half of the RNA of a gene in this group is an accurate or partial inversed-reversed sequence of the nucleotide sequence of its second half. By "inversed-reversed" is meant a sequence which is reversed and wherein each nucleotide is replaced by a complementary nucleotide, as is well known in the art (e.g. ATGGC is the inversed-reversed sequence of GCCAT).

An enzyme complex, designated DICER COMPLEX, "dices" the VGAM FOLDED PRECURSOR RNA into a single stranded RNA segment, about 22 nucleotides long, designated VGAM RNA. As is known in the art, "dicing" of the hairpin structured RNA precursor into shorter RNA segments about 22 nucleotides long by a Dicer type enzyme is catalyzed by an enzyme complex comprising an enzyme called Dicer together with other necessary proteins.

TARGET GENE encodes a corresponding messenger RNA, designated TARGET RNA. This TARGET RNA comprises 3 regions: a 5" untranslated region, a protein coding region and a 3" untranslated region, designated 5"UTR, PROTEIN CODING and 3"UTR respectively.

VGAM RNA binds complementarily a BINDING SITE, located on the 3"UTR segment of TARGET RNA. This complementarily binding is due to the fact that the nucleotide sequence of VGAM RNA is an accurate or partial inversed-reversed sequence of the nucleotide sequence of BINDING SITE.

The complementary binding of VGAM RNA to BINDING SITE inhibits translation of TARGET RNA into TARGET PROTEIN. TARGET PROTEIN is therefore outlined by a broken line.

It is appreciated by one skilled in the art that the mode of transcriptional inhibition illustrated by FIG. 1 with specific reference to VGAM genes of the present invention, is in fact common to all other miRNA genes. A specific complementary binding site has been demonstrated only for Lin-4 and Let-7. All the other 93 newly discovered miRNA genes are also believed by those skilled in the art to modulate expression of other genes by complementary binding, although specific complementary binding sites for these genes have not yet been found (Ruvkun G., "Perspective: Glimpses of a tiny RNA world", Science 294, 779 (2001)). The present invention discloses a novel group of genes, the VGAM genes, belonging to the miRNA genes group, and for which a specific an complementary binding has been determined.

Figure 2:
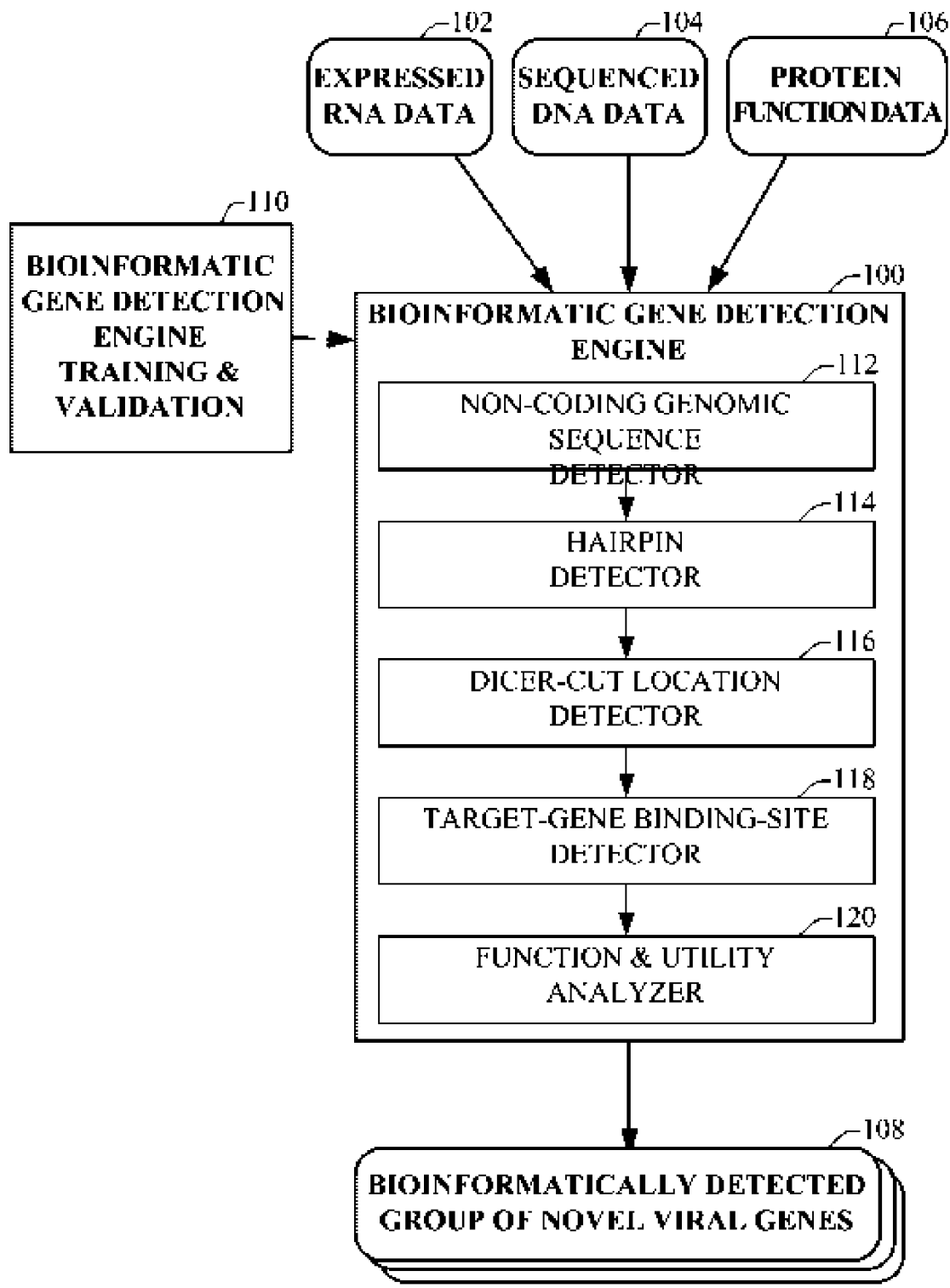
FIG. 2 is a simplified block diagram illustrating a bioinformatic gene detection system capable of detecting genes of the novel group of genes of the present invention, which system is constructed and operative in accordance with a preferred embodiment of the present invention.

Reference is now made to FIG. 2 which is a simplified block diagram illustrating a bioinformatic gene detection system capable of detecting genes of the novel group of genes of the present invention, which system is constructed and operative in accordance with a preferred embodiment of the present invention.

A centerpiece of the present invention is a bioinformatic gene detection engine 100, which is a preferred implementation of a mechanism capable of bioinformatically detecting genes of the novel group of genes of the present invention.

The function of the bioinformatic gene detection engine 100 is as follows: it receives three types of input, expressed RNA data 102, sequenced DNA data 104, and protein function data 106, performs a complex process of analysis of this data as elaborated below, and based on this analysis produces output of a bioinformatically detected group of novel genes designated 108.

Expressed RNA data 102 comprises published expressed sequence tags (EST) data, published mRNA data, as well as other sources of published RNA data. Sequenced DNA data 104 comprises alphanumeric data describing sequenced genomic data, which preferably includes annotation data such as location of known protein coding regions relative to the sequenced data. Protein function data 106 comprises scientific publications reporting studies which elucidated physiological function known proteins, and their connection, involvement and possible utility in treatment and diagnosis of various diseases. Expressed RNA data 102, sequenced DNA data 104 may preferably be obtained from data published by the National Center for Bioinformatics (NCBI) at the National Institute of Health (NIH), as well as from various other published data sources. Protein function data 106 may preferably be obtained from any one of numerous relevant published data sources, such as the Online Mendelian Inherited Disease In Man (OMIM) database developed by John Hopkins University, and also published by NCBI.

Prior to actual detection of bioinformatically detected novel genes 108 by the bioinformatic gene detection engine 100, a process of bioinformatic gene detection engine training & validation designated 110 takes place. This process uses the known miRNA genes as a training set (some 200 such genes have been found to date using biological laboratory means), to train the bioinformatic gene detection engine 100 to bioinformatically recognize miRNA-like genes, and their respective potential target binding sites. Bioinformatic gene detection engine training & validation 110 is further describe hereinbelow with reference to FIG. 3.

The bioinformatic gene detection engine 100 comprises several modules which are preferably activated sequentially, and are described as follows:

A non-coding genomic sequence detector 112 operative to bioinformatically detect non-protein coding genomic sequences. The non-coding genomic sequence detector 112 is further described hereinbelow with reference to FIGS. 4A and 4B.

A hairpin detector 114 operative to bioinformatically detect genomic "hairpin-shaped" sequences, similar to VGAM FOLDED PRECURSOR of FIG. 1. The hairpin detector 114 is further described hereinbelow with reference to FIGS. 5A and 5B.

A dicer-cut location detector 116 operative to bioinformatically detect the location on a hairpin shaped sequence which is enzymatically cut by DICER COMPLEX of FIG. 1. The dicer-cut location detector 116 is further described hereinbelow with reference to FIG. 6A.

A target-gene binding-site detector 118 operative to bioinformatically detect host target having binding sites, the nucleotide sequence of which is partially complementary to that of a given genomic sequence, such as a sequence cut by DICER COMPLEX of FIG. 1. The target-gene binding-site detector 118 is further described hereinbelow with reference to FIGS. 7A and 7B.

A function & utility analyzer 120 operative to analyze function and utility of host target, in order to identify host target which have a significant clinical function and utility. The function & utility analyzer 120 is further described hereinbelow with reference to FIG. 8.

Hardware implementation of the bioinformatic gene detection engine 100 is important, since significant computing power is preferably required in order to perform the computation of bioinformatic gene detection engine 100 in reasonable time and cost. As an example, it is estimated that using one powerful 8-processor PC Server, over 30 months of computing time (at 24 hours per day) would be required in order to detect all miRNA genes in human EST data, and their respective binding sites.

For example, in order to address this challenge at reasonable time and cost, a preferred embodiment of the present invention may comprise a cluster of a large number of personal computers (PCs), such as 100 PCs (Pentium IV, 1.7 GHz, with 40 GB storage each), connected by Ethernet to several strong servers, such as 4 servers (2-CPU, Xeon 2.2 GHz, with 200 GB storage each), combined with an 8-processor server (8-CPU, Xeon 550 Mhz w/ 8 GB RAM) connected via 2 HBA fiber-channels to an EMC Clariion 100-disks, 3.6 Terabyte storage device. Additionally, preferably an efficient database computer program, such as Microsoft (TM) SQL-Server database computer program is used and is optimized to the specific requirements of bioinformatic gene detection engine 100. Furthermore, the PCs are preferably optimized to operate close to 100% CPU usage continuously, as is known in the art. Using suitable hardware and software may preferably reduce the required calculation time in the abovementioned example from 30 months to 20 days.

It is appreciated that the abovementioned hardware configuration is not meant to be limiting, and is given as an illustration only. The present invention may be implemented in a wide variety of hardware and software configurations.

The present invention discloses 3815 novel viral genes of the VGAM group of genes, which have been detected bioinformatically, as described hereinbelow with reference to Tables 1 and 2 for VGMA1483. Laboratory confirmation of 4 genes of the GAM group of genes is described hereinbelow with reference to FIGS. 12 through 14.

Figure 3:
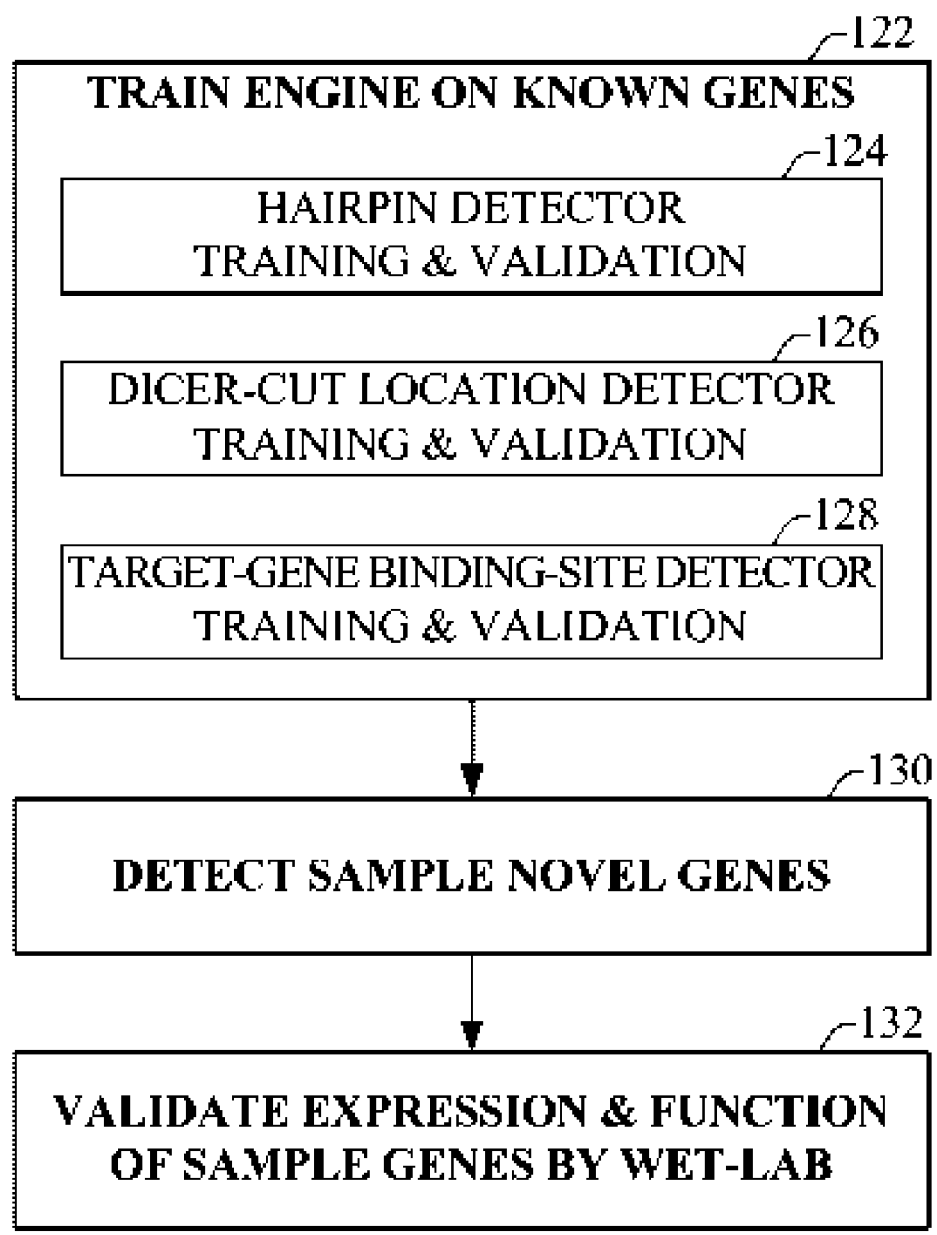
FIG. 3 is a simplified flowchart illustrating operation of a mechanism for training of a computer system to recognize the novel genes of the present invention, which mechanism is constructed and operative in accordance with a preferred embodiment of the present invention.

Reference is now made to FIG. 3 which is a simplified flowchart illustrating operation of a mechanism for training of a computer system to recognize the novel genes of the present invention. This mechanism is a preferred implementation of the bioinformatic gene detection engine training & validation 110 described hereinabove with reference to FIG. 2.

Bioinformatic gene detection engine training & validation 110 of FIG. 2 begins by training the bioinformatic gene detection engine to recognize known miRNA genes, as designated by numeral 122. This training step comprises hairpin detector training & validation 124, further described hereinbelow with reference to FIG. 12 A, dicer-cut location detector training & validation 126, further described hereinbelow with reference to FIGS. 6A and 6B, and target-gene binding-site detector training & validation 128, further described hereinbelow with reference to FIG. 7A.

Next, the bioinformatic gene detection engine 100 is used to bioinformatically detect sample novel genes, as designated by numeral 130. An example of a sample novel gene thus detected is described hereinbelow with reference to FIG. 12.

Finally, wet lab experiments are preferably conducted in order to validate expression and preferably function the sample novel genes detected by the bioinformatic gene detection engine 100 in the previous step. An example of wet-lab validation of the abovementioned sample novel gene bioinformatically detected by the system is described hereinbelow with reference to FIGS. 13A and 13B.

Figure 4A:
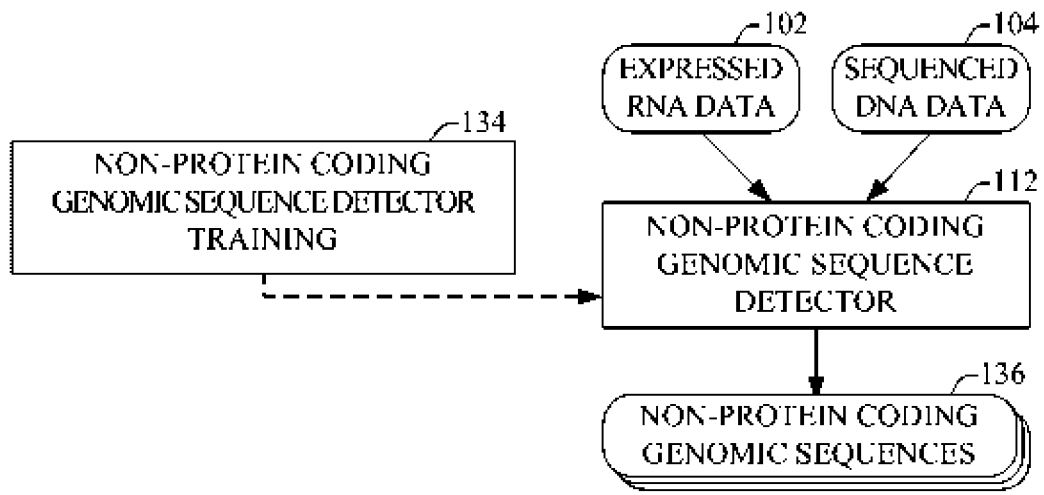
FIG. 4A is a simplified block diagram of a non-coding genomic sequence detector constructed and operative in accordance with a preferred embodiment of the present invention.

Reference is now made to FIG. 4A which is a simplified block diagram of a preferred implementation of the non-coding genomic sequence detector 112 described hereinabove with reference to FIG. 2. Non-protein coding genomic sequence detector 112 of FIG. 2 preferably receives as input at least two types of published genomic data: expressed RNA data 102, including EST data and mRNA data, and sequenced DNA data 104. After its initial training, indicated by numeral 134, and based on the above-mentioned input data, the non-protein coding genomic sequence detector 112 produces as output a plurality of non-protein coding genomic sequences 136. Preferred operation of the non-protein coding genomic sequence detector 112 is described hereinbelow with reference to FIG. 4B.

Figure 4B:
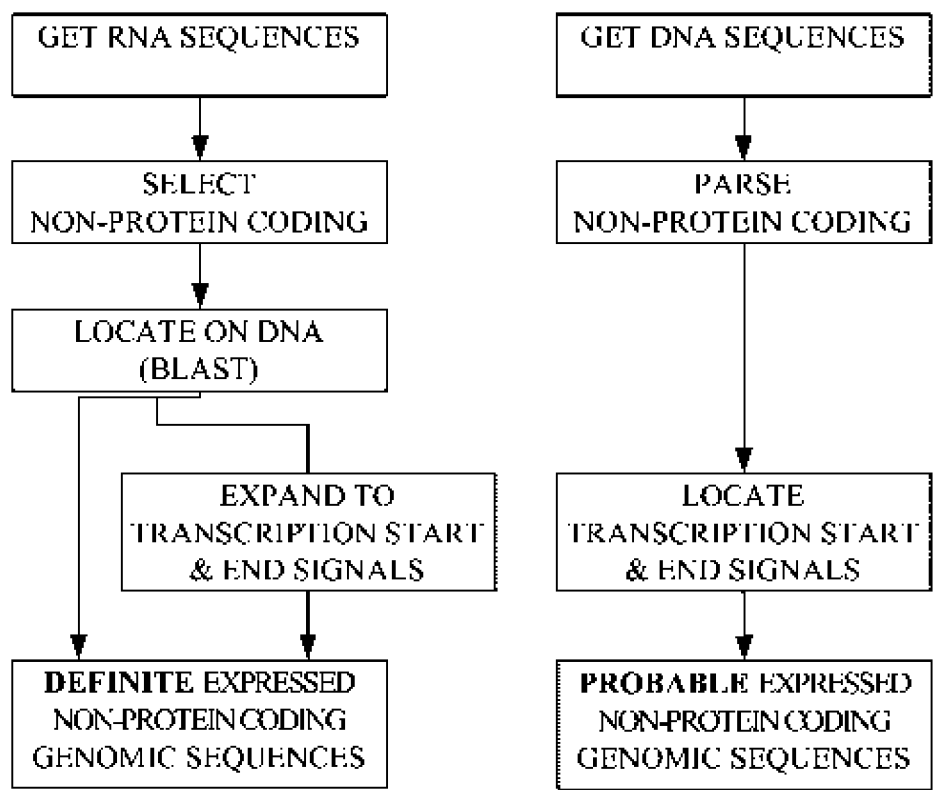
FIG. 4B is a simplified flowchart illustrating operation of a non-coding genomic sequence detector constructed and operative in accordance with a preferred embodiment of the present invention.

Reference is now made to FIG. 4B which is a simplified flowchart illustrating a preferred operation of the non-coding genomic sequence detector 112 of FIG. 2. Detection of non-protein coding genomic sequences to be further analyzed by the system generally preferably progresses in one of the following two paths.

A first path for detecting non-protein coding genomic sequences begins by receiving a plurality of known RNA sequences, such as EST data. Each RNA sequence is first compared to all known protein-coding sequences, in order to select only those RNA sequences which are non-protein coding. This can preferably be performed by BLAST comparison of the RNA sequence to known protein coding sequences. The abovementioned BLAST comparison to the DNA preferably also provides the localization of the RNA on the DNA.

Optionally, an attempt may be made to "expand" the non-protein RNA sequences thus found, by searching for transcription start and end signals, upstream and downstream of location of the RNA on the DNA respectively, as is well known in the art.

A second path for detecting non-protein coding genomic sequences starts by receiving DNA sequences. The DNA sequences are parsed into non protein coding sequences, based on published DNA annotation data: extracting those DNA sequences which are between known protein coding sequences. Next, transcription start and end signals are sought. If such signals are found, and depending on their "strength", probable expressed non-protein coding genomic sequences are yielded.

Figure 5A:
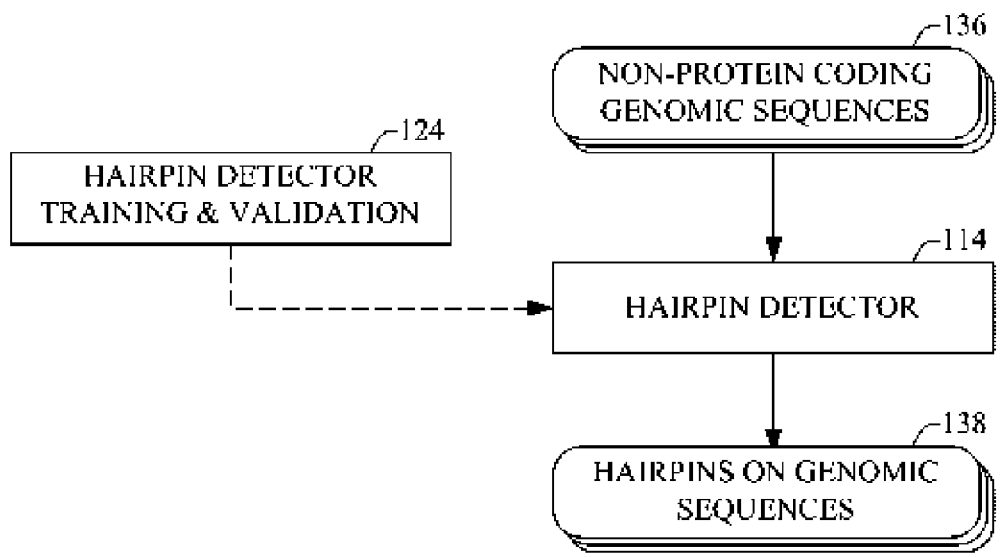
FIG. 5A is a simplified block diagram of a hairpin detector constructed and operative in accordance with a preferred embodiment of the present invention.

Reference is now made to FIG. 5A which is a simplified block diagram of a preferred implementation of the hairpin detector 114 described hereinabove with reference to FIG. 2.

The goal of the hairpin detector 114 is to detect "hairpin" shaped genomic sequences, similar to those of known miRNA genes. As mentioned hereinabove with reference to FIG. 1, a "hairpin" genomic sequence refers to a genomic sequence which "folds onto itself" forming a hairpin like shape, due to the fact that nucleotide sequence of the first half of the nucleotide sequence is an accurate or The hairpin detector 114 of FIG. 2 receives as input a plurality of non-protein coding genomic sequences 136 of FIG. 4A, and after a phase of hairpin detector training & validation 124 of FIG. 3, is operative to detect and output "hairpin shaped" sequences found in the input expressed non-protein coding sequences, designated by numeral 138.

The phase of hairpin detector training & validation 124 is an iterative process of applying the hairpin detector 114 to known hairpin shaped miRNA genes, calibrating the hairpin detector 114 such that it identifies the training set of known hairpins, as well as sequences which are similar thereto. Preferred operation of the hairpin detector 114 is described hereinbelow with reference to FIG. 5B.

Figure 5B:
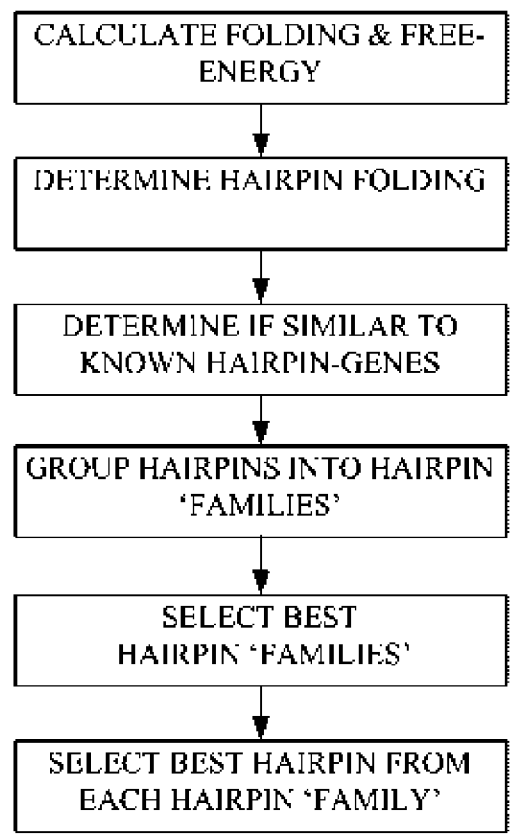
FIG. 5B is a simplified flowchart illustrating operation of a hairpin detector constructed and operative in accordance with a preferred embodiment of the present invention.

Reference is now made to FIG. 5B which is a simplified flowchart illustrating a preferred operation of the hairpin detector 114 of FIG. 2.

A hairpin structure is a two dimensional folding structure, resulting from the nucleotide sequence pattern: the nucleotide sequence of the first half of the hairpin sequence is an inversed-reversed sequence of the second half thereof. Different methodologies are known in the art for detection of various two dimensional and three dimensional hairpin structures.

In a preferred embodiment of the present invention, the hairpin detector 114 initially calculates possible 2-dimensional (2D) folding patterns of a given one of the non-protein coding genomic sequences 136, preferably using a 2D folding algorithm based on free-energy calculation, such as the Zucker algorithm, as is well known in the art.

Next, the hairpin detector 114 analyzes the results of the 2D folding, in order to determine the presence, and location of hairpin structures. A 2D folding algorithm typically provides as output a listing of the base-pairing of the 2D folded shape, i.e. a listing of which all two pairs of nucleotides in the sequence which will bond. The goal of this second step, is to assess this base-pairing listing, in order to determine if it describes a hairpin type bonding pattern.

The hairpin detector 114 then assess those hairpin structures found by the previous step, comparing them to hairpins of known miRNA genes, using various parameters such as length, free-energy, amount and type of mismatches, etc. Only hairpins that bear statistically significant resemblance of the population of hairpins of known miRNAs, according to the abovementioned parameters are accepted.

Lastly, the hairpin detector 114 attempts to select those hairpin structures which are as stable as the hairpins of know miRNA genes. This may be achieved in various manners. A preferred embodiment of the present invention utilizes the following methodology comprising three steps:

First, the hairpin detector 114 attempts to group potential hairpins into "families" of closely related hairpins. As is known in the art, a free-energy calculation algorithm, typically provides multiple "versions" each describing a different possible 2D folding pattern for the given genomic sequence, and the free energy of such possible folding. The hairpin detector 114 therefore preferably assesses all hairpins found on all "versions", grouping hairpins which appear in different versions, but which share near identical locations into a common "family" of hairpins. For example, all hairpins in different versions, the center of which is within 7 nucleotides of each other may preferably be grouped to a single "family".

Next, hairpin "families" are assessed, in order to select only those families which represent hairpins that are as stable as those of known miRNA hairpins. For example, preferably only families which are represented in at least 65% of the free-energy calculation 2D folding versions, are considered stable.

Finally, an attempt is made to select the most suitable hairpin from each selected family. For example, preferably the hairpin which appears in more versions than other hairpins, and in versions the free-energy of which is lower, may be selected.

Figure 6A:
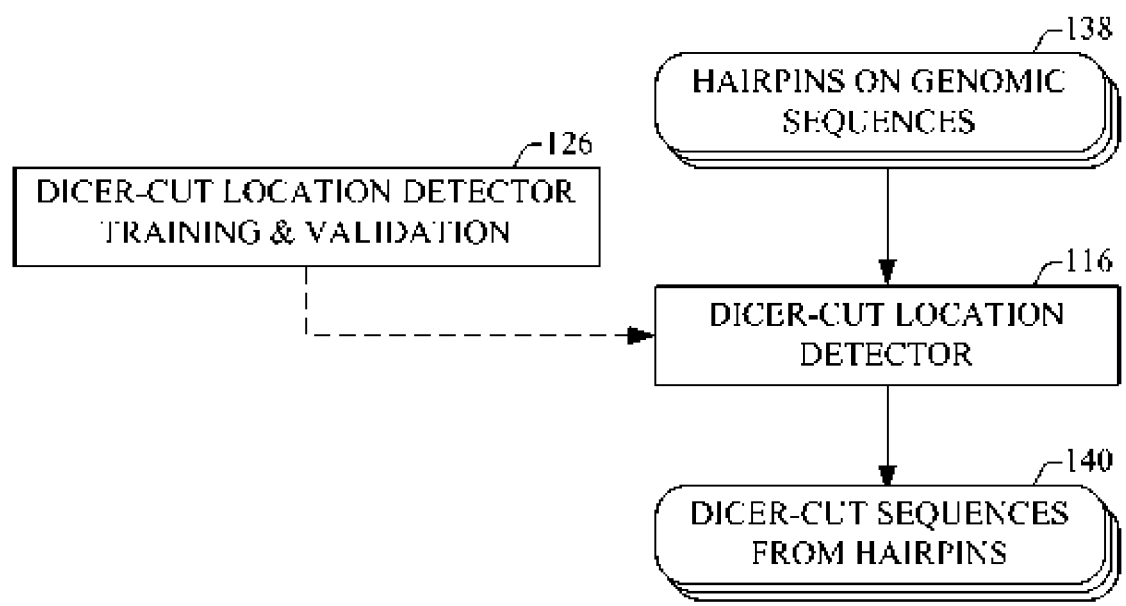
FIG. 6A is a simplified block diagram of a dicer-cut location detector constructed and operative in accordance with a preferred embodiment of the present invention.
Figure 6B:
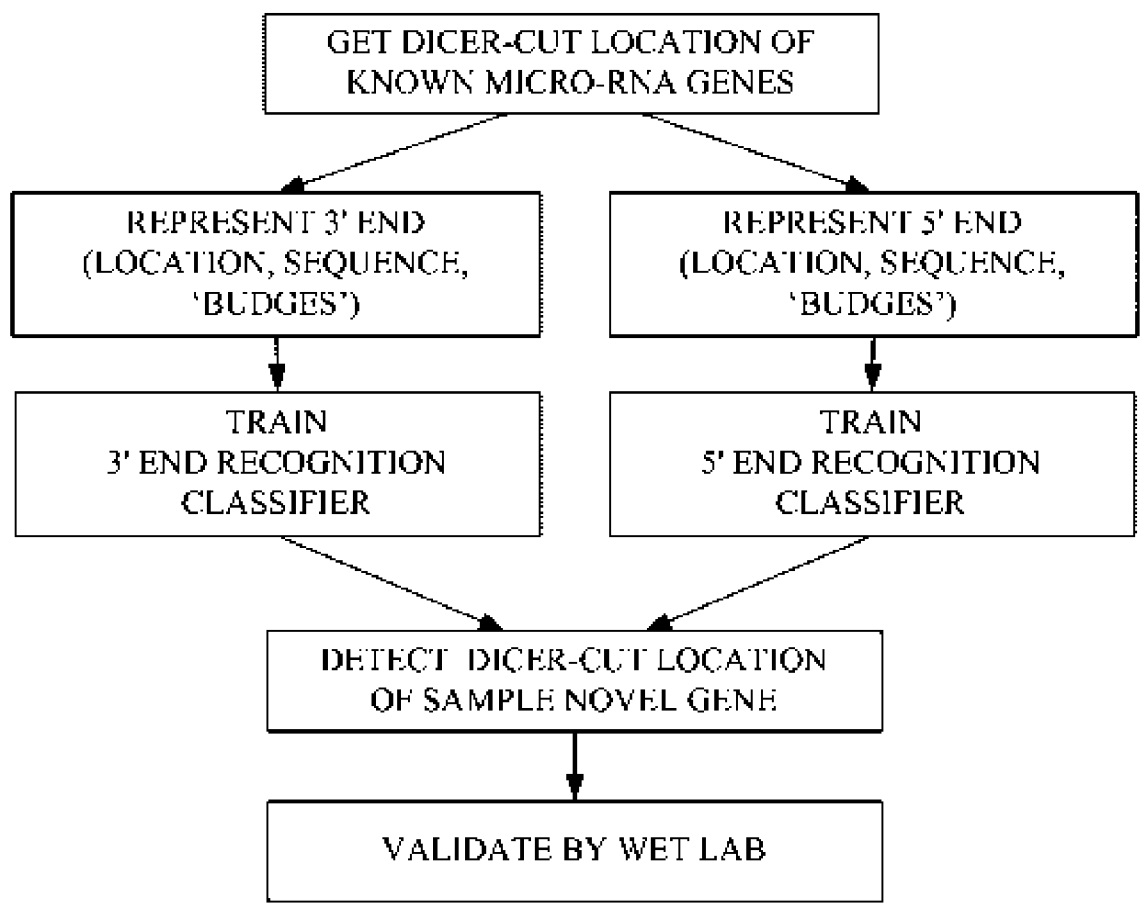
FIG. 6B is a simplified flowchart illustrating training of a dicer-cut location detector constructed and operative in accordance with a preferred embodiment of the present invention.

Reference is now made to FIG. 6A which is a simplified block diagram of a preferred implementation of the dicer-cut location detector 116 described hereinabove with reference to FIG. 2.

The goal of the dicer-cut location detector 116 is to detect the location in which DICER COMPLEX of FIG. 1, comprising the enzyme Dicer, would "dice" the given hairpin sequence, similar to VGAM FOLDED PRECURSOR RNA, yielding VGAM RNA both of FIG. 1.

The dicer-cut location detector 116 of FIG. 2 therefore receives as input a plurality of hairpins on genomic sequences 138 of FIG. 5A, which were calculated by the previous step, and after a phase of dicer-cut location detector training & validation 126 of FIG. 3, is operative to detect a respective plurality of dicer-cut sequences from hairpins 140, one for each hairpin.

In a preferred embodiment of the present invention, the dicer-cut location detector 116 preferably uses a combination of neural networks, Bayesian networks, Markovian modeling, and Support Vector Machines (SVMs) trained on the known dicer-cut locations of known miRNA genes, in order to detect dicer-cut locations. Dicer-cut location detector training & validation 126, which is further described hereinbelow with reference to FIG. 6B.

Figure 6C:
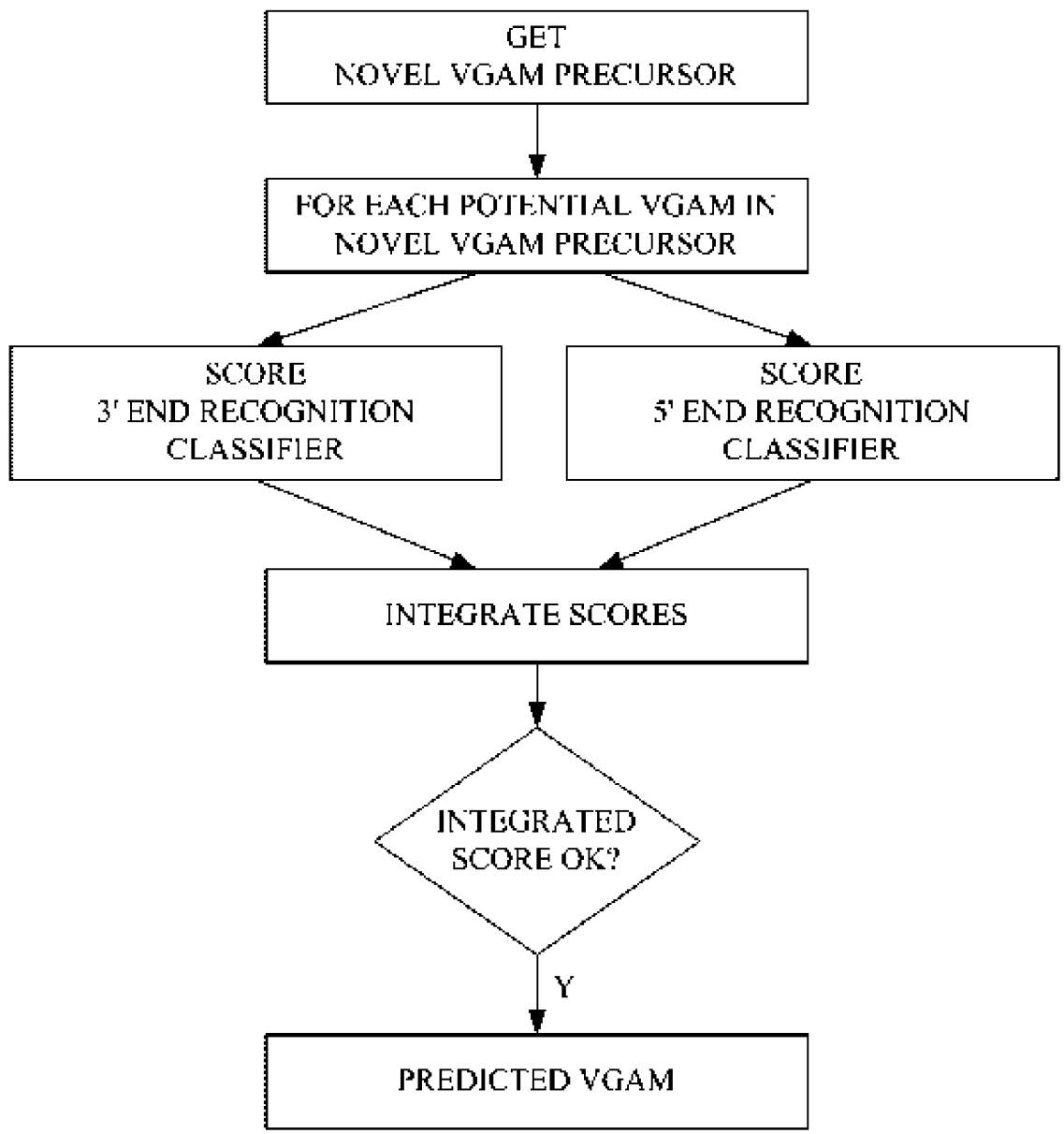
FIG. 6C is a simplified flowchart illustrating prediction of a viral genormic address messenger.

Reference is now made to FIG. 6 B which is a simplified flowchart illustrating a preferred implementation of dicer-cut location detector training & validation 126 of FIG. 3. Dicer-cut location detector 116 first preprocesses known miRNA hairpins and their respective dicer-cut locations, so as to be able to properly analyze them and train the detection system accordingly:

The folding pattern is calculated for each known miRNA, preferably based on free-energy calculation, and the size of the hairpin, the size of the loop at the center of the hairpin, and "bulges" (i.e. mismatched base-pairs) in the folded hairpin are noted.

The dicer-cut location, which is known for known miRNA genes, is noted relative to the above, as well as to the nucleotides in each location along the hairpin. Frequency of identity of nucleotides, and nucleotide-pairing, relative to their location in the hairpin, and relative to the known dicer-cut location in the known miRNA genes is analyzed and modeled.

Different techniques are well known in the art for analysis of existing pattern from a given "training set" of species belonging to a genus, which techniques are then capable, to a certain degree, to detect similar patterns in other species not belonging to the training-set genus. Such techniques include, but are not limited to neural networks, Bayesian networks, Support Vector Machines (SVM), Genetic Algorithms, Markovian modeling, and others, as is well known in the art.

Using such techniques, preferably a combination of several of the above techniques, the known hairpins are represented as a several different networks (such as neural, Bayesian, or SVM) input and output layers. Both nucleotide, and "bulge" (i.e. nucleotide pairing or mismatch) are represented for each position in the hairpin, at the input layer, and a corresponding true/false flag at each position, indicating whether it was diced by dicer at the output layer. Multiple networks are preferably used concurrently, and the results therefrom are integrated and further optimized. Markovian modeling may also be used to validate the results and enhance their accuracy. Finally, the bioinformatic detection of dicer-cut location of a sample novel is confirmed by wet-lab experimentation.

Figure 7A:
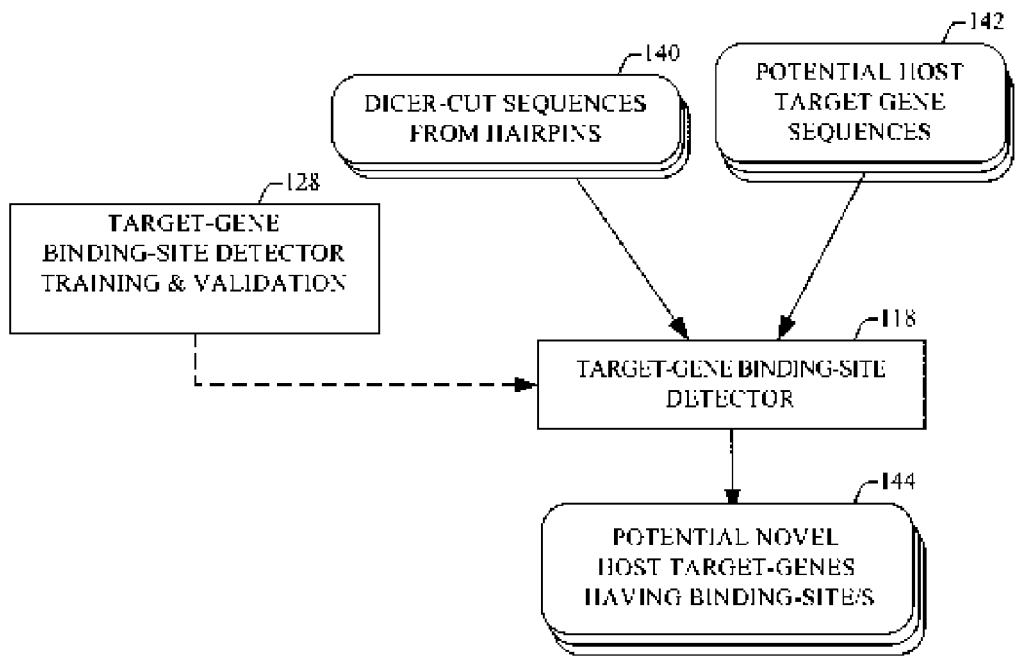
FIG. 7A is a simplified block diagram of a target-gene binding-site detector constructed and operative in accordance with a preferred embodiment of the present invention.

Reference is now made to FIG. 7A which is a simplified block diagram of a preferred implementation of the target-gene binding-site detector 118 described hereinabove with reference to FIG. 2. The goal of the target-gene binding-site detector 118 is to detect a BINDING SITE of FIG. 1, located in an untranslated region of the RNA of a known gene, the nucleotide sequence of which BINDING SITE is at least partially complementary to that of a VGAM RNA of FIG. 1, thereby determining that the abovementioned known gene is a target gene of VGAM of FIG. 1.

The target-gene binding-site detector 118 of FIG. 2 therefore receives as input a plurality of dicer-cut sequences from hairpins 140 of FIG. 6A which were calculated by the previous step, and a plurality of potential target gene sequences 142 which derive sequence DNA data 104 of FIG. 2, and after a phase of target-gene binding-site detector training & validation 128 of FIG. 3, is operative to detect target-genes having binding site/s 144 the nucleotide sequence of which is at least partially complementary to that of each of the plurality of dicer-cut sequences from hairpins 140. Preferred operation of the target-gene binding-site detector is further described hereinbelow with reference to FIG. 7B.

Figure 7B:
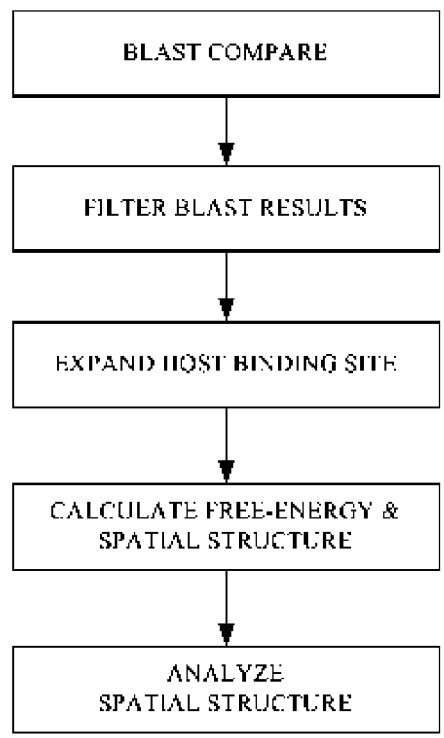
FIG. 7B is a simplified flowchart illustrating operation of a target-gene binding-site detector constructed and operative in accordance with a preferred embodiment of the present invention.

Reference is now made to FIG. 7B which is a simplified flowchart illustrating a preferred operation of the target-gene binding-site detector 118 of FIG. 2. In a preferred embodiment of the present invention, the target-gene binding-site detector 118 first performs a BLAST comparison of the nucleotide sequence of each of the plurality of dicer-cut sequences from hairpins 140, to the potential target gene sequences 142, in order to find crude potential matches. Blast results are then filtered to results which are similar to those of known binding sites (e.g. binding sites of miRNA genes Lin-4 and Let-7 to target genes Lin-14, Lin-41, Lin 28 etc.). Next the binding site is expanded, checking if nucleotide sequenced immediately adjacent to the binding site found by BLAST, may improve the match. Suitable binding sites, then are computed for free-energy and spatial structure. The results are analyzed, selecting only those binding sites, which have free-energy and spatial structure similar to that of known binding sites.

Reference is now made to FIG. 8 which is a simplified flowchart illustrating a preferred operation of the function & utility analyzer 120 described hereinabove with reference to FIG. 2. The goal of the function & utility analyzer 120 is to determine if a potential target gene is in fact a valid clinically useful target gene. Since a potential novel VGAM gene binding a binding site in the UTR of a target gene is understood to inhibit expression of that target gene, and if that target gene is shown to have a valid clinical utility, then in such a case it follows that the potential novel gene itself also has a valid useful function which is the opposite of that of the target gene.

The function & utility analyzer 120 preferably receives as input a plurality of potential novel target genes having binding-site/s 144, generated by the target-gene binding-site detector 118, both of FIG. 7A. Each potential gene, is evaluated as follows:

First the system first checks to see if the function of the potential target gene is scientifically well established. Preferably, this can be achieved bioinformatically by searching various published data sources presenting information on known function of proteins. Many such data sources exist and are published as is well known in the art.

Next, for those target genes the function of which is scientifically known and is well documented, the system then checks if scientific research data exists which links them to known diseases. For example, a preferred embodiment of the present invention utilizes the OMIM(TM) database published by NCBI, which summarizes research publications relating to genes which have been shown to be associated with diseases.

Finally, the specific possible utility of the target gene is evaluated. While this process too may be facilitated by bioinformatic means, it might require human evaluation of published scientific research regarding the target gene, in order to determine the utility of the target gene to the diagnosis and or treatment of specific disease. Only potential novel genes, the target-genes of which have passed all three examinations, are accepted as novel genes.

Figure 9:
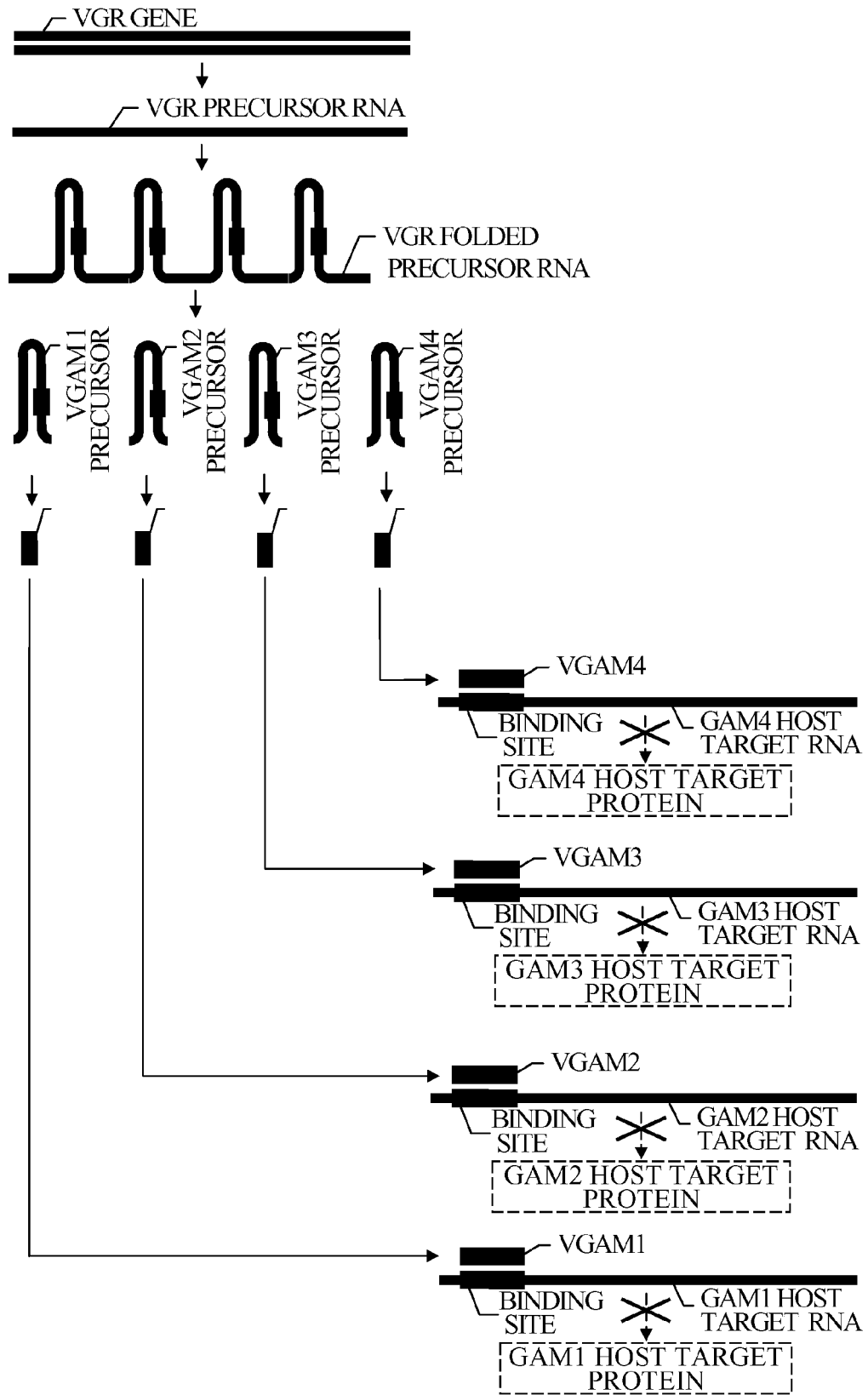
FIG. 9 is a simplified diagram describing a novel bioinformatically detected group of regulatory genes, referred to here as Genomic Record (GR) genes, each of which encodes an "operon-like" cluster of novel miRNA-like genes, which in turn modulates expression of a plurality of target genes.

Reference is now made to FIG. 9, which is a simplified diagram describing a novel bioinformatically detected group of regulatory genes, referred to here as Genomic Record (GR) genes, that encode an "operon-like" cluster of novel miRNA-like genes, each modulating expression of a plurality of host target, the function and utility of which target genes is known.

GR GENE (Genomic Record Gene) is gene of a novel, bioinformatically detected group of regulatory, non protein coding, RNA genes. The method by which GR is detected is described hereinabove with reference to FIGS. 6-15.

GR GENE encodes an RNA molecule, typically several hundred nucleotides long, designated GR PRECURSOR RNA.

GR PRECURSOR RNA folds spatially, as illustrated by GR FOLDED PRECURSOR RNA, into a plurality of what is known in the art as "hair-pin" structures. The nucleotide sequence of GR PRECURSOR RNA comprises a plurality of segments, the first half of each such segment having a nucleotide sequence which is at least a partial inversed-reversed sequence of the second half thereof, thereby causing formation of a plurality of "hairpin" structures, as is well known in the art.

GR FOLDED PRECURSOR RNA is naturally processed by cellular enzymatic activity, into 3 separate hairpin shaped RNA segments, each corresponding to VGAM PRECURSOR RNA of FIG. 1, designated VGAM1 PRECURSOR, VGAM2 PRECURSOR and VGAM3 PRECURSOR respectively.

The above mentioned VGAM precursors, are diced by Dicer of FIG. 1, yielding short RNA segments of about 22 nucleotides in length, each corresponding to VGAM RNA of FIG. 1, designated VGAM1, VGAM2 and VGAM3 respectively.

VGAM1, VGAM2 and VGAM3 each bind complementarily to binding sites located in untranslated regions of respective host target, designated VGAM 1-TARGET RNA, VGAM2-TARGET RNA and VGAM3-TARGET RNA respectively. This binding inhibits translation of the respective target proteins designated VGAM1-TARGET PROTEIN, VGAM2-TARGET PROTEIN and VGAM3-TARGET PROTEIN respectively.

The structure of VGAM genes comprised in a GR GENE, and their mode of modulation of expression of their respective target genes is described hereinabove with reference to FIG. 1. The bioinformatic approach to detection of VGAM genes comprised in a GR GENE is described hereinabove with reference to FIGS. 9 through 14.

The present invention discloses 90656 novel viral genes of the GR group of genes, which have been detected bioinformatically, as described hereinbelow with reference to Tables 1 and 2for VGAM1483. Laboratory confirmation of 3 genes of the GR group of genes is described hereinbelow with reference to FIGS. 9A through 14.

In summary, the current invention discloses a very large number of novel viral GR genes, each of which encodes a plurality of VGAM genes, which in turn may modulate expression of a plurality of host target proteins.

Figure 10:
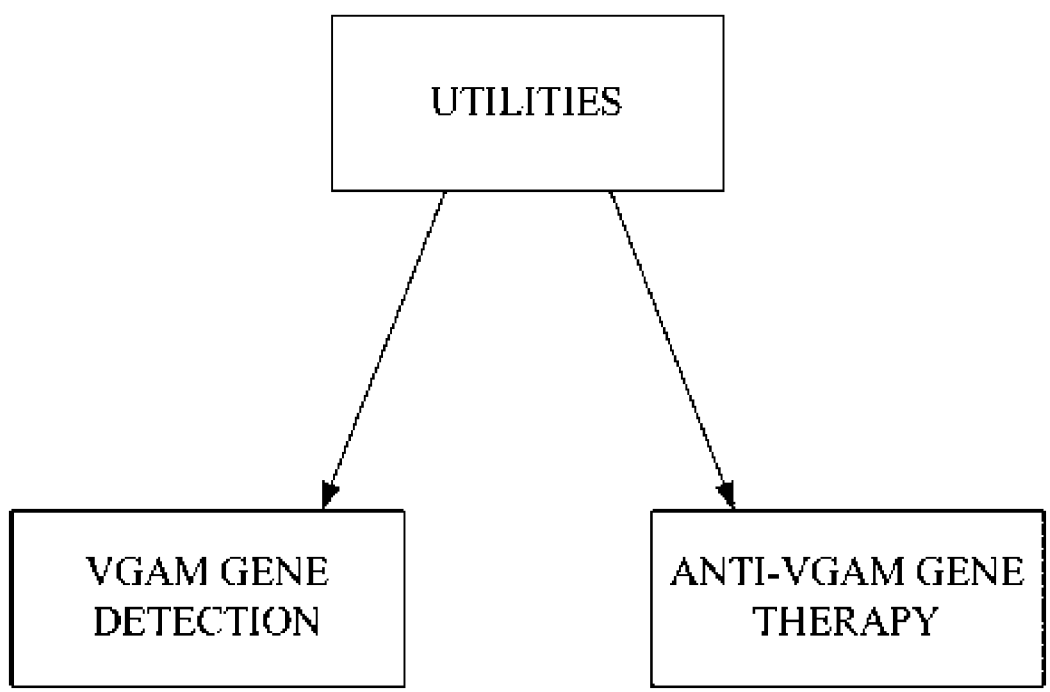
FIG. 10 is a block diagram illustrating different utilities of genes of a novel group of genes, and operons of a novel group of operons, both of the present invention.
Figures 15A, 15B, 15C:
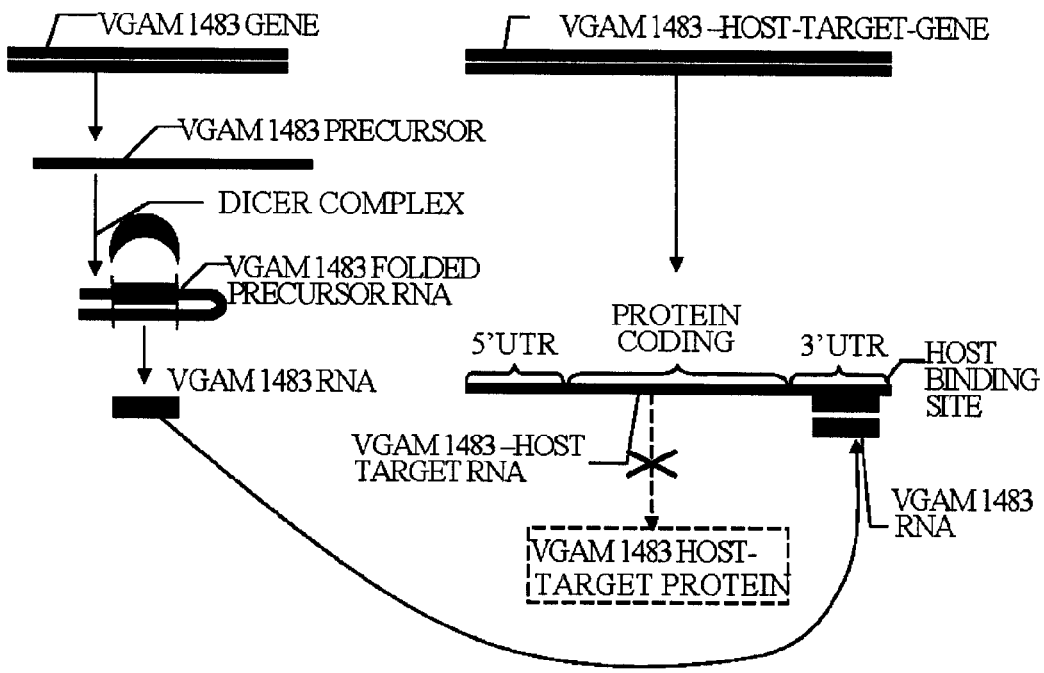

Reference is now made to FIG. 10 which is a block diagram illustrating different utilities of genes of the novel group of genes of the present invention referred to here as VGAM genes and GR genes.

The present invention discloses a first plurality of novel genes referred to here as VGAM genes, and a second plurality of operon-like genes referred to here as GR genes, each of the GR genes encoding a plurality of VGAM genes. The present invention further discloses a very large number of known target-genes, which are bound by, and the expression of which is modulated by each of the novel genes of the present invention. Published scientific data referenced by the present invention provides specific, substantial, and credible evidence that the abovementioned target genes modulated by novel genes of the present invention, are associated with various diseases. Specific novel genes of the present invention, target genes thereof and diseases associated therewith, are described hereinbelow with reference to Tables 1 and 2 for VGAM1483. It is therefore appreciated that a function of VGAM genes and GR genes of the present invention is modulation of expression of target genes related to known diseases, and that therefore utilities of novel genes of the present invention include diagnosis and treatment of the abovementioned diseases. FIG. 10 describes various types of diagnostic and therapeutic utilities of novel genes of the present invention.

A utility of novel genes of the present invention is detection of VGAM genes and of GR genes. It is appreciated that since VGAM genes and GR genes modulate expression of disease related target genes, that detection of expression of VGAM genes in clinical scenarios associated with said diseases is a specific, substantial and credible utility. Diagnosis of novel genes of the present invention may preferably be implemented by RNA expression detection techniques, including but not limited to biochips, as is well known in the art. Diagnosis of expression of genes of the present invention may be useful for research purposes, in order to further understand the connection between the novel genes of the present invention and the abovementioned related diseases, for disease diagnosis and prevention purposes, and for monitoring disease progress.

Another utility of novel genes of the present invention is anti-VGAM gene therapy, a mode of therapy which allows up regulation of a disease related target-gene of a novel VGAM gene of the present invention, by lowering levels of the novel VGAM gene which naturally inhibits expression of that target gene. This mode of therapy is particularly useful with respect to target genes which have been shown to be under-expressed in association with a specific disease. Anti-VGAM gene therapy is further discussed hereinbelow with reference to FIGS. 11A and 11B.

A further utility of novel genes of the present invention is VGAM replacement therapy, a mode of therapy which achieves down regulation of a disease related target-gene of a novel VGAM gene of the present invention, by raising levels of the VGAM gene which naturally inhibits expression of that target gene. This mode of therapy is particularly useful with respect to target genes which have been shown to be over-expressed in association with a specific disease. VGAM replacement therapy involves introduction of supplementary VGAM gene products into a cell, or stimulation of a cell to produce excess VGAM gene products. VGAM replacement therapy may preferably be achieved by transfecting cells with an artificial DNA molecule encoding a VGAM gene, which causes the cells to produce the VGAM gene product, as is well known in the art.

Yet a further utility of novel genes of the present invention is modified VGAM therapy. Disease conditions are likely to exist, in which a mutation in a binding site of a VGAM gene prevents natural VGAM gene to effectively bind inhibit a disease related target-gene, causing up regulation of that target gene, and thereby contributing to the disease pathology. In such conditions, a modified VGAM gene is designed which effectively binds the mutated VGAM binding site, i.e. is an effective anti-sense of the mutated VGAM binding site, and is introduced in disease effected cells. Modified VGAM therapy is preferably achieved by transfecting cells with an artificial DNA molecule encoding the modified VGAM gene, which causes the cells to produce the modified VGAM gene product, as is well known in the art.

An additional utility of novel genes of the present invention is induced cellular differentiation therapy. As aspect of the present invention is finding genes which determine cellular differentiation, as described hereinabove with reference to FIG. 11. Induced cellular differentiation therapy comprises transfection of cell with such VGAM genes thereby determining their differentiation as desired. It is appreciated that this approach may be widely applicable, inter alia as a means for auto transplantation harvesting cells of one cell-type from a patient, modifying their differentiation as desired, and then transplanting them back into the patient. It is further appreciated that this approach may also be utilized to modify cell differentiation in vivo, by transfecting cells in a genetically diseased tissue with a cell-differentiation determining VGAM gene, thus stimulating these cells to differentiate appropriately.

Reference is now made to FIGS. 11A and 11B, simplified diagrams which when taken together illustrate anti-VGAM gene therapy mentioned hereinabove with reference to FIG. 10. A utility of novel genes of the present invention is anti-VGAM gene therapy, a mode of therapy which allows up regulation of a disease related target-gene of a novel VGAM gene of the present invention, by lowering levels of the novel VGAM gene which naturally inhibits expression of that target gene. FIG. 11A shows a normal VGAM gene, inhibiting translation of a target gene of VGAM gene, by binding to a BINDING SITE found in an untranslated region of TARGET RNA, as described hereinabove with reference to FIG. 1.

FIG. 11B shows an example of anti-VGAM gene therapy. ANTI-VGAM RNA is short artificial RNA molecule the sequence of which is an anti-sense of VGAM RNA. Anti-VGAM treatment comprises transfecting diseased cells with ANTI-VGAM RNA, or with a DNA encoding thereof. The ANTI-VGAM RNA binds the natural VGAM RNA, thereby preventing binding of natural VGAM RNA to its BINDING SITE. This prevents natural translation inhibition of TARGET RNA by VGAM RNA, thereby up regulating expression of TARGET PROTEIN.

It is appreciated that anti-VGAM gene therapy is particularly useful with respect to target genes which have been shown to be under-expressed in association with a specific disease.

Reference is now made to FIG. 12A which is an annotated sequence of an EST comprising a novel gene detected by the gene detection system of the present invention. FIG. 12A shows the nucleotide sequence of a known human non-protein coding EST (Expressed Sequence Tag), identified as EST72223 (SEQ ID NO: 86871). It is appreciated that the sequence of this EST comprises sequences of one known miRNA gene, identified as MIR-98, and of one novel GAM gene, referred to here as GAM24, detected by the bioinformatic gene detection system of the present invention, described hereinabove with reference to FIG. 2.

Reference is now made to FIGS. 12B and 12C that are pictures of laboratory results, which when taken together demonstrate laboratory confirmation of expression of the bioinformatically detected novel gene of FIG. 12A. Reference is now made to FIG. 12B which is a Northern blot analysis of MIR-98 and EST72223 transcripts. MIR-98 and EST72223 were reacted with MIR-98 and GAM24 probes as indicated in the figure. It is appreciated that the probes of both MIR-98 and GAM24 reacted with EST72223, indicating that EST72223 contains the sequences of MIR-98 and of GAM24. It is further appreciated that the probe of GAM24 does not cross-react with MIR-98.

Reference is now made to FIG. 12C. A Northern blot analysis of EST72223 and MIR-98 transfections were performed, subsequently marking RNA by the MIR-98 and GAM24 probes. Left, Northern reacted with MIR-98, Right, Northern reacted with GAM24. The molecular Sizes of EST72223, MIR-98 and GAM24 are indicated by arrows. Hela are control cells that have not been introduced to exogenous RNA. EST and MIR-98 Transfections are RNA obtained from Hela transfected with EST72223 and MIR-98, respectively. MIR-98 and EST are the transcripts used for the transfection experiment. The results indicate that EST72223, when transfected into Hela cells, is cut yielding known miRNA gene MIR-98 and novel miRNA gene GAM24.

Reference is now made to FIG. 12D, which is a Northern blot of a lisate experiment with MIR-98 and GAM24. Northern blot analysis of hairpins in EST72223. Left, Northern reacted with predicted Mir-98 hairpin probe, Right, Northern reacted with predicted GAM24 hairpin probe. The molecular size of EST Is indicated by arrow. The molecular sizes of Mir-98 and GAM24 are 80 nt and 100 nt, respectively as indicated by arrows. The 22 nt molecular marker is indicated by arrow. 1-Hela lysate; 2-EST incubated 4h with Hela lysate; 3-EST without lysate; 4-Mir transcript incubated 4h with Hela lysate; 5-Mir transcript incubated overnight with Hela lysate; 6-Mir transcript without lysate; 7-RNA extracted from Hela cells following transfection with Mir transcript.

Technical methods used in experiments, the results of which are depicted in FIGS. 12B, 12C and 12D are as follows:

Transcript preparations: Digoxigenin (DIG) labeled transcripts were prepared from EST72223 (TIGER), MIR98 and predicted precursor hairpins by using a DIG RNA labeling kit (Roche Molecular Biochemicals) according to the manufacturer's protocol. Briefly, PCR products with T7 promoter at the 5" end or T3 promoter at the 3" end were prepared from each DNA in order to use it as a template to prepare sense and antisense transcripts, respectively. MIR-98 was amplified using EST72223 as a template with T7miR98 forward primer: 5-"TAATACGACTCACTATAGGGTGAGGTAG-TAAGTTGTATTGTT-3" (SEQ ID NO: 86874) and T3miR98 reverse primer: 5"-AATTAACCCTCAC- TAAAGGGAAAGTAGTAAGTTGTATAGTT-3" (SEQ ID NO: 86875). EST72223 was amplified with T7-EST 72223 forward primer: 5"-TAATACGACTCACTATAGGCCCT-TATTAGAGGATTCTGCT-3" (SEQ ID NO: 86876) and T3-EST72223 reverse primer: 5"-AATTAACCCTCAC-TAAAGGTTTTTTTTTCCTGAGACAGAGT-3" (SEQ ID NO: 86877). Bet-4 was amplified using EST72223 as a template with Bet-4 forward primer: 5"-GAGGCAGGAGAAT-TGCTTGA-3" (SEQ ID NO: 86878) and T3-EST72223 reverse primer: 5"-AATTAACCCTCACTAAAGGCCT-GAGACAGAGTCTTGCTC-3" (SEQ ID NO: 86879). The PCR products were cleaned and used for DIG-labeled or unlabeled transcription reactions with the appropriate polymerase. For transfection experiments, CAP reaction was performed by using a mMessage mMachine kit (Ambion).

Transfection procedure: Transfection of Hela cells was performed by using TransMessenger reagent (Qiagen) according to the manufacture"s protocol. Briefly, Hela cells were seeded to 1-2×10^6 cells per plate a day before transfection. Two μg RNA transcripts were mixed with 8 μl Enhancer in a final volume of 100 μl, mixed and incubated at room temperature for 5 min. 16 μl TransMessenger reagent was added to the RNA-Enhancer, mixed and incubated for additional 10 min. Cell plates were washed with sterile PBS twice and then incubated with the transfection mix diluted with 2.5 ml DMEM medium without serum. Cells were incubated with transfection mix for three hours under their normal growth condition (370 C and 5% CO2) before the transfection mix was removed and a fresh DMEM medium containing serum was added to the cells. Cells were left to grow 48 hours before harvesting.

Target RNA cleavage assay: Cap-labeled target RNAs were generated using mMessage mMachine™ (Ambion). Caped RNA transcripts were preincubated at 30° C. for 15 min in supplemented Hela S100 obtained from Computer Cell Culture, Mos, Belgium. After addition of all components, final concentrations were 100 mM target RNA, 1 m M ATP, 0.2 mM GTP, 10 U/ml RNasin, 30 μg/m creatine kinase, 25 mM creatine phosphate, and 50% S100 extract. Incubation was continued for 4 hours to overnight. Cleavage reaction was stopped by the addition of 8 volumes of proteinase K buffer (200 Mm Tris-Hcl, pH 7.5, 25 m M EDTA, 300mM NaCl, and 2% SDS). Proteinase K, dissolved in 50 mM Tris-HCl, pH 8, 5 m M CaCl2, and 50% glycerol, was added to a final concentration of 0.6 mg/ml. Sample were subjected to phenol/ chloroform extraction and kept frozen until analyzed by urea-TBE PAGE.

Northern analysis: RNAs were extracted from cells by using Tri-reagent according to the manufacture"s protocol. The RNAs were dissolved in water and heated to 650 C to disrupt any association of the 25 nt RNA with larger RNA molecules. RNA were placed on ice and incubated for 30 min with PEG (MW=8000) in a final concentration of 5% and NaCl in a final concentration of 0.5M to precipitate high molecular weight nucleic acid. The RNAs were centrifuged at 10,000 xg for 10 min to pellet the high molecular weight nucleic acid. The supernatant containing the low molecular weight RNAs was collected and three volumes of ethanol was added. The RNAs were placed at 200 C for at least two hours and then centrifuged at 10,000 xg for 10 min. The pellets were dissolved in Urea-TBE buffer (1Xtbe, 7M urea) for further analysis by a Northern blot.

RNA samples were boiled for 5 min before loading on 15%-8% polyacrylamide (19:1) gels containing 7M urea and 1xTBE. Gels were run in 1xTBE at a constant voltage of 300V and then transferred into a nylon membrane. The membrane was exposed to 3 min ultraviolet light to cross link the RNAs to the membrane. Hybridization was performed overnight with DIG-labeled probes at 420 C. Membranes were washed twice with SSCx2 and 0.2% SDS for 10 min. at 420 C and then washed twice with SSCx0.5 for 5 min at room temperature. The membrane was then developed by using a DIG luminescent detection kit (Roche) using anti DIG and CSPD reaction, according to the manufacture"s protocol.

It is appreciated that the data presented in FIGS. 12A, 12B, 12C and 12D, when taken together validate the function of the bioinformatic gene detection engine 100 of FIG. 2. FIG. 12A shows a novel GAM gene bioinformatically detected by the bioinformatic gene detection engine 100, and FIGS. 12B, 12C and 12D show laboratory confirmation of the expression of this novel gene. This is in accord with the engine training and validation methodology described hereinabove with reference to FIG. 3.

Reference is now made to FIG. 13A which is an annotated sequence of an EST comprising a novel gene detected by the gene detection system of the present invention. FIG. 13A shows the nucleotide sequence of a known human non-protein coding EST (Expressed Sequence Tag), identified as EST 7929020 (SEQ ID NO: 86872). It is appreciated that the sequence of this EST comprises sequences of two novel GAM genes, referred to here as GAM23 and GAM25, detected by the bioinformatic gene detection system of the present invention, described hereinabove with reference to FIG. 2.

Reference is now made to FIG. 13B which presents pictures of laboratory results, that demonstrate laboratory confirmation of expression of the bioinformatically detected novel gene of FIG. 13A. Northern blot analysis of hairpins in EST7929020. Left, Northern reacted with predicted GAM25 hairpin probe, Right, Northern reacted with predicted GAM23 hairpin probe. The molecular size of EST is indicated by arrow. The molecular sizes of GAM23 and GAM25 are 60 nt, as indicated by arrow. The 22 nt molecular marker is indicated by arrow. 1-Hela lysate; 2-EST incubated 4h with Hela lysate; 3-EST incubated overnight with Hela lysate; 4-EST without lysate; 5-GAM transcript; 6-GAM 22 nt marker; 7-GAM PCR probe; 8-RNA from control Hela cells; 9-RNA extracted from Hela cells following transfection with EST.

Reference is now made to FIG. 13C which is a picture of a Northern blot confirming Endogenous expression of bioinformatically detected gene GAM25 of FIG. 13A from in Hela cells. Northern was reacted with a predicted GAM25 hairpin probe. The molecular size of EST7929020 is indicated. The molecular sizes of GAM25 is 58 nt, as indicated. A 19 nt DNA oligo molecular marker is indicated. Endogenous expression of GAM25 in Hela total RNA fraction and in S-100 fraction is indicated by arrows. 1-GAM25 transcript; 2-GAM25 DNA oligo marker; 3-RNA from control Hela cells; 4-RNA extracted from Hela cells following transfection with EST; 5-RNA extracted from S-100 Hela lysate.

Reference is now made to FIG. 14A which is an annotated sequence of an EST comprising a novel gene detected by the gene detection system of the present invention. FIG. 14A shows the nucleotide sequence of a known human non-protein coding EST (Expressed Sequence Tag), identified as EST 1388749 (SEQ ID NO: 86873). It is appreciated that the sequence of this EST comprises sequence of a novel GAM gene, referred to here as GAM26, detected by the bioinformatic gene detection system of the present invention, described hereinabove with reference to FIG. 2.

FIG. 1 further provides a conceptual description of another novel bioinformatically detected viral gene of the present invention, referred to here as Viral Genomic Address Messenger 1483 (VGAM1483) viral gene, which modulates expression of respective host target genes thereof, the function and utility of which host target genes is known in the art.

VGAM1483 is a novel bioinformatically detected regulatory, non protein coding, viral micro RNA (miRNA) gene. The method by which VGAM1483 was detected is described hereinabove with reference to FIGS. 2-8.

VGAM1483 gene, herein designated VGAM GENE, is a viral gene contained in the genome of Human herpesvirus 5. VGAM1483 host target gene, herein designated VGAM HOST TARGET GENE, is a human gene contained in the human genome.

VGAM1483 gene, herein designated VGAM GENE, encodes a VGAM1483 precursor RNA, herein designated VGAM PRECURSOR RNA. Similar to other miRNA genes, and unlike most ordinary genes, VGAM1483 precursor RNA, herein designated VGAM PRECURSOR RNA, does not encode a protein. A nucleotide sequence identical or highly similar to the nucleotide sequence of VGAM1483 precursor RNA is designated SEQ ID:37404, and is provided hereinbelow with reference to the sequence listing part.

VGAM1483 precursor RNA, herein designated VGAM PRE-CURSOR RNA, folds onto itself, forming VGAM1483 folded precursor RNA, herein designated VGAM FOLDED PRECUR-SOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM1483 folded precursor RNA, herein designated VGAM FOLDED PRECURSOR RNA, into VGAM1483 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 35%) nucleotide sequence of VGAM1483 RNA is designated SEQ ID:37405, and is provided hereinbelow with reference to the sequence listing part.

VGAM1483 host target gene, herein designated VGAM HOST TARGET GENE, encodes a corresponding messenger RNA, VGAM1483 host target RNA, herein designated VGAM HOST TARGET RNA. VGAM1483 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN COD-ING and 3UTR respectively.

VGAM1483 RNA, herein designated VGAM RNA, binds complementarily to one or more host target binding sites located in untranslated regions of VGAM1483 host target RNA, herein designated VGAM HOST TARGET RNA. This complementary binding is due to the fact that the nucleotide sequence of VGAM1483 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM1483 RNA, herein designated VGAM RNA, may have a different number of host target binding sites in untranslated regions of a VGAM1483 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM1483 RNA, herein designated VGAM RNA, to host target binding sites on VGAM1483 host target RNA, herein designated VGAM HOST TARGET RNA, such as BINDING SITE I, BINDING SITE II and BINDING SITE III, inhibits translation of VGAM1483 host target RNA, herein designated VGAM HOST TARGET RNA, into VGAM1483 host target protein, herein designated VGAM HOST TARGET PROTEIN. VGAM host target protein is therefore outlined by a broken line.

It is appreciated that VGAM1483 host target gene, herein designated VGAM HOST TARGET GENE, in fact represents a plurality of VGAM1483 host target genes. The mRNA of each one of this plurality of VGAM1483 host target genes comprises one or more host target binding sites, each having a nucleotide sequence which is at least partly complementary to VGAM1483 RNA, herein designated VGAM RNA, and which when bound by VGAM1483 RNA, herein designated VGAM RNA, causes inhibition of translation of respective one or more VGAM1483 host target proteins.

It is further appreciated by one skilled in the art that the mode of translational inhibition illustrated by FIG. 1 with specific reference to translational inhibition exerted by VGAM1483 gene, herein designated VGAM GENE, on one or more VGAM1483 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294, 779 (2001)).

It is yet further appreciated that a function of VGAM1483 is inhibition of expression of host target genes, as part of a novel viral mechanism of attacking a host. Accordingly, utilities of VGAM1483 include diagnosis, prevention and treatment of viral infection by Human herpesvirus 5. Specific functions, and accordingly utilities, of VGAM1483 correlate with, and may be deduced from, the identity of the host target genes which VGAM1483 binds and inhibits, and the function of these host target genes, as elaborated hereinbelow.

Nucleotide sequences of the VGAM1483 precursor RNA, herein designated VGAM PRECURSOR RNA, and of the diced VGAM1483 RNA, herein designated VGAM RNA, and a schematic representation of the secondary folding of VGAM1483 folded precursor RNA, herein designated VGAM FOLDED PRECURSOR RNA, of VGAM1483 are further described hereinbelow with reference to Table 1.

TABLE 1

| GENE | PRECURSOR-SEQUENCE | P-SEQ ID | GENE-SEQ ID | G-SEQ | FOLDED PRECURSOR |
|---|---|---|---|---|---|
| GAM 1483 | GTGTGACGTG AGTCTGATCC GACGAGAGCG GCTTTCGTCG TGTTTTTCAT GCAGCTTTTA CAGACCATGA CAAGCCTGAC GAGAGCGTTC ATCGGGGCAT GAAGTACGCA TTACAC | 37404 | 37405 | TGACA AGCCT AACAC TGAAC TTCA | ``--     AG  - A    AACAC                TT     CAG  TT
TGA  CGTG  TC TG TCC       TGAACGCTTTCGTCG GTTT  TCATG   CT  T
|||  ||||  || || |||       ||||||||||||||| ||||  |||||   ||  ||
ATT  GCAT  AG AC GGG       ACTTGCGAGAGCAGT CGAA  AGTAC   GA  /
  AC     GA  T  -    GCT--                 C      C     CA- CA`` |

Nucleotide sequences of host target binding sites, such as BINDING SITE-I, BINDING SITE-II and BINDING SITE-III of FIG. 1, found on, and schematic representation of the complementarity of each of these host target binding sites to VGAM1483 RNA, herein designated VGAM RNA, are described hereinbelow with reference to Table 2.

TABLE 2

| GENE | TARGET | UTR | SEQUENCE | SEQID | BINDING-SITE |
|---|---|---|---|---|---|
| GAM1483 | C7 | 3' | TGATAGGCCTGAATGGAGCATTCA | 37406 | ``    CAA         CGA
TGA    GCCTGA     GAGCGTTCA
|||    ||||||     |||||||||
ACT    CGGACT     CTCGTAAGT
  ATC         TAC`` |
| GAM1483 | DUSP5 | 3' | TGCAAGCCTGGTGACCACTCA | 37407 | ``A         ACGA  G
TG CAAGCCTG    GA CGTTCA
|| ||||||||    || ||||||
AC GTTCGGAC    CT GTGAGT
         CA__  G`` |
| GAM1483 | ATP6V1F | 3' | TGGCAAGCCTGGGGAGAG | 37408 | ``A             AC
TG CAAGCCTG    GAGAG
|| ||||||||    |||||
AC GTTCGGAC    CTCTC
 C           CC`` |
| GAM1483 | DKFZP564C10 | 3' | TGATGGCCTGACGCTCTCTTCA | 37409 | ``    CAA            AGAGCG
TGA    GCCTGACG       TTCA
|||    ||||||||       ||||
ACT    CGGACTGC       AAGT
  AC_            GAGAG_`` |
| GAM1483 | KIAA0561 | 5' | GATGAGCTTGACGAGAGGGT | 37410 | ``   CA   C               C
GA   AGC  TGACGAGAG  GT
||   |||  |||||||||  ||
CT   TCG  ACTGCTCTC  CA
   AC   A               C`` |
| GAM1483 | KIAA0935 | 3' | TGGCAAGCCTGGCAGGGC | 37411 | ``A           A G  A
TG CAAGCCTG  C AG GC
|| ||||||||  | || ||
AC GTTCGGAC  G TC CG
         C    C _ C`` |
| GAM1483 | MIC2L1 | 3' | GACAAGCCTGACAAAGTTCA | 37412 | ``                  AGC
GACAAGCCTGACGAG    GTTCA
|||||||||||||||    |||||
CTGTTCGGACTGTTT    CAAGT
                   ___`` |
| GAM1483 | PPP4R1L | 5' | TGACAAGTCTGATGAAGAGCG | 37413 | ``      C    C
TGACAAG CTGA ¯GAGAGCG
||||||| ||||  |||||||
ACTGTTC GACT  TTCTCGC
      A    AC`` |

TABLE 2-continued

| GENE | TARGET | UTR | SEQUENCE | SEQID | BINDING-SITE |
|------|--------|-----|----------|-------|--------------|
| GAM1483 | ZAK | 3' | TGACAAGCCAGATCAGTTC | 37414 | `TGACAAGCC  TGACG  GC  `<br>`         AGA   GTTC`<br>`|||||||||  |||   ||||`<br>`ACTGTTCGG  TCT   CAAG`<br>`           AGT      ` |
| GAM1483 | LOC149566 | 3' | TGACAAGTTGGGTGAACGTT | 37415 | `         CC   ACGA     `<br>`TGACAAG  TG   GAGCGTT`<br>`|||||||  ||   |||||||`<br>`ACTGTTC  AC   CTTGCAA`<br>`       A_ CCA_       ` |
| GAM1483 | LOC150368 | 3' | TGGCAAGCCTGTGACAGTCTC | 37416 | `   A         AC  G  CG `<br>`TG CAAGCCTG  GA AG  TTC`<br>`|| |||||||||  || ||  |||`<br>`AC GTTCGGAC  CT TC  GAG`<br>`   C         A_ G  A_  ` |
| GAM1483 | LOC255718 | 5' | TGACAGGCCTGAGGGTCC | 37417 | `    A               CGAGA  C`<br>`TGACA GCCTGA       G  GTTC`<br>`||||| ||||||       |  ||||`<br>`ACTGT CGGACT       C  CAGG`<br>`    C               C____ C ` |

FIG. 9 further provides a conceptual description of novel bioinformatically detected regulatory viral gene, referred to here as Viral Genomic Record 4097(VGR4097) viral gene, which encodes an operon-like cluster of novel viral micro RNA-like genes, each of which in turn modulates expression of at least one host target gene, the function and utility of which at least one host target gene is known in the art.

VGR4097 gene, herein designated VGR GENE, is a novel bioinformatically detected regulatory, non protein coding, RNA viral gene. The method by which VGR4097 gene was detected is described hereinabove with reference to FIGS. 6-15.

VGR4097 gene encodes VGR4097 precursor RNA, herein designated VGR PRECURSOR RNA, an RNA molecule, typically several hundred nucleotides long.

VGR4097 precursor RNA folds spatially, forming VGR4097 folded precursor RNA, herein designated VGR FOLDED PRECURSOR RNA. It is appreciated that VGR4097 folded precursor RNA, herein designated VGR FOLDED PRECURSOR RNA, comprises a plurality of what is known in the art as hairpin structures. These hairpin structures are due to the fact that the nucleotide sequence of VGR4097 precursor RNA comprises a plurality of segments, the first half of each such segment having a nucleotide sequence which is at least a partial inversed-reversed sequence of the second half thereof, as is well known in the art.

VGR4097 folded precursor RNA, herein designated VGR FOLDED PRECURSOR RNA, is naturally processed by cellular enzymatic activity into at least 8 separate VGAM precursor RNAs, VGAM1423 precursor RNA, VGAM1483 precursor RNA, VGAM1484 precursor RNA, VGAM1485 precursor RNA, VGAM1524 precursor RNA, VGAM1528 precursor RNA, VGAM1556 precursor RNA and VGAM1557 precursor RNA, herein schematically represented by VGAM1 PRECURSOR, VGAM2 PRECURSOR, VGAM3 PRE-CURSOR, VGAM4 PRECURSOR, VGAM5 PRECURSOR, VGAM6 PRECURSOR, VGAM7 PRECURSOR and VGAM8 PRE-CURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM1423 RNA, VGAM1483 RNA, VGAM1484 RNA, VGAM1485 RNA, VGAM1524 RNA, VGAM1528 RNA, VGAM1556 RNA and VGAM1557 RNA respectively, herein schematically represented by VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8.

VGAM1423 RNA, herein schematically represented by VGAM1 binds complimentarily to a host target binding site located in an untranslated region of VGAM1423 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM1423 host target RNA, herein schematically represented by VGAM1 HOST TARGET RNA into VGAM1423 host target protein, herein schematically represented by VGAM1 HOST TARGET PROTEIN, both of FIG. 1.

VGAM1483 RNA, herein schematically represented by VGAM2 binds complimentarily to a host target binding site located in an untranslated region of VGAM1483 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM1483 host target RNA, herein schematically represented by VGAM2 HOST TARGET RNA into VGAM1483 host target protein, herein schematically represented by VGAM2 HOST TARGET PROTEIN, both of FIG. 1.

VGAM1484 RNA, herein schematically represented by VGAM3 binds complimentarily to a host target binding site located in an untranslated region of VGAM1484 host target RNA, herein schematically represented by VGAM3 HOST TARGET RNA, which host target binding site corresponds to a host target binding site such as BINDING SITE I, BINDING SITE II or BINDING SITE III of FIG. 1, thereby inhibiting translation of VGAM1484 host target RNA, herein schematically represented by VGAM3 HOST TARGET RNA into VGAM1484 host target protein, herein schematically represented by VGAM3 HOST TARGET PROTEIN, both of FIG. 1.

VGAM1485 RNA, herein schematically represented by VGAM4 binds complimentarily to a host target binding site located in an untranslated region of VGAM1485 host target RNA, herein schematically represented by VGAM4 HOST TARGET RNA, which host target binding site corresponds to a host target binding site such as BINDING SITE I, BINDING SITE II or BINDING SITE III of FIG. 1, thereby inhibiting translation of VGAM1485 host target RNA, herein schematically represented by VGAM4 HOST TARGET RNA into VGAM1485 host target protein, herein schematically represented by VGAM4 HOST TARGET PROTEIN, both of FIG. 1.

VGAM1524 RNA, herein schematically represented by VGAM5 binds complimentarily to a host target binding site located in an untranslated region of VGAM1524 host target RNA, herein schematically represented by VGAM5 HOST TARGET RNA, which host target binding site corresponds to a host target binding site such as BINDING SITE I, BINDING SITE II or BINDING SITE III of FIG. 1, thereby inhibiting translation of VGAM1524 host target RNA, herein schematically represented by VGAM5 HOST TARGET RNA into VGAM1524 host target protein, herein schematically represented by VGAM5 HOST TARGET PROTEIN, both of FIG. 1.

VGAM1528 RNA, herein schematically represented by VGAM6 binds complimentarily to a host target binding site located in an untranslated region of VGAM1528 host target RNA, herein schematically represented by VGAM6 HOST TARGET RNA, which host target binding site corresponds to a host target binding site such as BINDING SITE I, BINDING SITE II or BINDING SITE III of FIG. 1, thereby inhibiting translation of VGAM1528 host target RNA, herein schematically represented by VGAM6 HOST TARGET RNA into VGAM1528 host target protein, herein schematically represented by VGAM6 HOST TARGET PROTEIN, both of FIG. 1.

vGAM1556 RNA, herein schematically represented by VGAM7 binds complimentarily to a host target binding site located in an untranslated region of VGAM1556 host target RNA, herein schematically represented by VGAM7 HOST TARGET RNA, which host target binding site corresponds to a host target binding site such as BINDING SITE I, BINDING SITE II or BINDING SITE III of FIG. 1, thereby inhibiting translation of VGAM1556 host target RNA, herein schematically represented by VGAM7 HOST TARGET RNA into VGAM1556 host target protein, herein schematically represented by VGAM7 HOST TARGET PROTEIN, both of FIG. 1.

VGAM1557 RNA, herein schematically represented by VGAM8 binds complimentarily to a host target binding site located in an untranslated region of VGAM1557 host target RNA, herein schematically represented by VGAM8 HOST TARGET RNA, which host target binding site corresponds to a host target binding site such as BINDING SITE I, BINDING SITE II or BINDING SITE III of FIG. 1, thereby inhibiting translation of VGAM1557 host target RNA, herein schematically represented by VGAM8 HOST TARGET RNA into VGAM1557 host target protein, herein schematically represented by VGAM8 HOST TARGET PROTEIN, both of FIG. 1.

It is appreciated that a function of VGR4097 gene, herein designated VGR GENE, is inhibition of expression of host target genes, as part of a novel viral mechanism of attacking a host. Accordingly, utilities of VGR4097 gene include diagnosis, prevention and treatment of viral infection by. Specific functions, and accordingly utilities, of VGR4097 gene, herein designated VGR GENE, correlate with, and may be deduced from, the identity of the host target genes, which are inhibited by VGAM RNAs comprised in the operon-like cluster of VGR4097 gene: VGAM1423 host target protein, VGAM 1483 host target protein, VGAM1484 host target protein, VGAM1485 host target protein, VGAM1524 host target protein, VGAM1528 host target protein, VGAM1556 host target protein and VGAM1557 host target protein, herein schematically represented by VGAM1 HOST TARGET PROTEIN through VGAM HOST TARGET PROTEIN respectively. The function of these host target genes is elaborated hereinabove with reference to VGAM1423, VGAM1483, VGAM1484, VGAM1485, VGAM1524, VGAM1528, VGAM1556 and VGAM1557

SEQUENCE LISTING (86879 sequences)

SEQ ID NO: 1 - DNA, 131 bp, Melanoplus sanguinipes entomopoxvirus
tacatatcttgaatgtgatccattatatattgagtcattagagccattaaaaaatttaaaatatttaattttaaataatattgtaaataatgacattaaattgccaaaatcgattatatatattaaatgta

SEQ ID NO: 2 - DNA, 24 bp, Melanoplus sanguinipes entomopoxvirus
ataatattgtaaataatgacatta

SEQ ID NO: 3 - DNA, 20 bp, Homo sapiens
caatattgagtgatgacatt

SEQ ID NO: 4 - DNA, 23 bp, Homo sapiens
atattgtaaataactttccatta

SEQ ID NO: 5 - DNA, 19 bp, Homo sapiens
tatttcaataatgacatta

SEQ ID NO: 6 - DNA, 21 bp, Homo sapiens
taataattacataatgacatt

SEQ ID NO: 7 - DNA, 21 bp, Homo sapiens
caatacagcataatgacatta

SEQ ID NO: 8 - DNA, 98 bp, Porcine adenovirus A
ccgcgcgcgcatgactacctgggccaggttgagcgccaccaggcggttgaagggcgcctgcaggcgcagggcgtggtgcaggtagttgagggtggtgg

SEQ ID NO: 9 - DNA, 24 bp, Porcine adenovirus A
catgactacctgggccaggttgag

SEQ ID NO: 10 - DNA, 22 bp, Homo sapiens
atggccacctggaacaaggttg

SEQ ID NO: 11 - DNA, 20 bp, Homo sapiens
tggctgcctgggccctgctg

SEQ ID NO: 12 - DNA, 22 bp, Homo sapiens
atgctatgcacctcaggttgag

SEQ ID NO: 13 - DNA, 17 bp, Homo sapiens
tgactcaggccaggttg

SEQ ID NO: 14 - DNA, 19 bp, Homo sapiens
atgctcctgggccgggttg

SEQ ID NO: 15 - DNA, 23 bp, Homo sapiens
tgaggtccgcgggccaggttgag

SEQ ID NO: 16 - DNA, 21 bp, Homo sapiens
atgactgcctgggcctcagag

SEQ ID NO: 17 - DNA, 24 bp, Homo sapiens
catggccgtggcccacaggttgag

SEQ ID NO: 18 - DNA, 19 bp, Homo sapiens
atgattacctgagtcctgg

SEQ ID NO: 19 - DNA, 19 bp, Homo sapiens
catgtctgcctgggcctga

SEQ ID NO: 20 - DNA, 17 bp, Homo sapiens
catgctgacccaggttg

SEQ ID NO: 21 - DNA, 19 bp, Homo sapiens
tggctacctggctaggttg

SEQ ID NO: 22 - DNA, 64 bp, Porcine adenovirus A
tcaataatataccgcacacttttattgccccttttgtggcgtggtgattggcggagagggttgg

SEQ ID NO: 23 - DNA, 24 bp, Porcine adenovirus A
taccgcacacttttattgcccctt

SEQ ID NO: 24 - DNA, 22 bp, Homo sapiens
gctgtcagccccattgtccctt

SEQ ID NO: 25 - DNA, 19 bp, Homo sapiens
ccgcacccctctgctcctt

SEQ ID NO: 26 - DNA, 22 bp, Homo sapiens
caccgggcaatttattgctctt

SEQ ID NO: 27 - DNA, 19 bp, Homo sapiens
acactactgcctgtccctt

SEQ ID NO: 28 - DNA, 16 bp, Homo sapiens
cctacacaccactgcc

SEQ ID NO: 29 - DNA, 23 bp, Homo sapiens
cactgcacattagccagcccctt

SEQ ID NO: 30 - DNA, 20 bp, Homo sapiens
gcactgcccatttgcccctt

SEQ ID NO: 31 - DNA, 23 bp, Homo sapiens
gctgtatacttcacctgcccctt

SEQ ID NO: 32 - DNA, 24 bp, Homo sapiens
cgctgtatacttcacctgcccctt

SEQ ID NO: 33 - DNA, 20 bp, Homo sapiens
cctgcgctccggtgcccctt

SEQ ID NO: 34 - DNA, 17 bp, Homo sapiens
acactttttgcagcctt

SEQ ID NO: 35 - DNA, 23 bp, Homo sapiens
tactgcccactttgcctctcctt

SEQ ID NO: 36 - DNA, 20 bp, Homo sapiens
ccgtacactcctctcctctt

SEQ ID NO: 37 - DNA, 16 bp, Homo sapiens
caccgcacgttttccc

SEQ ID NO: 38 - DNA, 18 bp, Homo sapiens
acactttttggacccctt

SEQ ID NO: 39 - DNA, 94 bp, Equine herpesvirus 2
cactctgttacccctttttaactctctaacatttttctttgttttataagatataggcccaggaagatattcatttggaggggtgaactgaatg

SEQ ID NO: 40 - DNA, 24 bp, Equine herpesvirus 2
tgttacccctttttaactctctaa

SEQ ID NO: 41 - DNA, 23 bp, Homo sapiens
tgttaccctttttgatttttcta

SEQ ID NO: 42 - DNA, 17 bp, Homo sapiens
tgtatcccttttactct

SEQ ID NO: 43 - DNA, 17 bp, Homo sapiens
gttacttttcctctcta

SEQ ID NO: 44 - DNA, 22 bp, Homo sapiens
tgtatgccctttctcactgtct

SEQ ID NO: 45 - DNA, 23 bp, Homo sapiens
tgttatcccttctacatttctaa

SEQ ID NO: 46 - DNA, 18 bp, Homo sapiens
tgctactccaactctcta

SEQ ID NO: 47 - DNA, 17 bp, Homo sapiens
tgtttccctctttctct

SEQ ID NO: 48 - DNA, 21 bp, Homo sapiens
tgctacccctccagtttctct

SEQ ID NO: 49 - DNA, 16 bp, Homo sapiens
tgctacccttttttct

SEQ ID NO: 50 - DNA, 19 bp, Homo sapiens
gttaccctttttaaaatct

SEQ ID NO: 51 - DNA, 18 bp, Homo sapiens
tgttcccttaaccctcta

SEQ ID NO: 52 - DNA, 18 bp, Homo sapiens
tgtagtccctttctctct

SEQ ID NO: 53 - DNA, 18 bp, Homo sapiens
tgttgcccttttataacc

SEQ ID NO: 54 - DNA, 19 bp, Homo sapiens
ccctttttaggttcctcta

SEQ ID NO: 55 - DNA, 21 bp, Homo sapiens
tgttgctccttttcagtccct

SEQ ID NO: 56 - DNA, 20 bp, Homo sapiens
tattacccctttcgaactct

SEQ ID NO: 57 - DNA, 20 bp, Homo sapiens
tgttccaatcagctctctaa

SEQ ID NO: 58 - DNA, 20 bp, Homo sapiens
tgttgtccctctttattcta

SEQ ID NO: 59 - DNA, 21 bp, Homo sapiens
tgttaaccctttagatctcta

SEQ ID NO: 60 - DNA, 21 bp, Homo sapiens
tgtttccttgttactctctaa

SEQ ID NO: 61 - DNA, 17 bp, Homo sapiens
tgtgcccctctccttct

SEQ ID NO: 62 - DNA, 25 bp, Homo sapiens
tgtcatctctttttaatctttctaa

SEQ ID NO: 63 - DNA, 17 bp, Homo sapiens
tgttccctttccattct

SEQ ID NO: 64 - DNA, 18 bp, Homo sapiens
ctttttaaacttctctaa

SEQ ID NO: 65 - DNA, 76 bp, Alcelaphine herpesvirus 1
ttctgcacaagacagattgagcaaggatctccgttttaccacacacagatcctaacccaatctatcttacacagaa

SEQ ID NO: 66 - DNA, 24 bp, Alcelaphine herpesvirus 1
acagatcctaacccaatctatctt

SEQ ID NO: 67 - DNA, 22 bp, Homo sapiens
aggtcctaccccaacgacactt

SEQ ID NO: 68 - DNA, 19 bp, Homo sapiens
aatcctataggtctatctt

SEQ ID NO: 69 - DNA, 15 bp, Homo sapiens
acagatcatccatct

SEQ ID NO: 70 - DNA, 20 bp, Homo sapiens
acagatccctccacatctat

SEQ ID NO: 71 - DNA, 18 bp, Homo sapiens
tcctaacctccccttctt

SEQ ID NO: 72 - DNA, 17 bp, Homo sapiens
acagatcccaacactac

SEQ ID NO: 73 - DNA, 23 bp, Homo sapiens
caggttttaagccagtccacctt

SEQ ID NO: 74 - DNA, 21 bp, Homo sapiens
cagaccctggtccaccttctt

SEQ ID NO: 75 - DNA, 20 bp, Homo sapiens
gatcctaatttttccatctt

SEQ ID NO: 76 - DNA, 24 bp, Homo sapiens
acagcatctattacaatctatctt

SEQ ID NO: 77 - DNA, 15 bp, Homo sapiens
gatcctacaatctat

SEQ ID NO: 78 - DNA, 22 bp, Homo sapiens
acagatcctggttcaaatccca

SEQ ID NO: 79 - DNA, 96 bp, Alcelaphine herpesvirus 1
tgtagcatgtttaaaaaagtaacaagtcaccgcctcatcacctgctgtgtttaaggtaggttttgggggcttactgcttttttaaaaaaatttata

SEQ ID NO: 80 - DNA, 24 bp, Alcelaphine herpesvirus 1
aaagtaacaagtcaccgcctcatc

SEQ ID NO: 81 - DNA, 18 bp, Homo sapiens
aaagcaacaagtcatcac

SEQ ID NO: 82 - DNA, 18 bp, Homo sapiens
aaagaacaagtcacctct

SEQ ID NO: 83 - DNA, 20 bp, Homo sapiens
aaagtaacaagtgtcgtgtc

SEQ ID NO: 84 - DNA, 21 bp, Homo sapiens
gtaacaagtccacttgtacac

SEQ ID NO: 85 - DNA, 21 bp, Homo sapiens
aaagtggcagatgacctcatc

SEQ ID NO: 86 - DNA, 18 bp, Homo sapiens
aaagggacaagtcatcat

SEQ ID NO: 87 - DNA, 21 bp, Homo sapiens
aataacaagtcacagtgcatc

SEQ ID NO: 88 - DNA, 17 bp, Homo sapiens
gttacaagtcagccgtc

SEQ ID NO: 89 - DNA, 20 bp, Homo sapiens
aaagtaacaacgactctcat

SEQ ID NO: 90 - DNA, 19 bp, Homo sapiens
aaaataacaagttgcccac

SEQ ID NO: 91 - DNA, 19 bp, Homo sapiens
aacagtggctccgcctcat

SEQ ID NO: 92 - DNA, 19 bp, Homo sapiens
ggagtaaaccacaccgcct

SEQ ID NO: 93 - DNA, 18 bp, Homo sapiens
aaagcaacaagttatcct

SEQ ID NO: 94 - DNA, 21 bp, Homo sapiens
aagaaacaagtcatttgcatc

SEQ ID NO: 95 - DNA, 73 bp, Porcine adenovirus A
cggtgtcgcgcagggcgtagagcttgggggcgagcaggaccgtctcggagctgtgggcgtcgctgcggcagcg

SEQ ID NO: 96 - DNA, 24 bp, Porcine adenovirus A
tcggagctgtgggcgtcgctgcgg

SEQ ID NO: 97 - DNA, 16 bp, Homo sapiens
ggcgctgtccgctgcg

SEQ ID NO: 98 - DNA, 18 bp, Homo sapiens
gggctgtggcccctgtgg

SEQ ID NO: 99 - DNA, 18 bp, Homo sapiens
tcggggctggggcttgcg

SEQ ID NO: 100 - DNA, 23 bp, Homo sapiens
tcggggctgtggcctccaagcgg

SEQ ID NO: 101 - DNA, 16 bp, Homo sapiens
ggagctgtgagtgctg

SEQ ID NO: 102 - DNA, 21 bp, Homo sapiens
cgggccggggcgtcgctgcgg

SEQ ID NO: 103 - DNA, 16 bp, Homo sapiens
ccggagccgtcgctgc

SEQ ID NO: 104 - DNA, 22 bp, Homo sapiens
ccggagctggcgctcgctgtgg

SEQ ID NO: 105 - DNA, 23 bp, Homo sapiens
tcgagaggccggcgtcgctgcgg

SEQ ID NO: 106 - DNA, 16 bp, Homo sapiens
gggcaggcgtcgctgg

SEQ ID NO: 107 - DNA, 19 bp, Homo sapiens
tcggggcgtgtgggtggcg

SEQ ID NO: 108 - DNA, 19 bp, Homo sapiens
gctgtggacagagctgtgg

SEQ ID NO: 109 - DNA, 18 bp, Homo sapiens
tcggagctgagggcagcg

SEQ ID NO: 110 - DNA, 19 bp, Homo sapiens
tcgaagctgtgggactgcg

SEQ ID NO: 111 - DNA, 19 bp, Homo sapiens
ggagctgtggctgaagctg

SEQ ID NO: 112 - DNA, 22 bp, Homo sapiens
ggggctgtggctccggctgtgg

SEQ ID NO: 113 - DNA, 62 bp, Porcine adenovirus A
ccacgggcccggtgactcggaacctgaaagagagttccacggaatcaatgtcggcatcgtgg

SEQ ID NO: 114 - DNA, 24 bp, Porcine adenovirus A
ttccacggaatcaatgtcggcatc

SEQ ID NO: 115 - DNA, 17 bp, Homo sapiens
tcccacggagtctcggc

SEQ ID NO: 116 - DNA, 19 bp, Homo sapiens
ttccacgggaccatgtgtc

SEQ ID NO: 117 - DNA, 15 bp, Homo sapiens
ggatctgtcggcatc

SEQ ID NO: 118 - DNA, 20 bp, Homo sapiens
ttccatgaatcaatactgtc

SEQ ID NO: 119 - DNA, 17 bp, Homo sapiens
tcccacggggtcgcagc

SEQ ID NO: 120 - DNA, 22 bp, Homo sapiens
tcccacacctcttcagtgttgg

SEQ ID NO: 121 - DNA, 88 bp, Equine herpesvirus 2
ttcataaaccctcgctcaccatctatcaaaaaacaagcaaaagtttcagctcactttaacttgttgcctcagctaaaggttttgtgga

SEQ ID NO: 122 - DNA, 24 bp, Equine herpesvirus 2
taacttgttgcctcagctaaaggt

SEQ ID NO: 123 - DNA, 15 bp, Homo sapiens
aacttgttgtcagag

SEQ ID NO: 124 - DNA, 19 bp, Homo sapiens
gctcctcttggctaaaggt

SEQ ID NO: 125 - DNA, 20 bp, Homo sapiens
caacttgttgtctcagtaag

SEQ ID NO: 126 - DNA, 25 bp, Homo sapiens
taatttgttaccttagagctttggt

SEQ ID NO: 127 - DNA, 21 bp, Homo sapiens
taacttgctgccagttaaggt

SEQ ID NO: 128 - DNA, 19 bp, Homo sapiens
taacttgtagcctcagtaa

SEQ ID NO: 129 - DNA, 18 bp, Homo sapiens
taacttgttgcagaaagg

SEQ ID NO: 130 - DNA, 18 bp, Homo sapiens
taacttgttgattcagct

SEQ ID NO: 131 - DNA, 16 bp, Homo sapiens
cctgttgctcctaggt

SEQ ID NO: 132 - DNA, 20 bp, Homo sapiens
ttgtttccatcagctaaggt

SEQ ID NO: 133 - DNA, 20 bp, Homo sapiens
caactaaattcagctgaggt

SEQ ID NO: 134 - DNA, 24 bp, Homo sapiens
ttgttgccttcctttgctggaggt

SEQ ID NO: 135 - DNA, 60 bp, Melanoplus sanguinipes entomopoxvirus
gttaaataaaaatataaatgttatatgttaaaatgtgaaattatatatcatttgtttaat

SEQ ID NO: 136 - DNA, 24 bp, Melanoplus sanguinipes entomopoxvirus
tgaaattatatatcatttgtttaa

SEQ ID NO: 137 - DNA, 19 bp, Homo sapiens
aaattatatatcatttatt

SEQ ID NO: 138 - DNA, 19 bp, Homo sapiens
tgaaattatatatgatgtt

SEQ ID NO: 139 - DNA, 84 bp, Alcelaphine herpesvirus 1
gcagatcttatgcttgtcagttaaagcccggaatgtttttttttaattaacaattcctgctgtaactgacacaacaaaatctgc

SEQ ID NO: 140 - DNA, 24 bp, Alcelaphine herpesvirus 1
ttaaagcccggaatgttttttttt

SEQ ID NO: 141 - DNA, 24 bp, Homo sapiens
ttaaagcttggctggctttttttt

SEQ ID NO: 142 - DNA, 20 bp, Homo sapiens
ttaaagttttggaatgtttt

SEQ ID NO: 143 - DNA, 21 bp, Homo sapiens
tcaaagcctggagatgttttt

SEQ ID NO: 144 - DNA, 17 bp, Homo sapiens
agccccaattttttttt

SEQ ID NO: 145 - DNA, 19 bp, Homo sapiens
gcagagaatgttttttttt

SEQ ID NO: 146 - DNA, 15 bp, Homo sapiens
cccaggttttttttt

SEQ ID NO: 147 - DNA, 19 bp, Homo sapiens
aaagtccggaaagcttttt

SEQ ID NO: 148 - DNA, 17 bp, Homo sapiens
agcccctgctttttttt

SEQ ID NO: 149 - DNA, 25 bp, Homo sapiens
ttaaagccctggagcattttttttt

SEQ ID NO: 150 - DNA, 18 bp, Homo sapiens
aagccacgagtttttttt

SEQ ID NO: 151 - DNA, 70 bp, Alcelaphine herpesvirus 1
gtagctagggtggtgagtggcgctcgcagcagctagtgagctgctgagcaacactccctgccccagctac

SEQ ID NO: 152 - DNA, 24 bp, Alcelaphine herpesvirus 1
tggtgagtggcgctcgcagcagct

SEQ ID NO: 153 - DNA, 20 bp, Homo sapiens
tggtgggtggcgcagcagct

SEQ ID NO: 154 - DNA, 20 bp, Homo sapiens
ggtgagtgtgtgcagcagct

SEQ ID NO: 155 - DNA, 22 bp, Homo sapiens
tggtggtggaaggacagcagct

SEQ ID NO: 156 - DNA, 19 bp, Homo sapiens
tggtggtggcaacagcagc

SEQ ID NO: 157 - DNA, 16 bp, Homo sapiens
tggtgagtggcagcag

SEQ ID NO: 158 - DNA, 19 bp, Homo sapiens
agtgagtgggtcagcggct

SEQ ID NO: 159 - DNA, 22 bp, Homo sapiens
tggcgagtggcccacagtggct

SEQ ID NO: 160 - DNA, 19 bp, Homo sapiens
tggtcagtggcagcaacag

SEQ ID NO: 161 - DNA, 23 bp, Homo sapiens
tggtgagggcttaagcagcagct

SEQ ID NO: 162 - DNA, 22 bp, Homo sapiens
tggtgagctgggaacagtggct

SEQ ID NO: 163 - DNA, 21 bp, Homo sapiens
tggtcagtgctcgcagtggct

SEQ ID NO: 164 - DNA, 83 bp, Porcine adenovirus A
gggtgtggtccggaccgctgcggtagttgccctcgcagatctgggtctcccaggcgactacctcctgcggggggatcatgtcc

SEQ ID NO: 165 - DNA, 24 bp, Porcine adenovirus A
tcccaggcgactacctcctgcggg

SEQ ID NO: 166 - DNA, 18 bp, Homo sapiens
tctcaggcgactgccgcg

SEQ ID NO: 167 - DNA, 23 bp, Homo sapiens
tcctgggcactgcttctcccggg

SEQ ID NO: 168 - DNA, 21 bp, Homo sapiens
tcccaggcactgtcacgtggg

SEQ ID NO: 169 - DNA, 19 bp, Homo sapiens
ggcatagacctcctgtggg

SEQ ID NO: 170 - DNA, 16 bp, Homo sapiens
agggacctcctgcggg

SEQ ID NO: 171 - DNA, 19 bp, Homo sapiens
tcccaggcaggctagcagg

SEQ ID NO: 172 - DNA, 22 bp, Homo sapiens
tcccaggccactgcctctaaac

SEQ ID NO: 173 - DNA, 21 bp, Homo sapiens
tcccaggcagctgctggcagg

SEQ ID NO: 174 - DNA, 23 bp, Homo sapiens
cccaggcggctatggggtgtggg

SEQ ID NO: 175 - DNA, 21 bp, Homo sapiens
ccccaggcgagaccctgtggg

SEQ ID NO: 176 - DNA, 19 bp, Homo sapiens
tcccaggcggttcccaagg

SEQ ID NO: 177 - DNA, 23 bp, Homo sapiens
tcccaggtgctgtttctcacaag

SEQ ID NO: 178 - DNA, 19 bp, Homo sapiens
tcccaggcgctgcctggcc

SEQ ID NO: 179 - DNA, 97 bp, Equine herpesvirus 2
gcgcaaaagacccctagggagaggaggtaagctaggtgtgtgtttaataaccatcacctgtttatagtctctaaccaggatatattcatttttaagc

SEQ ID NO: 180 - DNA, 24 bp, Equine herpesvirus 2
tttatagtctctaaccaggatata

SEQ ID NO: 181 - DNA, 17 bp, Homo sapiens
tttacagttctcacagg

SEQ ID NO: 182 - DNA, 19 bp, Homo sapiens
tagcaacctgcaggatata

SEQ ID NO: 183 - DNA, 18 bp, Homo sapiens
ttcatagtgtcaggatat

SEQ ID NO: 184 - DNA, 24 bp, Homo sapiens
ttatagaaacttaaccaggatata

SEQ ID NO: 185 - DNA, 19 bp, Homo sapiens
tttatagtttttccaggat

SEQ ID NO: 186 - DNA, 21 bp, Homo sapiens
tttactggtcatcaggatata

SEQ ID NO: 187 - DNA, 21 bp, Homo sapiens
tttatagctctgacagcccat

SEQ ID NO: 188 - DNA, 64 bp, Melanoplus sanguinipes entomopoxvirus
tcgtgaattttgattttttaaaaccattaactaatttaaaaagtttaattattccaaataatga

SEQ ID NO: 189 - DNA, 24 bp, Melanoplus sanguinipes entomopoxvirus
taaaaagtttaattattccaaata

SEQ ID NO: 190 - DNA, 19 bp, Homo sapiens
aaaattattattccaaata

SEQ ID NO: 191 - DNA, 18 bp, Homo sapiens
aaaaatttaaaccttcca

SEQ ID NO: 192 - DNA, 21 bp, Homo sapiens
aaaagtcttggattccaaata

SEQ ID NO: 193 - DNA, 20 bp, Homo sapiens
aaagtttcttcttccaaata

SEQ ID NO: 194 - DNA, 22 bp, Homo sapiens
aaaagtttggtttgtccaaata

SEQ ID NO: 195 - DNA, 19 bp, Homo sapiens
aaaaatctaattccaaata

SEQ ID NO: 196 - DNA, 20 bp, Homo sapiens
aaagacccttattccaaata

SEQ ID NO: 197 - DNA, 20 bp, Homo sapiens
aaaatctcttattccaaata

SEQ ID NO: 198 - DNA, 20 bp, Homo sapiens
aaagtccctaattccaaata

SEQ ID NO: 199 - DNA, 18 bp, Homo sapiens
aagttctaattccaaata

SEQ ID NO: 200 - DNA, 19 bp, Homo sapiens
aaaaatacccattccaaat

SEQ ID NO: 201 - DNA, 20 bp, Homo sapiens
aaaaattccaaattccaaat

SEQ ID NO: 202 - DNA, 26 bp, Homo sapiens
taaaaagttctagaaatgcccaaata

SEQ ID NO: 203 - DNA, 92 bp, Alcelaphine herpesvirus 1
aggtgagctccacgtaggatagcttaagatacaatctcagtttatacaacactacagagagcaccttaagctatcatacctaaaacacacct

SEQ ID NO: 204 - DNA, 24 bp, Alcelaphine herpesvirus 1
agagagcaccttaagctatcatac

SEQ ID NO: 205 - DNA, 22 bp, Homo sapiens
agggagcaccctgagcttgcat

SEQ ID NO: 206 - DNA, 22 bp, Homo sapiens
aagagcactttaattcacatac

SEQ ID NO: 207 - DNA, 18 bp, Homo sapiens
gagagcacctttcaccat

SEQ ID NO: 208 - DNA, 22 bp, Homo sapiens
agagagcacttaagattcatac

SEQ ID NO: 209 - DNA, 18 bp, Homo sapiens
gagcacctgaggctccat

SEQ ID NO: 210 - DNA, 23 bp, Homo sapiens
gatagcattttcaaatatcatac

SEQ ID NO: 211 - DNA, 18 bp, Homo sapiens
agaggacaccatatcata

SEQ ID NO: 212 - DNA, 23 bp, Homo sapiens
agagcacctggtaattgtcatac

SEQ ID NO: 213 - DNA, 19 bp, Homo sapiens
agggagcacctgggtaagc

SEQ ID NO: 214 - DNA, 18 bp, Homo sapiens
gagagcactttaacctat

SEQ ID NO: 215 - DNA, 20 bp, Homo sapiens
agagagcattttagttctat

SEQ ID NO: 216 - DNA, 23 bp, Homo sapiens
agagagcaccttgcagggactac

SEQ ID NO: 217 - DNA, 17 bp, Homo sapiens
gagacacagactatcat

SEQ ID NO: 218 - DNA, 20 bp, Homo sapiens
aaagagcattttctcttcat

SEQ ID NO: 219 - DNA, 18 bp, Homo sapiens
gagagcacttttcaccat

SEQ ID NO: 220 - DNA, 19 bp, Homo sapiens
gaggcaccttaaatgcata

SEQ ID NO: 221 - DNA, 65 bp, Alcelaphine herpesvirus 1
ttgctcaacattttaattttatctttaatgttaacattttaaactgcagttaaaagttttagtaa

SEQ ID NO: 222 - DNA, 24 bp, Alcelaphine herpesvirus 1
tttaattttatctttaatgttaac

SEQ ID NO: 223 - DNA, 23 bp, Homo sapiens
tttaattttacctgatacgttaa

SEQ ID NO: 224 - DNA, 22 bp, Homo sapiens
ttaagttttatctttcttgcta

SEQ ID NO: 225 - DNA, 65 bp, Porcine adenovirus A
agagggcgttggagagaagcttggcgatgctgcggagcgtttggtttctgtcccggtcggccttt

SEQ ID NO: 226 - DNA, 24 bp, Porcine adenovirus A
tggagagaagcttggcgatgctgc

SEQ ID NO: 227 - DNA, 19 bp, Homo sapiens
tggagggaagcttgggctg

SEQ ID NO: 228 - DNA, 19 bp, Homo sapiens
tggggagaaacaaatgctg

SEQ ID NO: 229 - DNA, 23 bp, Homo sapiens
tgggcagaggccagggatgctgc

SEQ ID NO: 230 - DNA, 17 bp, Homo sapiens
tggggaggacgctgctg

SEQ ID NO: 231 - DNA, 23 bp, Homo sapiens
tggggagaaggtagagatgctgc

SEQ ID NO: 232 - DNA, 19 bp, Homo sapiens
tggagtggaggggatgctg

SEQ ID NO: 233 - DNA, 20 bp, Homo sapiens
tggggaggactcacttgctg

SEQ ID NO: 234 - DNA, 18 bp, Homo sapiens
tggagagagccagtgctg

SEQ ID NO: 235 - DNA, 21 bp, Homo sapiens
ggggagaaggagggatgctgc

SEQ ID NO: 236 - DNA, 19 bp, Homo sapiens
tggagagaggcctgggtgc

SEQ ID NO: 237 - DNA, 20 bp, Homo sapiens
tggtgaggatgacgatgctg

SEQ ID NO: 238 - DNA, 23 bp, Homo sapiens
tggagagacagcttggtgaaagc

SEQ ID NO: 239 - DNA, 19 bp, Homo sapiens
tggagagaggcctcagctg

SEQ ID NO: 240 - DNA, 24 bp, Homo sapiens
tggagagagggaggcagggtgctg

SEQ ID NO: 241 - DNA, 25 bp, Homo sapiens
tgggaagaagcttgttgtgcagcac

SEQ ID NO: 242 - DNA, 19 bp, Homo sapiens
tggagagagcctcttgctg

SEQ ID NO: 243 - DNA, 23 bp, Homo sapiens
tggagtggggcgaaggatgctgc

SEQ ID NO: 244 - DNA, 22 bp, Homo sapiens
tggggagaagcccccagtgctg

SEQ ID NO: 245 - DNA, 22 bp, Homo sapiens
tggggagggcccagcgtgctgc

SEQ ID NO: 246 - DNA, 19 bp, Homo sapiens
tgaagagaggcttcagctg

SEQ ID NO: 247 - DNA, 23 bp, Homo sapiens
tgggtggaagccagggatgctgc

SEQ ID NO: 248 - DNA, 25 bp, Homo sapiens
tggagagaggttatcaaaggtgctg

SEQ ID NO: 249 - DNA, 16 bp, Homo sapiens
ggaaagaaagatgctg

SEQ ID NO: 250 - DNA, 23 bp, Homo sapiens
tgggtagaggccagcgatgctgc

SEQ ID NO: 251 - DNA, 18 bp, Homo sapiens
tggagagaggctggcggc

SEQ ID NO: 252 - DNA, 23 bp, Homo sapiens
tgggggaaggtttataatgctgc

SEQ ID NO: 253 - DNA, 25 bp, Homo sapiens
tggggggaagcttgttgcgcagcac

SEQ ID NO: 254 - DNA, 24 bp, Homo sapiens
tgggagggggtgggctgatgctgc

SEQ ID NO: 255 - DNA, 21 bp, Homo sapiens
tgggagaagctgcgagtgctg

SEQ ID NO: 256 - DNA, 25 bp, Homo sapiens
tgggcagaagcttgttgtgcagcac

SEQ ID NO: 257 - DNA, 20 bp, Homo sapiens
ggagagaggacagatgctgc

SEQ ID NO: 258 - DNA, 21 bp, Homo sapiens
tggagagaaattagaagtgtg

SEQ ID NO: 259 - DNA, 22 bp, Homo sapiens
tggggggatgcttggcatggcc

SEQ ID NO: 260 - DNA, 24 bp, Homo sapiens
tggggaggagcctggcctctcctg

SEQ ID NO: 261 - DNA, 19 bp, Homo sapiens
tggggggatgcttggcagc

SEQ ID NO: 262 - DNA, 97 bp, Melanoplus sanguinipes entomopoxvirus
ccattaaataaattaaaaaaattggaaatattggaatgtaatcattttaatatagaaaaacatacattaccaaattcaattactagtttatcattgg

SEQ ID NO: 263 - DNA, 24 bp, Melanoplus sanguinipes entomopoxvirus
taaattaaaaaaattggaaatatt

SEQ ID NO: 264 - DNA, 21 bp, Homo sapiens
atgaaaaaaattggaagtatt

SEQ ID NO: 265 - DNA, 20 bp, Homo sapiens
ttaaaaaaatagaaaatatt

SEQ ID NO: 266 - DNA, 27 bp, Homo sapiens
taaattaaaaggatcactggaagtatt

SEQ ID NO: 267 - DNA, 25 bp, Homo sapiens
aattaaaaaattaaaaggaaatatt

SEQ ID NO: 268 - DNA, 104 bp, Alcelaphine herpesvirus 1
ggtgagaaaggcttttcacgcatacttgcactgtcagcagttattgtattcctaacaccaacacataactactgatggtgctcaacatgcgtgcgccaaacacc

SEQ ID NO: 269 - DNA, 24 bp, Alcelaphine herpesvirus 1
atggtgctcaacatgcgtgcgcca

SEQ ID NO: 270 - DNA, 21 bp, Homo sapiens
cggtgctcagtgcccggcgcc

SEQ ID NO: 271 - DNA, 17 bp, Homo sapiens
tggagctcggcgtgcgc

SEQ ID NO: 272 - DNA, 22 bp, Homo sapiens
tggtgttacggtgagcacgcca

SEQ ID NO: 273 - DNA, 20 bp, Homo sapiens
tggtgctctggccccgcgcc

SEQ ID NO: 274 - DNA, 20 bp, Homo sapiens
gtgctcagcgtacacagcca

SEQ ID NO: 275 - DNA, 20 bp, Homo sapiens
atggtgctcagtgagcgccc

SEQ ID NO: 276 - DNA, 19 bp, Homo sapiens
atggtgctggttgtgcgcc

SEQ ID NO: 277 - DNA, 19 bp, Homo sapiens
ggtgctcagtccatggtgc

SEQ ID NO: 278 - DNA, 20 bp, Homo sapiens
atggtgctccatgctctgtg

SEQ ID NO: 279 - DNA, 18 bp, Homo sapiens
atgttgctcagcatgcac

SEQ ID NO: 280 - DNA, 19 bp, Homo sapiens
gtgcttaacaaatacgcca

SEQ ID NO: 281 - DNA, 18 bp, Homo sapiens
tggcgctcggctgcgcgc

SEQ ID NO: 282 - DNA, 20 bp, Homo sapiens
ggtgctcagcgtcagcggcc

SEQ ID NO: 283 - DNA, 19 bp, Homo sapiens
atggcgctcagcagccgcc

SEQ ID NO: 284 - DNA, 25 bp, Homo sapiens
tggtgccatctgcacatgcgtgtgc

SEQ ID NO: 285 - DNA, 16 bp, Homo sapiens
tggtgctcatgcgtgc

SEQ ID NO: 286 - DNA, 20 bp, Homo sapiens
acggtgctcagcaggaatgc

SEQ ID NO: 287 - DNA, 20 bp, Homo sapiens
tgggcccggcatgcgtgcgc

SEQ ID NO: 288 - DNA, 18 bp, Homo sapiens
atgctgttcaacatgaca

SEQ ID NO: 289 - DNA, 18 bp, Homo sapiens
atggtgcttgccgctgcc

SEQ ID NO: 290 - DNA, 15 bp, Homo sapiens
atggtgcttacgtgc

SEQ ID NO: 291 - DNA, 18 bp, Homo sapiens
atggttttcaacatgtgt

SEQ ID NO: 292 - DNA, 20 bp, Homo sapiens
tggtgcttcccacgtgcgcc

SEQ ID NO: 293 - DNA, 19 bp, Homo sapiens
atggtcttggccgcgcgcc

SEQ ID NO: 294 - DNA, 23 bp, Homo sapiens
gtgctcaatgctatggtgcgtca

SEQ ID NO: 295 - DNA, 18 bp, Homo sapiens
atggcgctcgatgacgcc

SEQ ID NO: 296 - DNA, 21 bp, Homo sapiens
atggtgctcaatggggctcca

SEQ ID NO: 297 - DNA, 18 bp, Homo sapiens
tgtgcgccctgcgtgcgc

SEQ ID NO: 298 - DNA, 129 bp, Alcelaphine herpesvirus 1
gaaactttaaaatttatattcatgtaaagttttaagcttacaaaattaaatcagggcttcaaaaaagattgtttttctagtatatgttttgtagatgttttaagcttacagattttaaattagggcttc

SEQ ID NO: 299 - DNA, 24 bp, Alcelaphine herpesvirus 1
ttcatgtaaagttttaagcttaca

SEQ ID NO: 300 - DNA, 17 bp, Homo sapiens
ttctgtaaagttcttgc

SEQ ID NO: 301 - DNA, 17 bp, Homo sapiens
ttctgtatcttaagctt

SEQ ID NO: 302 - DNA, 20 bp, Homo sapiens
atgctaaagaatagcttaca

SEQ ID NO: 303 - DNA, 23 bp, Homo sapiens
ttcctgtgaattcagagcttaca

SEQ ID NO: 304 - DNA, 23 bp, Homo sapiens
ttcatgtagagtaacattttaca

SEQ ID NO: 305 - DNA, 22 bp, Homo sapiens
ttcatgtaaagttttcattaca

SEQ ID NO: 306 - DNA, 20 bp, Homo sapiens
ttcatgtacagttttgaagc

SEQ ID NO: 307 - DNA, 21 bp, Homo sapiens
ctcaagatagttttaagctta

SEQ ID NO: 308 - DNA, 20 bp, Homo sapiens
catgtaaagttttctcccta

SEQ ID NO: 309 - DNA, 19 bp, Homo sapiens
ttcacttattttaagctta

SEQ ID NO: 310 - DNA, 20 bp, Homo sapiens
tattgagtggaaagcttaca

SEQ ID NO: 311 - DNA, 130 bp, Porcine adenovirus A
tgcagcagatgtgccacgggcacgtcccggtcggcgtccaggtgggtgcgaccgtagccccgcagggggcgcagcagcgccaggtcggccaccacgcgctcggccaggatggcctgctgcatgcgctgca

SEQ ID NO: 312 - DNA, 24 bp, Porcine adenovirus A
aggtgggtgcgaccgtagccccgc

SEQ ID NO: 313 - DNA, 21 bp, Homo sapiens
gtgggtgacacgtggccccgc

SEQ ID NO: 314 - DNA, 21 bp, Homo sapiens
agctgggtgcgggcttcctgc

SEQ ID NO: 315 - DNA, 19 bp, Homo sapiens
gtgggtgcggcgccctcgc

SEQ ID NO: 316 - DNA, 18 bp, Homo sapiens
agtgccgactgtggcccg

SEQ ID NO: 317 - DNA, 19 bp, Homo sapiens
ggtgagtgtggctgccacg

SEQ ID NO: 318 - DNA, 20 bp, Homo sapiens
ggtgggtgtgggctgcccgc

SEQ ID NO: 319 - DNA, 21 bp, Homo sapiens
aggtgggtggcgggtccctgc

SEQ ID NO: 320 - DNA, 16 bp, Homo sapiens
gtgggtgcgcgccccg

SEQ ID NO: 321 - DNA, 20 bp, Homo sapiens
gggggtggccatagccctgc

SEQ ID NO: 322 - DNA, 15 bp, Homo sapiens
ggtggggccagcccc

SEQ ID NO: 323 - DNA, 21 bp, Homo sapiens
agggggtgcaagaagccctgc

SEQ ID NO: 324 - DNA, 25 bp, Homo sapiens
aggtgggtgctggcagctgtcctgc

SEQ ID NO: 325 - DNA, 20 bp, Homo sapiens
ggtaggtgcgacttcattcc

SEQ ID NO: 326 - DNA, 18 bp, Homo sapiens
ggtgggtgcgatcgaagc

SEQ ID NO: 327 - DNA, 18 bp, Homo sapiens
aggtgggtgcggccgtgc

SEQ ID NO: 328 - DNA, 19 bp, Homo sapiens
ggtgggtgcgccgacacgc

SEQ ID NO: 329 - DNA, 15 bp, Homo sapiens
ggtgggcgcgacccc

SEQ ID NO: 330 - DNA, 21 bp, Homo sapiens
aggtgggttgaccttccctgc

SEQ ID NO: 331 - DNA, 20 bp, Homo sapiens
ggtgggtgggaaaggccccg

SEQ ID NO: 332 - DNA, 19 bp, Homo sapiens
aggtaggtgcggagtcccg

SEQ ID NO: 333 - DNA, 17 bp, Homo sapiens
aggtgggtggcagggcc

SEQ ID NO: 334 - DNA, 19 bp, Homo sapiens
ggttgggtgcggccagggc

SEQ ID NO: 335 - DNA, 20 bp, Homo sapiens
aggtgggagtgggtgccccg

SEQ ID NO: 336 - DNA, 22 bp, Homo sapiens
aggtgggtggactcctggccgc

SEQ ID NO: 337 - DNA, 21 bp, Homo sapiens
ggtgggcgctgccggcctcgc

SEQ ID NO: 338 - DNA, 21 bp, Homo sapiens
aggctgggtgcagagctctgc

SEQ ID NO: 339 - DNA, 21 bp, Homo sapiens
aggtgggtgctgtccatccgc

SEQ ID NO: 340 - DNA, 20 bp, Homo sapiens
ggtgggggcggagtgccccg

SEQ ID NO: 341 - DNA, 21 bp, Homo sapiens
ggtggggtggcccgcgctcgc

SEQ ID NO: 342 - DNA, 20 bp, Homo sapiens
aggtgggtgcggtcgtgggc

SEQ ID NO: 343 - DNA, 21 bp, Homo sapiens
aggtgggtggcgggtccccgc

SEQ ID NO: 344 - DNA, 18 bp, Homo sapiens
ggtgggtgcgaaggcccg

SEQ ID NO: 345 - DNA, 25 bp, Homo sapiens
aggtgggtggtggcctggtccctgc

SEQ ID NO: 346 - DNA, 18 bp, Homo sapiens
aggtgggtgcgctggtgc

SEQ ID NO: 347 - DNA, 19 bp, Homo sapiens
agtgggtctcgtggcctcg

SEQ ID NO: 348 - DNA, 21 bp, Homo sapiens
ggtgggtgtccgtggtcctgc

SEQ ID NO: 349 - DNA, 20 bp, Homo sapiens
ggtgggtgctactggggtgc

SEQ ID NO: 350 - DNA, 19 bp, Homo sapiens
ggtgggtgcccggccctgc

SEQ ID NO: 351 - DNA, 84 bp, Alcelaphine herpesvirus 1
ctgtcactcatgccagtacactcgcacccgtagtgtttatacataaactacgggggaagcttgtgtactggatatgagtgacag

SEQ ID NO: 352 - DNA, 24 bp, Alcelaphine herpesvirus 1
tcactcatgccagtacactcgcac

SEQ ID NO: 353 - DNA, 24 bp, Homo sapiens
tcactcgcgcacagacactcgcac

SEQ ID NO: 354 - DNA, 18 bp, Homo sapiens
ctctcgagatacactcgc

SEQ ID NO: 355 - DNA, 22 bp, Homo sapiens
tcacgcacgcgtgcactcgcac

SEQ ID NO: 356 - DNA, 17 bp, Homo sapiens
cactcatcacacttgca

SEQ ID NO: 357 - DNA, 21 bp, Homo sapiens
actcatgctggtatagactgc

SEQ ID NO: 358 - DNA, 19 bp, Homo sapiens
tcactcatcctcgcttcgc

SEQ ID NO: 359 - DNA, 22 bp, Homo sapiens
tcactcatgttagtggcttcac

SEQ ID NO: 360 - DNA, 20 bp, Homo sapiens
tcactcatgatagcctgcgc

SEQ ID NO: 361 - DNA, 17 bp, Homo sapiens
ccatgccagtagcttgc

SEQ ID NO: 362 - DNA, 22 bp, Homo sapiens
cactcgcggagtgcactcgcac

SEQ ID NO: 363 - DNA, 24 bp, Homo sapiens
tcactcatccattgacaacttgca

SEQ ID NO: 364 - DNA, 20 bp, Homo sapiens
tcatttctgccagtagtcac

SEQ ID NO: 365 - DNA, 20 bp, Homo sapiens
tcattcatgccagaacgtgc

SEQ ID NO: 366 - DNA, 73 bp, Alcelaphine herpesvirus 1
cgcgcatgagcatgccctgtatgcctcaagtttcatagagtatgtaggtgatccatgggcagtgcgcatgccg

SEQ ID NO: 367 - DNA, 22 bp, Alcelaphine herpesvirus 1
tccatgggcagtgcgcatgccg

SEQ ID NO: 368 - DNA, 17 bp, Homo sapiens
ccatgggcgccgccatg

SEQ ID NO: 369 - DNA, 18 bp, Homo sapiens
tccatgggcagatggaac

SEQ ID NO: 370 - DNA, 19 bp, Homo sapiens
tctgtgagcagttggcttg

SEQ ID NO: 371 - DNA, 16 bp, Homo sapiens
tccatggggtacatgc

SEQ ID NO: 372 - DNA, 19 bp, Homo sapiens
cctgtgggcagtgccacac

SEQ ID NO: 373 - DNA, 16 bp, Homo sapiens
ccatggcagtgtatgc

SEQ ID NO: 374 - DNA, 19 bp, Homo sapiens
tccatgagcgactcggtgc

SEQ ID NO: 375 - DNA, 19 bp, Homo sapiens
tcctgtggaccgcatgccg

SEQ ID NO: 376 - DNA, 19 bp, Homo sapiens
tccatgggtggtgcatctg

SEQ ID NO: 377 - DNA, 17 bp, Homo sapiens
tcctgggcagtgtctgc

SEQ ID NO: 378 - DNA, 20 bp, Homo sapiens
catgggcatccacggtgccg

SEQ ID NO: 379 - DNA, 16 bp, Homo sapiens
tccttgggcaccatgc

SEQ ID NO: 380 - DNA, 16 bp, Homo sapiens
catggacagtgcaacc

SEQ ID NO: 381 - DNA, 22 bp, Homo sapiens
tccgtgggcagtgccagcttgc

SEQ ID NO: 382 - DNA, 15 bp, Homo sapiens
ccatgggccacatgc

SEQ ID NO: 383 - DNA, 19 bp, Homo sapiens
cctgtgggcagtgcccatg

SEQ ID NO: 384 - DNA, 18 bp, Homo sapiens
tccatgggtggcaactgc

SEQ ID NO: 385 - DNA, 21 bp, Homo sapiens
tcctgggcagctctggcatgc

SEQ ID NO: 386 - DNA, 19 bp, Homo sapiens
tcctgagccgtgcatgccg

SEQ ID NO: 387 - DNA, 18 bp, Homo sapiens
tctgtgggcagtagctgc

SEQ ID NO: 388 - DNA, 18 bp, Homo sapiens
tccatgggcactgcctcc

SEQ ID NO: 389 - DNA, 18 bp, Homo sapiens
tccatggggagtgccatg

SEQ ID NO: 390 - DNA, 20 bp, Homo sapiens
tctgtgggcagtgggagcca

SEQ ID NO: 391 - DNA, 17 bp, Homo sapiens
tccagggcgggcgctgc

SEQ ID NO: 392 - DNA, 17 bp, Homo sapiens
tccgtgagcagtgcgat

SEQ ID NO: 393 - DNA, 18 bp, Homo sapiens
tccatgggcgccgccatg

SEQ ID NO: 394 - DNA, 75 bp, Alcelaphine herpesvirus 1
gtgtctagtgacagacagggagtggattgcgctccttaaactcccgcacccgctcactgtctgtctacagactac

SEQ ID NO: 395 - DNA, 24 bp, Alcelaphine herpesvirus 1
cacccgctcactgtctgtctacag

SEQ ID NO: 396 - DNA, 21 bp, Homo sapiens
cgctcactggagatcctgcag

SEQ ID NO: 397 - DNA, 15 bp, Homo sapiens
gctctctgtctacag

SEQ ID NO: 398 - DNA, 18 bp, Homo sapiens
gctcactgtattcctcag

SEQ ID NO: 399 - DNA, 17 bp, Homo sapiens
cctttcactgtcttcta

SEQ ID NO: 400 - DNA, 23 bp, Homo sapiens
ccagaattattgtctgtctgcag

SEQ ID NO: 401 - DNA, 21 bp, Homo sapiens
cccctcagagcctgtctgcag

SEQ ID NO: 402 - DNA, 19 bp, Homo sapiens
ctcttgctgttatctacag

SEQ ID NO: 403 - DNA, 24 bp, Homo sapiens
cccgcccgctgctatggctgtaca

SEQ ID NO: 404 - DNA, 20 bp, Homo sapiens
cacccgttcctgcgctctac

SEQ ID NO: 405 - DNA, 23 bp, Homo sapiens
cctttgctcactacagctgtaca

SEQ ID NO: 406 - DNA, 22 bp, Homo sapiens
caccctcttcagatgtctacag

SEQ ID NO: 407 - DNA, 17 bp, Homo sapiens
cctgctcctgccttaca

SEQ ID NO: 408 - DNA, 18 bp, Homo sapiens
ccacttgcgcatctacag

SEQ ID NO: 409 - DNA, 23 bp, Homo sapiens
gctcttcacagagatgtctacag

SEQ ID NO: 410 - DNA, 19 bp, Homo sapiens
cacccgccagctggtctgc

SEQ ID NO: 411 - DNA, 18 bp, Homo sapiens
cctgcctcatctgtctgt

SEQ ID NO: 412 - DNA, 19 bp, Homo sapiens
tcatgttccctgtctacag

SEQ ID NO: 413 - DNA, 27 bp, Homo sapiens
cacctgttccctgtgcttcctttacag

SEQ ID NO: 414 - DNA, 20 bp, Homo sapiens
gcttgctgtctgcccctcag

SEQ ID NO: 415 - DNA, 19 bp, Homo sapiens
cgctccttcatccgtctac

SEQ ID NO: 416 - DNA, 18 bp, Homo sapiens
cacctgcccactgtcccc

SEQ ID NO: 417 - DNA, 19 bp, Homo sapiens
ctcattgtctacaactcag

SEQ ID NO: 418 - DNA, 18 bp, Homo sapiens
cacccgttttctgccaca

SEQ ID NO: 419 - DNA, 20 bp, Homo sapiens
cacccttcactgtctacgtc

SEQ ID NO: 420 - DNA, 19 bp, Homo sapiens
cctgctcctgtagccgcag

SEQ ID NO: 421 - DNA, 19 bp, Homo sapiens
cacttctcatctgtcgtct

SEQ ID NO: 422 - DNA, 19 bp, Homo sapiens
gctcactgcacacctgcag

SEQ ID NO: 423 - DNA, 22 bp, Homo sapiens
acctgcctccctgtgtttacag

SEQ ID NO: 424 - DNA, 16 bp, Homo sapiens
acttactgttgctaca

SEQ ID NO: 425 - DNA, 21 bp, Homo sapiens
cacctgctcctgtagccgcag

SEQ ID NO: 426 - DNA, 17 bp, Homo sapiens
gcttatcaaatctacag

SEQ ID NO: 427 - DNA, 21 bp, Homo sapiens
acccgcacgcaccagctctac

SEQ ID NO: 428 - DNA, 19 bp, Homo sapiens
cacctgtcactgagctaca

SEQ ID NO: 429 - DNA, 22 bp, Homo sapiens
acccgctccctgtttggctgtc

SEQ ID NO: 430 - DNA, 18 bp, Homo sapiens
cacccacttaacgtctgt

SEQ ID NO: 431 - DNA, 16 bp, Homo sapiens
caccctctcagtctgc

SEQ ID NO: 432 - DNA, 23 bp, Homo sapiens
actcgctcactttgatgttctgt

SEQ ID NO: 433 - DNA, 21 bp, Homo sapiens
cccgctcctgtccatccgcag

SEQ ID NO: 434 - DNA, 21 bp, Homo sapiens
cacccgtcactccaggtctgc

SEQ ID NO: 435 - DNA, 20 bp, Homo sapiens
cccattcactgctaaactgt

SEQ ID NO: 436 - DNA, 25 bp, Homo sapiens
acccattcactgttccagctgtaca

SEQ ID NO: 437 - DNA, 21 bp, Homo sapiens
acccgcttctctgtggctgtc

SEQ ID NO: 438 - DNA, 18 bp, Homo sapiens
ctcagatgctgtctacag

SEQ ID NO: 439 - DNA, 17 bp, Homo sapiens
cacctgcttgtggtcca

SEQ ID NO: 440 - DNA, 24 bp, Homo sapiens
actcgctcactgtcatgagaacag

SEQ ID NO: 441 - DNA, 16 bp, Homo sapiens
cacccgccatgtttgc

SEQ ID NO: 442 - DNA, 20 bp, Homo sapiens
gctcgttgcttggcctacag

SEQ ID NO: 443 - DNA, 16 bp, Homo sapiens
cacccacttgttgtcc

SEQ ID NO: 444 - DNA, 19 bp, Homo sapiens
cacccacactctgtctaca

SEQ ID NO: 445 - DNA, 26 bp, Homo sapiens
accggctcactgtgcacagctgtaca

SEQ ID NO: 446 - DNA, 24 bp, Homo sapiens
cacttgcttcttgtctgtcttcag

SEQ ID NO: 447 - DNA, 19 bp, Homo sapiens
ccttctcactgtgtcctac

SEQ ID NO: 448 - DNA, 18 bp, Homo sapiens
acttctcactgtcatgcc

SEQ ID NO: 449 - DNA, 23 bp, Homo sapiens
acctgttgtctttctgtctacag

SEQ ID NO: 450 - DNA, 18 bp, Homo sapiens
gcttcctgtctgtctcag

SEQ ID NO: 451 - DNA, 18 bp, Homo sapiens
ccattcagtctgtctcag

SEQ ID NO: 452 - DNA, 73 bp, Melanoplus sanguinipes entomopoxvirus
gtaataagttaaataaaaatataaatgttatatgttaaaatgtgaaattatatatcatttgtttaataattac

SEQ ID NO: 453 - DNA, 24 bp, Melanoplus sanguinipes entomopoxvirus
taagttaaataaaaatataaatgt

SEQ ID NO: 454 - DNA, 20 bp, Homo sapiens
tcatataaaaatataaatgt

SEQ ID NO: 455 - DNA, 114 bp, Porcine adenovirus A
ctgagaagtcatccaggtccaggaaccggtggtaggcgcccgtgttgatggtgtaggagcagttgcccagcacggaccagttgaccacctggtagtggggctggatgacctcgg

SEQ ID NO: 456 - DNA, 24 bp, Porcine adenovirus A
tccaggaaccggtggtaggcgccc

SEQ ID NO: 457 - DNA, 21 bp, Homo sapiens
ccgggcgtggtggtaggtgcc

SEQ ID NO: 458 - DNA, 19 bp, Homo sapiens
gggcatggtggtaggcgcc

SEQ ID NO: 459 - DNA, 19 bp, Homo sapiens
ggccctggtggtaggtgcc

SEQ ID NO: 460 - DNA, 18 bp, Homo sapiens
cctggggatgtaggcgcc

SEQ ID NO: 461 - DNA, 18 bp, Homo sapiens
ggacgcctggaggcgccc

SEQ ID NO: 462 - DNA, 16 bp, Homo sapiens
tccgggaccagggcgc

SEQ ID NO: 463 - DNA, 16 bp, Homo sapiens
tccaggaatggtggcg

SEQ ID NO: 464 - DNA, 17 bp, Homo sapiens
ggaaccgatggccgccc

SEQ ID NO: 465 - DNA, 22 bp, Homo sapiens
cccaggggctggagaggcgccc

SEQ ID NO: 466 - DNA, 21 bp, Homo sapiens
ccgggcatagtggtgggtgcc

SEQ ID NO: 467 - DNA, 22 bp, Homo sapiens
ccgggagccggcggtggcgccc

SEQ ID NO: 468 - DNA, 19 bp, Homo sapiens
tccagggaggtgtaggcgc

SEQ ID NO: 469 - DNA, 30 bp, Homo sapiens
tccaggaatctgggctcaagtgggtgtccg

SEQ ID NO: 470 - DNA, 20 bp, Homo sapiens
tccagaaactggggctgtgc

SEQ ID NO: 471 - DNA, 17 bp, Homo sapiens
tctgggaacgcaggcgc

SEQ ID NO: 472 - DNA, 21 bp, Homo sapiens
tccagggactgggctcagccc

SEQ ID NO: 473 - DNA, 20 bp, Homo sapiens
tcctggaaccagcaggtgcc

SEQ ID NO: 474 - DNA, 20 bp, Homo sapiens
tccagtggccggtgtggtcc

SEQ ID NO: 475 - DNA, 18 bp, Homo sapiens
gggaccacccaggcgccc

SEQ ID NO: 476 - DNA, 20 bp, Homo sapiens
tccaggaatcagtgttgtcc

SEQ ID NO: 477 - DNA, 19 bp, Homo sapiens
agggactggtggtagggac

SEQ ID NO: 478 - DNA, 19 bp, Homo sapiens
caggagctgatggtaggca

SEQ ID NO: 479 - DNA, 22 bp, Homo sapiens
tccagggagtggtagttggtgc

SEQ ID NO: 480 - DNA, 21 bp, Homo sapiens
tccaggaagtggtggtcgggc

SEQ ID NO: 481 - DNA, 25 bp, Homo sapiens
tccaggaaccgttacaatggcgtcc

SEQ ID NO: 482 - DNA, 19 bp, Homo sapiens
tccaagaactgctgggtgc

SEQ ID NO: 483 - DNA, 19 bp, Homo sapiens
cccgggagcccaccgggcg

SEQ ID NO: 484 - DNA, 23 bp, Homo sapiens
tccgggtgggggggtaggcgccc

SEQ ID NO: 485 - DNA, 19 bp, Homo sapiens
tccgggacccggcagtgcc

SEQ ID NO: 486 - DNA, 19 bp, Homo sapiens
tccgggggccggcggtggg

SEQ ID NO: 487 - DNA, 19 bp, Homo sapiens
tccagcagccagcaggtgc

SEQ ID NO: 488 - DNA, 21 bp, Homo sapiens
ccagggcaggtggtaggtgcc

SEQ ID NO: 489 - DNA, 23 bp, Homo sapiens
tccaagaactttcaagggcgccc

SEQ ID NO: 490 - DNA, 23 bp, Homo sapiens
ggggcctggcagacagtaggtgc

SEQ ID NO: 491 - DNA, 21 bp, Homo sapiens
tccagggctggaccaggcgcc

SEQ ID NO: 492 - DNA, 18 bp, Homo sapiens
tccgggaacccaggcgcc

SEQ ID NO: 493 - DNA, 18 bp, Homo sapiens
tctgggaaccagtgggac

SEQ ID NO: 494 - DNA, 20 bp, Homo sapiens
caggtgtggtggtaggcgcc

SEQ ID NO: 495 - DNA, 18 bp, Homo sapiens
tccagcaggggtgggtgc

SEQ ID NO: 496 - DNA, 15 bp, Homo sapiens
ggaaggggtaggcgc

SEQ ID NO: 497 - DNA, 19 bp, Homo sapiens
tccaggaactggtagagcc

SEQ ID NO: 498 - DNA, 21 bp, Homo sapiens
tccaggaatgggattagtgcc

SEQ ID NO: 499 - DNA, 23 bp, Homo sapiens
tccaggaataggttttcctgccc

SEQ ID NO: 500 - DNA, 18 bp, Homo sapiens
tccaggaaccgtagcgcc

SEQ ID NO: 501 - DNA, 20 bp, Homo sapiens
caggagccgcacaggcgccc

SEQ ID NO: 502 - DNA, 22 bp, Homo sapiens
cctaggaatcagccaggcgccc

SEQ ID NO: 503 - DNA, 22 bp, Homo sapiens
tccaggaagctggtgtagtcgc

SEQ ID NO: 504 - DNA, 20 bp, Homo sapiens
gggggtgtcgctaggcgccc

SEQ ID NO: 505 - DNA, 83 bp, Alcelaphine herpesvirus 1
tgtctcttgctaggtagcctgtacaaaacagtccttttttaatgtaaaacagtgttttgtccagactagcctaacacgaacca

SEQ ID NO: 506 - DNA, 24 bp, Alcelaphine herpesvirus 1
tctcttgctaggtagcctgtacaa

SEQ ID NO: 507 - DNA, 22 bp, Homo sapiens
tctcttgcggagtatttgtgca

SEQ ID NO: 508 - DNA, 20 bp, Homo sapiens
tctcttgcatttcctgtgca

SEQ ID NO: 509 - DNA, 20 bp, Homo sapiens
tcttttaaaacgctgtacaa

SEQ ID NO: 510 - DNA, 22 bp, Homo sapiens
ccttttgctgggtggcgtccta

SEQ ID NO: 511 - DNA, 15 bp, Homo sapiens
ttgccggctgtacaa

SEQ ID NO: 512 - DNA, 21 bp, Homo sapiens
tctcttttattcccctgtaca

SEQ ID NO: 513 - DNA, 21 bp, Homo sapiens
tctcttgctaggtagctggta

SEQ ID NO: 514 - DNA, 20 bp, Homo sapiens
tctcctgctgggtagaactg

SEQ ID NO: 515 - DNA, 20 bp, Homo sapiens
tcccttgctgggtgggcatg

SEQ ID NO: 516 - DNA, 19 bp, Homo sapiens
tctcttgctagggggactg

SEQ ID NO: 517 - DNA, 17 bp, Homo sapiens
tctcttgctcagactgt

SEQ ID NO: 518 - DNA, 16 bp, Homo sapiens
tcttgctaagtataca

SEQ ID NO: 519 - DNA, 19 bp, Homo sapiens
cttgctaataacacctgta

SEQ ID NO: 520 - DNA, 19 bp, Homo sapiens
tctcttgctggttgaccgc

SEQ ID NO: 521 - DNA, 19 bp, Homo sapiens
tcttttttggtactgtaca

SEQ ID NO: 522 - DNA, 19 bp, Homo sapiens
cttgtacaagtctgtacaa

SEQ ID NO: 523 - DNA, 17 bp, Homo sapiens
tctttgctaggtaggca

SEQ ID NO: 524 - DNA, 20 bp, Homo sapiens
tctcttgctgtgatggtgta

SEQ ID NO: 525 - DNA, 16 bp, Homo sapiens
tcttgccaggtgcagt

SEQ ID NO: 526 - DNA, 16 bp, Homo sapiens
tcttgtgccctgtaca

SEQ ID NO: 527 - DNA, 21 bp, Homo sapiens
tcatcttgcttttctgtacaa

SEQ ID NO: 528 - DNA, 19 bp, Homo sapiens
tcttttgctagggtagaca

SEQ ID NO: 529 - DNA, 85 bp, Porcine adenovirus A
tcctgcagcacccccggtcccgcgcgctgaccgcgcagctgctgctgatcgcgcagcactgccgggacgagggcatggtgaagga

SEQ ID NO: 530 - DNA, 24 bp, Porcine adenovirus A
tcgcgcagcactgccgggacgagg

SEQ ID NO: 531 - DNA, 25 bp, Homo sapiens
tcacgcaaaagctgccggggtgagg

SEQ ID NO: 532 - DNA, 20 bp, Homo sapiens
ccgcgcagctgggggcgagg

SEQ ID NO: 533 - DNA, 22 bp, Homo sapiens
gcccagcactgcactctggagg

SEQ ID NO: 534 - DNA, 22 bp, Homo sapiens
gcgcggcgctgccgggcagagg

SEQ ID NO: 535 - DNA, 21 bp, Homo sapiens
ccgcgcagcactgccaccagg

SEQ ID NO: 536 - DNA, 20 bp, Homo sapiens
tcacgcagtaagtggacggg

SEQ ID NO: 537 - DNA, 17 bp, Homo sapiens
tccgcagcgctgctggg

SEQ ID NO: 538 - DNA, 21 bp, Homo sapiens
tcgcgcaggcgctgccacagg

SEQ ID NO: 539 - DNA, 90 bp, Alcelaphine herpesvirus 1
ttttgcaagtccctaccaggtagccgtgcataagcttaaaattaataaaaagcttatgcacaagccgtctgattaggaagcactgcaaaa

SEQ ID NO: 540 - DNA, 24 bp, Alcelaphine herpesvirus 1
accaggtagccgtgcataagctta

SEQ ID NO: 541 - DNA, 24 bp, Homo sapiens
ccaggtagccattgaccagggctt

SEQ ID NO: 542 - DNA, 21 bp, Homo sapiens
accagtagcacgatgagctta

SEQ ID NO: 543 - DNA, 19 bp, Homo sapiens
accaagtatgtggtgtaag

SEQ ID NO: 544 - DNA, 23 bp, Homo sapiens
ccaggtagcagatataaagctta

SEQ ID NO: 545 - DNA, 16 bp, Homo sapiens
cagtgtagccaagctt

SEQ ID NO: 546 - DNA, 16 bp, Homo sapiens
accaggaggttaagct

SEQ ID NO: 547 - DNA, 19 bp, Homo sapiens
actaggtaagaataagctt

SEQ ID NO: 548 - DNA, 17 bp, Homo sapiens
ccaggtagctgctgctc

SEQ ID NO: 549 - DNA, 15 bp, Homo sapiens
ccaggtagctgagct

SEQ ID NO: 550 - DNA, 17 bp, Homo sapiens
ccaggagccgtgcagct

SEQ ID NO: 551 - DNA, 16 bp, Homo sapiens
caggttatataagctt

SEQ ID NO: 552 - DNA, 21 bp, Homo sapiens
cacaagcctgtgcataagctt

SEQ ID NO: 553 - DNA, 22 bp, Homo sapiens
gccagctgtgcctgtaagctta

SEQ ID NO: 554 - DNA, 17 bp, Homo sapiens
accaggtagctgtggct

SEQ ID NO: 555 - DNA, 20 bp, Homo sapiens
accagtgtggcgataagctt

SEQ ID NO: 556 - DNA, 20 bp, Homo sapiens
ccaggtagcgggactggctt

SEQ ID NO: 557 - DNA, 16 bp, Homo sapiens
caggtagcctaagctt

SEQ ID NO: 558 - DNA, 18 bp, Homo sapiens
ccaggtagagatgggctt

SEQ ID NO: 559 - DNA, 65 bp, Porcine adenovirus A
gttggtgtgtggtagcgatctatctttctttgtgatcttggtagtgaagcctgccaggctccagc

SEQ ID NO: 560 - DNA, 24 bp, Porcine adenovirus A
ttggtagtgaagcctgccaggctc

SEQ ID NO: 561 - DNA, 23 bp, Homo sapiens
ctggtagtggaagaccgtgggct

SEQ ID NO: 562 - DNA, 17 bp, Homo sapiens
tggtactctgccaggct

SEQ ID NO: 563 - DNA, 23 bp, Homo sapiens
ttagtagtggagtcagctgggct

SEQ ID NO: 564 - DNA, 20 bp, Homo sapiens
gtagtggccaaaaccaggct

SEQ ID NO: 565 - DNA, 23 bp, Homo sapiens
ctggatgaaggtttgccaggctc

SEQ ID NO: 566 - DNA, 22 bp, Homo sapiens
ggtggtggcctaagccaggctc

SEQ ID NO: 567 - DNA, 16 bp, Homo sapiens
ttggaagtggccaggc

SEQ ID NO: 568 - DNA, 18 bp, Homo sapiens
tggtacacttgccaggct

SEQ ID NO: 569 - DNA, 21 bp, Homo sapiens
ttggtagtcagtcttcaggct

SEQ ID NO: 570 - DNA, 20 bp, Homo sapiens
ttggggtgggcggccaggct

SEQ ID NO: 571 - DNA, 19 bp, Homo sapiens
ttggtgatgaagcccaggc

SEQ ID NO: 572 - DNA, 88 bp, Porcine adenovirus A
gaggccgttctgaaagagttggatttcagcaccttgggacgcaccgtagctagtgtggctctggtctgcttcatttttgagaagcttc

SEQ ID NO: 573 - DNA, 24 bp, Porcine adenovirus A
tgaaagagttggatttcagcacct

SEQ ID NO: 574 - DNA, 24 bp, Homo sapiens
gaaagagttgggcatcgcgcatct

SEQ ID NO: 575 - DNA, 21 bp, Homo sapiens
aaggggttggagcccatgcct

SEQ ID NO: 576 - DNA, 22 bp, Homo sapiens
tgaaggcaaaatttcagtgcct

SEQ ID NO: 577 - DNA, 18 bp, Homo sapiens
tgagaggattggatctca

SEQ ID NO: 578 - DNA, 18 bp, Homo sapiens
gaaaggcaattttcagca

SEQ ID NO: 579 - DNA, 18 bp, Homo sapiens
agagacggagtttcagca

SEQ ID NO: 580 - DNA, 19 bp, Homo sapiens
tgagtgagttggatttcaa

SEQ ID NO: 581 - DNA, 19 bp, Homo sapiens
gaaagtggtttcagcacct

SEQ ID NO: 582 - DNA, 25 bp, Homo sapiens
tggaagagctgtcataacagcacct

SEQ ID NO: 583 - DNA, 18 bp, Homo sapiens
tgaaagaatgaaaatcag

SEQ ID NO: 584 - DNA, 22 bp, Homo sapiens
tgagaggagctgttcagcacct

SEQ ID NO: 585 - DNA, 22 bp, Homo sapiens
tgggagagctgggcggtcacct

SEQ ID NO: 586 - DNA, 18 bp, Homo sapiens
aaaggaaaattttcagca

SEQ ID NO: 587 - DNA, 21 bp, Homo sapiens
agatctgggatttcggcatct

SEQ ID NO: 588 - DNA, 19 bp, Homo sapiens
tggaagatttggattttca

SEQ ID NO: 589 - DNA, 20 bp, Homo sapiens
gaatggtgatttcagtgcct

SEQ ID NO: 590 - DNA, 24 bp, Homo sapiens
tgaagggttggaaccccagcatct

SEQ ID NO: 591 - DNA, 18 bp, Homo sapiens
tgacaggcactttcagca

SEQ ID NO: 592 - DNA, 19 bp, Homo sapiens
gaaaggattttcagcatct

SEQ ID NO: 593 - DNA, 20 bp, Homo sapiens
agggttggaccctggcacct

SEQ ID NO: 594 - DNA, 18 bp, Homo sapiens
tggaagagctggatttgc

SEQ ID NO: 595 - DNA, 18 bp, Homo sapiens
tgaggagtccttcagcac

SEQ ID NO: 596 - DNA, 20 bp, Homo sapiens
aagagttgatgattttagca

SEQ ID NO: 597 - DNA, 18 bp, Homo sapiens
tgaaggagttgaataaca

SEQ ID NO: 598 - DNA, 19 bp, Homo sapiens
gagctggattttggcacct

SEQ ID NO: 599 - DNA, 22 bp, Homo sapiens
tggaagagctggaagctcacct

SEQ ID NO: 600 - DNA, 17 bp, Homo sapiens
aaataggtttcagcacc

SEQ ID NO: 601 - DNA, 21 bp, Homo sapiens
tgatggagagcttcagcatct

SEQ ID NO: 602 - DNA, 21 bp, Homo sapiens
tgagggagttgaatttatcct

SEQ ID NO: 603 - DNA, 22 bp, Homo sapiens
gagagggatgtgcgcagcacct

SEQ ID NO: 604 - DNA, 16 bp, Homo sapiens
tgaaaaagttggagca

SEQ ID NO: 605 - DNA, 21 bp, Homo sapiens
tgcaagggcacgtttcagcac

SEQ ID NO: 606 - DNA, 99 bp, Alcelaphine herpesvirus 1
gagtatgtgagttttgtgttgaggcaggccacttgcacttgcattgccttccaaatgcaggtgagagatagcctgctttaacacatatcccacaggttt

SEQ ID NO: 607 - DNA, 24 bp, Alcelaphine herpesvirus 1
tagcctgctttaacacatatccca

SEQ ID NO: 608 - DNA, 18 bp, Homo sapiens
tagcttgctctaagttcc

SEQ ID NO: 609 - DNA, 22 bp, Homo sapiens
taccctacccatacatatccca

SEQ ID NO: 610 - DNA, 18 bp, Homo sapiens
tagccaggccacatgtcc

SEQ ID NO: 611 - DNA, 16 bp, Homo sapiens
gcctgttccatatccc

SEQ ID NO: 612 - DNA, 21 bp, Homo sapiens
tagtctgctttattgtgcatc

SEQ ID NO: 613 - DNA, 22 bp, Homo sapiens
taacctgcttttacaaatgtcc

SEQ ID NO: 614 - DNA, 17 bp, Homo sapiens
agcctgttttatatccc

SEQ ID NO: 615 - DNA, 18 bp, Homo sapiens
cagcctgctttggtacat

SEQ ID NO: 616 - DNA, 22 bp, Homo sapiens
gcataagttaacacatattcca

SEQ ID NO: 617 - DNA, 23 bp, Homo sapiens
gcctgtggccaagcacatgttcc

SEQ ID NO: 618 - DNA, 22 bp, Homo sapiens
cagcctgcctgtgcatgtctca

SEQ ID NO: 619 - DNA, 21 bp, Homo sapiens
gcctgctttgctagaatatcc

SEQ ID NO: 620 - DNA, 17 bp, Homo sapiens
gcctgctttgcacatcc

SEQ ID NO: 621 - DNA, 19 bp, Homo sapiens
gccctaccctatatatatc

SEQ ID NO: 622 - DNA, 20 bp, Homo sapiens
gcctgctttccagatgtccc

SEQ ID NO: 623 - DNA, 65 bp, Porcine adenovirus A
ggcgggggtgagcgcggcctccctggcgcccgagcgggcgacgcggatgcaggcgctgccctccc

SEQ ID NO: 624 - DNA, 24 bp, Porcine adenovirus A
cgacgcggatgcaggcgctgccct

SEQ ID NO: 625 - DNA, 23 bp, Homo sapiens
cggcgaggcgcgggcgctgctct

SEQ ID NO: 626 - DNA, 26 bp, Homo sapiens
cgcgggcgctgccgggcgctgtccta

SEQ ID NO: 627 - DNA, 18 bp, Homo sapiens
cgacgcggagcatggtct

SEQ ID NO: 628 - DNA, 21 bp, Homo sapiens
cgacgcggtgtgggcagcagc

SEQ ID NO: 629 - DNA, 20 bp, Homo sapiens
gctgggtgcagaactgccct

SEQ ID NO: 630 - DNA, 20 bp, Homo sapiens
gcggcgggaggcgctgctct

SEQ ID NO: 631 - DNA, 18 bp, Homo sapiens
gacgcggtgcaggcagcc

SEQ ID NO: 632 - DNA, 16 bp, Homo sapiens
gcggatgcacaggccc

SEQ ID NO: 633 - DNA, 18 bp, Homo sapiens
cagacgtgggcgctgccc

SEQ ID NO: 634 - DNA, 18 bp, Homo sapiens
acgcggtcggcgctgccc

SEQ ID NO: 635 - DNA, 18 bp, Homo sapiens
cgatcgctccaggcgctg

SEQ ID NO: 636 - DNA, 20 bp, Homo sapiens
cgcgccgggggcgctgccct

SEQ ID NO: 637 - DNA, 26 bp, Homo sapiens
cgacgcgggtgtatcgaatttgtcct

SEQ ID NO: 638 - DNA, 18 bp, Homo sapiens
cacgggagacgctgtcct

SEQ ID NO: 639 - DNA, 17 bp, Homo sapiens
cggtgccaggcgctgcc

SEQ ID NO: 640 - DNA, 22 bp, Homo sapiens
catgtgcaatgggtgctgccct

SEQ ID NO: 641 - DNA, 18 bp, Homo sapiens
ggctgcaggcgttgccct

SEQ ID NO: 642 - DNA, 17 bp, Homo sapiens
cgcaggcaggtgctgcc

SEQ ID NO: 643 - DNA, 83 bp, Alcelaphine herpesvirus 1
tgccagtctcctaccagagtacttggcaaagatctttttagtacacagagccttcgccaagagctcttagcacgagatgagca

SEQ ID NO: 644 - DNA, 24 bp, Alcelaphine herpesvirus 1
accagagtacttggcaaagatctt

SEQ ID NO: 645 - DNA, 21 bp, Homo sapiens
accggagtacttagcagcaat

SEQ ID NO: 646 - DNA, 18 bp, Homo sapiens
accaagtaccttagagat

SEQ ID NO: 647 - DNA, 15 bp, Homo sapiens
cagagtaacaaagat

SEQ ID NO: 648 - DNA, 20 bp, Homo sapiens
accagagtacttgtttgcaa

SEQ ID NO: 649 - DNA, 21 bp, Homo sapiens
accagtaatggtgaaggtctt

SEQ ID NO: 650 - DNA, 17 bp, Homo sapiens
gtatttggaaagatctt

SEQ ID NO: 651 - DNA, 17 bp, Homo sapiens
cagagtgttgacaaaaa

SEQ ID NO: 652 - DNA, 17 bp, Homo sapiens
accagagctgcggagat

SEQ ID NO: 653 - DNA, 17 bp, Homo sapiens
aaagtactcacaaagat

SEQ ID NO: 654 - DNA, 21 bp, Homo sapiens
cagagtacatttagcaaggat

SEQ ID NO: 655 - DNA, 20 bp, Homo sapiens
ccaggtaagttaaagatctt

SEQ ID NO: 656 - DNA, 19 bp, Homo sapiens
agagatagctaaagatctt

SEQ ID NO: 657 - DNA, 18 bp, Homo sapiens
agagtatgtggcaataat

SEQ ID NO: 658 - DNA, 21 bp, Homo sapiens
ccagggtacttggcccctctt

SEQ ID NO: 659 - DNA, 20 bp, Homo sapiens
tactctttggtgaagatctt

SEQ ID NO: 660 - DNA, 19 bp, Homo sapiens
gcggccatgcaaagatctt

SEQ ID NO: 661 - DNA, 19 bp, Homo sapiens
aagtacttggtggattctt

SEQ ID NO: 662 - DNA, 22 bp, Homo sapiens
ccaggtcaaaggcaaagatctt

SEQ ID NO: 663 - DNA, 21 bp, Homo sapiens
cagggtcttcacgaagatctt

SEQ ID NO: 664 - DNA, 21 bp, Homo sapiens
ccagagtactcagaagatctt

SEQ ID NO: 665 - DNA, 61 bp, Alcelaphine herpesvirus 1
ggtaaggcctgtgagtaagctatctcctcccacagaagcttagtaattcagagcagttatt

SEQ ID NO: 666 - DNA, 18 bp, Alcelaphine herpesvirus 1
taattcagagcagttatt

SEQ ID NO: 667 - DNA, 18 bp, Homo sapiens
caattcaaggcagttatt

SEQ ID NO: 668 - DNA, 16 bp, Homo sapiens
taatccaacagttatt

SEQ ID NO: 669 - DNA, 20 bp, Homo sapiens
aattcagaaggtcagttatt

SEQ ID NO: 670 - DNA, 17 bp, Homo sapiens
taattagggcagttatt

SEQ ID NO: 671 - DNA, 20 bp, Homo sapiens
taattcagggcatcattatt

SEQ ID NO: 672 - DNA, 17 bp, Homo sapiens
taattctaacagttatt

SEQ ID NO: 673 - DNA, 19 bp, Homo sapiens
aattcagatgcatgttatt

SEQ ID NO: 674 - DNA, 18 bp, Homo sapiens
taactcagttcaattatt

SEQ ID NO: 675 - DNA, 18 bp, Homo sapiens
caattcagcgcagttatt

SEQ ID NO: 676 - DNA, 20 bp, Homo sapiens
taattcaagacacagctatt

SEQ ID NO: 677 - DNA, 19 bp, Homo sapiens
taattcagcagctgctatt

SEQ ID NO: 678 - DNA, 18 bp, Homo sapiens
aattcaggtgcagttatt

SEQ ID NO: 679 - DNA, 64 bp, Porcine adenovirus A
tcgcggaggagatgaacgtcagccggagctcctacattgggcacctgctgacactctaccgcga

SEQ ID NO: 680 - DNA, 23 bp, Porcine adenovirus A
cacctgctgacactctaccgcga

SEQ ID NO: 681 - DNA, 21 bp, Homo sapiens
cacctgctggaactgcgcgcg

SEQ ID NO: 682 - DNA, 19 bp, Homo sapiens
cacccgctgacactgagcg

SEQ ID NO: 683 - DNA, 19 bp, Homo sapiens
acctgctacccctttctgc

SEQ ID NO: 684 - DNA, 20 bp, Homo sapiens
cacctgctggctgctctcca

SEQ ID NO: 685 - DNA, 17 bp, Homo sapiens
cctcctgacacttacgc

SEQ ID NO: 686 - DNA, 16 bp, Homo sapiens
cctgcgacactcaacg

SEQ ID NO: 687 - DNA, 18 bp, Homo sapiens
ctctgacactcccagacg

SEQ ID NO: 688 - DNA, 20 bp, Homo sapiens
cacctgctgggctgacgtga

SEQ ID NO: 689 - DNA, 22 bp, Homo sapiens
cacctgctggcacccctcatcg

SEQ ID NO: 690 - DNA, 20 bp, Homo sapiens
cacccgccctttctgccgcg

SEQ ID NO: 691 - DNA, 17 bp, Homo sapiens
tgcttgacaacaccacg

SEQ ID NO: 692 - DNA, 18 bp, Homo sapiens
cacctgtgacacgctgcg

SEQ ID NO: 693 - DNA, 19 bp, Homo sapiens
cacctgctggccattcacc

SEQ ID NO: 694 - DNA, 19 bp, Homo sapiens
tactaacattctgtcgtga

SEQ ID NO: 695 - DNA, 23 bp, Homo sapiens
caccagctggcaccagatcaccg

SEQ ID NO: 696 - DNA, 22 bp, Homo sapiens
cccgctgacgcttccctctgcg

SEQ ID NO: 697 - DNA, 20 bp, Homo sapiens
caccgctgagcagcgccgcg

SEQ ID NO: 698 - DNA, 20 bp, Homo sapiens
cctgttggactggtccgcga

SEQ ID NO: 699 - DNA, 19 bp, Homo sapiens
ctgctgacacaggtcgcga

SEQ ID NO: 700 - DNA, 25 bp, Homo sapiens
caccggctggcactccagtcccgcg

SEQ ID NO: 701 - DNA, 15 bp, Homo sapiens
ctgctgacactctgc

SEQ ID NO: 702 - DNA, 21 bp, Homo sapiens
cacctgctccacgctgtcgcg

SEQ ID NO: 703 - DNA, 17 bp, Homo sapiens
cacctgctgtgtacgcg

SEQ ID NO: 704 - DNA, 24 bp, Homo sapiens
cctgctgacagtggcctcccgcga

SEQ ID NO: 705 - DNA, 20 bp, Homo sapiens
cacctgcctttcctgccgcg

SEQ ID NO: 706 - DNA, 18 bp, Homo sapiens
cacctgctggcacacaca

SEQ ID NO: 707 - DNA, 16 bp, Homo sapiens
tgctgacattacacga

SEQ ID NO: 708 - DNA, 17 bp, Homo sapiens
caccgctgaccgccgcg

SEQ ID NO: 709 - DNA, 18 bp, Homo sapiens
cacctgctgagcgctcta

SEQ ID NO: 710 - DNA, 130 bp, Alcelaphine herpesvirus 1
aagtagtgcgggtaatgaagaagttgcaagtctctcatctgatagcatagtaaaaatcagttcagtatacagattttttctaaactatcgtgacacaagacaagccatcagtacttactcgcacttactt

SEQ ID NO: 711 - DNA, 24 bp, Alcelaphine herpesvirus 1
tagcatagtaaaaatcagttcagt

SEQ ID NO: 712 - DNA, 17 bp, Homo sapiens
tagaaaagtcggttcag

SEQ ID NO: 713 - DNA, 20 bp, Homo sapiens
gccagaaggattagttcagt

SEQ ID NO: 714 - DNA, 21 bp, Homo sapiens
tagtaaagtccacagttcagt

SEQ ID NO: 715 - DNA, 18 bp, Homo sapiens
tagctatagtgaaaatca

SEQ ID NO: 716 - DNA, 19 bp, Homo sapiens
atagtaaaaatatctcagt

SEQ ID NO: 717 - DNA, 24 bp, Homo sapiens
taacatagtaaagtaccttttagt

SEQ ID NO: 718 - DNA, 20 bp, Homo sapiens
tagtaaaaatagcattcagt

SEQ ID NO: 719 - DNA, 23 bp, Homo sapiens
gcaagataaaaaatcagtttagt

SEQ ID NO: 720 - DNA, 23 bp, Homo sapiens
cagcatggtagaaatacatcagt

SEQ ID NO: 721 - DNA, 24 bp, Homo sapiens
tagcataggtaaggaggctctagt

SEQ ID NO: 722 - DNA, 20 bp, Homo sapiens
agcatagcagttggttcagt

SEQ ID NO: 723 - DNA, 18 bp, Homo sapiens
catagtaaaaaatacagt

SEQ ID NO: 724 - DNA, 17 bp, Homo sapiens
tagcatgtggaatcagt

SEQ ID NO: 725 - DNA, 20 bp, Homo sapiens
gctggtaagaatagctcagt

SEQ ID NO: 726 - DNA, 78 bp, Porcine adenovirus A
ccccggccctctcgcgcgtcccgtcccgggcatcctccctgctctctctggcctctctgggaaagcgggagggagggg

SEQ ID NO: 727 - DNA, 24 bp, Porcine adenovirus A
tctctgggaaagcgggagggaggg

SEQ ID NO: 728 - DNA, 19 bp, Homo sapiens
tctctgagaccgggggagg

SEQ ID NO: 729 - DNA, 20 bp, Homo sapiens
tctgggaaggcgaatggggg

SEQ ID NO: 730 - DNA, 18 bp, Homo sapiens
tctctaggagggtgaggg

SEQ ID NO: 731 - DNA, 23 bp, Homo sapiens
tctgggaagctgaagagggaggg

SEQ ID NO: 732 - DNA, 19 bp, Homo sapiens
tctttgggaagggaaaggg

SEQ ID NO: 733 - DNA, 19 bp, Homo sapiens
tctctgggaaggcgggagg

SEQ ID NO: 734 - DNA, 18 bp, Homo sapiens
ctttggggagaagggagg

SEQ ID NO: 735 - DNA, 22 bp, Homo sapiens
cctgggaaggtggcaagggggg

SEQ ID NO: 736 - DNA, 17 bp, Homo sapiens
tggggggcgggagaggg

SEQ ID NO: 737 - DNA, 24 bp, Homo sapiens
tctcttggggaaggagggggaggg

SEQ ID NO: 738 - DNA, 19 bp, Homo sapiens
tccctgggggagccggggg

SEQ ID NO: 739 - DNA, 23 bp, Homo sapiens
tctctggaggaagtgggtctggg

SEQ ID NO: 740 - DNA, 26 bp, Homo sapiens
tcattgggagagaaaggtggggaggg

SEQ ID NO: 741 - DNA, 16 bp, Homo sapiens
tctctgggagggtggg

SEQ ID NO: 742 - DNA, 20 bp, Homo sapiens
tctctggggaacagggaggg

SEQ ID NO: 743 - DNA, 22 bp, Homo sapiens
tctctggggaagggatggaggg

SEQ ID NO: 744 - DNA, 18 bp, Homo sapiens
tcttggtggggagggagg

SEQ ID NO: 745 - DNA, 21 bp, Homo sapiens
tccctgggagggctcaggggg

SEQ ID NO: 746 - DNA, 21 bp, Homo sapiens
tcctggatctgggagggaggg

SEQ ID NO: 747 - DNA, 20 bp, Homo sapiens
tccaggggtgggagggaggg

SEQ ID NO: 748 - DNA, 22 bp, Homo sapiens
tccactgaggcgggagggaggg

SEQ ID NO: 749 - DNA, 21 bp, Homo sapiens
tccttgggaaaggggggaggg

SEQ ID NO: 750 - DNA, 18 bp, Homo sapiens
ctggggaaacagggaggg

SEQ ID NO: 751 - DNA, 21 bp, Homo sapiens
tctctggggaaatgcagaggg

SEQ ID NO: 752 - DNA, 24 bp, Homo sapiens
cctttgggggattagaagggaggg

SEQ ID NO: 753 - DNA, 18 bp, Homo sapiens
tgggggggctaaggaggg

SEQ ID NO: 754 - DNA, 19 bp, Homo sapiens
tctccagtgggagggaggg

SEQ ID NO: 755 - DNA, 19 bp, Homo sapiens
tctccgggagggcgggcgg

SEQ ID NO: 756 - DNA, 24 bp, Homo sapiens
tctctggggggggggagtcggggg

SEQ ID NO: 757 - DNA, 20 bp, Homo sapiens
cctctgggggaggaggaggg

SEQ ID NO: 758 - DNA, 17 bp, Homo sapiens
tctgggaaaggaaaggg

SEQ ID NO: 759 - DNA, 23 bp, Homo sapiens
tctctgggaaagggcggagaggg

SEQ ID NO: 760 - DNA, 23 bp, Homo sapiens
tctctggggagggattctggggg

SEQ ID NO: 761 - DNA, 17 bp, Homo sapiens
ctccagtgggagggagg

SEQ ID NO: 762 - DNA, 18 bp, Homo sapiens
gggaggtgggagggaggg

SEQ ID NO: 763 - DNA, 20 bp, Homo sapiens
tctctgggagctggggaggg

SEQ ID NO: 764 - DNA, 22 bp, Homo sapiens
tgggaaagcaggccaataaggg

SEQ ID NO: 765 - DNA, 20 bp, Homo sapiens
tctcagggaaagtcaggggg

SEQ ID NO: 766 - DNA, 23 bp, Homo sapiens
tctcagccctgcgggagggaggg

SEQ ID NO: 767 - DNA, 23 bp, Homo sapiens
ctttgggaaggagggagggaggg

SEQ ID NO: 768 - DNA, 24 bp, Homo sapiens
tctctggagtcagctgagggaggg

SEQ ID NO: 769 - DNA, 19 bp, Homo sapiens
tctctaggagggagggagg

SEQ ID NO: 770 - DNA, 24 bp, Homo sapiens
tctgtgggaccaggggagggaggg

SEQ ID NO: 771 - DNA, 20 bp, Homo sapiens
tctctgggaaagctgctggg

SEQ ID NO: 772 - DNA, 17 bp, Homo sapiens
ctctgggaaggtgggag

SEQ ID NO: 773 - DNA, 25 bp, Homo sapiens
tctactgggagagactcggggaggg

SEQ ID NO: 774 - DNA, 22 bp, Homo sapiens
ctgctgggggtggggggggggg

SEQ ID NO: 775 - DNA, 19 bp, Homo sapiens
tctccgggagagttggggg

SEQ ID NO: 776 - DNA, 19 bp, Homo sapiens
tctctggggggtcctgagg

SEQ ID NO: 777 - DNA, 23 bp, Homo sapiens
tcgctggaacccgggagggaggg

SEQ ID NO: 778 - DNA, 18 bp, Homo sapiens
tctctgggaagcgtaggg

SEQ ID NO: 779 - DNA, 17 bp, Homo sapiens
tgggggaagagggaggg

SEQ ID NO: 780 - DNA, 22 bp, Homo sapiens
tctctggaaggctgccggaggg

SEQ ID NO: 781 - DNA, 19 bp, Homo sapiens
cctctgggaaggcagaggg

SEQ ID NO: 782 - DNA, 18 bp, Homo sapiens
cctgggagagcaggaggg

SEQ ID NO: 783 - DNA, 19 bp, Homo sapiens
tggagggggataaggaggg

SEQ ID NO: 784 - DNA, 15 bp, Homo sapiens
tgggcgggagggagg

SEQ ID NO: 785 - DNA, 18 bp, Homo sapiens
tctctgtgaaagggaggg

SEQ ID NO: 786 - DNA, 21 bp, Homo sapiens
tccctggggaatgggggaggg

SEQ ID NO: 787 - DNA, 23 bp, Homo sapiens
tctgggaaggccaaaggggaggg

SEQ ID NO: 788 - DNA, 25 bp, Homo sapiens
tctttgggcaggaagctggggaggg

SEQ ID NO: 789 - DNA, 18 bp, Homo sapiens
tctctggggagggccagg

SEQ ID NO: 790 - DNA, 20 bp, Homo sapiens
ctgccagggtgggagggggg

SEQ ID NO: 791 - DNA, 19 bp, Homo sapiens
tcattgggaaaggggaggg

SEQ ID NO: 792 - DNA, 22 bp, Homo sapiens
tctctggggcaagtgggaatgg

SEQ ID NO: 793 - DNA, 21 bp, Homo sapiens
tctatgtggtgggagggaggg

SEQ ID NO: 794 - DNA, 22 bp, Homo sapiens
tcagggagagggcaggggaggg

SEQ ID NO: 795 - DNA, 19 bp, Homo sapiens
ctctgggaggacgggaggg

SEQ ID NO: 796 - DNA, 21 bp, Homo sapiens
tctctgggggagccccgaggg

SEQ ID NO: 797 - DNA, 21 bp, Homo sapiens
tctctggagatgcggggaggg

SEQ ID NO: 798 - DNA, 24 bp, Homo sapiens
tctctgagagatgctgggggaggg

SEQ ID NO: 799 - DNA, 24 bp, Homo sapiens
cctttgggaggcctgaagggaggg

SEQ ID NO: 800 - DNA, 16 bp, Homo sapiens
tgggagggagggaggg

SEQ ID NO: 801 - DNA, 20 bp, Homo sapiens
tggaaagagcgggggggggg

SEQ ID NO: 802 - DNA, 18 bp, Homo sapiens
gggaggcgggggggaggg

SEQ ID NO: 803 - DNA, 18 bp, Homo sapiens
cctgggagtgaagggagg

SEQ ID NO: 804 - DNA, 19 bp, Homo sapiens
tctggggaagtagggaagg

SEQ ID NO: 805 - DNA, 21 bp, Homo sapiens
tctctggaaaagctaagaggg

SEQ ID NO: 806 - DNA, 22 bp, Homo sapiens
tctctggggtgaggctggaggg

SEQ ID NO: 807 - DNA, 23 bp, Homo sapiens
ctttggggtggtgggagggaggg

SEQ ID NO: 808 - DNA, 19 bp, Homo sapiens
tggggaaacgggacttggg

SEQ ID NO: 809 - DNA, 24 bp, Homo sapiens
tccctggggctgtgggagggaggg

SEQ ID NO: 810 - DNA, 21 bp, Homo sapiens
tctctgggaggctgggaatgg

SEQ ID NO: 811 - DNA, 23 bp, Homo sapiens
tctcgggaaggtgacagtgaggg

SEQ ID NO: 812 - DNA, 19 bp, Homo sapiens
tctcaggggagggaggagg

SEQ ID NO: 813 - DNA, 21 bp, Homo sapiens
tccctgggggaactgggaggg

SEQ ID NO: 814 - DNA, 21 bp, Homo sapiens
tctcggggagggcgtcggggg

SEQ ID NO: 815 - DNA, 22 bp, Homo sapiens
tctctgaggaagtggtttaggg

SEQ ID NO: 816 - DNA, 22 bp, Homo sapiens
cctgggaagacactggggaggg

SEQ ID NO: 817 - DNA, 118 bp, Melanoplus sanguinipes entomopoxvirus
aaattatttataaaatttgaaaagaatgtagaaactataacttagaattaaatattacaatattatataaatatatagatttttatgatcctttatagtataattttgtaaataattt

SEQ ID NO: 818 - DNA, 24 bp, Melanoplus sanguinipes entomopoxvirus
tagaaactataacttagaattaaa

SEQ ID NO: 819 - DNA, 19 bp, Homo sapiens
cagaaacacttggaattaa

SEQ ID NO: 820 - DNA, 19 bp, Homo sapiens
tagaaaatataactctaga

SEQ ID NO: 821 - DNA, 19 bp, Homo sapiens
tagaaactatatttactta

SEQ ID NO: 822 - DNA, 22 bp, Homo sapiens
taaaaaaatgacttagaattaa

SEQ ID NO: 823 - DNA, 22 bp, Homo sapiens
agaaactggctgatagaattaa

SEQ ID NO: 824 - DNA, 21 bp, Homo sapiens
cagaaactataatttaatatt

SEQ ID NO: 825 - DNA, 21 bp, Homo sapiens
gaaactataacactacttaaa

SEQ ID NO: 826 - DNA, 24 bp, Homo sapiens
taaaaactatgacttgccactaaa

SEQ ID NO: 827 - DNA, 23 bp, Homo sapiens
tagaaaccataaaaaaaagttaa

SEQ ID NO: 828 - DNA, 19 bp, Homo sapiens
tacaaactatcagaattaa

SEQ ID NO: 829 - DNA, 20 bp, Homo sapiens
tagaaactaaccacaaatta

SEQ ID NO: 830 - DNA, 61 bp, Porcine adenovirus A
aggcggcgtggggaaggccggcctgcgtgtggacgaaggcgcggtaggactcttgcagctt

SEQ ID NO: 831 - DNA, 17 bp, Porcine adenovirus A
taggactcttgcagctt

SEQ ID NO: 832 - DNA, 20 bp, Homo sapiens
caggactctgccaccagctt

SEQ ID NO: 833 - DNA, 21 bp, Homo sapiens
tagaactcttcctcccagctt

SEQ ID NO: 834 - DNA, 20 bp, Homo sapiens
taggactcagcaagcagctt

SEQ ID NO: 835 - DNA, 18 bp, Homo sapiens
taggactcctgcctgctt

SEQ ID NO: 836 - DNA, 21 bp, Homo sapiens
taggaccctctgccatggctt

SEQ ID NO: 837 - DNA, 19 bp, Homo sapiens
aggatcacagctgcagctt

SEQ ID NO: 838 - DNA, 19 bp, Homo sapiens
ggactcctggccgcagctt

SEQ ID NO: 839 - DNA, 18 bp, Homo sapiens
taggaatccagccagctt

SEQ ID NO: 840 - DNA, 18 bp, Homo sapiens
taagactctcagatgctt

SEQ ID NO: 841 - DNA, 121 bp, Alcelaphine herpesvirus 1
aacacgtgcccacacttggcaagtctcttgcggaaaagctattttcaaatacattatttaattacaaacgtatttgaaacatagcttttccaacaagcaactagcaatttttgcacctgtt

SEQ ID NO: 842 - DNA, 24 bp, Alcelaphine herpesvirus 1
tttgaaacatagcttttccaacaa

SEQ ID NO: 843 - DNA, 24 bp, Homo sapiens
tttaaatctatgtttttccaacaa

SEQ ID NO: 844 - DNA, 21 bp, Homo sapiens
tttaaaatatagtttctccaa

SEQ ID NO: 845 - DNA, 16 bp, Homo sapiens
gaaatagcttccaaca

SEQ ID NO: 846 - DNA, 24 bp, Homo sapiens
ttgaaacagatttcttttttaaca

SEQ ID NO: 847 - DNA, 23 bp, Homo sapiens
tttgaaacatgacctgcatgaca

SEQ ID NO: 848 - DNA, 20 bp, Homo sapiens
tttggcaccattttccaaca

SEQ ID NO: 849 - DNA, 20 bp, Homo sapiens
tttgagccaatgttccaaca

SEQ ID NO: 850 - DNA, 22 bp, Homo sapiens
tttaaaacctgctttccagcaa

SEQ ID NO: 851 - DNA, 18 bp, Homo sapiens
aaacatagcaaccagaca

SEQ ID NO: 852 - DNA, 23 bp, Homo sapiens
tttgaaatgggcttttccaacaa

SEQ ID NO: 853 - DNA, 17 bp, Homo sapiens
tttaaatatagcttttc

SEQ ID NO: 854 - DNA, 23 bp, Homo sapiens
tttgagtacagctacttctaaca

SEQ ID NO: 855 - DNA, 17 bp, Homo sapiens
tttaaaaccctttccaa

SEQ ID NO: 856 - DNA, 22 bp, Homo sapiens
tttgcaacagctccttttccaa

SEQ ID NO: 857 - DNA, 19 bp, Homo sapiens
tttgaaacattgttttcca

SEQ ID NO: 858 - DNA, 21 bp, Homo sapiens
tttgaggttgttttccaacaa

SEQ ID NO: 859 - DNA, 22 bp, Homo sapiens
tctgaaacatagaaggctgaca

SEQ ID NO: 860 - DNA, 83 bp, Porcine adenovirus A
ggggcagtgtcccttgtccacggccagctcgtaggccgcggcggccttgcggaggctggtgtgcgtgagggcgaaggtgtccc

SEQ ID NO: 861 - DNA, 24 bp, Porcine adenovirus A
ccttgcggaggctggtgtgcgtga

SEQ ID NO: 862 - DNA, 20 bp, Homo sapiens
cttggggatgtgtgtgcgtg

SEQ ID NO: 863 - DNA, 20 bp, Homo sapiens
cttgcgaggctgagttgtga

SEQ ID NO: 864 - DNA, 17 bp, Homo sapiens
cttgggaggctgatgtg

SEQ ID NO: 865 - DNA, 16 bp, Homo sapiens
ccttgtgtgtgtgcgt

SEQ ID NO: 866 - DNA, 19 bp, Homo sapiens
ttgggaggctgaggcagtg

SEQ ID NO: 867 - DNA, 17 bp, Homo sapiens
cttcggaggcccgtgtg

SEQ ID NO: 868 - DNA, 18 bp, Homo sapiens
ctttcggaggctgaggtg

SEQ ID NO: 869 - DNA, 18 bp, Homo sapiens
ccttgggaggctgaggtg

SEQ ID NO: 870 - DNA, 24 bp, Homo sapiens
ccttgcggcaggttggccacgtga

SEQ ID NO: 871 - DNA, 18 bp, Homo sapiens
cttttggaggctgaggtg

SEQ ID NO: 872 - DNA, 18 bp, Homo sapiens
cctgtggaggctgttgtg

SEQ ID NO: 873 - DNA, 19 bp, Homo sapiens
ttgggaggctgaggcgtga

SEQ ID NO: 874 - DNA, 19 bp, Homo sapiens
ccttggggtggtgtgcgtg

SEQ ID NO: 875 - DNA, 19 bp, Homo sapiens
cctttggagactgtgtgtg

SEQ ID NO: 876 - DNA, 17 bp, Homo sapiens
cttgggaggctgaggtg

SEQ ID NO: 877 - DNA, 18 bp, Homo sapiens
ttgggaggctgaggtgtg

SEQ ID NO: 878 - DNA, 18 bp, Homo sapiens
ccttgcggagcccgcgtg

SEQ ID NO: 879 - DNA, 67 bp, Porcine adenovirus A
agctgggcataggccagggggtcctcggggtcgtccggcaggccggggccccgctcctgcgccagct

SEQ ID NO: 880 - DNA, 24 bp, Porcine adenovirus A
agggggtcctcggggtcgtccggc

SEQ ID NO: 881 - DNA, 21 bp, Homo sapiens
agggggcttcggcaagccggc

SEQ ID NO: 882 - DNA, 23 bp, Homo sapiens
gggggtcacttggggtggggagc

SEQ ID NO: 883 - DNA, 18 bp, Homo sapiens
agggggccttggggaggc

SEQ ID NO: 884 - DNA, 24 bp, Homo sapiens
aggggggcctcgggggtccctggc

SEQ ID NO: 885 - DNA, 24 bp, Homo sapiens
agggggtcctaggggtggtctggc

SEQ ID NO: 886 - DNA, 24 bp, Homo sapiens
agggggccttgggcggtgccggag

SEQ ID NO: 887 - DNA, 18 bp, Homo sapiens
aggaggtcctcggggtca

SEQ ID NO: 888 - DNA, 16 bp, Homo sapiens
gggggtcctcggccgg

SEQ ID NO: 889 - DNA, 21 bp, Homo sapiens
agggggtcctggggatgaggc

SEQ ID NO: 890 - DNA, 23 bp, Homo sapiens
gggagtccttgggggaagccggc

SEQ ID NO: 891 - DNA, 21 bp, Homo sapiens
agggagtctttggagcttggc

SEQ ID NO: 892 - DNA, 21 bp, Homo sapiens
agggggccttggtgggtcggc

SEQ ID NO: 893 - DNA, 21 bp, Homo sapiens
ggcgggtcctcggggaggggc

SEQ ID NO: 894 - DNA, 17 bp, Homo sapiens
gggggtccatggcccgg

SEQ ID NO: 895 - DNA, 19 bp, Homo sapiens
agggggcccttgggggagg

SEQ ID NO: 896 - DNA, 21 bp, Homo sapiens
gggggtccctgctactccggc

SEQ ID NO: 897 - DNA, 24 bp, Homo sapiens
agggggtctgtggggtccaggagc

SEQ ID NO: 898 - DNA, 19 bp, Homo sapiens
agggggtcctggcggctgg

SEQ ID NO: 899 - DNA, 91 bp, Rana tigrina ranavirus
ggttctcttgtagccctccaacattggaagccagcactgagaagtgtttgggttaaagtccctgatgtagaggaggtcgcactcgacggcc

SEQ ID NO: 900 - DNA, 24 bp, Rana tigrina ranavirus
tctcttgtagccctccaacattgg

SEQ ID NO: 901 - DNA, 22 bp, Homo sapiens
cctcctccttctctaacattgg

SEQ ID NO: 902 - DNA, 23 bp, Homo sapiens
tctcttgtagtcattctccttgg

SEQ ID NO: 903 - DNA, 19 bp, Homo sapiens
tcttgtagcccctcaccat

SEQ ID NO: 904 - DNA, 15 bp, Homo sapiens
tctctgtacaacatt

SEQ ID NO: 905 - DNA, 21 bp, Homo sapiens
tcttgtaggtttcgacattgg

SEQ ID NO: 906 - DNA, 22 bp, Homo sapiens
tcctttgtagccctctccactg

SEQ ID NO: 907 - DNA, 26 bp, Homo sapiens
tctcttgtggttcctgaggccaattg

SEQ ID NO: 908 - DNA, 20 bp, Homo sapiens
tcttgtagctctctggctgg

SEQ ID NO: 909 - DNA, 24 bp, Homo sapiens
tcctttgttctcctccaacgttgg

SEQ ID NO: 910 - DNA, 24 bp, Homo sapiens
tctcttgtgctttttctactttgg

SEQ ID NO: 911 - DNA, 20 bp, Homo sapiens
tctcttgtagcatctccaca

SEQ ID NO: 912 - DNA, 22 bp, Homo sapiens
cctcttggtcttccagtgttgg

SEQ ID NO: 913 - DNA, 25 bp, Homo sapiens
tctcctgtagtgtctgtggcattgg

SEQ ID NO: 914 - DNA, 81 bp, Alcelaphine herpesvirus 1
ctcattttaaaatagcttgtcgggctgtgtctattcttctttatgtccacagacacaacacacaagctaccttactatgag

SEQ ID NO: 915 - DNA, 24 bp, Alcelaphine herpesvirus 1
tagcttgtcgggctgtgtctattc

SEQ ID NO: 916 - DNA, 20 bp, Homo sapiens
gctggggccgtgtgtctatt

SEQ ID NO: 917 - DNA, 21 bp, Homo sapiens
taacttgtcaaatgtctgttc

SEQ ID NO: 918 - DNA, 21 bp, Homo sapiens
tagcttgcgaggcagtctatt

SEQ ID NO: 919 - DNA, 18 bp, Homo sapiens
acttgttatatgtctatt

SEQ ID NO: 920 - DNA, 62 bp, Porcine adenovirus A
ggaagaccagcaggaagggcacgagctgctttccgaagcggccgtgccaggtgtaggtctcc

SEQ ID NO: 921 - DNA, 24 bp, Porcine adenovirus A
aagggcacgagctgctttccgaag

SEQ ID NO: 922 - DNA, 24 bp, Homo sapiens
gggcaagagttgctttccatgaag

SEQ ID NO: 923 - DNA, 18 bp, Homo sapiens
agggcacagttttcctga

SEQ ID NO: 924 - DNA, 18 bp, Homo sapiens
gggtgtgagctgttccca

SEQ ID NO: 925 - DNA, 22 bp, Homo sapiens
agggtgtgagctgctgctgaag

SEQ ID NO: 926 - DNA, 23 bp, Homo sapiens
agggccatgggctgattccgaag

SEQ ID NO: 927 - DNA, 20 bp, Homo sapiens
gggatggctgctttctgaag

SEQ ID NO: 928 - DNA, 19 bp, Homo sapiens
aagggcacagagcgtggct

SEQ ID NO: 929 - DNA, 20 bp, Homo sapiens
ggagaaagctgctttctgga

SEQ ID NO: 930 - DNA, 21 bp, Homo sapiens
agggcacaggctgcttaaacg

SEQ ID NO: 931 - DNA, 21 bp, Homo sapiens
aagggcaataagggctttccg

SEQ ID NO: 932 - DNA, 23 bp, Homo sapiens
aagggcacaggctagctcctgga

SEQ ID NO: 933 - DNA, 18 bp, Homo sapiens
agggcacgagctgttcca

SEQ ID NO: 934 - DNA, 20 bp, Homo sapiens
agggagtgggctgcttccaa

SEQ ID NO: 935 - DNA, 17 bp, Homo sapiens
gggcactacctttctga

SEQ ID NO: 936 - DNA, 18 bp, Homo sapiens
aaggcaccgctctttccg

SEQ ID NO: 937 - DNA, 17 bp, Homo sapiens
agggcacgcgcttctcg

SEQ ID NO: 938 - DNA, 16 bp, Homo sapiens
aagggcacgggctccg

SEQ ID NO: 939 - DNA, 21 bp, Homo sapiens
agggcatccctgttttctgga

SEQ ID NO: 940 - DNA, 16 bp, Homo sapiens
agggcacagcttcgcg

SEQ ID NO: 941 - DNA, 16 bp, Homo sapiens
gggcacggccgctccg

SEQ ID NO: 942 - DNA, 22 bp, Homo sapiens
agggcacggcgcctccctgaag

SEQ ID NO: 943 - DNA, 20 bp, Homo sapiens
agggcacaggtacctttgga

SEQ ID NO: 944 - DNA, 22 bp, Homo sapiens
gggtggatgagactttccgaag

SEQ ID NO: 945 - DNA, 21 bp, Homo sapiens
aggccgctcctcgctttctga

SEQ ID NO: 946 - DNA, 21 bp, Homo sapiens
ggcacgagctgccagcagaag

SEQ ID NO: 947 - DNA, 21 bp, Homo sapiens
aaggacacgagttgtatcaga

SEQ ID NO: 948 - DNA, 21 bp, Homo sapiens
aaggcacagcgctttctgaag

SEQ ID NO: 949 - DNA, 22 bp, Homo sapiens
aggagcacgagctgcggcccga

SEQ ID NO: 950 - DNA, 17 bp, Homo sapiens
ggcgcacgggccccgaa

SEQ ID NO: 951 - DNA, 17 bp, Homo sapiens
agggcacaggcactgaa

SEQ ID NO: 952 - DNA, 18 bp, Homo sapiens
agggcacaagctgtggga

SEQ ID NO: 953 - DNA, 17 bp, Homo sapiens
agggcacgcggctccga

SEQ ID NO: 954 - DNA, 19 bp, Homo sapiens
agggcacagctgctgtcca

SEQ ID NO: 955 - DNA, 17 bp, Homo sapiens
aaggcacgagtcctgaa

SEQ ID NO: 956 - DNA, 60 bp, Porcine adenovirus A
cccctcctcttgcaggtacgtggccccgcccagtgggatgggctttggatgggggagggg

SEQ ID NO: 957 - DNA, 18 bp, Porcine adenovirus A
ctttggatgggggagggg

SEQ ID NO: 958 - DNA, 20 bp, Homo sapiens
ctctggatgccagggagggg

SEQ ID NO: 959 - DNA, 18 bp, Homo sapiens
ctttggtatggggagggg

SEQ ID NO: 960 - DNA, 17 bp, Homo sapiens
ccttggccaaggagggg

SEQ ID NO: 961 - DNA, 15 bp, Homo sapiens
ctctgaagggagggg

SEQ ID NO: 962 - DNA, 17 bp, Homo sapiens
ccgaagatggggggggg

SEQ ID NO: 963 - DNA, 18 bp, Homo sapiens
ctctggctgcgggagggg

SEQ ID NO: 964 - DNA, 15 bp, Homo sapiens
ctctcgggggagggg

SEQ ID NO: 965 - DNA, 17 bp, Homo sapiens
ctttactaagggagggg

SEQ ID NO: 966 - DNA, 20 bp, Homo sapiens
ctttggggagaagggagggg

SEQ ID NO: 967 - DNA, 17 bp, Homo sapiens
ctccggtgggggagggg

SEQ ID NO: 968 - DNA, 18 bp, Homo sapiens
tttgagcagggggagggg

SEQ ID NO: 969 - DNA, 18 bp, Homo sapiens
ctttgggtgtgggagggg

SEQ ID NO: 970 - DNA, 17 bp, Homo sapiens
cttcctgcggggagggg

SEQ ID NO: 971 - DNA, 15 bp, Homo sapiens
cttcgggaggagggg

SEQ ID NO: 972 - DNA, 18 bp, Homo sapiens
ctatggatgggaatcagg

SEQ ID NO: 973 - DNA, 17 bp, Homo sapiens
caatggtgggggagggg

SEQ ID NO: 974 - DNA, 17 bp, Homo sapiens
cccctttgggggagggg

SEQ ID NO: 975 - DNA, 16 bp, Homo sapiens
ctttgcaagggagggg

SEQ ID NO: 976 - DNA, 17 bp, Homo sapiens
ctgtggacggggagggg

SEQ ID NO: 977 - DNA, 19 bp, Homo sapiens
ccttggatgggccgcgggg

SEQ ID NO: 978 - DNA, 18 bp, Homo sapiens
tttgtgtggggggagggg

SEQ ID NO: 979 - DNA, 18 bp, Homo sapiens
ctctgatgacaggagggg

SEQ ID NO: 980 - DNA, 18 bp, Homo sapiens
ccttgctgtggggagggg

SEQ ID NO: 981 - DNA, 16 bp, Homo sapiens
ctttgacagggagggg

SEQ ID NO: 982 - DNA, 17 bp, Homo sapiens
caacggtgggggagggg

SEQ ID NO: 983 - DNA, 15 bp, Homo sapiens
ctctgaggggagggg

SEQ ID NO: 984 - DNA, 16 bp, Homo sapiens
ctctgggagggagggg

SEQ ID NO: 985 - DNA, 17 bp, Homo sapiens
ctttggaaaaggagggg

SEQ ID NO: 986 - DNA, 20 bp, Homo sapiens
cttcggatggaaccttgggg

SEQ ID NO: 987 - DNA, 17 bp, Homo sapiens
ctgtgtcgggggagggg

SEQ ID NO: 988 - DNA, 16 bp, Homo sapiens
ctttggaggggagggg

SEQ ID NO: 989 - DNA, 18 bp, Homo sapiens
cttagggtggaggaaggg

SEQ ID NO: 990 - DNA, 20 bp, Homo sapiens
cttgggaaaggggggagggg

SEQ ID NO: 991 - DNA, 18 bp, Homo sapiens
ctgtgtatgtgggagggg

SEQ ID NO: 992 - DNA, 20 bp, Homo sapiens
ccttggggaggaaggagggg

SEQ ID NO: 993 - DNA, 15 bp, Homo sapiens
ctttaggagaagggg

SEQ ID NO: 994 - DNA, 18 bp, Homo sapiens
tctgcctggggggagggg

SEQ ID NO: 995 - DNA, 18 bp, Homo sapiens
tctgcctgcggggagggg

SEQ ID NO: 996 - DNA, 19 bp, Homo sapiens
tttgggagggaagaagggg

SEQ ID NO: 997 - DNA, 20 bp, Homo sapiens
ctttaggtgtaggggagggg

SEQ ID NO: 998 - DNA, 15 bp, Homo sapiens
ctttggaaaaagggg

SEQ ID NO: 999 - DNA, 15 bp, Homo sapiens
ccttagggggagggg

SEQ ID NO: 1000 - DNA, 18 bp, Homo sapiens
ctgtgggcaaaaaagggg

SEQ ID NO: 1001 - DNA, 18 bp, Homo sapiens
ctctggagtggggagggg

SEQ ID NO: 1002 - DNA, 18 bp, Homo sapiens
ccttggatgggtccaggg

SEQ ID NO: 1003 - DNA, 18 bp, Homo sapiens
ctttggaagtttaagggg

SEQ ID NO: 1004 - DNA, 18 bp, Homo sapiens
tttggtccgagggagggg

SEQ ID NO: 1005 - DNA, 17 bp, Homo sapiens
ctttaccaagggagggg

SEQ ID NO: 1006 - DNA, 20 bp, Homo sapiens
ctctggatgggaaaaagggg

SEQ ID NO: 1007 - DNA, 17 bp, Homo sapiens
ctgtgaatggggagggg

SEQ ID NO: 1008 - DNA, 18 bp, Homo sapiens
ctttgggaaaaaaagggg

SEQ ID NO: 1009 - DNA, 15 bp, Homo sapiens
ctctagagggagggg

SEQ ID NO: 1010 - DNA, 15 bp, Homo sapiens
ccttgagaggagggg

SEQ ID NO: 1011 - DNA, 15 bp, Homo sapiens
cctctgggggagggg

SEQ ID NO: 1012 - DNA, 18 bp, Homo sapiens
ttgaaagtgggggagggg

SEQ ID NO: 1013 - DNA, 17 bp, Homo sapiens
cctcattgggggagggg

SEQ ID NO: 1014 - DNA, 17 bp, Homo sapiens
ctttgcgggaggagggg

SEQ ID NO: 1015 - DNA, 18 bp, Homo sapiens
tttggcactcaggagggg

SEQ ID NO: 1016 - DNA, 16 bp, Homo sapiens
ctatggaggagagggg

SEQ ID NO: 1017 - DNA, 16 bp, Homo sapiens
ctctgcaggggagggg

SEQ ID NO: 1018 - DNA, 19 bp, Homo sapiens
tctggggcagcgggagggg

SEQ ID NO: 1019 - DNA, 16 bp, Homo sapiens
ctttggtggggagggg

SEQ ID NO: 1020 - DNA, 18 bp, Homo sapiens
ctctggggaaaaaagggg

SEQ ID NO: 1021 - DNA, 17 bp, Homo sapiens
ctctggataaaaagggg

SEQ ID NO: 1022 - DNA, 18 bp, Homo sapiens
ctgtggatttaggagggg

SEQ ID NO: 1023 - DNA, 19 bp, Homo sapiens
ctttgagtaaaaagagggg

SEQ ID NO: 1024 - DNA, 16 bp, Homo sapiens
ctctggtggggagggg

SEQ ID NO: 1025 - DNA, 18 bp, Homo sapiens
ctttggatgaagtttggg

SEQ ID NO: 1026 - DNA, 15 bp, Homo sapiens
ccttgaaaggagggg

SEQ ID NO: 1027 - DNA, 18 bp, Homo sapiens
ctttggagaaagtagggg

SEQ ID NO: 1028 - DNA, 18 bp, Homo sapiens
ctctgaggaggggagggg

SEQ ID NO: 1029 - DNA, 18 bp, Homo sapiens
tctggggaagatgagggg

SEQ ID NO: 1030 - DNA, 18 bp, Homo sapiens
ctgtggtgaggggagggg

SEQ ID NO: 1031 - DNA, 17 bp, Homo sapiens
ctgtggtgcaggagggg

SEQ ID NO: 1032 - DNA, 17 bp, Homo sapiens
ctttgcaagaagagggg

SEQ ID NO: 1033 - DNA, 15 bp, Homo sapiens
ctttgagaggagggg

SEQ ID NO: 1034 - DNA, 15 bp, Homo sapiens
ccttgaagggagggg

SEQ ID NO: 1035 - DNA, 18 bp, Homo sapiens
ctctggactctggagggg

SEQ ID NO: 1036 - DNA, 18 bp, Homo sapiens
ctttggcgaagggagggg

SEQ ID NO: 1037 - DNA, 16 bp, Homo sapiens
cttcttgggggagggg

SEQ ID NO: 1038 - DNA, 17 bp, Homo sapiens
ctgtggggagggagggg

SEQ ID NO: 1039 - DNA, 19 bp, Homo sapiens
tttggaaaggagggagggg

SEQ ID NO: 1040 - DNA, 17 bp, Homo sapiens
cctttctgagggagggg

SEQ ID NO: 1041 - DNA, 17 bp, Homo sapiens
ctgcagcaggggagggg

SEQ ID NO: 1042 - DNA, 18 bp, Homo sapiens
ctctatagaggggagggg

SEQ ID NO: 1043 - DNA, 18 bp, Homo sapiens
ctctgtgaaagggagggg

SEQ ID NO: 1044 - DNA, 17 bp, Homo sapiens
ccttagatggggagggg

SEQ ID NO: 1045 - DNA, 18 bp, Homo sapiens
ccttggatggagataggg

SEQ ID NO: 1046 - DNA, 16 bp, Homo sapiens
ccttgcaggggagggg

SEQ ID NO: 1047 - DNA, 17 bp, Homo sapiens
ctttgatgggggagggg

SEQ ID NO: 1048 - DNA, 18 bp, Homo sapiens
ctttgtgaatgagagggg

SEQ ID NO: 1049 - DNA, 17 bp, Homo sapiens
ctttgggtagggagggg

SEQ ID NO: 1050 - DNA, 18 bp, Homo sapiens
tctggtgtgggggagggg

SEQ ID NO: 1051 - DNA, 17 bp, Homo sapiens
ctgtggatgagaagggg

SEQ ID NO: 1052 - DNA, 20 bp, Homo sapiens
ctttgaatgggattatgggg

SEQ ID NO: 1053 - DNA, 18 bp, Homo sapiens
ctttgggtgggggaaggg

SEQ ID NO: 1054 - DNA, 16 bp, Homo sapiens
ctctgtgggggagggg

SEQ ID NO: 1055 - DNA, 16 bp, Homo sapiens
ccttggcggggagggg

SEQ ID NO: 1056 - DNA, 18 bp, Homo sapiens
ctcaagctgggggagggg

SEQ ID NO: 1057 - DNA, 18 bp, Homo sapiens
ttgggtgggagagcaggg

SEQ ID NO: 1058 - DNA, 15 bp, Homo sapiens
ctctgaaaggagggg

SEQ ID NO: 1059 - DNA, 18 bp, Homo sapiens
ttagaagtgggggagggg

SEQ ID NO: 1060 - DNA, 16 bp, Homo sapiens
ctctggcagggagggg

SEQ ID NO: 1061 - DNA, 16 bp, Homo sapiens
ctgtggggaggagggg

SEQ ID NO: 1062 - DNA, 21 bp, Homo sapiens
ccttggatggacagctagggg

SEQ ID NO: 1063 - DNA, 16 bp, Homo sapiens
ccttggaagtgagggg

SEQ ID NO: 1064 - DNA, 18 bp, Homo sapiens
cccaaaatgggggagggg

SEQ ID NO: 1065 - DNA, 16 bp, Homo sapiens
ccttgggggggagggg

SEQ ID NO: 1066 - DNA, 17 bp, Homo sapiens
ctctgcggtgggagggg

SEQ ID NO: 1067 - DNA, 18 bp, Homo sapiens
ctttggaaccgagagggg

SEQ ID NO: 1068 - DNA, 17 bp, Homo sapiens
ctaagttgggggagggg

SEQ ID NO: 1069 - DNA, 18 bp, Homo sapiens
ctctggatgggagagggg

SEQ ID NO: 1070 - DNA, 17 bp, Homo sapiens
ctctgggggaggagggg

SEQ ID NO: 1071 - DNA, 18 bp, Homo sapiens
ctttgaggtaaggagggg

SEQ ID NO: 1072 - DNA, 19 bp, Homo sapiens
ccttggatgaaggcagggg

SEQ ID NO: 1073 - DNA, 15 bp, Homo sapiens
ctttggggagagggg

SEQ ID NO: 1074 - DNA, 19 bp, Homo sapiens
ccttggggtgccggagggg

SEQ ID NO: 1075 - DNA, 16 bp, Homo sapiens
ctttgggggggggggg

SEQ ID NO: 1076 - DNA, 21 bp, Homo sapiens
tttggcaggtgggggaggggc

SEQ ID NO: 1077 - DNA, 17 bp, Homo sapiens
cttaggatgaggagggg

SEQ ID NO: 1078 - DNA, 18 bp, Homo sapiens
ctgtggactggggagggg

SEQ ID NO: 1079 - DNA, 21 bp, Homo sapiens
ctttggaaaactggggagggg

SEQ ID NO: 1080 - DNA, 15 bp, Homo sapiens
ctctggaaggagggg

SEQ ID NO: 1081 - DNA, 17 bp, Homo sapiens
ctctgctatgggagggg

SEQ ID NO: 1082 - DNA, 18 bp, Homo sapiens
ctttggagatgggagggg

SEQ ID NO: 1083 - DNA, 16 bp, Homo sapiens
ctgtggaggggagggg

SEQ ID NO: 1084 - DNA, 18 bp, Homo sapiens
cttgggttgggggagggg

SEQ ID NO: 1085 - DNA, 18 bp, Homo sapiens
ctttggagatggaagggg

SEQ ID NO: 1086 - DNA, 18 bp, Homo sapiens
ctctggatggatagaggg

SEQ ID NO: 1087 - DNA, 18 bp, Homo sapiens
ctttggacggaagtgggg

SEQ ID NO: 1088 - DNA, 18 bp, Homo sapiens
ctctggtcaggggagggg

SEQ ID NO: 1089 - DNA, 16 bp, Homo sapiens
ccttggggaagagggg

SEQ ID NO: 1090 - DNA, 18 bp, Homo sapiens
ctctgagtaggggagggg

SEQ ID NO: 1091 - DNA, 64 bp, Alcelaphine herpesvirus 1
tatgtcatgatcttaatgtagcacctttatttgaaaaaaagtcctccattaggatcatcacata

SEQ ID NO: 1092 - DNA, 24 bp, Alcelaphine herpesvirus 1
tgtcatgatcttaatgtagcacct

SEQ ID NO: 1093 - DNA, 22 bp, Homo sapiens
tgtcgtatttcctgcagcacct

SEQ ID NO: 1094 - DNA, 20 bp, Homo sapiens
tgtcacgattttcatttagc

SEQ ID NO: 1095 - DNA, 22 bp, Homo sapiens
tatcatgattttcccagcacct

SEQ ID NO: 1096 - DNA, 23 bp, Homo sapiens
tgttgtatcttaatggtgtacct

SEQ ID NO: 1097 - DNA, 18 bp, Homo sapiens
tgtcatgaacttaattgt

SEQ ID NO: 1098 - DNA, 20 bp, Homo sapiens
tgtgaggatctgtagcacct

SEQ ID NO: 1099 - DNA, 20 bp, Homo sapiens
tgtgatttctaacagcacct

SEQ ID NO: 1100 - DNA, 17 bp, Homo sapiens
tggcatgatcttatgca

SEQ ID NO: 1101 - DNA, 19 bp, Homo sapiens
tcatgatcttgtttcatct

SEQ ID NO: 1102 - DNA, 19 bp, Homo sapiens
tgtcatgacctgaagcgcc

SEQ ID NO: 1103 - DNA, 19 bp, Homo sapiens
tgtcatgttcagtagcacc

SEQ ID NO: 1104 - DNA, 21 bp, Homo sapiens
tgtcatgaaaatgtggtacct

SEQ ID NO: 1105 - DNA, 22 bp, Homo sapiens
gtcatgatcttgaacagtgcct

SEQ ID NO: 1106 - DNA, 18 bp, Homo sapiens
tgttcttcaatgtagcac

SEQ ID NO: 1107 - DNA, 18 bp, Homo sapiens
tgtcatgatctaatcacc

SEQ ID NO: 1108 - DNA, 131 bp, Porcine adenovirus A
ttggcctggatcttgaggttggagatgttgccgctctggtcgcggcgggggttcatgttgtggaggacgacgaggacggcgtagccggtgcagcgggggaagcgggcgtgcagcttggaggggaaggcgtg

SEQ ID NO: 1109 - DNA, 24 bp, Porcine adenovirus A
agatgttgccgctctggtcgcggc

SEQ ID NO: 1110 - DNA, 19 bp, Homo sapiens
agatgttgtcctccctggt

SEQ ID NO: 1111 - DNA, 23 bp, Homo sapiens
agatgttagctgcagcgtgcggc

SEQ ID NO: 1112 - DNA, 20 bp, Homo sapiens
aaatgttgctgttctgtggc

SEQ ID NO: 1113 - DNA, 22 bp, Homo sapiens
agatgttactgctgggcgtggc

SEQ ID NO: 1114 - DNA, 20 bp, Homo sapiens
agatgttgctgtctccgggc

SEQ ID NO: 1115 - DNA, 19 bp, Homo sapiens
agatgttgtctgttgctgg

SEQ ID NO: 1116 - DNA, 23 bp, Homo sapiens
gatgttgccgatcttccacaggc

SEQ ID NO: 1117 - DNA, 21 bp, Homo sapiens
gatgtcgctgccccctgcggc

SEQ ID NO: 1118 - DNA, 22 bp, Homo sapiens
gatgttgctgctgctgggagac

SEQ ID NO: 1119 - DNA, 68 bp, Porcine adenovirus A
ccagggcgctgtcccagtggcggtggtaggtgatgctccagctctccccgtcctgggtggtgccctgg

SEQ ID NO: 1120 - DNA, 24 bp, Porcine adenovirus A
tccccgtcctgggtggtgccctgg

SEQ ID NO: 1121 - DNA, 24 bp, Homo sapiens
tctcctgtcctgtcagtgccctgg

SEQ ID NO: 1122 - DNA, 21 bp, Homo sapiens
tccctgcctgggtggctgtgg

SEQ ID NO: 1123 - DNA, 19 bp, Homo sapiens
tctccgtcctgcggctctg

SEQ ID NO: 1124 - DNA, 24 bp, Homo sapiens
tccttgtcctagggaatagtctgg

SEQ ID NO: 1125 - DNA, 23 bp, Homo sapiens
ccctgtcctggagctgcccttgg

SEQ ID NO: 1126 - DNA, 21 bp, Homo sapiens
ccctagagagtggtgccctgg

SEQ ID NO: 1127 - DNA, 23 bp, Homo sapiens
tcctgctctgggaggggccctgg

SEQ ID NO: 1128 - DNA, 19 bp, Homo sapiens
tccctgtcctgagcccctg

SEQ ID NO: 1129 - DNA, 21 bp, Homo sapiens
ccgtcctgggagtctccctgg

SEQ ID NO: 1130 - DNA, 17 bp, Homo sapiens
cctttcctgggcacctg

SEQ ID NO: 1131 - DNA, 21 bp, Homo sapiens
tccttgtcctgggtgtcctgg

SEQ ID NO: 1132 - DNA, 21 bp, Homo sapiens
tccctgatcctggagccctgg

SEQ ID NO: 1133 - DNA, 23 bp, Homo sapiens
tccttatcctggagccatcctgg

SEQ ID NO: 1134 - DNA, 22 bp, Homo sapiens
tcctcttcctggatattcctgg

SEQ ID NO: 1135 - DNA, 18 bp, Homo sapiens
tccttgtctctggccctg

SEQ ID NO: 1136 - DNA, 21 bp, Homo sapiens
cctctcctgggcctgctctgg

SEQ ID NO: 1137 - DNA, 22 bp, Homo sapiens
tctccatcctggaggctcctgg

SEQ ID NO: 1138 - DNA, 20 bp, Homo sapiens
gccctgggaggaggctctgg

SEQ ID NO: 1139 - DNA, 18 bp, Homo sapiens
tccctctcctgggtcctg

SEQ ID NO: 1140 - DNA, 19 bp, Homo sapiens
ccctcgtcctcctgccctg

SEQ ID NO: 1141 - DNA, 21 bp, Homo sapiens
cccgtctcccaggtgccctgg

SEQ ID NO: 1142 - DNA, 22 bp, Homo sapiens
ccctgtccccacagtgccctgg

SEQ ID NO: 1143 - DNA, 24 bp, Homo sapiens
tccctctcctgggtggaggtctgg

SEQ ID NO: 1144 - DNA, 18 bp, Homo sapiens
cattctgggtgatgatgg

SEQ ID NO: 1145 - DNA, 18 bp, Homo sapiens
tccctggcctgggtgatg

SEQ ID NO: 1146 - DNA, 17 bp, Homo sapiens
tcctgggtcagagctgg

SEQ ID NO: 1147 - DNA, 21 bp, Homo sapiens
tcccctcttagggtgccctgg

SEQ ID NO: 1148 - DNA, 19 bp, Homo sapiens
tcctcgtctgagagctctg

SEQ ID NO: 1149 - DNA, 24 bp, Homo sapiens
tcccctccacatcaggtgccctgg

SEQ ID NO: 1150 - DNA, 20 bp, Homo sapiens
tcctgcctgggtgggggtgg

SEQ ID NO: 1151 - DNA, 26 bp, Homo sapiens
tccctgccctgggccttccgtcctgg

SEQ ID NO: 1152 - DNA, 21 bp, Homo sapiens
tccccatcttgtatgtcctgg

SEQ ID NO: 1153 - DNA, 21 bp, Homo sapiens
tccctggcctggaagccttgg

SEQ ID NO: 1154 - DNA, 18 bp, Homo sapiens
cccttgtcctgggtcctg

SEQ ID NO: 1155 - DNA, 18 bp, Homo sapiens
tctccgtcctgggtgctg

SEQ ID NO: 1156 - DNA, 17 bp, Homo sapiens
gccctgggcggccttgg

SEQ ID NO: 1157 - DNA, 23 bp, Homo sapiens
tccccgcctggggctgtgtctgg

SEQ ID NO: 1158 - DNA, 20 bp, Homo sapiens
tcccttctgcactgccctgg

SEQ ID NO: 1159 - DNA, 20 bp, Homo sapiens
cgtgagaggtggtgttctgg

SEQ ID NO: 1160 - DNA, 16 bp, Homo sapiens
gtcctggagatcctgg

SEQ ID NO: 1161 - DNA, 21 bp, Homo sapiens
tccccttcttcactgccctgg

SEQ ID NO: 1162 - DNA, 23 bp, Homo sapiens
tcctgtcctgatgcctgccctgg

SEQ ID NO: 1163 - DNA, 21 bp, Homo sapiens
tcctcgttattgacgccctgg

SEQ ID NO: 1164 - DNA, 21 bp, Homo sapiens
tcctcgtttgcgatgtcctgg

SEQ ID NO: 1165 - DNA, 21 bp, Homo sapiens
tcctcgttcgcgatgccctgg

SEQ ID NO: 1166 - DNA, 62 bp, Alcelaphine herpesvirus 1
gccttctaccctccttatatatattatatattgtttattatattgaaaaaggaagtacaggt

SEQ ID NO: 1167 - DNA, 24 bp, Alcelaphine herpesvirus 1
ttatattgaaaaaggaagtacagg

SEQ ID NO: 1168 - DNA, 22 bp, Homo sapiens
tcatattgaaggaaattacagg

SEQ ID NO: 1169 - DNA, 19 bp, Homo sapiens
tatattgaaaaggatcagg

SEQ ID NO: 1170 - DNA, 18 bp, Homo sapiens
ttattttgagaaaggaaa

SEQ ID NO: 1171 - DNA, 22 bp, Homo sapiens
tattcaaaaagggaagtatagg

SEQ ID NO: 1172 - DNA, 22 bp, Homo sapiens
ttatattgataacaggtacagg

SEQ ID NO: 1173 - DNA, 22 bp, Homo sapiens
ttatattaggaaatcatacagg

SEQ ID NO: 1174 - DNA, 19 bp, Homo sapiens
ttgaagaaggaaatacagg

SEQ ID NO: 1175 - DNA, 17 bp, Homo sapiens
ttatttgagaaaggaag

SEQ ID NO: 1176 - DNA, 19 bp, Homo sapiens
gagcaaaggggagtacagg

SEQ ID NO: 1177 - DNA, 18 bp, Homo sapiens
ttatttgaaaaagtacag

SEQ ID NO: 1178 - DNA, 18 bp, Homo sapiens
tattgaggaggaaacagg

SEQ ID NO: 1179 - DNA, 20 bp, Homo sapiens
ttaaattgaaaaagggatac

SEQ ID NO: 1180 - DNA, 19 bp, Homo sapiens
tattgaaagaggagtaagg

SEQ ID NO: 1181 - DNA, 19 bp, Homo sapiens
ttatattggaaaaaggaag

SEQ ID NO: 1182 - DNA, 21 bp, Homo sapiens
tattgaaaaggatgatacagg

SEQ ID NO: 1183 - DNA, 18 bp, Homo sapiens
ttatattggaaaagaaaa

SEQ ID NO: 1184 - DNA, 65 bp, Fowlpox virus
tatatcacgctctattgtatagatcgtctaacgttgaatcgctgatattacacggagcggatata

SEQ ID NO: 1185 - DNA, 20 bp, Fowlpox virus
tattacacggagcggatata

SEQ ID NO: 1186 - DNA, 18 bp, Homo sapiens
ttacacaacactggatat

SEQ ID NO: 1187 - DNA, 17 bp, Homo sapiens
tattacattacagatat

SEQ ID NO: 1188 - DNA, 17 bp, Homo sapiens
ttacacagaagagtata

SEQ ID NO: 1189 - DNA, 19 bp, Homo sapiens
tacagcgggagcggatata

SEQ ID NO: 1190 - DNA, 18 bp, Homo sapiens
tatgacatggaacaaata

SEQ ID NO: 1191 - DNA, 19 bp, Homo sapiens
ttacacaggaagcaatata

SEQ ID NO: 1192 - DNA, 17 bp, Homo sapiens
tatcacacgatgatata

SEQ ID NO: 1193 - DNA, 17 bp, Homo sapiens
tattacacagctaatat

SEQ ID NO: 1194 - DNA, 22 bp, Homo sapiens
tattacactgagacttttggat

SEQ ID NO: 1195 - DNA, 70 bp, Rat cytomegalovirus
ccggctgagtcatcgcccgaggacgcgcccacgaccaaaaaaggtgcctcctcgagggcgggacgtccgg

SEQ ID NO: 1196 - DNA, 24 bp, Rat cytomegalovirus
tgagtcatcgcccgaggacgcgcc

SEQ ID NO: 1197 - DNA, 17 bp, Homo sapiens
tgagtcatcgctcagga

SEQ ID NO: 1198 - DNA, 24 bp, Homo sapiens
tgagtcactgtccagctccgtgcc

SEQ ID NO: 1199 - DNA, 127 bp, Rana tigrina ranavirus
gtgagtttaccacggcagcgaaagccttgacggtctcgtaggccttggtcatgtccgacaccatgcccccgtcggaaaaggcagaggcgtacttggtaacgtcggtggcgtcgaccgccgcggacac

SEQ ID NO: 1200 - DNA, 24 bp, Rana tigrina ranavirus
tcgtaggccttggtcatgtccgac

SEQ ID NO: 1201 - DNA, 20 bp, Homo sapiens
gtagggcttggtcaaatgac

SEQ ID NO: 1202 - DNA, 18 bp, Homo sapiens
ggccttgaagtgcatgtc

SEQ ID NO: 1203 - DNA, 19 bp, Homo sapiens
tcgtagccttgggcgtccg

SEQ ID NO: 1204 - DNA, 16 bp, Homo sapiens
gtaggtgtatgtccga

SEQ ID NO: 1205 - DNA, 60 bp, Rana tigrina ranavirus
tcctcacggggtgccttatcttgttttcgagagattccagcatcaggtccccgtcgagga

SEQ ID NO: 1206 - DNA, 17 bp, Rana tigrina ranavirus
caggtccccgtcgagga

SEQ ID NO: 1207 - DNA, 18 bp, Homo sapiens
caagtccctgccagcagg

SEQ ID NO: 1208 - DNA, 18 bp, Homo sapiens
caggccccagtaagagga

SEQ ID NO: 1209 - DNA, 18 bp, Homo sapiens
cagatccccggcctgagg

SEQ ID NO: 1210 - DNA, 18 bp, Homo sapiens
caggcccccacatctgga

SEQ ID NO: 1211 - DNA, 19 bp, Homo sapiens
aggtccccaagtcagagga

SEQ ID NO: 1212 - DNA, 18 bp, Homo sapiens
aggtcccctgccctgagg

SEQ ID NO: 1213 - DNA, 18 bp, Homo sapiens
caggtcccggtgcagagg

SEQ ID NO: 1214 - DNA, 18 bp, Homo sapiens
caggcccctggctgagga

SEQ ID NO: 1215 - DNA, 21 bp, Homo sapiens
caggtccccatactctgagga

SEQ ID NO: 1216 - DNA, 18 bp, Homo sapiens
cagatccccacatctgga

SEQ ID NO: 1217 - DNA, 20 bp, Homo sapiens
caggtccctctcggtgagga

SEQ ID NO: 1218 - DNA, 18 bp, Homo sapiens
caggcccctctcaatgga

SEQ ID NO: 1219 - DNA, 18 bp, Homo sapiens
caagtccccgtgaaagga

SEQ ID NO: 1220 - DNA, 19 bp, Homo sapiens
caggtcccatcgctgagga

SEQ ID NO: 1221 - DNA, 18 bp, Homo sapiens
caggcccccactgccggg

SEQ ID NO: 1222 - DNA, 18 bp, Homo sapiens
caagtcccacaataagga

SEQ ID NO: 1223 - DNA, 20 bp, Homo sapiens
cagatcccctcacacgagga

SEQ ID NO: 1224 - DNA, 19 bp, Homo sapiens
caggtcccagccttcagga

SEQ ID NO: 1225 - DNA, 19 bp, Homo sapiens
cagatcccgagccccgagg

SEQ ID NO: 1226 - DNA, 19 bp, Homo sapiens
caggccccttccactagga

SEQ ID NO: 1227 - DNA, 18 bp, Homo sapiens
caggcccccttcttagga

SEQ ID NO: 1228 - DNA, 18 bp, Homo sapiens
cagatcccttaatcagga

SEQ ID NO: 1229 - DNA, 18 bp, Homo sapiens
ggtccccatgtcagagga

SEQ ID NO: 1230 - DNA, 18 bp, Homo sapiens
caggtcccagcagcggga

SEQ ID NO: 1231 - DNA, 18 bp, Homo sapiens
caggtccctcagccagga

SEQ ID NO: 1232 - DNA, 19 bp, Homo sapiens
caggtccctggcacgggga

SEQ ID NO: 1233 - DNA, 75 bp, Rana tigrina ranavirus
gagttgcaaatgctcctccgacgagaggctcactcaccagagcctctctggcgggaggttcagcgtcaccggctc

SEQ ID NO: 1234 - DNA, 24 bp, Rana tigrina ranavirus
tggcgggaggttcagcgtcaccgg

SEQ ID NO: 1235 - DNA, 17 bp, Homo sapiens
tggcgagacgtgtcacg

SEQ ID NO: 1236 - DNA, 23 bp, Homo sapiens
tggctggaggttcaggggttcgg

SEQ ID NO: 1237 - DNA, 16 bp, Homo sapiens
tggtgggaggtccgcc

SEQ ID NO: 1238 - DNA, 128 bp, Rat cytomegalovirus
gggaggagcagtacggaatatccggtcaggagggtggagttgagggtatcccattggcgagcgtagcgagccaatgggatatccgtaaacggaactctcctgaccggatattccgtactgctccgacc

SEQ ID NO: 1239 - DNA, 20 bp, Rat cytomegalovirus
tattccgtactgctccgacc

SEQ ID NO: 1240 - DNA, 19 bp, Homo sapiens
tattcctactccagtgacc

SEQ ID NO: 1241 - DNA, 19 bp, Homo sapiens
tattccgtacagttcctga

SEQ ID NO: 1242 - DNA, 20 bp, Homo sapiens
cattctgtacttctcttgac

SEQ ID NO: 1243 - DNA, 18 bp, Homo sapiens
ttcctgtagcctccgacc

SEQ ID NO: 1244 - DNA, 18 bp, Homo sapiens
ttcctattgctccaaacc

SEQ ID NO: 1245 - DNA, 20 bp, Homo sapiens
tattccatacagccctggcc

SEQ ID NO: 1246 - DNA, 17 bp, Homo sapiens
tattccgtgccatgacc

SEQ ID NO: 1247 - DNA, 18 bp, Homo sapiens
tattccatattgctcaga

SEQ ID NO: 1248 - DNA, 16 bp, Homo sapiens
ctccactgctctgacc

SEQ ID NO: 1249 - DNA, 20 bp, Homo sapiens
tattccgcgcccgcaggacc

SEQ ID NO: 1250 - DNA, 17 bp, Homo sapiens
ttcctccgtctccgacc

SEQ ID NO: 1251 - DNA, 19 bp, Homo sapiens
tatttttaccgctccggcc

SEQ ID NO: 1252 - DNA, 17 bp, Homo sapiens
tattccgtctccaaacc

SEQ ID NO: 1253 - DNA, 17 bp, Homo sapiens
attccgtactctctgac

SEQ ID NO: 1254 - DNA, 20 bp, Homo sapiens
ctccgtgctcagagacgacc

SEQ ID NO: 1255 - DNA, 21 bp, Homo sapiens
tattccataaacacattgacc

SEQ ID NO: 1256 - DNA, 18 bp, Homo sapiens
attccgtactcgcaccga

SEQ ID NO: 1257 - DNA, 19 bp, Homo sapiens
ttcagcacctgctccggcc

SEQ ID NO: 1258 - DNA, 17 bp, Homo sapiens
tattccgtgactccgcc

SEQ ID NO: 1259 - DNA, 17 bp, Homo sapiens
tattccgtgctcacacc

SEQ ID NO: 1260 - DNA, 62 bp, Simian T-lymphotropic virus 2
cgacgcttttcttccttctcccgcagccgctcccttctgcgctgctccttctcctcgcgttg

SEQ ID NO: 1261 - DNA, 24 bp, Simian T-lymphotropic virus 2
acgcttttcttccttctcccgcag

SEQ ID NO: 1262 - DNA, 22 bp, Homo sapiens
gccacagctccttctcctgcag

SEQ ID NO: 1263 - DNA, 22 bp, Homo sapiens
gcttttcttctaatccttgcag

SEQ ID NO: 1264 - DNA, 26 bp, Homo sapiens
gctttttttttccttctttaaatcag

SEQ ID NO: 1265 - DNA, 18 bp, Homo sapiens
cgctctttccttctctcg

SEQ ID NO: 1266 - DNA, 18 bp, Homo sapiens
actttttttttccttctc

SEQ ID NO: 1267 - DNA, 22 bp, Homo sapiens
cgctttccaggccctcttttcc

SEQ ID NO: 1268 - DNA, 18 bp, Homo sapiens
ttttcctcctttttgcag

SEQ ID NO: 1269 - DNA, 18 bp, Homo sapiens
ttttcttttttcccacag

SEQ ID NO: 1270 - DNA, 18 bp, Homo sapiens
cgcgtccttctcctgcag

SEQ ID NO: 1271 - DNA, 21 bp, Homo sapiens
acttttctccttctcctgcag

SEQ ID NO: 1272 - DNA, 26 bp, Homo sapiens
gctttccttccctccaactcctgcag

SEQ ID NO: 1273 - DNA, 23 bp, Homo sapiens
gcccttagtgtcttctcccgcag

SEQ ID NO: 1274 - DNA, 19 bp, Homo sapiens
gcttctccttttcttgcag

SEQ ID NO: 1275 - DNA, 19 bp, Homo sapiens
ttttcttcaacttctgcag

SEQ ID NO: 1276 - DNA, 19 bp, Homo sapiens
cgttttattttcttctccc

SEQ ID NO: 1277 - DNA, 21 bp, Homo sapiens
gctcgcccccttctcccgcag

SEQ ID NO: 1278 - DNA, 18 bp, Homo sapiens
gctgcctttctcctgcag

SEQ ID NO: 1279 - DNA, 23 bp, Homo sapiens
cgattctcctctttctcccgcag

SEQ ID NO: 1280 - DNA, 15 bp, Homo sapiens
ttttcctcttctgca

SEQ ID NO: 1281 - DNA, 19 bp, Homo sapiens
tttccttccttccttaagc

SEQ ID NO: 1282 - DNA, 15 bp, Homo sapiens
cacttttctttctcc

SEQ ID NO: 1283 - DNA, 19 bp, Homo sapiens
gctttttttccttcttccc

SEQ ID NO: 1284 - DNA, 19 bp, Homo sapiens
ctttttttccttcctcaca

SEQ ID NO: 1285 - DNA, 18 bp, Homo sapiens
acgcttcaacccttctcc

SEQ ID NO: 1286 - DNA, 22 bp, Homo sapiens
gcttttcttttttctacaacag

SEQ ID NO: 1287 - DNA, 24 bp, Homo sapiens
acgcctgcacgtcttttcccgcag

SEQ ID NO: 1288 - DNA, 21 bp, Homo sapiens
gctttggtccttctcccgcag

SEQ ID NO: 1289 - DNA, 86 bp, Rana tigrina ranavirus
ggagctggtcgtaggctcccagggactttatctgatacctagcgaatcctgaggcgtcaaagttaagcttggtcatgaccagctcc

SEQ ID NO: 1290 - DNA, 24 bp, Rana tigrina ranavirus
cgtcaaagttaagcttggtcatga

SEQ ID NO: 1291 - DNA, 23 bp, Homo sapiens
gtcaaagttagcctggtacatga

SEQ ID NO: 1292 - DNA, 21 bp, Homo sapiens
cgttcaaaaacttggttatga

SEQ ID NO: 1293 - DNA, 20 bp, Homo sapiens
attaaggttggaaatcatga

SEQ ID NO: 1294 - DNA, 21 bp, Homo sapiens
gtaaagttgataaggtcatga

SEQ ID NO: 1295 - DNA, 21 bp, Homo sapiens
gccaggatgggcttggtcgtg

SEQ ID NO: 1296 - DNA, 22 bp, Homo sapiens
gttaaagttaacctcattcgtg

SEQ ID NO: 1297 - DNA, 20 bp, Homo sapiens
gttaaaattaagccatatga

SEQ ID NO: 1298 - DNA, 22 bp, Homo sapiens
gtcagtggttgggctgatcatg

SEQ ID NO: 1299 - DNA, 21 bp, Homo sapiens
gccaaagttaagtttctatga

SEQ ID NO: 1300 - DNA, 21 bp, Homo sapiens
gtcaaagttaaatttaaaatg

SEQ ID NO: 1301 - DNA, 18 bp, Homo sapiens
gtcaaagttgagatcatg

SEQ ID NO: 1302 - DNA, 24 bp, Homo sapiens
cgtcaaggttgcagtgagccatga

SEQ ID NO: 1303 - DNA, 21 bp, Homo sapiens
tcaaaaaggggcttggtcgtg

SEQ ID NO: 1304 - DNA, 83 bp, Simian T-lymphotropic virus 2
tgcagggggaataaccggatccctgtccctagcatcaagccgcagcctgctttttgaagttgacaaagatatttcccacctca

SEQ ID NO: 1305 - DNA, 23 bp, Simian T-lymphotropic virus 2
tgacaaagatatttcccacctca

SEQ ID NO: 1306 - DNA, 23 bp, Homo sapiens
tgacaaaaatgttttcttctcct

SEQ ID NO: 1307 - DNA, 18 bp, Homo sapiens
tgaggtagacccacctca

SEQ ID NO: 1308 - DNA, 17 bp, Homo sapiens
tgacaaagattttcaca

SEQ ID NO: 1309 - DNA, 23 bp, Homo sapiens
tgatgggaagaaaacccacctca

SEQ ID NO: 1310 - DNA, 21 bp, Homo sapiens
tggcagggaaatttcccatct

SEQ ID NO: 1311 - DNA, 21 bp, Homo sapiens
tggcaaagatatattaaacct

SEQ ID NO: 1312 - DNA, 23 bp, Homo sapiens
tgacagagcaagactccacctca

SEQ ID NO: 1313 - DNA, 19 bp, Homo sapiens
acaaagatcacctacttca

SEQ ID NO: 1314 - DNA, 24 bp, Homo sapiens
tgacaaagatgttaaatactgcct

SEQ ID NO: 1315 - DNA, 16 bp, Homo sapiens
tgacaaaggccacctc

SEQ ID NO: 1316 - DNA, 22 bp, Homo sapiens
tgcagggagcacaacccacctc

SEQ ID NO: 1317 - DNA, 18 bp, Homo sapiens
gacaccatttcccacctc

SEQ ID NO: 1318 - DNA, 17 bp, Homo sapiens
gacagaactcccacctc

SEQ ID NO: 1319 - DNA, 19 bp, Homo sapiens
tgacaatatttccacttca

SEQ ID NO: 1320 - DNA, 21 bp, Homo sapiens
tgaaaaagatattctttacct

SEQ ID NO: 1321 - DNA, 19 bp, Homo sapiens
tgatggaaattctccccac

SEQ ID NO: 1322 - DNA, 21 bp, Homo sapiens
tgacaaaaatccttcacttca

SEQ ID NO: 1323 - DNA, 21 bp, Homo sapiens
tgaagccatcttcccacctca

SEQ ID NO: 1324 - DNA, 16 bp, Homo sapiens
taacatatatttccca

SEQ ID NO: 1325 - DNA, 20 bp, Homo sapiens
gacaaagatgcagccgccac

SEQ ID NO: 1326 - DNA, 22 bp, Homo sapiens
tgcatgagtcatttccacctca

SEQ ID NO: 1327 - DNA, 17 bp, Homo sapiens
tgacacagacccacttc

SEQ ID NO: 1328 - DNA, 23 bp, Homo sapiens
tgacaaagcaagattccatctca

SEQ ID NO: 1329 - DNA, 18 bp, Homo sapiens
tgacagaaatatccacct

SEQ ID NO: 1330 - DNA, 19 bp, Homo sapiens
cagggacacgaccacctca

SEQ ID NO: 1331 - DNA, 23 bp, Homo sapiens
tgacaaagcaagatcctgtctca

SEQ ID NO: 1332 - DNA, 18 bp, Homo sapiens
tgacaaagatgtgatctc

SEQ ID NO: 1333 - DNA, 24 bp, Homo sapiens
tgacacaggtccccacccacctca

SEQ ID NO: 1334 - DNA, 19 bp, Homo sapiens
tgcaaagatatttcagtcc

SEQ ID NO: 1335 - DNA, 18 bp, Homo sapiens
tgacaaaagtatttctca

SEQ ID NO: 1336 - DNA, 18 bp, Homo sapiens
caaagatatgacacctca

SEQ ID NO: 1337 - DNA, 19 bp, Homo sapiens
tgacaaagatgctttttcc

SEQ ID NO: 1338 - DNA, 23 bp, Homo sapiens
tgacaaagcaagactctgtctca

SEQ ID NO: 1339 - DNA, 23 bp, Homo sapiens
tgacaaagaggctcaccacctca

SEQ ID NO: 1340 - DNA, 20 bp, Homo sapiens
tgactggtcttcccacctca

SEQ ID NO: 1341 - DNA, 17 bp, Homo sapiens
acaaagacacctacttc

SEQ ID NO: 1342 - DNA, 17 bp, Homo sapiens
caaagatatatacctca

SEQ ID NO: 1343 - DNA, 22 bp, Homo sapiens
tgatcaagatacccctgcctca

SEQ ID NO: 1344 - DNA, 20 bp, Homo sapiens
gatagaagaccttcccacct

SEQ ID NO: 1345 - DNA, 17 bp, Homo sapiens
gacaaagaatctgcctc

SEQ ID NO: 1346 - DNA, 19 bp, Homo sapiens
caaggattgttccccacct

SEQ ID NO: 1347 - DNA, 22 bp, Homo sapiens
tgaagaagatatccaagcctca

SEQ ID NO: 1348 - DNA, 22 bp, Homo sapiens
gacaaacattttttccatttca

SEQ ID NO: 1349 - DNA, 129 bp, Human herpesvirus 4
ccgggtggggggtggccccgctgggcaccgctgcgccgccgccaggtcctggggcagccggggttcctggcgctccgggggcagccgggcggccgccggtgggtccgctgggccgctgccccgctccgg

SEQ ID NO: 1350 - DNA, 24 bp, Human herpesvirus 4
cgctccgggggcagccgggcggcc

SEQ ID NO: 1351 - DNA, 19 bp, Homo sapiens
tcctctgggcccgggcggc

SEQ ID NO: 1352 - DNA, 22 bp, Homo sapiens
gctctgggccctgcgggtggcc

SEQ ID NO: 1353 - DNA, 19 bp, Homo sapiens
ccgggggctcccggtggcc

SEQ ID NO: 1354 - DNA, 18 bp, Homo sapiens
gctctgggggcagctggc

SEQ ID NO: 1355 - DNA, 26 bp, Homo sapiens
cgctccggcggcgggcgcaggcggcc

SEQ ID NO: 1356 - DNA, 20 bp, Homo sapiens
gctccggggacggcggcggc

SEQ ID NO: 1357 - DNA, 24 bp, Homo sapiens
cgctccggggtcggggcgcgcggc

SEQ ID NO: 1358 - DNA, 16 bp, Homo sapiens
cgcccgggggcagggc

SEQ ID NO: 1359 - DNA, 19 bp, Homo sapiens
gctccgggcgtgggcggcc

SEQ ID NO: 1360 - DNA, 17 bp, Homo sapiens
gcgccgggggcccgcgg

SEQ ID NO: 1361 - DNA, 23 bp, Homo sapiens
gctctgtggggcctggagcggcc

SEQ ID NO: 1362 - DNA, 17 bp, Homo sapiens
gctccggggaccgcggc

SEQ ID NO: 1363 - DNA, 18 bp, Homo sapiens
gctctggggcggggcggc

SEQ ID NO: 1364 - DNA, 17 bp, Homo sapiens
gcttgggggcaagtggc

SEQ ID NO: 1365 - DNA, 19 bp, Homo sapiens
ctcccgtagctgggcggcc

SEQ ID NO: 1366 - DNA, 23 bp, Homo sapiens
gctccgggggctccgagggtggc

SEQ ID NO: 1367 - DNA, 21 bp, Homo sapiens
cgccccgggggtctcgcggcc

SEQ ID NO: 1368 - DNA, 22 bp, Homo sapiens
cgctccggcggcggcgggggcc

SEQ ID NO: 1369 - DNA, 21 bp, Homo sapiens
ccctctggggtggcgggcggc

SEQ ID NO: 1370 - DNA, 21 bp, Homo sapiens
ctccgggggcgggctccggcc

SEQ ID NO: 1371 - DNA, 24 bp, Homo sapiens
cgctccgggggcagcagaggggcc

SEQ ID NO: 1372 - DNA, 23 bp, Homo sapiens
cgctccgggggcaccgaggagcc

SEQ ID NO: 1373 - DNA, 18 bp, Homo sapiens
gcccgggggctgagcggc

SEQ ID NO: 1374 - DNA, 20 bp, Homo sapiens
cgctccgggggcagctgagc

SEQ ID NO: 1375 - DNA, 22 bp, Homo sapiens
cgcgccgggggcagcgtctggc

SEQ ID NO: 1376 - DNA, 19 bp, Homo sapiens
gctttgggggcaggagggc

SEQ ID NO: 1377 - DNA, 16 bp, Homo sapiens
cgcctggcccgggcgg

SEQ ID NO: 1378 - DNA, 22 bp, Homo sapiens
gctcctgggggtgcaggcggcc

SEQ ID NO: 1379 - DNA, 16 bp, Homo sapiens
gcccgggggcgctggc

SEQ ID NO: 1380 - DNA, 17 bp, Homo sapiens
gctccggggcgtggcgg

SEQ ID NO: 1381 - DNA, 21 bp, Homo sapiens
ctctgcagccagccgggcggc

SEQ ID NO: 1382 - DNA, 19 bp, Homo sapiens
cgcccgggggaggggcggc

SEQ ID NO: 1383 - DNA, 19 bp, Homo sapiens
cgctccgggggcaacagcg

SEQ ID NO: 1384 - DNA, 18 bp, Homo sapiens
cgcaccgggggcggcggc

SEQ ID NO: 1385 - DNA, 18 bp, Homo sapiens
tccaggggctgggtggcc

SEQ ID NO: 1386 - DNA, 22 bp, Homo sapiens
actccgggggcaagacatggcc

SEQ ID NO: 1387 - DNA, 21 bp, Homo sapiens
cgcccgggggcgggccaaggc

SEQ ID NO: 1388 - DNA, 16 bp, Homo sapiens
cgctccgcccgggcgg

SEQ ID NO: 1389 - DNA, 15 bp, Homo sapiens
gcccgggggcagggc

SEQ ID NO: 1390 - DNA, 23 bp, Homo sapiens
ccctctgattccagttgggtggc

SEQ ID NO: 1391 - DNA, 21 bp, Homo sapiens
gctcttgggggaccaggcggc

SEQ ID NO: 1392 - DNA, 19 bp, Homo sapiens
gctccgagggctgcgcggc

SEQ ID NO: 1393 - DNA, 23 bp, Homo sapiens
ccctggcaggcagctgggtggcc

SEQ ID NO: 1394 - DNA, 19 bp, Homo sapiens
cgatggcagtcgggcggcc

SEQ ID NO: 1395 - DNA, 20 bp, Homo sapiens
ctctgggggtggcctcagcc

SEQ ID NO: 1396 - DNA, 20 bp, Homo sapiens
gctccgggggtgcctcgtgg

SEQ ID NO: 1397 - DNA, 22 bp, Homo sapiens
gctccgggggtggcctcgtgcc

SEQ ID NO: 1398 - DNA, 22 bp, Homo sapiens
tctgggggcaggtcgggtggcc

SEQ ID NO: 1399 - DNA, 24 bp, Homo sapiens
ccctccgggggtagttcggcggcc

SEQ ID NO: 1400 - DNA, 20 bp, Homo sapiens
cgctccgggcggcaggcagg

SEQ ID NO: 1401 - DNA, 20 bp, Homo sapiens
cgcttcgagggcagcctggc

SEQ ID NO: 1402 - DNA, 22 bp, Homo sapiens
cgccttcgggggcagccggagc

SEQ ID NO: 1403 - DNA, 18 bp, Homo sapiens
cgcccgggggcggccggg

SEQ ID NO: 1404 - DNA, 19 bp, Homo sapiens
ggaggcagggagggtggcc

SEQ ID NO: 1405 - DNA, 21 bp, Homo sapiens
cgctgggtgggctgggcggcc

SEQ ID NO: 1406 - DNA, 15 bp, Homo sapiens
gctccggccgggcgg

SEQ ID NO: 1407 - DNA, 18 bp, Homo sapiens
tctgggggcagtcatggc

SEQ ID NO: 1408 - DNA, 17 bp, Homo sapiens
gcccgggggcgaacggc

SEQ ID NO: 1409 - DNA, 27 bp, Homo sapiens
cgctccggggcggctctggccgcccgg

SEQ ID NO: 1410 - DNA, 16 bp, Homo sapiens
cgttccggcgggcggc

SEQ ID NO: 1411 - DNA, 18 bp, Homo sapiens
tccgggtgcgaggcggcc

SEQ ID NO: 1412 - DNA, 16 bp, Homo sapiens
ctccgggggccgcggc

SEQ ID NO: 1413 - DNA, 20 bp, Homo sapiens
gctctgggggcggctggagc

SEQ ID NO: 1414 - DNA, 23 bp, Homo sapiens
cgctccgggggtggctgggtcgc

SEQ ID NO: 1415 - DNA, 23 bp, Homo sapiens
gctccgcgcgcagccgggcggcc

SEQ ID NO: 1416 - DNA, 20 bp, Homo sapiens
cgcccgggggtggccggggc

SEQ ID NO: 1417 - DNA, 17 bp, Homo sapiens
gctctgggggcaggggc

SEQ ID NO: 1418 - DNA, 21 bp, Homo sapiens
tcccggggctgagtgggcggc

SEQ ID NO: 1419 - DNA, 22 bp, Homo sapiens
gcctgggggtgccagacgtggc

SEQ ID NO: 1420 - DNA, 23 bp, Homo sapiens
gcctcgggggcagggatcccggc

SEQ ID NO: 1421 - DNA, 20 bp, Homo sapiens
cgctccggtggttgctgcgg

SEQ ID NO: 1422 - DNA, 18 bp, Homo sapiens
tccgggggcacacacagg

SEQ ID NO: 1423 - DNA, 22 bp, Homo sapiens
gctctgggggcagacccgtggc

SEQ ID NO: 1424 - DNA, 19 bp, Homo sapiens
gctccgtgggcggcctggg

SEQ ID NO: 1425 - DNA, 15 bp, Homo sapiens
cgtccgggggcgggg

SEQ ID NO: 1426 - DNA, 26 bp, Homo sapiens
cgttccgggaggcggcctgcagagcc

SEQ ID NO: 1427 - DNA, 24 bp, Homo sapiens
cacttcccagacagttgggcggcc

SEQ ID NO: 1428 - DNA, 19 bp, Homo sapiens
gctcctcggctgggcggcc

SEQ ID NO: 1429 - DNA, 27 bp, Homo sapiens
gccccgggggcggtttcggccgcccgg

SEQ ID NO: 1430 - DNA, 22 bp, Homo sapiens
gcctggtcgcgggccgggcggc

SEQ ID NO: 1431 - DNA, 23 bp, Homo sapiens
cgctgccggggacccgggcggcc

SEQ ID NO: 1432 - DNA, 18 bp, Homo sapiens
gcactgggggcaggcggc

SEQ ID NO: 1433 - DNA, 20 bp, Homo sapiens
cgctgggggcggccggtgcg

SEQ ID NO: 1434 - DNA, 63 bp, Rana tigrina ranavirus
gcgccggcaagaccaccttcgagattaagcccatgtttaagcttcacgtcatctgcaacgcgc

SEQ ID NO: 1435 - DNA, 24 bp, Rana tigrina ranavirus
ttaagcttcacgtcatctgcaacg

SEQ ID NO: 1436 - DNA, 23 bp, Homo sapiens
ttaagcctcaatcctctgcagcg

SEQ ID NO: 1437 - DNA, 19 bp, Homo sapiens
ttaagcttgacagatgcaa

SEQ ID NO: 1438 - DNA, 25 bp, Homo sapiens
ttaagcttccttccatcttgcagcg

SEQ ID NO: 1439 - DNA, 19 bp, Homo sapiens
ttaagcttcatttgtatcc

SEQ ID NO: 1440 - DNA, 22 bp, Homo sapiens
ctaagctaaaaattatctgcaa

SEQ ID NO: 1441 - DNA, 18 bp, Homo sapiens
taagcttcaacacttgca

SEQ ID NO: 1442 - DNA, 21 bp, Homo sapiens
ttaacctgatcatatctgcaa

SEQ ID NO: 1443 - DNA, 22 bp, Homo sapiens
ttaagcctattgcgcatttgca

SEQ ID NO: 1444 - DNA, 21 bp, Homo sapiens
ttaatttcacgctatctgcaa

SEQ ID NO: 1445 - DNA, 17 bp, Homo sapiens
ttaaggttcccatctgc

SEQ ID NO: 1446 - DNA, 120 bp, Rat cytomegalovirus
ggaggtccgcggtgtcgtcatgaccaccctgtgggctccccccaaatgtctagaaccgaccacggccggtctccgttctcggaggtccgcggtgtcgtcatgaccaccctgtgggctccc

SEQ ID NO: 1447 - DNA, 24 bp, Rat cytomegalovirus
tcggaggtccgcggtgtcgtcatg

SEQ ID NO: 1448 - DNA, 20 bp, Homo sapiens
tcggaggctccgcggtgtcg

SEQ ID NO: 1449 - DNA, 16 bp, Homo sapiens
ggggtccgcggggtgt

SEQ ID NO: 1450 - DNA, 98 bp, Rat cytomegalovirus
ggtgtcgtcatgaccaccctgtgggctccccccaaatgtctagaaccggccacggccggtctccgttctcggagacccgaagtgtcgtcatgatcacc

SEQ ID NO: 1451 - DNA, 24 bp, Rat cytomegalovirus
accctgtgggctccccccaaatgt

SEQ ID NO: 1452 - DNA, 23 bp, Homo sapiens
cctcattatctctccccaaatgt

SEQ ID NO: 1453 - DNA, 22 bp, Homo sapiens
ccgctgtgtgcattccaaatgt

SEQ ID NO: 1454 - DNA, 23 bp, Homo sapiens
accctggggtgttttctaaatgt

SEQ ID NO: 1455 - DNA, 21 bp, Homo sapiens
cctgctgttccccccaaatgt

SEQ ID NO: 1456 - DNA, 22 bp, Homo sapiens
ccctgtcccaccccccaaatgt

SEQ ID NO: 1457 - DNA, 22 bp, Homo sapiens
ccctggcccaccccccaaatgt

SEQ ID NO: 1458 - DNA, 21 bp, Homo sapiens
ccctgtgaagccctcagatgt

SEQ ID NO: 1459 - DNA, 20 bp, Homo sapiens
cccggggaccccccgggtgt

SEQ ID NO: 1460 - DNA, 20 bp, Homo sapiens
tgtgggccagccccagatgt

SEQ ID NO: 1461 - DNA, 19 bp, Homo sapiens
ctgtgtttctcccaaatgt

SEQ ID NO: 1462 - DNA, 19 bp, Homo sapiens
cctgtgggcaggcagatgt

SEQ ID NO: 1463 - DNA, 18 bp, Homo sapiens
acccagtgggctctcccc

SEQ ID NO: 1464 - DNA, 21 bp, Homo sapiens
ccagaaagatcccccaaatgt

SEQ ID NO: 1465 - DNA, 19 bp, Homo sapiens
tgtgagctcctgcagatgt

SEQ ID NO: 1466 - DNA, 21 bp, Homo sapiens
cctgaaccccttctcaagtgt

SEQ ID NO: 1467 - DNA, 29 bp, Homo sapiens
ccctgtggtgctctctgatctcaaatgta

SEQ ID NO: 1468 - DNA, 21 bp, Homo sapiens
accgctgtttctcctaaatgt

SEQ ID NO: 1469 - DNA, 24 bp, Homo sapiens
ccctcctcagcttcccccaaatgt

SEQ ID NO: 1470 - DNA, 17 bp, Homo sapiens
ccctgtggctctcccca

SEQ ID NO: 1471 - DNA, 19 bp, Homo sapiens
cctgtgagcttctgaatgt

SEQ ID NO: 1472 - DNA, 17 bp, Homo sapiens
ccctggggctccccacg

SEQ ID NO: 1473 - DNA, 22 bp, Homo sapiens
acccaaggctttccccaaatgt

SEQ ID NO: 1474 - DNA, 22 bp, Homo sapiens
cctgtggagctccctgggatgt

SEQ ID NO: 1475 - DNA, 20 bp, Homo sapiens
accctgtgggctcttgctcc

SEQ ID NO: 1476 - DNA, 18 bp, Homo sapiens
ccctgtggactccccacc

SEQ ID NO: 1477 - DNA, 19 bp, Homo sapiens
acccagttgtccccaaatg

SEQ ID NO: 1478 - DNA, 24 bp, Homo sapiens
ccttctgtcctcctccctggatgt

SEQ ID NO: 1479 - DNA, 21 bp, Homo sapiens
ctgagggctccctccaattgt

SEQ ID NO: 1480 - DNA, 20 bp, Homo sapiens
acctgaactccctcagatgt

SEQ ID NO: 1481 - DNA, 103 bp, Rana tigrina ranavirus
ttgtgtcccgcatgctagagtatcctcgaggaggattcttctacagcaccgacatggcctgcatgatggagggtctcgcagaggagctagcaggaggacacaa

SEQ ID NO: 1482 - DNA, 24 bp, Rana tigrina ranavirus
tcgcagaggagctagcaggaggac

SEQ ID NO: 1483 - DNA, 23 bp, Homo sapiens
gcagggctttctggtaggaggac

SEQ ID NO: 1484 - DNA, 20 bp, Homo sapiens
tcgcggcctgaggcaggagg

SEQ ID NO: 1485 - DNA, 18 bp, Homo sapiens
cgcgggaaggcaggagga

SEQ ID NO: 1486 - DNA, 20 bp, Homo sapiens
gagaggctgaggcaggagga

SEQ ID NO: 1487 - DNA, 19 bp, Homo sapiens
ggaggccaaggcaggagga

SEQ ID NO: 1488 - DNA, 17 bp, Homo sapiens
gcagaggaactggtgaa

SEQ ID NO: 1489 - DNA, 20 bp, Homo sapiens
gcagaggagcagacaacaga

SEQ ID NO: 1490 - DNA, 16 bp, Homo sapiens
ccggaggagaggagga

SEQ ID NO: 1491 - DNA, 20 bp, Homo sapiens
cagtggtgtagcaggaggac

SEQ ID NO: 1492 - DNA, 20 bp, Homo sapiens
tcccagaggggacaggagga

SEQ ID NO: 1493 - DNA, 20 bp, Homo sapiens
cgcagaggagttagttaagg

SEQ ID NO: 1494 - DNA, 21 bp, Homo sapiens
ccgcaggggtgaggcaggagg

SEQ ID NO: 1495 - DNA, 16 bp, Homo sapiens
gcaggaagtaggggga

SEQ ID NO: 1496 - DNA, 17 bp, Homo sapiens
tcgcgaggagctagggg

SEQ ID NO: 1497 - DNA, 18 bp, Homo sapiens
gcagaagggctgtcagga

SEQ ID NO: 1498 - DNA, 19 bp, Homo sapiens
ggagactgaggcaggagga

SEQ ID NO: 1499 - DNA, 17 bp, Homo sapiens
tcgcagaggagttatag

SEQ ID NO: 1500 - DNA, 20 bp, Homo sapiens
gagagactgaggcaggagga

SEQ ID NO: 1501 - DNA, 18 bp, Homo sapiens
tcacagaggagctagaga

SEQ ID NO: 1502 - DNA, 21 bp, Homo sapiens
ccggggggagccaaggaggac

SEQ ID NO: 1503 - DNA, 16 bp, Homo sapiens
cagaggacacaggagg

SEQ ID NO: 1504 - DNA, 20 bp, Homo sapiens
gcgaggttgaggcaggagga

SEQ ID NO: 1505 - DNA, 22 bp, Homo sapiens
tcatggagggagcagcaggagg

SEQ ID NO: 1506 - DNA, 20 bp, Homo sapiens
gctggggccagcaggaggac

SEQ ID NO: 1507 - DNA, 22 bp, Homo sapiens
tcgggaggctgaggcaggagga

SEQ ID NO: 1508 - DNA, 19 bp, Homo sapiens
gcaagactgaggcaggagg

SEQ ID NO: 1509 - DNA, 20 bp, Homo sapiens
ggaggccaaggcaggaggac

SEQ ID NO: 1510 - DNA, 18 bp, Homo sapiens
tcctagaggagctggtga

SEQ ID NO: 1511 - DNA, 18 bp, Homo sapiens
gcagaggagctgctctgg

SEQ ID NO: 1512 - DNA, 17 bp, Homo sapiens
gcagaaggggcaggagg

SEQ ID NO: 1513 - DNA, 21 bp, Homo sapiens
ggacacacatagcaggaggac

SEQ ID NO: 1514 - DNA, 18 bp, Homo sapiens
gaggcccaggcaggagga

SEQ ID NO: 1515 - DNA, 22 bp, Homo sapiens
tcccaggatccggagcaggagg

SEQ ID NO: 1516 - DNA, 19 bp, Homo sapiens
tcgcaaaggagcgtgggga

SEQ ID NO: 1517 - DNA, 19 bp, Homo sapiens
ggaggctaaggcaggagga

SEQ ID NO: 1518 - DNA, 20 bp, Homo sapiens
ggggctcagagcaggaggac

SEQ ID NO: 1519 - DNA, 22 bp, Homo sapiens
gcagaggagctggctttaagac

SEQ ID NO: 1520 - DNA, 16 bp, Homo sapiens
gagggctgaggaggac

SEQ ID NO: 1521 - DNA, 21 bp, Homo sapiens
tctggaggagctgagtctgga

SEQ ID NO: 1522 - DNA, 18 bp, Homo sapiens
gaagctgtggcaggagga

SEQ ID NO: 1523 - DNA, 17 bp, Homo sapiens
gcagcaggagccgagga

SEQ ID NO: 1524 - DNA, 17 bp, Homo sapiens
catgggagagcaggagg

SEQ ID NO: 1525 - DNA, 20 bp, Homo sapiens
ccgcagaggggctctgggga

SEQ ID NO: 1526 - DNA, 18 bp, Homo sapiens
tctcagaaggtaggagga

SEQ ID NO: 1527 - DNA, 26 bp, Homo sapiens
tctggaggagctagctttcctgggac

SEQ ID NO: 1528 - DNA, 19 bp, Homo sapiens
ggagaccgaagcaggagga

SEQ ID NO: 1529 - DNA, 20 bp, Homo sapiens
gagaggctgaagcaggagga

SEQ ID NO: 1530 - DNA, 17 bp, Homo sapiens
gcagaggagcatagagg

SEQ ID NO: 1531 - DNA, 21 bp, Homo sapiens
ccgcggagaaaggtaggagga

SEQ ID NO: 1532 - DNA, 22 bp, Homo sapiens
ccgcggaggagctgggcctagg

SEQ ID NO: 1533 - DNA, 21 bp, Homo sapiens
tcgcaggggagtggcaggagg

SEQ ID NO: 1534 - DNA, 18 bp, Homo sapiens
gaagaggcgagcaggagg

SEQ ID NO: 1535 - DNA, 19 bp, Homo sapiens
gaaggctgaggcaggagga

SEQ ID NO: 1536 - DNA, 19 bp, Homo sapiens
cgcagaggcacccaggagg

SEQ ID NO: 1537 - DNA, 19 bp, Homo sapiens
gcagggggctggcaggagg

SEQ ID NO: 1538 - DNA, 17 bp, Homo sapiens
gatagttagcaggagga

SEQ ID NO: 1539 - DNA, 19 bp, Homo sapiens
gaggggctgccaggaggac

SEQ ID NO: 1540 - DNA, 20 bp, Homo sapiens
gcgaggctgaggcaggagga

SEQ ID NO: 1541 - DNA, 20 bp, Homo sapiens
gccagactgaagcaggagga

SEQ ID NO: 1542 - DNA, 17 bp, Homo sapiens
gaggagatgcaggagga

SEQ ID NO: 1543 - DNA, 20 bp, Homo sapiens
gcagaggagctatttgggac

SEQ ID NO: 1544 - DNA, 17 bp, Homo sapiens
ccggaggagctgcgggg

SEQ ID NO: 1545 - DNA, 20 bp, Homo sapiens
tcgcagagcgggctgggcgg

SEQ ID NO: 1546 - DNA, 20 bp, Homo sapiens
gcggaggagagcaggaggac

SEQ ID NO: 1547 - DNA, 20 bp, Homo sapiens
ggagatccaaggcaggagga

SEQ ID NO: 1548 - DNA, 16 bp, Homo sapiens
gcaggaggcaggagga

SEQ ID NO: 1549 - DNA, 20 bp, Homo sapiens
cagaggagctggggaagagg

SEQ ID NO: 1550 - DNA, 21 bp, Homo sapiens
agaggagctgactcagaggac

SEQ ID NO: 1551 - DNA, 19 bp, Homo sapiens
ggagcaaagagcaggagga

SEQ ID NO: 1552 - DNA, 19 bp, Homo sapiens
ggaggccgaggcaggagga

SEQ ID NO: 1553 - DNA, 19 bp, Homo sapiens
gcagaggagttagcaatgg

SEQ ID NO: 1554 - DNA, 20 bp, Homo sapiens
tcacagagggacaggggagg

SEQ ID NO: 1555 - DNA, 21 bp, Homo sapiens
tcggaggctgaagcaggagga

SEQ ID NO: 1556 - DNA, 22 bp, Homo sapiens
tcgagaggctaaggcaggagga

SEQ ID NO: 1557 - DNA, 22 bp, Homo sapiens
tctggaggctgaagcaggagga

SEQ ID NO: 1558 - DNA, 19 bp, Homo sapiens
gcagggggaagcaggagga

SEQ ID NO: 1559 - DNA, 20 bp, Homo sapiens
gctgaggagctggcgggagg

SEQ ID NO: 1560 - DNA, 21 bp, Homo sapiens
tcacagaggagctccatgggg

SEQ ID NO: 1561 - DNA, 20 bp, Homo sapiens
gagaggctggagcaggagga

SEQ ID NO: 1562 - DNA, 20 bp, Homo sapiens
ggaggccagtgcaggaggac

SEQ ID NO: 1563 - DNA, 19 bp, Homo sapiens
agaactaaaggcaggagga

SEQ ID NO: 1564 - DNA, 65 bp, Rana tigrina ranavirus
gtcagggcggctgacggtctcaagggtccaaattccatcgaccccgagacaaaaatggtcctgat

SEQ ID NO: 1565 - DNA, 21 bp, Rana tigrina ranavirus
cgagacaaaaatggtcctgat

SEQ ID NO: 1566 - DNA, 19 bp, Homo sapiens
gaaacagaactaccctgat

SEQ ID NO: 1567 - DNA, 17 bp, Homo sapiens
cgaggcaaggtcctgat

SEQ ID NO: 1568 - DNA, 16 bp, Homo sapiens
gagacaaaaagtccca

SEQ ID NO: 1569 - DNA, 17 bp, Homo sapiens
gacaaaaatatcttgat

SEQ ID NO: 1570 - DNA, 16 bp, Homo sapiens
gacaaaaaaggttgat

SEQ ID NO: 1571 - DNA, 17 bp, Homo sapiens
gagaacatggtcctgat

SEQ ID NO: 1572 - DNA, 20 bp, Homo sapiens
gagacaaaaggaaaattgat

SEQ ID NO: 1573 - DNA, 21 bp, Homo sapiens
gaggtaatggtccacgttgat

SEQ ID NO: 1574 - DNA, 18 bp, Homo sapiens
gaaacaaaaatgaagctg

SEQ ID NO: 1575 - DNA, 16 bp, Homo sapiens
aaaacaaaatcctgat

SEQ ID NO: 1576 - DNA, 18 bp, Homo sapiens
caaggcagaaatggcccc

SEQ ID NO: 1577 - DNA, 17 bp, Homo sapiens
aagacaaaagaactgat

SEQ ID NO: 1578 - DNA, 20 bp, Homo sapiens
gagacaatggtggccctgat

SEQ ID NO: 1579 - DNA, 17 bp, Homo sapiens
gataaaatggtcctgat

SEQ ID NO: 1580 - DNA, 19 bp, Homo sapiens
caagacaaaaacctttggt

SEQ ID NO: 1581 - DNA, 18 bp, Homo sapiens
gaaacaaaagtacctaat

SEQ ID NO: 1582 - DNA, 18 bp, Homo sapiens
gagacaaaatggttctga

SEQ ID NO: 1583 - DNA, 20 bp, Homo sapiens
gagataaagccagtcctgat

SEQ ID NO: 1584 - DNA, 17 bp, Homo sapiens
gagacaaaaatatagat

SEQ ID NO: 1585 - DNA, 18 bp, Homo sapiens
agccaggatggtcctgat

SEQ ID NO: 1586 - DNA, 18 bp, Homo sapiens
aaggcaaaaatggtcctg

SEQ ID NO: 1587 - DNA, 18 bp, Homo sapiens
gaggccaagatggcccca

SEQ ID NO: 1588 - DNA, 16 bp, Homo sapiens
gaggcaaaaatgactg

SEQ ID NO: 1589 - DNA, 16 bp, Homo sapiens
caagacttggtcctga

SEQ ID NO: 1590 - DNA, 17 bp, Homo sapiens
gagccaaaggtcccgat

SEQ ID NO: 1591 - DNA, 19 bp, Homo sapiens
gataaaaacagttcctgat

SEQ ID NO: 1592 - DNA, 18 bp, Homo sapiens
gagcaatgcagtcctgat

SEQ ID NO: 1593 - DNA, 19 bp, Homo sapiens
gagacaaaacaaccatgat

SEQ ID NO: 1594 - DNA, 17 bp, Homo sapiens
gagacaattatcctgat

SEQ ID NO: 1595 - DNA, 17 bp, Homo sapiens
agacaaaaatatatgat

SEQ ID NO: 1596 - DNA, 19 bp, Homo sapiens
gagattaaagagccctgat

SEQ ID NO: 1597 - DNA, 17 bp, Homo sapiens
gacagacgatcccagat

SEQ ID NO: 1598 - DNA, 22 bp, Homo sapiens
caagacaaagttgttttctgat

SEQ ID NO: 1599 - DNA, 21 bp, Homo sapiens
gaacaaaaacatagttctgat

SEQ ID NO: 1600 - DNA, 19 bp, Homo sapiens
agacaaaaacaagactgat

SEQ ID NO: 1601 - DNA, 16 bp, Homo sapiens
cgggacaaaatggcct

SEQ ID NO: 1602 - DNA, 20 bp, Homo sapiens
gaacaaaaactgaccctgat

SEQ ID NO: 1603 - DNA, 20 bp, Homo sapiens
gagagcaggatggtcctgat

SEQ ID NO: 1604 - DNA, 18 bp, Homo sapiens
gaggcaaaaatggttgat

SEQ ID NO: 1605 - DNA, 15 bp, Homo sapiens
gagacaaaaagcctg

SEQ ID NO: 1606 - DNA, 19 bp, Homo sapiens
cgagacaaaggagccagat

SEQ ID NO: 1607 - DNA, 20 bp, Homo sapiens
gaggccagcatcatcctgat

SEQ ID NO: 1608 - DNA, 19 bp, Homo sapiens
gaagcaaaagagtcctgat

SEQ ID NO: 1609 - DNA, 16 bp, Homo sapiens
cgagacaaaggcgtga

SEQ ID NO: 1610 - DNA, 21 bp, Homo sapiens
agacaaaaaggaaggcttgat

SEQ ID NO: 1611 - DNA, 19 bp, Homo sapiens
gaaacaaaagtcaactgat

SEQ ID NO: 1612 - DNA, 18 bp, Homo sapiens
gagacaaaagttgggcct

SEQ ID NO: 1613 - DNA, 19 bp, Homo sapiens
caaggcagggagccctgat

SEQ ID NO: 1614 - DNA, 18 bp, Homo sapiens
agacaaaaatatgctgat

SEQ ID NO: 1615 - DNA, 15 bp, Homo sapiens
caagacaaggcctga

SEQ ID NO: 1616 - DNA, 130 bp, Rat cytomegalovirus
caggttttttgggtgggacatccggtactgcaggggcggagtcaaggataccccattggcgagcgtagcgagccaatggggtatccgatgacgtagctgctgcagtaccggtgtcccacccaaaaaaccg

SEQ ID NO: 1617 - DNA, 24 bp, Rat cytomegalovirus
tgacgtagctgctgcagtaccggt

SEQ ID NO: 1618 - DNA, 21 bp, Homo sapiens
tgatgtggctgctacaaaggt

SEQ ID NO: 1619 - DNA, 24 bp, Homo sapiens
tgatgtacttgttgtagtaccggt

SEQ ID NO: 1620 - DNA, 21 bp, Homo sapiens
tggcatagctgttgtggcagc

SEQ ID NO: 1621 - DNA, 20 bp, Homo sapiens
tgatgtatttgctgcaggcc

SEQ ID NO: 1622 - DNA, 24 bp, Homo sapiens
tgaagtggtccttgcagtactggt

SEQ ID NO: 1623 - DNA, 90 bp, Rana tigrina ranavirus
gagacggtcgggcttgacgttgaggagctccagcttggacttgtccaccgagtttacgacagcgcaaatcttgtacagctcgtccttctt

SEQ ID NO: 1624 - DNA, 24 bp, Rana tigrina ranavirus
accgagtttacgacagcgcaaatc

SEQ ID NO: 1625 - DNA, 18 bp, Homo sapiens
ccagtttacatgaggcaa

SEQ ID NO: 1626 - DNA, 17 bp, Homo sapiens
gagttaacagtgcaaat

SEQ ID NO: 1627 - DNA, 20 bp, Homo sapiens
ccaggttcggggcgcaaatc

SEQ ID NO: 1628 - DNA, 66 bp, Human herpesvirus 4
tccctcagtgtttgccagcttatttccccagttttcacgtactggggcctgtggacacctgaggga

SEQ ID NO: 1629 - DNA, 22 bp, Human herpesvirus 4
gggcctgtggacacctgaggga

SEQ ID NO: 1630 - DNA, 20 bp, Homo sapiens
aggcctgtggctatggggga

SEQ ID NO: 1631 - DNA, 17 bp, Homo sapiens
gggcctgtgggtggggg

SEQ ID NO: 1632 - DNA, 20 bp, Homo sapiens
gggcctgtgggaattaaggg

SEQ ID NO: 1633 - DNA, 21 bp, Homo sapiens
gggcttttggacaccttgggg

SEQ ID NO: 1634 - DNA, 24 bp, Homo sapiens
gggcctgtagggaggagtggggga

SEQ ID NO: 1635 - DNA, 18 bp, Homo sapiens
gcctgtggggctgaggga

SEQ ID NO: 1636 - DNA, 26 bp, Homo sapiens
gggcctgtgaatatagatccctcagg

SEQ ID NO: 1637 - DNA, 19 bp, Homo sapiens
ggcctgtgggcaccccggg

SEQ ID NO: 1638 - DNA, 18 bp, Homo sapiens
gggtctgggacaccctga

SEQ ID NO: 1639 - DNA, 19 bp, Homo sapiens
gggcctgtgcaccgcaggg

SEQ ID NO: 1640 - DNA, 18 bp, Homo sapiens
aggtctgggccctgaggg

SEQ ID NO: 1641 - DNA, 17 bp, Homo sapiens
gggcctgtgtgcgaggg

SEQ ID NO: 1642 - DNA, 17 bp, Homo sapiens
gcctgtggcagggaggg

SEQ ID NO: 1643 - DNA, 17 bp, Homo sapiens
gggcttgtgggccgggg

SEQ ID NO: 1644 - DNA, 22 bp, Homo sapiens
gggctgttttctatctgaggga

SEQ ID NO: 1645 - DNA, 22 bp, Homo sapiens
ggtcctgtggagacagcgaggg

SEQ ID NO: 1646 - DNA, 15 bp, Homo sapiens
gggcgtacctgaggg

SEQ ID NO: 1647 - DNA, 19 bp, Homo sapiens
gggcttgtggtcgcgaggg

SEQ ID NO: 1648 - DNA, 18 bp, Homo sapiens
gggcctgagggaggaggg

SEQ ID NO: 1649 - DNA, 19 bp, Homo sapiens
gggcctgaggactgtggga

SEQ ID NO: 1650 - DNA, 17 bp, Homo sapiens
gggcctgctggagaggg

SEQ ID NO: 1651 - DNA, 20 bp, Homo sapiens
ggccctgtggaccaaaggga

SEQ ID NO: 1652 - DNA, 16 bp, Homo sapiens
gcccgtacctgaggga

SEQ ID NO: 1653 - DNA, 19 bp, Homo sapiens
gggcctgtgggagccaggg

SEQ ID NO: 1654 - DNA, 23 bp, Homo sapiens
aggtttgtggacacatctgggga

SEQ ID NO: 1655 - DNA, 17 bp, Homo sapiens
ggacccctacctgaggg

SEQ ID NO: 1656 - DNA, 21 bp, Homo sapiens
aggcctgtgggtggctccgga

SEQ ID NO: 1657 - DNA, 19 bp, Homo sapiens
gggctgtgtggatggagga

SEQ ID NO: 1658 - DNA, 19 bp, Homo sapiens
aggtctagtgcctgaggga

SEQ ID NO: 1659 - DNA, 19 bp, Homo sapiens
ggccgtggcacctgaggga

SEQ ID NO: 1660 - DNA, 18 bp, Homo sapiens
gggcctgcggagccgggg

SEQ ID NO: 1661 - DNA, 17 bp, Homo sapiens
gggccatgtggggaggg

SEQ ID NO: 1662 - DNA, 19 bp, Homo sapiens
gggcctgggacacccggga

SEQ ID NO: 1663 - DNA, 21 bp, Homo sapiens
ggtcctgctgctacctgaggg

SEQ ID NO: 1664 - DNA, 16 bp, Homo sapiens
gggcctgtggtggggg

SEQ ID NO: 1665 - DNA, 21 bp, Homo sapiens
gggcctgtgggggccctgggg

SEQ ID NO: 1666 - DNA, 21 bp, Homo sapiens
gagcctgtgaggtctggggga

SEQ ID NO: 1667 - DNA, 22 bp, Homo sapiens
gggcctgtgaggtgcctgggga

SEQ ID NO: 1668 - DNA, 16 bp, Homo sapiens
aggcctgtggtggggg

SEQ ID NO: 1669 - DNA, 16 bp, Homo sapiens
gggcctgtgagtgggg

SEQ ID NO: 1670 - DNA, 18 bp, Homo sapiens
gggctgtggacaggcgga

SEQ ID NO: 1671 - DNA, 20 bp, Homo sapiens
gggcctgtcaccctgaggga

SEQ ID NO: 1672 - DNA, 23 bp, Homo sapiens
gagcctgtggacaagggtaggga

SEQ ID NO: 1673 - DNA, 23 bp, Homo sapiens
gggcctgctggggcgaccgggga

SEQ ID NO: 1674 - DNA, 21 bp, Homo sapiens
gggagaatggcacctgaggga

SEQ ID NO: 1675 - DNA, 20 bp, Homo sapiens
gagtctgtggactttgggga

SEQ ID NO: 1676 - DNA, 19 bp, Homo sapiens
aggtttgaattctgaggga

SEQ ID NO: 1677 - DNA, 16 bp, Homo sapiens
gagcctgtgggaaggg

SEQ ID NO: 1678 - DNA, 19 bp, Homo sapiens
ggggatggtgtctgaggga

SEQ ID NO: 1679 - DNA, 16 bp, Homo sapiens
ggacctgtgggcgggg

SEQ ID NO: 1680 - DNA, 17 bp, Homo sapiens
gggcctgtcgaggaggg

SEQ ID NO: 1681 - DNA, 17 bp, Homo sapiens
gggctgtggacacaggg

SEQ ID NO: 1682 - DNA, 18 bp, Homo sapiens
gggcctgtggtcactcca

SEQ ID NO: 1683 - DNA, 20 bp, Homo sapiens
gggcctgaggactcctggga

SEQ ID NO: 1684 - DNA, 17 bp, Homo sapiens
gggcctgtggctgcagg

SEQ ID NO: 1685 - DNA, 22 bp, Homo sapiens
ggctctgtggacaggagcaggg

SEQ ID NO: 1686 - DNA, 22 bp, Homo sapiens
gggcctgtagacacagcaggga

SEQ ID NO: 1687 - DNA, 23 bp, Homo sapiens
gggcctgtgggacaggtccctcg

SEQ ID NO: 1688 - DNA, 18 bp, Homo sapiens
gggcctgtgggacctggg

SEQ ID NO: 1689 - DNA, 23 bp, Homo sapiens
gggcctgtgccagggcctgaggg

SEQ ID NO: 1690 - DNA, 19 bp, Homo sapiens
gggcctgtggaaccctaga

SEQ ID NO: 1691 - DNA, 22 bp, Homo sapiens
gggcctgtggagtgggccaggg

SEQ ID NO: 1692 - DNA, 16 bp, Homo sapiens
gagcctgtggggaggg

SEQ ID NO: 1693 - DNA, 20 bp, Homo sapiens
tgtaaaaaacacttgaggga

SEQ ID NO: 1694 - DNA, 17 bp, Homo sapiens
gggcctgagggccaggg

SEQ ID NO: 1695 - DNA, 18 bp, Homo sapiens
gggtctgtgcacacttga

SEQ ID NO: 1696 - DNA, 23 bp, Homo sapiens
ggcctgtgggaaataatggggga

SEQ ID NO: 1697 - DNA, 20 bp, Homo sapiens
gggcccgtggggtccaggga

SEQ ID NO: 1698 - DNA, 20 bp, Homo sapiens
gggcctgtgcactgctgggg

SEQ ID NO: 1699 - DNA, 22 bp, Homo sapiens
ggcctgtgggcatgcctgggga

SEQ ID NO: 1700 - DNA, 19 bp, Homo sapiens
gggcctgtggagccccaga

SEQ ID NO: 1701 - DNA, 22 bp, Homo sapiens
ggcctgtgggcgcctgcccggg

SEQ ID NO: 1702 - DNA, 19 bp, Homo sapiens
aggcctgtggtgtggggga

SEQ ID NO: 1703 - DNA, 18 bp, Homo sapiens
gggatcagcacctgaggg

SEQ ID NO: 1704 - DNA, 19 bp, Homo sapiens
aggcctgtgggcactgggg

SEQ ID NO: 1705 - DNA, 20 bp, Homo sapiens
gggccatgctgtctgaggga

SEQ ID NO: 1706 - DNA, 17 bp, Homo sapiens
gggctggaacctgaggg

SEQ ID NO: 1707 - DNA, 17 bp, Homo sapiens
aggcctgtctctgaggg

SEQ ID NO: 1708 - DNA, 21 bp, Homo sapiens
ggggttgaacacgcctgaggg

SEQ ID NO: 1709 - DNA, 16 bp, Homo sapiens
gggcctgtggggaggg

SEQ ID NO: 1710 - DNA, 22 bp, Homo sapiens
gggtcgtgccggctctgaggga

SEQ ID NO: 1711 - DNA, 16 bp, Homo sapiens
ggacctgtggacaggg

SEQ ID NO: 1712 - DNA, 22 bp, Homo sapiens
gagcatgcaggtacttgaggga

SEQ ID NO: 1713 - DNA, 20 bp, Homo sapiens
gggtctgggatctgccaggg

SEQ ID NO: 1714 - DNA, 18 bp, Homo sapiens
gggcctgaggacccaggg

SEQ ID NO: 1715 - DNA, 20 bp, Homo sapiens
gggtttgttggacccaaggg

SEQ ID NO: 1716 - DNA, 22 bp, Homo sapiens
gggcctgtggccatgcccctgg

SEQ ID NO: 1717 - DNA, 18 bp, Homo sapiens
gggcctgtgggtgcagga

SEQ ID NO: 1718 - DNA, 22 bp, Homo sapiens
gggtctggtgggatctgaggga

SEQ ID NO: 1719 - DNA, 16 bp, Homo sapiens
gagcctgctctgaggg

SEQ ID NO: 1720 - DNA, 18 bp, Homo sapiens
gggcctggatctgaggga

SEQ ID NO: 1721 - DNA, 20 bp, Homo sapiens
gggcctgctggacacacaga

SEQ ID NO: 1722 - DNA, 22 bp, Homo sapiens
gagcctgtggatactcctgggg

SEQ ID NO: 1723 - DNA, 19 bp, Homo sapiens
gggcctgtgtgactcgggg

SEQ ID NO: 1724 - DNA, 19 bp, Homo sapiens
gggcctgttgcatggggga

SEQ ID NO: 1725 - DNA, 26 bp, Homo sapiens
gagtctgtggacgcggatccctcagg

SEQ ID NO: 1726 - DNA, 21 bp, Homo sapiens
gggcctgtgggcttccgggga

SEQ ID NO: 1727 - DNA, 17 bp, Homo sapiens
gggtgtgtggacactga

SEQ ID NO: 1728 - DNA, 21 bp, Homo sapiens
gggtgctgttcggctgaggga

SEQ ID NO: 1729 - DNA, 20 bp, Homo sapiens
gggcctgtggaatgtgaggg

SEQ ID NO: 1730 - DNA, 21 bp, Homo sapiens
gggccaggctgggcctgaggg

SEQ ID NO: 1731 - DNA, 18 bp, Homo sapiens
gggcctggctctgaggga

SEQ ID NO: 1732 - DNA, 17 bp, Homo sapiens
aggcctgtggaaaaggg

SEQ ID NO: 1733 - DNA, 18 bp, Homo sapiens
aggcctgtggacattctg

SEQ ID NO: 1734 - DNA, 18 bp, Homo sapiens
gggcctgtggggcccggg

SEQ ID NO: 1735 - DNA, 18 bp, Homo sapiens
gggcctgtgacgcgaggg

SEQ ID NO: 1736 - DNA, 20 bp, Homo sapiens
aggcttgtggacacataggg

SEQ ID NO: 1737 - DNA, 17 bp, Homo sapiens
gggcctgagggctgggg

SEQ ID NO: 1738 - DNA, 21 bp, Homo sapiens
gggcctgtgcgaggccaggga

SEQ ID NO: 1739 - DNA, 17 bp, Homo sapiens
gggcctgctgggccggg

SEQ ID NO: 1740 - DNA, 20 bp, Homo sapiens
gcctgcaggacacctgaggg

SEQ ID NO: 1741 - DNA, 22 bp, Homo sapiens
ggatccagaattacctgaggga

SEQ ID NO: 1742 - DNA, 20 bp, Homo sapiens
gggcctgtgggccggcagga

SEQ ID NO: 1743 - DNA, 20 bp, Homo sapiens
gggcctgtgggggtcggggg

SEQ ID NO: 1744 - DNA, 17 bp, Homo sapiens
gggctgtgaactgaggg

SEQ ID NO: 1745 - DNA, 19 bp, Homo sapiens
gagccgcccgcctgaggga

SEQ ID NO: 1746 - DNA, 20 bp, Homo sapiens
gagcctgtggtgtctgaggg

SEQ ID NO: 1747 - DNA, 15 bp, Homo sapiens
gggcacacctgaggg

SEQ ID NO: 1748 - DNA, 16 bp, Homo sapiens
ggctctgtcctgaggg

SEQ ID NO: 1749 - DNA, 19 bp, Homo sapiens
gcgtctggatcctgaggga

SEQ ID NO: 1750 - DNA, 16 bp, Homo sapiens
gggctgcgtctgaggg

SEQ ID NO: 1751 - DNA, 22 bp, Homo sapiens
gggcctgttgatgccaccggga

SEQ ID NO: 1752 - DNA, 25 bp, Homo sapiens
ggcctgtggggtcggtgtctggggg

SEQ ID NO: 1753 - DNA, 16 bp, Homo sapiens
gggcctgtggagaggg

SEQ ID NO: 1754 - DNA, 21 bp, Homo sapiens
gggtgctacgtgcctgaggga

SEQ ID NO: 1755 - DNA, 19 bp, Homo sapiens
gggactgcttcctgaggga

SEQ ID NO: 1756 - DNA, 21 bp, Homo sapiens
gggcctgtggtgtacccaagg

SEQ ID NO: 1757 - DNA, 17 bp, Homo sapiens
ggctctgtggactgggg

SEQ ID NO: 1758 - DNA, 17 bp, Homo sapiens
gggcctgcgcctggggg

SEQ ID NO: 1759 - DNA, 19 bp, Homo sapiens
gggcctgtgggtcccctga

SEQ ID NO: 1760 - DNA, 20 bp, Homo sapiens
gggcctggacaacccttggg

SEQ ID NO: 1761 - DNA, 19 bp, Homo sapiens
ggcctgtgggcattaatgg

SEQ ID NO: 1762 - DNA, 21 bp, Homo sapiens
gggcctgtagacgcactggga

SEQ ID NO: 1763 - DNA, 17 bp, Homo sapiens
gggcctgtagatgctga

SEQ ID NO: 1764 - DNA, 22 bp, Homo sapiens
gggcctgtcggggcgtggggga

SEQ ID NO: 1765 - DNA, 18 bp, Homo sapiens
gggcctgggacacccagg

SEQ ID NO: 1766 - DNA, 21 bp, Homo sapiens
gggcgtccacggcctgaggga

SEQ ID NO: 1767 - DNA, 19 bp, Homo sapiens
ggtcctgtgggcaccgcgg

SEQ ID NO: 1768 - DNA, 19 bp, Homo sapiens
aggcttgtggacagcaggg

SEQ ID NO: 1769 - DNA, 20 bp, Homo sapiens
gggccttgggcatccttgga

SEQ ID NO: 1770 - DNA, 19 bp, Homo sapiens
gggcccgtggacgccaggg

SEQ ID NO: 1771 - DNA, 21 bp, Homo sapiens
ggctgtaagagcacctgaggg

SEQ ID NO: 1772 - DNA, 19 bp, Homo sapiens
aggcctgtgggttctggga

SEQ ID NO: 1773 - DNA, 16 bp, Homo sapiens
gggtgtgacctgaggg

SEQ ID NO: 1774 - DNA, 90 bp, Rana tigrina ranavirus
gccagagtctgaaaagtttgtagcctttatgtccgccgcccggcggatcatggacaagagaaaggccaaaaagactatgcaagagttggc

SEQ ID NO: 1775 - DNA, 24 bp, Rana tigrina ranavirus
gatcatggacaagagaaaggccaa

SEQ ID NO: 1776 - DNA, 18 bp, Homo sapiens
cgggcaggagaaaggcca

SEQ ID NO: 1777 - DNA, 18 bp, Homo sapiens
gagcaagagaagggccaa

SEQ ID NO: 1778 - DNA, 21 bp, Homo sapiens
gatcatggaaaccaagggagg

SEQ ID NO: 1779 - DNA, 20 bp, Homo sapiens
tcaggactatcaagaggcca

SEQ ID NO: 1780 - DNA, 21 bp, Homo sapiens
gacatggacactgaggggcca

SEQ ID NO: 1781 - DNA, 21 bp, Homo sapiens
tggacaaggacgcgaggccaa

SEQ ID NO: 1782 - DNA, 22 bp, Homo sapiens
tggacaaggacggcgaggccaa

SEQ ID NO: 1783 - DNA, 19 bp, Homo sapiens
gaccagcagaggaaggtca

SEQ ID NO: 1784 - DNA, 18 bp, Homo sapiens
cataaacaggagaaaggc

SEQ ID NO: 1785 - DNA, 20 bp, Homo sapiens
atcatggatttgaaaggtca

SEQ ID NO: 1786 - DNA, 16 bp, Homo sapiens
gatctggagaaaaagg

SEQ ID NO: 1787 - DNA, 24 bp, Homo sapiens
gatcataggtgagactcccaccaa

SEQ ID NO: 1788 - DNA, 18 bp, Homo sapiens
tcatgaacaaggaggcca

SEQ ID NO: 1789 - DNA, 17 bp, Homo sapiens
atagacacaaaggccaa

SEQ ID NO: 1790 - DNA, 17 bp, Homo sapiens
gattataggaaaaaggc

SEQ ID NO: 1791 - DNA, 20 bp, Homo sapiens
gattgtggacaaattcacca

SEQ ID NO: 1792 - DNA, 16 bp, Homo sapiens
gaaatgggagaaaggc

SEQ ID NO: 1793 - DNA, 18 bp, Homo sapiens
gattatggggaagagaaa

SEQ ID NO: 1794 - DNA, 22 bp, Homo sapiens
gaaaaggacaggagaaaggtca

SEQ ID NO: 1795 - DNA, 21 bp, Homo sapiens
gatcatggctaaggagtttgc

SEQ ID NO: 1796 - DNA, 16 bp, Homo sapiens
gatcgagaagaaaggc

SEQ ID NO: 1797 - DNA, 21 bp, Homo sapiens
tcatggattttcaaaggccaa

SEQ ID NO: 1798 - DNA, 20 bp, Homo sapiens
ggacatagtgagaaaggtca

SEQ ID NO: 1799 - DNA, 17 bp, Homo sapiens
accagggggaaaggcca

SEQ ID NO: 1800 - DNA, 21 bp, Homo sapiens
gaccatgggcaggaactctgc

SEQ ID NO: 1801 - DNA, 19 bp, Homo sapiens
gatcatagacaaggggcca

SEQ ID NO: 1802 - DNA, 23 bp, Homo sapiens
cataaatacaagggaaaggccaa

SEQ ID NO: 1803 - DNA, 22 bp, Homo sapiens
gatcatggggagtttataaggc

SEQ ID NO: 1804 - DNA, 20 bp, Homo sapiens
atggtgtgagggaaggccaa

SEQ ID NO: 1805 - DNA, 16 bp, Homo sapiens
atcatggatgaaaagg

SEQ ID NO: 1806 - DNA, 19 bp, Homo sapiens
gatcaaggacaaaaggcca

SEQ ID NO: 1807 - DNA, 21 bp, Homo sapiens
gaccagcagggagaagggcca

SEQ ID NO: 1808 - DNA, 20 bp, Homo sapiens
gatattaagaggagaaaggc

SEQ ID NO: 1809 - DNA, 21 bp, Homo sapiens
atcatgaaggaagagaggggc

SEQ ID NO: 1810 - DNA, 21 bp, Homo sapiens
gatcctggacaaaggggtcaa

SEQ ID NO: 1811 - DNA, 21 bp, Homo sapiens
tcgatggatcttgaaggccaa

SEQ ID NO: 1812 - DNA, 16 bp, Homo sapiens
gattatggaaaaggcc

SEQ ID NO: 1813 - DNA, 19 bp, Homo sapiens
gatcatgggggaggtacca

SEQ ID NO: 1814 - DNA, 20 bp, Homo sapiens
gaccatgggtgagaccgggc

SEQ ID NO: 1815 - DNA, 17 bp, Homo sapiens
catggacaaggaggtca

SEQ ID NO: 1816 - DNA, 62 bp, Human herpesvirus 4
ggaccccagccccgccgatccctcccccagggcgtacccggcttgcctggttctggggctcc

SEQ ID NO: 1817 - DNA, 21 bp, Human herpesvirus 4
cttgcctggttctggggctcc

SEQ ID NO: 1818 - DNA, 20 bp, Homo sapiens
cttagatggttctggggttc

SEQ ID NO: 1819 - DNA, 19 bp, Homo sapiens
tgctccagcctggggctcc

SEQ ID NO: 1820 - DNA, 17 bp, Homo sapiens
tgcctggttctgcctcc

SEQ ID NO: 1821 - DNA, 17 bp, Homo sapiens
cttccacgcctggggct

SEQ ID NO: 1822 - DNA, 20 bp, Homo sapiens
cctgcctgagcctgggctcc

SEQ ID NO: 1823 - DNA, 18 bp, Homo sapiens
ttgctggttctgaatgtc

SEQ ID NO: 1824 - DNA, 17 bp, Homo sapiens
tgcctggggccggctcc

SEQ ID NO: 1825 - DNA, 18 bp, Homo sapiens
cttgcagtccctggggct

SEQ ID NO: 1826 - DNA, 16 bp, Homo sapiens
gcctggccgaggctcc

SEQ ID NO: 1827 - DNA, 20 bp, Homo sapiens
ctttttggctcacagggctc

SEQ ID NO: 1828 - DNA, 18 bp, Homo sapiens
cttggccgatggggctcc

SEQ ID NO: 1829 - DNA, 18 bp, Homo sapiens
ctggtcacctggggctcc

SEQ ID NO: 1830 - DNA, 20 bp, Homo sapiens
cttgcttggctctgaacact

SEQ ID NO: 1831 - DNA, 18 bp, Homo sapiens
tgcctgtcccagggttcc

SEQ ID NO: 1832 - DNA, 17 bp, Homo sapiens
ttgtttggttctgaccc

SEQ ID NO: 1833 - DNA, 21 bp, Homo sapiens
cttgcctgtgttgggggctcc

SEQ ID NO: 1834 - DNA, 21 bp, Homo sapiens
cttcctgtgcatgggggctcc

SEQ ID NO: 1835 - DNA, 15 bp, Homo sapiens
cttgcctggctcgcc

SEQ ID NO: 1836 - DNA, 18 bp, Homo sapiens
cttccctcacggggctcc

SEQ ID NO: 1837 - DNA, 18 bp, Homo sapiens
cctgccctcatggggctc

SEQ ID NO: 1838 - DNA, 18 bp, Homo sapiens
cctgcctggtttctatcc

SEQ ID NO: 1839 - DNA, 16 bp, Homo sapiens
ctgccttccaggggct

SEQ ID NO: 1840 - DNA, 19 bp, Homo sapiens
tgcttggcactggggctcc

SEQ ID NO: 1841 - DNA, 15 bp, Homo sapiens
cttcctagggggctc

SEQ ID NO: 1842 - DNA, 20 bp, Homo sapiens
tgctccccttctggggctcc

SEQ ID NO: 1843 - DNA, 16 bp, Homo sapiens
cttcctggttccactc

SEQ ID NO: 1844 - DNA, 19 bp, Homo sapiens
cttggttggttctagattc

SEQ ID NO: 1845 - DNA, 17 bp, Homo sapiens
cttgcctggtgggctcc

SEQ ID NO: 1846 - DNA, 19 bp, Homo sapiens
ctggctactcatggggctc

SEQ ID NO: 1847 - DNA, 18 bp, Homo sapiens
tcgtcctgcttggggctc

SEQ ID NO: 1848 - DNA, 16 bp, Homo sapiens
cttcctcctggggttc

SEQ ID NO: 1849 - DNA, 19 bp, Homo sapiens
ttgtgtggtcgggggctcc

SEQ ID NO: 1850 - DNA, 20 bp, Homo sapiens
tgtttggttctgaaagggtc

SEQ ID NO: 1851 - DNA, 20 bp, Homo sapiens
ttgcttggtcccaggagctc

SEQ ID NO: 1852 - DNA, 20 bp, Homo sapiens
tgcctggcctgggtggggct

SEQ ID NO: 1853 - DNA, 16 bp, Homo sapiens
cctgcggcctggggct

SEQ ID NO: 1854 - DNA, 18 bp, Homo sapiens
cttgtcccctggggctcc

SEQ ID NO: 1855 - DNA, 21 bp, Homo sapiens
cttgcctgatttcttagattc

SEQ ID NO: 1856 - DNA, 19 bp, Homo sapiens
tgccattacctggggctcc

SEQ ID NO: 1857 - DNA, 20 bp, Homo sapiens
tgccttccccgtggggctcc

SEQ ID NO: 1858 - DNA, 16 bp, Homo sapiens
cttcctgctggggctc

SEQ ID NO: 1859 - DNA, 18 bp, Homo sapiens
ctgctgtggttggggctc

SEQ ID NO: 1860 - DNA, 17 bp, Homo sapiens
cttgcccggaggcggct

SEQ ID NO: 1861 - DNA, 23 bp, Homo sapiens
cttgcctgattcccttcggagcc

SEQ ID NO: 1862 - DNA, 18 bp, Homo sapiens
cttgcccggctacgggct

SEQ ID NO: 1863 - DNA, 18 bp, Homo sapiens
ctgccactggctggggct

SEQ ID NO: 1864 - DNA, 19 bp, Homo sapiens
cttgactgagaagggctcc

SEQ ID NO: 1865 - DNA, 18 bp, Homo sapiens
ctgtctgccctggggctc

SEQ ID NO: 1866 - DNA, 20 bp, Homo sapiens
cttccctcagtctggggctc

SEQ ID NO: 1867 - DNA, 21 bp, Homo sapiens
cttgcctgttttcacagactc

SEQ ID NO: 1868 - DNA, 22 bp, Homo sapiens
cttcctgggataaaggggttcc

SEQ ID NO: 1869 - DNA, 19 bp, Homo sapiens
ctgcctggtttcctgtgct

SEQ ID NO: 1870 - DNA, 17 bp, Homo sapiens
ttgactaaaggggctcc

SEQ ID NO: 1871 - DNA, 18 bp, Homo sapiens
cttccctgaagagggctc

SEQ ID NO: 1872 - DNA, 17 bp, Homo sapiens
gccctgcctggggctcc

SEQ ID NO: 1873 - DNA, 17 bp, Homo sapiens
gcctggttctgggttcc

SEQ ID NO: 1874 - DNA, 20 bp, Homo sapiens
cttgcttggtcctagaatcc

SEQ ID NO: 1875 - DNA, 19 bp, Homo sapiens
ctgcttggttctggagttc

SEQ ID NO: 1876 - DNA, 19 bp, Homo sapiens
cttgttttgttagaactcc

SEQ ID NO: 1877 - DNA, 18 bp, Homo sapiens
cctgcctggtgggggctc

SEQ ID NO: 1878 - DNA, 18 bp, Homo sapiens
tgcggagactggggctcc

SEQ ID NO: 1879 - DNA, 19 bp, Homo sapiens
ctagcacccctggggctcc

SEQ ID NO: 1880 - DNA, 19 bp, Homo sapiens
cttgaaaaagtctggggct

SEQ ID NO: 1881 - DNA, 17 bp, Homo sapiens
ctacgccttggggctcc

SEQ ID NO: 1882 - DNA, 20 bp, Homo sapiens
cctgtctgggagggggctcc

SEQ ID NO: 1883 - DNA, 17 bp, Homo sapiens
ttgtctgttctgggatc

SEQ ID NO: 1884 - DNA, 20 bp, Homo sapiens
tgcctgggtcaccgggctcc

SEQ ID NO: 1885 - DNA, 20 bp, Homo sapiens
cctgcctggtgtacctggct

SEQ ID NO: 1886 - DNA, 19 bp, Homo sapiens
cttggcttatcagggggct

SEQ ID NO: 1887 - DNA, 21 bp, Homo sapiens
cttacttctgagatggggctc

SEQ ID NO: 1888 - DNA, 18 bp, Homo sapiens
cttgcctgtgagggctcc

SEQ ID NO: 1889 - DNA, 18 bp, Homo sapiens
tgtctggttctaagttcc

SEQ ID NO: 1890 - DNA, 18 bp, Homo sapiens
cttgcctgtccctgctcc

SEQ ID NO: 1891 - DNA, 19 bp, Homo sapiens
ctttctgtcatctggggct

SEQ ID NO: 1892 - DNA, 15 bp, Homo sapiens
tgcctggcagggctc

SEQ ID NO: 1893 - DNA, 16 bp, Homo sapiens
tacataattggggctc

SEQ ID NO: 1894 - DNA, 19 bp, Homo sapiens
cctgcctggcctgggctcc

SEQ ID NO: 1895 - DNA, 20 bp, Homo sapiens
cttgttggttcacacagtcc

SEQ ID NO: 1896 - DNA, 18 bp, Homo sapiens
ctgcccacctggggctcc

SEQ ID NO: 1897 - DNA, 16 bp, Homo sapiens
ctggcctggggggctc

SEQ ID NO: 1898 - DNA, 18 bp, Homo sapiens
ctgcctggccctgggctc

SEQ ID NO: 1899 - DNA, 16 bp, Homo sapiens
cttgctgctggggctc

SEQ ID NO: 1900 - DNA, 22 bp, Homo sapiens
tgcctggtaagtagtggggttc

SEQ ID NO: 1901 - DNA, 19 bp, Homo sapiens
cttccctggttggagctcc

SEQ ID NO: 1902 - DNA, 20 bp, Homo sapiens
tgtcaaagttttggggctcc

SEQ ID NO: 1903 - DNA, 19 bp, Homo sapiens
ttgcctggcaggcagggct

SEQ ID NO: 1904 - DNA, 22 bp, Homo sapiens
cttcctggttccccctggttcc

SEQ ID NO: 1905 - DNA, 23 bp, Homo sapiens
cttgccctggttcctctggagcc

SEQ ID NO: 1906 - DNA, 20 bp, Homo sapiens
cctgtctgatgtggggctcc

SEQ ID NO: 1907 - DNA, 16 bp, Homo sapiens
cttgctctggtcagct

SEQ ID NO: 1908 - DNA, 18 bp, Homo sapiens
tgccgtgctctggggctc

SEQ ID NO: 1909 - DNA, 21 bp, Homo sapiens
cttgcctggtccaatcaatcc

SEQ ID NO: 1910 - DNA, 20 bp, Homo sapiens
tgtccttgccctggggctcc

SEQ ID NO: 1911 - DNA, 20 bp, Homo sapiens
ttgctatggcagggggctcc

SEQ ID NO: 1912 - DNA, 19 bp, Homo sapiens
ttggctcgtctggggctcc

SEQ ID NO: 1913 - DNA, 20 bp, Homo sapiens
ctggcccagtcctggggctc

SEQ ID NO: 1914 - DNA, 16 bp, Homo sapiens
cttgccgcgagggctc

SEQ ID NO: 1915 - DNA, 18 bp, Homo sapiens
ctttcctggttctcaact

SEQ ID NO: 1916 - DNA, 21 bp, Homo sapiens
ttgctggtcctcctggggctc

SEQ ID NO: 1917 - DNA, 18 bp, Homo sapiens
cttacctggttcaagtcc

SEQ ID NO: 1918 - DNA, 17 bp, Homo sapiens
cttgctggttctggaac

SEQ ID NO: 1919 - DNA, 19 bp, Homo sapiens
ctggtgccactggggctcc

SEQ ID NO: 1920 - DNA, 18 bp, Homo sapiens
cctgcctgggaaggttcc

SEQ ID NO: 1921 - DNA, 20 bp, Homo sapiens
cctgcctggcccagggctcc

SEQ ID NO: 1922 - DNA, 20 bp, Homo sapiens
ctggccccctcctggggctc

SEQ ID NO: 1923 - DNA, 20 bp, Homo sapiens
cttggcctggggctggttcc

SEQ ID NO: 1924 - DNA, 20 bp, Homo sapiens
ctagcactccttggggctcc

SEQ ID NO: 1925 - DNA, 18 bp, Homo sapiens
ttgcctgagttttgaacc

SEQ ID NO: 1926 - DNA, 22 bp, Homo sapiens
cctgcccccttgtctggggttc

SEQ ID NO: 1927 - DNA, 19 bp, Homo sapiens
ttgcctggcttaaagttcc

SEQ ID NO: 1928 - DNA, 18 bp, Homo sapiens
tgctcctcctggggctcc

SEQ ID NO: 1929 - DNA, 15 bp, Homo sapiens
cttgcccggtgggct

SEQ ID NO: 1930 - DNA, 16 bp, Homo sapiens
cttgtctggtcctatc

SEQ ID NO: 1931 - DNA, 17 bp, Homo sapiens
ttgcctggtgcagaacc

SEQ ID NO: 1932 - DNA, 17 bp, Homo sapiens
ctgcctggtctggttcc

SEQ ID NO: 1933 - DNA, 20 bp, Homo sapiens
cctgcctggttttgaaagcc

SEQ ID NO: 1934 - DNA, 19 bp, Homo sapiens
ctgtctggttctgcaagct

SEQ ID NO: 1935 - DNA, 19 bp, Homo sapiens
cttcctgagcgctgggctc

SEQ ID NO: 1936 - DNA, 16 bp, Homo sapiens
tcgcgcctggggctcc

SEQ ID NO: 1937 - DNA, 18 bp, Homo sapiens
tgcttgtgctggggctcc

SEQ ID NO: 1938 - DNA, 15 bp, Homo sapiens
ctcgcctgggggctc

SEQ ID NO: 1939 - DNA, 21 bp, Homo sapiens
cttccttgggctctgggctcc

SEQ ID NO: 1940 - DNA, 20 bp, Homo sapiens
cttccctggaggaaggctcc

SEQ ID NO: 1941 - DNA, 19 bp, Homo sapiens
ctggcctggttctgcctcc

SEQ ID NO: 1942 - DNA, 19 bp, Homo sapiens
cctgcctctgtggggctcc

SEQ ID NO: 1943 - DNA, 17 bp, Homo sapiens
cttccctggtagggctc

SEQ ID NO: 1944 - DNA, 16 bp, Homo sapiens
cctgcctgggaggttc

SEQ ID NO: 1945 - DNA, 20 bp, Homo sapiens
cttgccttggctcagggctc

SEQ ID NO: 1946 - DNA, 17 bp, Homo sapiens
tgccttcctggggctcc

SEQ ID NO: 1947 - DNA, 18 bp, Homo sapiens
cttcctggttctgagact

SEQ ID NO: 1948 - DNA, 20 bp, Homo sapiens
cttgcctggtgtcatagtcc

SEQ ID NO: 1949 - DNA, 20 bp, Homo sapiens
ctgcctgggagtgagggctc

SEQ ID NO: 1950 - DNA, 20 bp, Homo sapiens
cttgcccattcttggggttc

SEQ ID NO: 1951 - DNA, 25 bp, Homo sapiens
ttgcctgagtttcctttggagcccc

SEQ ID NO: 1952 - DNA, 18 bp, Homo sapiens
tgcctggttcttcgggct

SEQ ID NO: 1953 - DNA, 18 bp, Homo sapiens
cttgcctggtcagacccc

SEQ ID NO: 1954 - DNA, 18 bp, Homo sapiens
ttgcgttcctggggttcc

SEQ ID NO: 1955 - DNA, 19 bp, Homo sapiens
cttccctggggtcagggct

SEQ ID NO: 1956 - DNA, 19 bp, Homo sapiens
tgcctgagcaaagggctcc

SEQ ID NO: 1957 - DNA, 20 bp, Homo sapiens
cttgtttagttctggagact

SEQ ID NO: 1958 - DNA, 21 bp, Homo sapiens
ctgcttgggctctggggctcc

SEQ ID NO: 1959 - DNA, 17 bp, Homo sapiens
ctgcaccccctggggct

SEQ ID NO: 1960 - DNA, 19 bp, Homo sapiens
cttggccttcaggggctcc

SEQ ID NO: 1961 - DNA, 18 bp, Homo sapiens
cttgcctagttcctgact

SEQ ID NO: 1962 - DNA, 18 bp, Homo sapiens
cttgcctggattcagtcc

SEQ ID NO: 1963 - DNA, 21 bp, Homo sapiens
cttgccgctgtctggggctcc

SEQ ID NO: 1964 - DNA, 16 bp, Homo sapiens
cttgcctatggggttc

SEQ ID NO: 1965 - DNA, 20 bp, Homo sapiens
ctggttgcatttggggctcc

SEQ ID NO: 1966 - DNA, 20 bp, Homo sapiens
cctgcctgggggcctggctc

SEQ ID NO: 1967 - DNA, 15 bp, Homo sapiens
cttcctggagggctc

SEQ ID NO: 1968 - DNA, 17 bp, Homo sapiens
ttgctaggttctgactc

SEQ ID NO: 1969 - DNA, 18 bp, Homo sapiens
cctgcgctcctggggctc

SEQ ID NO: 1970 - DNA, 21 bp, Homo sapiens
cttgcctgatacacaggttcc

SEQ ID NO: 1971 - DNA, 18 bp, Homo sapiens
ttccctcaggggggctcc

SEQ ID NO: 1972 - DNA, 19 bp, Homo sapiens
tgtgtggtcctggggctcc

SEQ ID NO: 1973 - DNA, 18 bp, Homo sapiens
cctgcctggaactggctc

SEQ ID NO: 1974 - DNA, 18 bp, Homo sapiens
ctgcagcccctggggctc

SEQ ID NO: 1975 - DNA, 20 bp, Homo sapiens
cttgctgcccacaggggctc

SEQ ID NO: 1976 - DNA, 17 bp, Homo sapiens
ctgtctggtcctcggct

SEQ ID NO: 1977 - DNA, 20 bp, Homo sapiens
ctctgaggctttggggttcc

SEQ ID NO: 1978 - DNA, 20 bp, Homo sapiens
ctcgcctgaggaacgggctc

SEQ ID NO: 1979 - DNA, 20 bp, Homo sapiens
cttgcctggctctcaaggcc

SEQ ID NO: 1980 - DNA, 18 bp, Homo sapiens
ctttccgttatggggctc

SEQ ID NO: 1981 - DNA, 24 bp, Homo sapiens
cctgcctggggcccatggggctcc

SEQ ID NO: 1982 - DNA, 16 bp, Homo sapiens
cttgcctggctcactc

SEQ ID NO: 1983 - DNA, 19 bp, Homo sapiens
cttcctggttctgaaagct

SEQ ID NO: 1984 - DNA, 16 bp, Homo sapiens
cttgctggccggggct

SEQ ID NO: 1985 - DNA, 16 bp, Homo sapiens
cttgacccgtggggct

SEQ ID NO: 1986 - DNA, 23 bp, Homo sapiens
ttgcctggtcacctaggggctcc

SEQ ID NO: 1987 - DNA, 18 bp, Homo sapiens
ttgcctggctttgtggag

SEQ ID NO: 1988 - DNA, 18 bp, Homo sapiens
cttgctggtccttggctc

SEQ ID NO: 1989 - DNA, 19 bp, Homo sapiens
ttggctgggccagggctcc

SEQ ID NO: 1990 - DNA, 18 bp, Homo sapiens
cttgccttggttgatgct

SEQ ID NO: 1991 - DNA, 18 bp, Homo sapiens
cctgcaaaagctggggct

SEQ ID NO: 1992 - DNA, 20 bp, Homo sapiens
ctggcttggtttgaccctcc

SEQ ID NO: 1993 - DNA, 19 bp, Homo sapiens
ctgactcttctggggttcc

SEQ ID NO: 1994 - DNA, 17 bp, Homo sapiens
cttgcctggctcaaact

SEQ ID NO: 1995 - DNA, 18 bp, Homo sapiens
cctgccctctggggctcc

SEQ ID NO: 1996 - DNA, 15 bp, Homo sapiens
tgcctggctgggctc

SEQ ID NO: 1997 - DNA, 22 bp, Homo sapiens
ctggcctggggcgcagggctcc

SEQ ID NO: 1998 - DNA, 20 bp, Homo sapiens
cttgcttgacacggggctcc

SEQ ID NO: 1999 - DNA, 15 bp, Homo sapiens
cctgcctgagggctc

SEQ ID NO: 2000 - DNA, 18 bp, Homo sapiens
cttttctgctctggggct

SEQ ID NO: 2001 - DNA, 16 bp, Homo sapiens
cttcctggtgaagctc

SEQ ID NO: 2002 - DNA, 19 bp, Homo sapiens
ctggcctggccctggttcc

SEQ ID NO: 2003 - DNA, 19 bp, Homo sapiens
cttgaccctctctggggct

SEQ ID NO: 2004 - DNA, 16 bp, Homo sapiens
tgcctgggggggctcc

SEQ ID NO: 2005 - DNA, 17 bp, Homo sapiens
tgcctggtttccactcc

SEQ ID NO: 2006 - DNA, 16 bp, Homo sapiens
ctgcctgaggggctcc

SEQ ID NO: 2007 - DNA, 73 bp, Rana tigrina ranavirus
agttttgccacaacaagcctactgtcaacacgatgggagtggagagcgcagtgaccgggctggtggcagagct

SEQ ID NO: 2008 - DNA, 24 bp, Rana tigrina ranavirus
aagcctactgtcaacacgatggga

SEQ ID NO: 2009 - DNA, 20 bp, Homo sapiens
agctcatatactacgatggg

SEQ ID NO: 2010 - DNA, 23 bp, Homo sapiens
aagtttactgtcaaaaagaggga

SEQ ID NO: 2011 - DNA, 22 bp, Homo sapiens
agctttactgtcagtcagtgga

SEQ ID NO: 2012 - DNA, 18 bp, Homo sapiens
aaggctactgtcaatgca

SEQ ID NO: 2013 - DNA, 22 bp, Homo sapiens
aagttactgtcaggtgatggga

SEQ ID NO: 2014 - DNA, 20 bp, Homo sapiens
agccactgtcggggatcggg

SEQ ID NO: 2015 - DNA, 22 bp, Homo sapiens
aacctgctgtcaacgaccctgg

SEQ ID NO: 2016 - DNA, 20 bp, Homo sapiens
aacctactgtcctgcatggg

SEQ ID NO: 2017 - DNA, 19 bp, Homo sapiens
gcctactgtcctgaatggg

SEQ ID NO: 2018 - DNA, 25 bp, Homo sapiens
gcttactgtcaataaatatgtggga

SEQ ID NO: 2019 - DNA, 17 bp, Homo sapiens
acctattgtcaacaagg

SEQ ID NO: 2020 - DNA, 19 bp, Homo sapiens
aagcctctgtcaaccaggg

SEQ ID NO: 2021 - DNA, 21 bp, Homo sapiens
gccttagggcacacgatggga

SEQ ID NO: 2022 - DNA, 18 bp, Homo sapiens
aagcttatgtcaacacga

SEQ ID NO: 2023 - DNA, 17 bp, Homo sapiens
gccactgtcaccctggg

SEQ ID NO: 2024 - DNA, 22 bp, Homo sapiens
gccagctgtcagcccaatggga

SEQ ID NO: 2025 - DNA, 22 bp, Homo sapiens
agcttgttgtcaacaaagtaga

SEQ ID NO: 2026 - DNA, 19 bp, Homo sapiens
ctctgcagtacacgatggg

SEQ ID NO: 2027 - DNA, 17 bp, Homo sapiens
cctactgtcaatataga

SEQ ID NO: 2028 - DNA, 17 bp, Homo sapiens
ccaggcaacacgatggg

SEQ ID NO: 2029 - DNA, 18 bp, Homo sapiens
aagtctacagtcaatggg

SEQ ID NO: 2030 - DNA, 22 bp, Homo sapiens
agccactgtcaatattcaaagg

SEQ ID NO: 2031 - DNA, 19 bp, Homo sapiens
aagcttgcatcacgatggg

SEQ ID NO: 2032 - DNA, 25 bp, Homo sapiens
aacctactgtcaaggcagggtggga

SEQ ID NO: 2033 - DNA, 22 bp, Homo sapiens
aactctactgtcaacatgtggg

SEQ ID NO: 2034 - DNA, 22 bp, Homo sapiens
agcctacttcaatgcatgcaga

SEQ ID NO: 2035 - DNA, 22 bp, Homo sapiens
agcccactgtggacatggtggg

SEQ ID NO: 2036 - DNA, 95 bp, Rana tigrina ranavirus
ggctcgttaaacccgccgtgggcatggacaccctgtacggcaccaggaacgccaggttcgtacccagggacgtcggacggtggggaaagggagct

SEQ ID NO: 2037 - DNA, 24 bp, Rana tigrina ranavirus
accctgtacggcaccaggaacgcc

SEQ ID NO: 2038 - DNA, 24 bp, Homo sapiens
ccctgtgtctgctttgggaacgcc

SEQ ID NO: 2039 - DNA, 21 bp, Homo sapiens
ccgtggctcgccgggagcgcc

SEQ ID NO: 2040 - DNA, 17 bp, Homo sapiens
accctgtacggcatggg

SEQ ID NO: 2041 - DNA, 23 bp, Homo sapiens
ccttgtggtcagggaggaacgcc

SEQ ID NO: 2042 - DNA, 18 bp, Homo sapiens
ccctgcacgccgggacgc

SEQ ID NO: 2043 - DNA, 22 bp, Homo sapiens
ccctgtacctggccaggaatgc

SEQ ID NO: 2044 - DNA, 24 bp, Homo sapiens
acccagtcacacaccaggagcgcc

SEQ ID NO: 2045 - DNA, 19 bp, Homo sapiens
accttgtcggcaccattgg

SEQ ID NO: 2046 - DNA, 19 bp, Homo sapiens
ccccagcaccagggatgcc

SEQ ID NO: 2047 - DNA, 23 bp, Homo sapiens
ctgtacagcatcaatggcatgcc

SEQ ID NO: 2048 - DNA, 20 bp, Homo sapiens
cgcagaccgccgggaacgcc

SEQ ID NO: 2049 - DNA, 21 bp, Homo sapiens
tgtacagcaactggggatgcc

SEQ ID NO: 2050 - DNA, 21 bp, Homo sapiens
cctgtggctgccagggacgcc

SEQ ID NO: 2051 - DNA, 21 bp, Homo sapiens
ccctgtacggggaagggcgcc

SEQ ID NO: 2052 - DNA, 19 bp, Homo sapiens
tgtgctgcaccaagatgcc

SEQ ID NO: 2053 - DNA, 90 bp, Rana tigrina ranavirus
gagatttaatgctagtctaaatatttctatattaagatactatcttaagatatcggtactctgagatattttacgctgacatttttactc

SEQ ID NO: 2054 - DNA, 24 bp, Rana tigrina ranavirus
tattttacgctgacatttttactc

SEQ ID NO: 2055 - DNA, 19 bp, Homo sapiens
tattttacctgacaaattc

SEQ ID NO: 2056 - DNA, 18 bp, Homo sapiens
tatcttacgctgatattc

SEQ ID NO: 2057 - DNA, 23 bp, Homo sapiens
attttgggccaacatttttattc

SEQ ID NO: 2058 - DNA, 97 bp, Rat cytomegalovirus
ggccgccgcctcgaggtggctcgcgtcgccatggagaccgagacccgtcaatcagcggtcaccatggcgacgcgagcccgcctccgagtccgcggcc

SEQ ID NO: 2059 - DNA, 24 bp, Rat cytomegalovirus
caccatggcgacgcgagcccgcct

SEQ ID NO: 2060 - DNA, 21 bp, Homo sapiens
caacatggcgaaaccccgtct

SEQ ID NO: 2061 - DNA, 21 bp, Homo sapiens
caacatggcgaaacctcgtct

SEQ ID NO: 2062 - DNA, 18 bp, Homo sapiens
catggcgaaaccccgcct

SEQ ID NO: 2063 - DNA, 23 bp, Homo sapiens
caccatggtgccagcctctgcct

SEQ ID NO: 2064 - DNA, 19 bp, Homo sapiens
caccatggcgcggcgcgcc

SEQ ID NO: 2065 - DNA, 21 bp, Homo sapiens
gactgtgcgccgagcccgcct

SEQ ID NO: 2066 - DNA, 26 bp, Homo sapiens
caccatagctctgaatgggcctgcct

SEQ ID NO: 2067 - DNA, 27 bp, Homo sapiens
caccatggcggagcacagcctccgcct

SEQ ID NO: 2068 - DNA, 22 bp, Homo sapiens
caccatggttagactagcctgc

SEQ ID NO: 2069 - DNA, 21 bp, Homo sapiens
caacatggcgaaaccccgcct

SEQ ID NO: 2070 - DNA, 18 bp, Homo sapiens
caccatgatgaaacccgc

SEQ ID NO: 2071 - DNA, 16 bp, Homo sapiens
caacatggcgaaaccc

SEQ ID NO: 2072 - DNA, 21 bp, Homo sapiens
cacggcgccgtgggctcgtct

SEQ ID NO: 2073 - DNA, 21 bp, Homo sapiens
caccgggttccaagcccgcct

SEQ ID NO: 2074 - DNA, 21 bp, Homo sapiens
accacggcggcgacgctgcct

SEQ ID NO: 2075 - DNA, 21 bp, Homo sapiens
caacatggcgagaccccgtct

SEQ ID NO: 2076 - DNA, 18 bp, Homo sapiens
cggccgagtgcgagcccg

SEQ ID NO: 2077 - DNA, 19 bp, Homo sapiens
ccacggcgattcctcgcct

SEQ ID NO: 2078 - DNA, 19 bp, Homo sapiens
caccatggcggccagggcc

SEQ ID NO: 2079 - DNA, 18 bp, Homo sapiens
aacaatgcgagcccgtct

SEQ ID NO: 2080 - DNA, 16 bp, Homo sapiens
caacatggcgagaccc

SEQ ID NO: 2081 - DNA, 21 bp, Homo sapiens
caacatggcgaaactccgcct

SEQ ID NO: 2082 - DNA, 21 bp, Homo sapiens
gccgtcgagaagggcccgcct

SEQ ID NO: 2083 - DNA, 18 bp, Homo sapiens
caccatggcagccctgcc

SEQ ID NO: 2084 - DNA, 23 bp, Homo sapiens
caccttggtggccttgcccgcct

SEQ ID NO: 2085 - DNA, 15 bp, Homo sapiens
caccatggcgccccc

SEQ ID NO: 2086 - DNA, 21 bp, Homo sapiens
caccatggtgaaattccgtct

SEQ ID NO: 2087 - DNA, 16 bp, Homo sapiens
caccgcggcagcccgc

SEQ ID NO: 2088 - DNA, 21 bp, Homo sapiens
cctgtggccaccggcccgcct

SEQ ID NO: 2089 - DNA, 15 bp, Homo sapiens
atggcgacggccacc

SEQ ID NO: 2090 - DNA, 19 bp, Homo sapiens
caccaaggtgaagccctgc

SEQ ID NO: 2091 - DNA, 92 bp, Amsacta moorei entomopoxvirus
aattcattagaattgattttattagaatgagttatttcttcatccgaagattcaacatcatctttttttttcttaatttctattctagaatt

SEQ ID NO: 2092 - DNA, 24 bp, Amsacta moorei entomopoxvirus
ttcattagaattgattttattaga

SEQ ID NO: 2093 - DNA, 20 bp, Homo sapiens
ttagaatttatcttgttaga

SEQ ID NO: 2094 - DNA, 23 bp, Homo sapiens
ttcatagaattgaagtgagttag

SEQ ID NO: 2095 - DNA, 119 bp, Amsacta moorei entomopoxvirus
agaatcttcttctaattcattagaattgattttattagaatgagttatttcttcatccgaagattcaacatcatctttttttttcttaatttctattctagaattttttttattattct

SEQ ID NO: 2096 - DNA, 68 bp, Amsacta moorei entomopoxvirus
attttaggatcattaaaattatttttacacttaaatttaattttatcaattttttcagattttaaaat

SEQ ID NO: 2097 - DNA, 24 bp, Amsacta moorei entomopoxvirus
taggatcattaaaattatttttac

SEQ ID NO: 2098 - DNA, 22 bp, Homo sapiens
ggatcatcaagaactaagttac

SEQ ID NO: 2099 - DNA, 23 bp, Homo sapiens
aggaagactaggattatttttac

SEQ ID NO: 2100 - DNA, 18 bp, Homo sapiens
atcttaaaattattttta

SEQ ID NO: 2101 - DNA, 62 bp, Rat cytomegalovirus
gaaaataaatgacggatatgatgtgaatgatatatcgtcatcgatatacgtggtttcttatc

SEQ ID NO: 2102 - DNA, 24 bp, Rat cytomegalovirus
taaatgacggatatgatgtgaatg

SEQ ID NO: 2103 - DNA, 21 bp, Homo sapiens
tgagggacagaggtgtgaatg

SEQ ID NO: 2104 - DNA, 20 bp, Homo sapiens
taaatgacggagtcaggatg

SEQ ID NO: 2105 - DNA, 17 bp, Homo sapiens
aatgacggatggatgga

SEQ ID NO: 2106 - DNA, 17 bp, Homo sapiens
tgcggtcaatgtgaatg

SEQ ID NO: 2107 - DNA, 18 bp, Homo sapiens
aatgacggaggtgctgga

SEQ ID NO: 2108 - DNA, 19 bp, Homo sapiens
atgacgaatggtgtgaatg

SEQ ID NO: 2109 - DNA, 23 bp, Homo sapiens
taagtgacagatgtgactcaaga

SEQ ID NO: 2110 - DNA, 17 bp, Homo sapiens
aatgacaggataggaat

SEQ ID NO: 2111 - DNA, 18 bp, Homo sapiens
gagtgaaatgatgtgaat

SEQ ID NO: 2112 - DNA, 18 bp, Homo sapiens
atgacggatggccgaatg

SEQ ID NO: 2113 - DNA, 21 bp, Homo sapiens
taaatgacgagtttatgggtg

SEQ ID NO: 2114 - DNA, 17 bp, Homo sapiens
tgatgacggattgggtg

SEQ ID NO: 2115 - DNA, 24 bp, Homo sapiens
taaatatggatgtgataataaatg

SEQ ID NO: 2116 - DNA, 70 bp, Ateline herpesvirus 3
gttattggctctaattagtcataaaagtacaacaatacagtatgcgaccactgaaatagagctaaaaaac

SEQ ID NO: 2117 - DNA, 19 bp, Ateline herpesvirus 3
tgaaatagagctaaaaaac

SEQ ID NO: 2118 - DNA, 17 bp, Homo sapiens
tgaaagagccaaaaaac

SEQ ID NO: 2119 - DNA, 19 bp, Homo sapiens
tgggacagagctctaaaac

SEQ ID NO: 2120 - DNA, 18 bp, Homo sapiens
taaaatagaaccacaaaa

SEQ ID NO: 2121 - DNA, 17 bp, Homo sapiens
tgaaaagagcaaaaaac

SEQ ID NO: 2122 - DNA, 18 bp, Homo sapiens
gaaatagaagcctaaaaa

SEQ ID NO: 2123 - DNA, 19 bp, Homo sapiens
tggcactaagctaaaaaac

SEQ ID NO: 2124 - DNA, 18 bp, Homo sapiens
tgaaatagaaccacaaaa

SEQ ID NO: 2125 - DNA, 19 bp, Homo sapiens
tgaaacagtactgaaaaac

SEQ ID NO: 2126 - DNA, 18 bp, Homo sapiens
taaaataaaactaaaaaa

SEQ ID NO: 2127 - DNA, 18 bp, Homo sapiens
gaaatagactgccaaaaa

SEQ ID NO: 2128 - DNA, 18 bp, Homo sapiens
tgaaacagatctgctaaa

SEQ ID NO: 2129 - DNA, 18 bp, Homo sapiens
tgaaacagattccaaaaa

SEQ ID NO: 2130 - DNA, 18 bp, Homo sapiens
tgaaatagttaccaaaaa

SEQ ID NO: 2131 - DNA, 19 bp, Homo sapiens
taaaataaaactaaagaac

SEQ ID NO: 2132 - DNA, 18 bp, Homo sapiens
tgaaatgcaccaaaaaac

SEQ ID NO: 2133 - DNA, 19 bp, Homo sapiens
tgaaatagaacaaggaaac

SEQ ID NO: 2134 - DNA, 19 bp, Homo sapiens
tgaaacagcctaccaaaaa

SEQ ID NO: 2135 - DNA, 19 bp, Homo sapiens
tgaaacagagcagggaaac

SEQ ID NO: 2136 - DNA, 18 bp, Homo sapiens
tgaaacaggagctgaaaa

SEQ ID NO: 2137 - DNA, 19 bp, Homo sapiens
tgaaaaggaaccaaaaaac

SEQ ID NO: 2138 - DNA, 18 bp, Homo sapiens
tgaaataaagttaaaaaa

SEQ ID NO: 2139 - DNA, 17 bp, Homo sapiens
tgaaatatactaaaaaa

SEQ ID NO: 2140 - DNA, 18 bp, Homo sapiens
taaaatagagcttcaaaa

SEQ ID NO: 2141 - DNA, 21 bp, Homo sapiens
tgaaataaatgctacaaaaac

SEQ ID NO: 2142 - DNA, 18 bp, Homo sapiens
tgaaacagtgcaaaaaaa

SEQ ID NO: 2143 - DNA, 19 bp, Homo sapiens
tgaaataaaaccaagaaac

SEQ ID NO: 2144 - DNA, 19 bp, Homo sapiens
taaaatatgaactaaaaaa

SEQ ID NO: 2145 - DNA, 23 bp, Homo sapiens
tgaaacagagcctatgaaaaaac

SEQ ID NO: 2146 - DNA, 19 bp, Homo sapiens
gaaacaagagctaagaaac

SEQ ID NO: 2147 - DNA, 60 bp, Human herpesvirus 6
gtttccgcttttcagcgagcatgtaccctaatgggaatgcgatggctgttagtgcgggac

SEQ ID NO: 2148 - DNA, 24 bp, Human herpesvirus 6
gaatgcgatggctgttagtgcggg

SEQ ID NO: 2149 - DNA, 18 bp, Homo sapiens
gagtgcgagggggtgcgg

SEQ ID NO: 2150 - DNA, 21 bp, Homo sapiens
atgcgacggttggccaacggg

SEQ ID NO: 2151 - DNA, 21 bp, Homo sapiens
gagtgcgatgctgggagtggg

SEQ ID NO: 2152 - DNA, 21 bp, Homo sapiens
tgtgatggccacctgtgtggg

SEQ ID NO: 2153 - DNA, 16 bp, Homo sapiens
tggatggctgggtggg

SEQ ID NO: 2154 - DNA, 18 bp, Homo sapiens
tggatggctggagctggg

SEQ ID NO: 2155 - DNA, 19 bp, Homo sapiens
atgcgatgcttggcttggg

SEQ ID NO: 2156 - DNA, 19 bp, Homo sapiens
gcggtgcggtgcagtgcgg

SEQ ID NO: 2157 - DNA, 20 bp, Homo sapiens
gcgatggccgggggtgtggg

SEQ ID NO: 2158 - DNA, 18 bp, Homo sapiens
tggctgctgcagtgtggg

SEQ ID NO: 2159 - DNA, 24 bp, Homo sapiens
gaatgcggggctaaggagtgtggg

SEQ ID NO: 2160 - DNA, 72 bp, Ateline herpesvirus 3
agtacttgaaatacagcccctagaaaaatcaaaagtatttcttgaaaaactaaaacctgtagaacaaaaact

SEQ ID NO: 2161 - DNA, 24 bp, Ateline herpesvirus 3
aaaaactaaaacctgtagaacaaa

SEQ ID NO: 2162 - DNA, 19 bp, Homo sapiens
aaaaaccaaaacaaaacaa

SEQ ID NO: 2163 - DNA, 18 bp, Homo sapiens
aaaaactaaaacctgaaa

SEQ ID NO: 2164 - DNA, 22 bp, Homo sapiens
aaaaacaaaaacccagaggcag

SEQ ID NO: 2165 - DNA, 20 bp, Homo sapiens
aaactgaaaactagaacaaa

SEQ ID NO: 2166 - DNA, 18 bp, Homo sapiens
aaaaacaaaaccgaacaa

SEQ ID NO: 2167 - DNA, 21 bp, Homo sapiens
aaaaccaaaactgtctataaa

SEQ ID NO: 2168 - DNA, 20 bp, Homo sapiens
aaaactaaaatccagagcag

SEQ ID NO: 2169 - DNA, 19 bp, Homo sapiens
aaaactgcactgtagagca

SEQ ID NO: 2170 - DNA, 17 bp, Homo sapiens
aaaaacaaaacctgaaa

SEQ ID NO: 2171 - DNA, 21 bp, Homo sapiens
aaaaacaaaccaaggaacaaa

SEQ ID NO: 2172 - DNA, 18 bp, Homo sapiens
aaaaccaaaacaaaacaa

SEQ ID NO: 2173 - DNA, 22 bp, Homo sapiens
aaaaacaaaaccaagaaacaaa

SEQ ID NO: 2174 - DNA, 22 bp, Homo sapiens
aaaaactaaaaattcctggcag

SEQ ID NO: 2175 - DNA, 19 bp, Homo sapiens
aaaactaaaacactctaaa

SEQ ID NO: 2176 - DNA, 19 bp, Homo sapiens
aaaaaccaaaactgagcag

SEQ ID NO: 2177 - DNA, 19 bp, Homo sapiens
aaaaacaaaaacccacaaa

SEQ ID NO: 2178 - DNA, 23 bp, Homo sapiens
aaagactgtggaatgtagaacaa

SEQ ID NO: 2179 - DNA, 16 bp, Homo sapiens
actaaaccagaacaaa

SEQ ID NO: 2180 - DNA, 22 bp, Homo sapiens
aaaagctaaaacctcagcacaa

SEQ ID NO: 2181 - DNA, 19 bp, Homo sapiens
aaaaacaaaagcccacaga

SEQ ID NO: 2182 - DNA, 23 bp, Homo sapiens
aaaatcaaaaccaaaaaaacaaa

SEQ ID NO: 2183 - DNA, 18 bp, Homo sapiens
gaaaaatatgtagaacaa

SEQ ID NO: 2184 - DNA, 26 bp, Homo sapiens
ggaaaccaaaactacctccgaacaaa

SEQ ID NO: 2185 - DNA, 23 bp, Homo sapiens
aaccaaaaccagaaaagaacaaa

SEQ ID NO: 2186 - DNA, 17 bp, Homo sapiens
aaaaccgaaactgcaga

SEQ ID NO: 2187 - DNA, 21 bp, Homo sapiens
aaaaactacgaccttctcaga

SEQ ID NO: 2188 - DNA, 17 bp, Homo sapiens
aaaactaaaccctgaga

SEQ ID NO: 2189 - DNA, 23 bp, Homo sapiens
aaaaacaaaacccagaaaacaaa

SEQ ID NO: 2190 - DNA, 17 bp, Homo sapiens
aaaacaaaacctgacaa

SEQ ID NO: 2191 - DNA, 21 bp, Homo sapiens
aaaaacaaaaccaaaaacaaa

SEQ ID NO: 2192 - DNA, 18 bp, Homo sapiens
aaaaaccaaaacaaaaca

SEQ ID NO: 2193 - DNA, 19 bp, Homo sapiens
aaaaactaactctagaaca

SEQ ID NO: 2194 - DNA, 21 bp, Homo sapiens
aaaaacaaaacacatagacaa

SEQ ID NO: 2195 - DNA, 22 bp, Homo sapiens
aaaaacttaaacaaagaacaaa

SEQ ID NO: 2196 - DNA, 23 bp, Homo sapiens
aaaaacaaaaccctcaaaacaaa

SEQ ID NO: 2197 - DNA, 18 bp, Homo sapiens
aaaagccaaaacccacag

SEQ ID NO: 2198 - DNA, 18 bp, Homo sapiens
aaaactgaaactctgtaa

SEQ ID NO: 2199 - DNA, 20 bp, Homo sapiens
aaaacctaaagccatgtaga

SEQ ID NO: 2200 - DNA, 21 bp, Homo sapiens
aaaaaataaaatgcagaacaa

SEQ ID NO: 2201 - DNA, 21 bp, Homo sapiens
aaaaactaaaactgccacaaa

SEQ ID NO: 2202 - DNA, 19 bp, Homo sapiens
aaaaactaaaactgtacaa

SEQ ID NO: 2203 - DNA, 19 bp, Homo sapiens
aaaaaccaaaacctactag

SEQ ID NO: 2204 - DNA, 19 bp, Homo sapiens
aaaaactaaaatatgcaaa

SEQ ID NO: 2205 - DNA, 22 bp, Homo sapiens
aaaaactaaacaatagagcaaa

SEQ ID NO: 2206 - DNA, 19 bp, Homo sapiens
aaaaacaaaaaccaaaaca

SEQ ID NO: 2207 - DNA, 20 bp, Homo sapiens
ctaaaaccaaactaaacaaa

SEQ ID NO: 2208 - DNA, 18 bp, Homo sapiens
accaaaaccacagaacaa

SEQ ID NO: 2209 - DNA, 20 bp, Homo sapiens
aaaaaccaaaacagagcaga

SEQ ID NO: 2210 - DNA, 24 bp, Homo sapiens
aaaaactaataacacgtaaacaaa

SEQ ID NO: 2211 - DNA, 19 bp, Homo sapiens
aactaaaacagaaaaacaa

SEQ ID NO: 2212 - DNA, 22 bp, Homo sapiens
tgaaactgagaacagtagaaca

SEQ ID NO: 2213 - DNA, 22 bp, Homo sapiens
aaaaacagaaacctatggagca

SEQ ID NO: 2214 - DNA, 20 bp, Homo sapiens
aaaccaaaaccaagacacaa

SEQ ID NO: 2215 - DNA, 18 bp, Homo sapiens
aaaactaaagctgaacaa

SEQ ID NO: 2216 - DNA, 18 bp, Homo sapiens
aaaaacaaaaccaacaga

SEQ ID NO: 2217 - DNA, 17 bp, Homo sapiens
aaaaacaaaactgcaga

SEQ ID NO: 2218 - DNA, 18 bp, Homo sapiens
aaaaactaaaaacgtaga

SEQ ID NO: 2219 - DNA, 21 bp, Homo sapiens
aaaaccaaaacccacaacaaa

SEQ ID NO: 2220 - DNA, 21 bp, Homo sapiens
aaagactaaaaccagacaaca

SEQ ID NO: 2221 - DNA, 21 bp, Homo sapiens
aaaactaagaacctactcaga

SEQ ID NO: 2222 - DNA, 18 bp, Homo sapiens
aaaactaaaaacctgaaa

SEQ ID NO: 2223 - DNA, 18 bp, Homo sapiens
aaaactaaaaccagcaaa

SEQ ID NO: 2224 - DNA, 17 bp, Homo sapiens
aaaaactaaaccgcaga

SEQ ID NO: 2225 - DNA, 20 bp, Homo sapiens
aaaaactaaaatcctaaaaa

SEQ ID NO: 2226 - DNA, 17 bp, Homo sapiens
aaaaactaaaactatag

SEQ ID NO: 2227 - DNA, 18 bp, Homo sapiens
aaagccaaaaccagcaga

SEQ ID NO: 2228 - DNA, 18 bp, Homo sapiens
aaaactaaagcaaaacaa

SEQ ID NO: 2229 - DNA, 17 bp, Homo sapiens
aaaagctaaacctgcaa

SEQ ID NO: 2230 - DNA, 20 bp, Homo sapiens
aaactaaaacttgtttccaa

SEQ ID NO: 2231 - DNA, 22 bp, Homo sapiens
caaaaccctgttgtagagcaaa

SEQ ID NO: 2232 - DNA, 17 bp, Homo sapiens
aaactgaaacctatgaa

SEQ ID NO: 2233 - DNA, 70 bp, Rat cytomegalovirus
atagaaaaagataagaggatcgattaagcaaaataaaactatggtgctcttggtcaatttcggtttctat

SEQ ID NO: 2234 - DNA, 24 bp, Rat cytomegalovirus
ctcttggtcaatttcggtttctat

SEQ ID NO: 2235 - DNA, 20 bp, Homo sapiens
ctcttggctcagcactttct

SEQ ID NO: 2236 - DNA, 18 bp, Homo sapiens
ctcttggtcaggtggttt

SEQ ID NO: 2237 - DNA, 18 bp, Homo sapiens
ctcttagtcaatttgctc

SEQ ID NO: 2238 - DNA, 23 bp, Homo sapiens
ctcttggttgaatgattttctat

SEQ ID NO: 2239 - DNA, 18 bp, Homo sapiens
tctaggtcaatttggatt

SEQ ID NO: 2240 - DNA, 18 bp, Homo sapiens
tcttggcaatccctgttt

SEQ ID NO: 2241 - DNA, 18 bp, Homo sapiens
tcttggttgttttcggct

SEQ ID NO: 2242 - DNA, 19 bp, Homo sapiens
ctcttggtcattaaagtct

SEQ ID NO: 2243 - DNA, 20 bp, Homo sapiens
tcttggcaaaatatttctat

SEQ ID NO: 2244 - DNA, 20 bp, Homo sapiens
ctcttggcaatttattattt

SEQ ID NO: 2245 - DNA, 18 bp, Homo sapiens
ccttggtcttggtttcta

SEQ ID NO: 2246 - DNA, 70 bp, Equine herpesvirus 2
ttgaaatcaatgtttaaagttttaaattgagttttctctcttaaaaacaagctaaataaattggttttaa

SEQ ID NO: 2247 - DNA, 24 bp, Equine herpesvirus 2
tttaaagttttaaattgagttttc

SEQ ID NO: 2248 - DNA, 20 bp, Homo sapiens
tttaaagttttaaagttttc

SEQ ID NO: 2249 - DNA, 21 bp, Homo sapiens
aagtgaaaaaattgagttttc

SEQ ID NO: 2250 - DNA, 60 bp, Rat cytomegalovirus
ccgtaatcgtggtgttcgtcgtcacttgttaactttaacgttcgagaatagcgagcatgg

SEQ ID NO: 2251 - DNA, 20 bp, Rat cytomegalovirus
ttcgagaatagcgagcatgg

SEQ ID NO: 2252 - DNA, 19 bp, Homo sapiens
ttcgaaaattcatacatgg

SEQ ID NO: 2253 - DNA, 21 bp, Homo sapiens
ttcaagaatatccctgcatgg

SEQ ID NO: 2254 - DNA, 24 bp, Homo sapiens
ttcgagaaggggaagagagtgtgg

SEQ ID NO: 2255 - DNA, 17 bp, Homo sapiens
tcgagaatggagaatgg

SEQ ID NO: 2256 - DNA, 19 bp, Homo sapiens
ttcaggaaatcaagcatgg

SEQ ID NO: 2257 - DNA, 18 bp, Homo sapiens
ttctagacacaagcatgg

SEQ ID NO: 2258 - DNA, 16 bp, Homo sapiens
cgagataagagcatgg

SEQ ID NO: 2259 - DNA, 23 bp, Homo sapiens
gagaacagaataaagagcgtggc

SEQ ID NO: 2260 - DNA, 17 bp, Homo sapiens
ttcgaaaatagatatgg

SEQ ID NO: 2261 - DNA, 19 bp, Homo sapiens
gagaataaaggcagcatgg

SEQ ID NO: 2262 - DNA, 19 bp, Homo sapiens
ttccagggaaagagcatgg

SEQ ID NO: 2263 - DNA, 17 bp, Homo sapiens
ttcagagagcagcgtgg

SEQ ID NO: 2264 - DNA, 17 bp, Homo sapiens
ttcgaaaatccgcgtgg

SEQ ID NO: 2265 - DNA, 18 bp, Homo sapiens
ttcaggaatagcaccagg

SEQ ID NO: 2266 - DNA, 17 bp, Homo sapiens
cgggaatagcgaggtgg

SEQ ID NO: 2267 - DNA, 18 bp, Homo sapiens
gagaatagcgaactgtgg

SEQ ID NO: 2268 - DNA, 19 bp, Homo sapiens
ttcaagaatgaagccgtgg

SEQ ID NO: 2269 - DNA, 19 bp, Homo sapiens
ttcaagaatgaagccatgg

SEQ ID NO: 2270 - DNA, 17 bp, Homo sapiens
ctctccagcgagcatgg

SEQ ID NO: 2271 - DNA, 75 bp, Amsacta moorei entomopoxvirus
tctgaaatatttatctaacaatggtccaattacaagtttaattttatcacacacaatagatgtaatatattcaga

SEQ ID NO: 2272 - DNA, 24 bp, Amsacta moorei entomopoxvirus
tgaaatatttatctaacaatggtc

SEQ ID NO: 2273 - DNA, 21 bp, Homo sapiens
tgaaatatattcttaatggtc

SEQ ID NO: 2274 - DNA, 22 bp, Homo sapiens
tgaaatatttatttataaggtc

SEQ ID NO: 2275 - DNA, 18 bp, Homo sapiens
tatttatctaaaccaatg

SEQ ID NO: 2276 - DNA, 18 bp, Homo sapiens
tgaaatatttaactaggc

SEQ ID NO: 2277 - DNA, 18 bp, Homo sapiens
tgaaatatttgccttggt

SEQ ID NO: 2278 - DNA, 18 bp, Homo sapiens
tgaaatatttctaatggt

SEQ ID NO: 2279 - DNA, 19 bp, Homo sapiens
tgaaatatttatctacaca

SEQ ID NO: 2280 - DNA, 17 bp, Homo sapiens
gaaatatttatctaggc

SEQ ID NO: 2281 - DNA, 23 bp, Homo sapiens
tgaagaatttatatccaatggtc

SEQ ID NO: 2282 - DNA, 19 bp, Homo sapiens
tccacctttggcaatggtc

SEQ ID NO: 2283 - DNA, 18 bp, Homo sapiens
atatttatcctcatggtc

SEQ ID NO: 2284 - DNA, 18 bp, Homo sapiens
tgaaatatttgtcttggt

SEQ ID NO: 2285 - DNA, 61 bp, Rat cytomegalovirus
gaggtcgtggagtacggttgatttctttttcttaaaagaagtaaactgattcgatttcctt

SEQ ID NO: 2286 - DNA, 24 bp, Rat cytomegalovirus
tcgtggagtacggttgatttcttt

SEQ ID NO: 2287 - DNA, 17 bp, Homo sapiens
tgggggtttgatttctt

SEQ ID NO: 2288 - DNA, 19 bp, Homo sapiens
gtggagttaagatttcttt

SEQ ID NO: 2289 - DNA, 22 bp, Homo sapiens
cgtgggcgttgttgatttcttt

SEQ ID NO: 2290 - DNA, 74 bp, Ateline herpesvirus 3
cagtgatcaagaaacaatatacatgataggtgacgaaaatattcatgactggtcatatgtagacgatgacactg

SEQ ID NO: 2291 - DNA, 19 bp, Ateline herpesvirus 3
tatgtagacgatgacactg

SEQ ID NO: 2292 - DNA, 17 bp, Homo sapiens
tatgttggatgacactg

SEQ ID NO: 2293 - DNA, 21 bp, Homo sapiens
tatgcagacacacagacactg

SEQ ID NO: 2294 - DNA, 18 bp, Homo sapiens
tatgtaaacaatgcactg

SEQ ID NO: 2295 - DNA, 19 bp, Homo sapiens
tgctgacaaggtgacactg

SEQ ID NO: 2296 - DNA, 18 bp, Homo sapiens
tatgtagaccaactcctg

SEQ ID NO: 2297 - DNA, 20 bp, Homo sapiens
tatgtgcacaataaccactg

SEQ ID NO: 2298 - DNA, 18 bp, Homo sapiens
tatgcagagaactcactg

SEQ ID NO: 2299 - DNA, 18 bp, Homo sapiens
tgtggacagatgacactg

SEQ ID NO: 2300 - DNA, 15 bp, Homo sapiens
atgtagactgaactg

SEQ ID NO: 2301 - DNA, 21 bp, Homo sapiens
tatataaatacaatgacactg

SEQ ID NO: 2302 - DNA, 18 bp, Homo sapiens
tatgtaggaacaacactg

SEQ ID NO: 2303 - DNA, 18 bp, Homo sapiens
tatgaaaggctgacactg

SEQ ID NO: 2304 - DNA, 18 bp, Homo sapiens
tgtaaacagtgttcactg

SEQ ID NO: 2305 - DNA, 21 bp, Homo sapiens
tgtagacagtatctgacactg

SEQ ID NO: 2306 - DNA, 19 bp, Homo sapiens
tgtagcacaggtgacactg

SEQ ID NO: 2307 - DNA, 20 bp, Homo sapiens
tatgtaaataataagcactg

SEQ ID NO: 2308 - DNA, 18 bp, Homo sapiens
tgtaaattgatgacactg

SEQ ID NO: 2309 - DNA, 19 bp, Homo sapiens
catgtagattctgccactg

SEQ ID NO: 2310 - DNA, 19 bp, Homo sapiens
tatgcagactataccactg

SEQ ID NO: 2311 - DNA, 72 bp, Ateline herpesvirus 3
aatattgatttatattatgcaacagtaacagaaccatttgaaaatactgtcctaagcacaatgtttaatgtt

SEQ ID NO: 2312 - DNA, 24 bp, Ateline herpesvirus 3
tattatgcaacagtaacagaacca

SEQ ID NO: 2313 - DNA, 17 bp, Homo sapiens
gcaacagtgcagaacca

SEQ ID NO: 2314 - DNA, 16 bp, Homo sapiens
ttatgcaataacagaa

SEQ ID NO: 2315 - DNA, 24 bp, Homo sapiens
cattatgcaataaattaagagcca

SEQ ID NO: 2316 - DNA, 25 bp, Homo sapiens
cattatgcaataaattaaagagcca

SEQ ID NO: 2317 - DNA, 23 bp, Homo sapiens
tattatacagaacaatggaacca

SEQ ID NO: 2318 - DNA, 19 bp, Homo sapiens
tattatgcagttgcaaaac

SEQ ID NO: 2319 - DNA, 23 bp, Homo sapiens
tattgggcaacagcaacgagcca

SEQ ID NO: 2320 - DNA, 21 bp, Homo sapiens
cattatgcggctgcagagcca

SEQ ID NO: 2321 - DNA, 20 bp, Homo sapiens
tattttgccctcaacagaac

SEQ ID NO: 2322 - DNA, 21 bp, Homo sapiens
tacagagtagtgacagaacca

SEQ ID NO: 2323 - DNA, 19 bp, Homo sapiens
tgcaacagatcaaaagaac

SEQ ID NO: 2324 - DNA, 21 bp, Homo sapiens
tattatgctttttcaacagaa

SEQ ID NO: 2325 - DNA, 27 bp, Homo sapiens
cattgtgcaataacaaagacagaatca

SEQ ID NO: 2326 - DNA, 16 bp, Homo sapiens
tattatgcaacataca

SEQ ID NO: 2327 - DNA, 19 bp, Homo sapiens
tattatgccacagtgaaca

SEQ ID NO: 2328 - DNA, 22 bp, Homo sapiens
tcatgcaccagtagtagcagaa

SEQ ID NO: 2329 - DNA, 16 bp, Homo sapiens
ttatgcaacagagaac

SEQ ID NO: 2330 - DNA, 22 bp, Homo sapiens
catgcaaacacagtaatggaac

SEQ ID NO: 2331 - DNA, 130 bp, Equine herpesvirus 2
accctccacccagcctcccattggtccagaatagggaagtccgccattcccgggatctcctgatggtctcgggactctcctcccggctccccattggccagagatgacgtgccaggcatggggcaatcgt

SEQ ID NO: 2332 - DNA, 24 bp, Equine herpesvirus 2
gtccagaatagggaagtccgccat

SEQ ID NO: 2333 - DNA, 19 bp, Homo sapiens
gtccagaacagggaaaacc

SEQ ID NO: 2334 - DNA, 23 bp, Homo sapiens
gtccaggaaaggggttgggccat

SEQ ID NO: 2335 - DNA, 21 bp, Homo sapiens
gtccagaaatggaatactgtc

SEQ ID NO: 2336 - DNA, 19 bp, Homo sapiens
gtccagaataaggaaccca

SEQ ID NO: 2337 - DNA, 19 bp, Homo sapiens
gtccaaatagggcaatgtc

SEQ ID NO: 2338 - DNA, 18 bp, Homo sapiens
gtccagggaaggctgcca

SEQ ID NO: 2339 - DNA, 16 bp, Homo sapiens
gtccagggaaagtccg

SEQ ID NO: 2340 - DNA, 16 bp, Homo sapiens
gtccagaaggagctgc

SEQ ID NO: 2341 - DNA, 20 bp, Homo sapiens
gtctagaataggcaaatcca

SEQ ID NO: 2342 - DNA, 63 bp, Equine herpesvirus 2
gcaatcctgatatatcgcaatagtgggccgggcccggtccaaataaggtcagtcgccccttgc

SEQ ID NO: 2343 - DNA, 24 bp, Equine herpesvirus 2
tatcgcaatagtgggccgggcccg

SEQ ID NO: 2344 - DNA, 21 bp, Homo sapiens
tcgcgccgcccgggccgggcc

SEQ ID NO: 2345 - DNA, 16 bp, Homo sapiens
tcgccgggccgggccc

SEQ ID NO: 2346 - DNA, 20 bp, Homo sapiens
tatccgtgcagaggccgggc

SEQ ID NO: 2347 - DNA, 75 bp, Equine herpesvirus 2
gggagatagtggacagcccccattgggccatgggctttattgcccaatgccctaatgcataggtatcagtcttcc

SEQ ID NO: 2348 - DNA, 24 bp, Equine herpesvirus 2
tagtggacagcccccattgggcca

SEQ ID NO: 2349 - DNA, 16 bp, Homo sapiens
tagggactcattgggc

SEQ ID NO: 2350 - DNA, 21 bp, Homo sapiens
atggacagtctcaccaggcca

SEQ ID NO: 2351 - DNA, 19 bp, Homo sapiens
tggattccctcattgggcc

SEQ ID NO: 2352 - DNA, 20 bp, Homo sapiens
atggagcccctgttgggcca

SEQ ID NO: 2353 - DNA, 22 bp, Homo sapiens
agtgggcagccccccacttcca

SEQ ID NO: 2354 - DNA, 19 bp, Homo sapiens
gtggacaggctccctgtcg

SEQ ID NO: 2355 - DNA, 20 bp, Homo sapiens
gtggacagtcccctgagcca

SEQ ID NO: 2356 - DNA, 20 bp, Homo sapiens
tagtggacgctcgactgggc

SEQ ID NO: 2357 - DNA, 20 bp, Homo sapiens
gtgggtggcttcccagacca

SEQ ID NO: 2358 - DNA, 21 bp, Homo sapiens
tggaggctccccattgggcca

SEQ ID NO: 2359 - DNA, 19 bp, Homo sapiens
agtggacagttctccctcg

SEQ ID NO: 2360 - DNA, 17 bp, Homo sapiens
tggcagcgcctgggcca

SEQ ID NO: 2361 - DNA, 19 bp, Homo sapiens
gtggacaagccctgggggc

SEQ ID NO: 2362 - DNA, 22 bp, Homo sapiens
gtggacagtcaatgctgggcca

SEQ ID NO: 2363 - DNA, 22 bp, Homo sapiens
gtggacagtcccctcccttcca

SEQ ID NO: 2364 - DNA, 15 bp, Homo sapiens
tagtggacgccccgc

SEQ ID NO: 2365 - DNA, 19 bp, Homo sapiens
atgggtagcccccacttcc

SEQ ID NO: 2366 - DNA, 21 bp, Homo sapiens
atggacagagtgattgggtca

SEQ ID NO: 2367 - DNA, 24 bp, Homo sapiens
agtggatggccctatctcaggcca

SEQ ID NO: 2368 - DNA, 22 bp, Homo sapiens
tagtggagcagctgctgggcca

SEQ ID NO: 2369 - DNA, 22 bp, Homo sapiens
tagagggatccccattgggtca

SEQ ID NO: 2370 - DNA, 18 bp, Homo sapiens
tagtgggcatcctcactg

SEQ ID NO: 2371 - DNA, 20 bp, Homo sapiens
cagtggacagtttcccactg

SEQ ID NO: 2372 - DNA, 16 bp, Homo sapiens
tagtgggcagccccac

SEQ ID NO: 2373 - DNA, 19 bp, Homo sapiens
cagtggacagctcccacca

SEQ ID NO: 2374 - DNA, 21 bp, Homo sapiens
ggacagcctaggaatgggcca

SEQ ID NO: 2375 - DNA, 18 bp, Homo sapiens
gtgggcagcccccaggcc

SEQ ID NO: 2376 - DNA, 19 bp, Homo sapiens
tagttggatatattgggcc

SEQ ID NO: 2377 - DNA, 86 bp, Rat cytomegalovirus
aacgggaatgatcgattgacactatgtaaagagttcttataaattcaaagcagctcgaaaaggtgacagttgaataatctctcgtt

SEQ ID NO: 2378 - DNA, 24 bp, Rat cytomegalovirus
gaaaaggtgacagttgaataatct

SEQ ID NO: 2379 - DNA, 19 bp, Homo sapiens
aaaggtgactaaataatct

SEQ ID NO: 2380 - DNA, 19 bp, Homo sapiens
gagaggtgttgaataatct

SEQ ID NO: 2381 - DNA, 21 bp, Homo sapiens
gaaaaagtggagtgataatct

SEQ ID NO: 2382 - DNA, 21 bp, Homo sapiens
gaaagggtgaggttgaacaac

SEQ ID NO: 2383 - DNA, 19 bp, Homo sapiens
aggggaaatagaataatct

SEQ ID NO: 2384 - DNA, 17 bp, Homo sapiens
aaggatttgaataatct

SEQ ID NO: 2385 - DNA, 75 bp, Rat cytomegalovirus
gatggtaacgatagtgggtattttcgtcgttctcggggtcgtagagtgttgatatcatccttatcgttaatcatc

SEQ ID NO: 2386 - DNA, 24 bp, Rat cytomegalovirus
tagagtgttgatatcatccttatc

SEQ ID NO: 2387 - DNA, 21 bp, Homo sapiens
tagagcaatatcatttttatc

SEQ ID NO: 2388 - DNA, 22 bp, Homo sapiens
aagtgcttttatcatccttatc

SEQ ID NO: 2389 - DNA, 15 bp, Homo sapiens
cagaatgtcgtcctt

SEQ ID NO: 2390 - DNA, 20 bp, Homo sapiens
gagactgtatcatccttatc

SEQ ID NO: 2391 - DNA, 130 bp, Equine herpesvirus 2
agcaaccggggtctttattggccgagggtgcagtgggtagcccccattgggccgccgggatagttacccaatggctcatacatagtcatcatggtcccccatagtctgcctggcaacttaagatcccatt

SEQ ID NO: 2392 - DNA, 24 bp, Equine herpesvirus 2
agtgggtagcccccattgggccgc

SEQ ID NO: 2393 - DNA, 22 bp, Homo sapiens
gtgggggcttcctccgagccgc

SEQ ID NO: 2394 - DNA, 21 bp, Homo sapiens
agtggtagccctcataattgc

SEQ ID NO: 2395 - DNA, 18 bp, Homo sapiens
agtggggagcccccatcg

SEQ ID NO: 2396 - DNA, 21 bp, Homo sapiens
agtgggtagatggtgggttgc

SEQ ID NO: 2397 - DNA, 17 bp, Homo sapiens
agtgggtaccccctttg

SEQ ID NO: 2398 - DNA, 22 bp, Homo sapiens
agcgggtagcctccgagcccgc

SEQ ID NO: 2399 - DNA, 21 bp, Homo sapiens
cgcacagctcccgttgggccg

SEQ ID NO: 2400 - DNA, 18 bp, Homo sapiens
gtgggtagctgcccagtg

SEQ ID NO: 2401 - DNA, 18 bp, Homo sapiens
gtgggcagcccctgggcc

SEQ ID NO: 2402 - DNA, 17 bp, Homo sapiens
gtgggcagtccccagcg

SEQ ID NO: 2403 - DNA, 21 bp, Homo sapiens
gtgggagctcccatcggctgc

SEQ ID NO: 2404 - DNA, 22 bp, Homo sapiens
agtgggcagcctctgtcctagg

SEQ ID NO: 2405 - DNA, 18 bp, Homo sapiens
gtgggagcccccagggtg

SEQ ID NO: 2406 - DNA, 23 bp, Homo sapiens
agtgggtagctcctctccatagc

SEQ ID NO: 2407 - DNA, 22 bp, Homo sapiens
gtgggcagccctgaggggttgc

SEQ ID NO: 2408 - DNA, 20 bp, Homo sapiens
agtgggtaactcctttctgc

SEQ ID NO: 2409 - DNA, 20 bp, Homo sapiens
agtgggtagctcctttctgc

SEQ ID NO: 2410 - DNA, 21 bp, Homo sapiens
gtgggtattcctggggctccg

SEQ ID NO: 2411 - DNA, 18 bp, Homo sapiens
agtgggtagtcctggacc

SEQ ID NO: 2412 - DNA, 61 bp, Equine herpesvirus 2
aaccctgccccctgactccccattggctaaatgggtcagtgggaggtacccattaagggtt

SEQ ID NO: 2413 - DNA, 24 bp, Equine herpesvirus 2
tcagtgggaggtacccattaaggg

SEQ ID NO: 2414 - DNA, 22 bp, Homo sapiens
tcagtggttgcaccattaaggg

SEQ ID NO: 2415 - DNA, 20 bp, Homo sapiens
aggggaaacaccattagggg

SEQ ID NO: 2416 - DNA, 23 bp, Homo sapiens
tcagtggggtgtgcctgtcaggg

SEQ ID NO: 2417 - DNA, 19 bp, Homo sapiens
tcggtgggaggtggccatc

SEQ ID NO: 2418 - DNA, 26 bp, Homo sapiens
tcagtgggaggggaagggcccttaag

SEQ ID NO: 2419 - DNA, 21 bp, Homo sapiens
tcagtggggggggcagaaggg

SEQ ID NO: 2420 - DNA, 22 bp, Homo sapiens
tcagtggggagtgggggaaggg

SEQ ID NO: 2421 - DNA, 22 bp, Homo sapiens
tcagtgacctgcccattaaggg

SEQ ID NO: 2422 - DNA, 19 bp, Homo sapiens
gtggggggtgacatttggg

SEQ ID NO: 2423 - DNA, 27 bp, Homo sapiens
tcagtgggggcgtgtccatctgtaggg

SEQ ID NO: 2424 - DNA, 22 bp, Homo sapiens
tcagtgggggcgtgtccacagg

SEQ ID NO: 2425 - DNA, 16 bp, Homo sapiens
aggggaggcattgagg

SEQ ID NO: 2426 - DNA, 19 bp, Homo sapiens
tcagtgagaggtgcccatc

SEQ ID NO: 2427 - DNA, 102 bp, Cryphonectria hypovirus
cgatcaagtattctcagcctgtgatgtctcaccaagccgccgcaatctgtggcttcaaggagggtgagtacatcgtggatgacgagtaccagaagaggatcg

SEQ ID NO: 2428 - DNA, 24 bp, Cryphonectria hypovirus
tgagtacatcgtggatgacgagta

SEQ ID NO: 2429 - DNA, 21 bp, Homo sapiens
tgagtacatttgggcacagta

SEQ ID NO: 2430 - DNA, 19 bp, Homo sapiens
tgagcacactcccatggcg

SEQ ID NO: 2431 - DNA, 19 bp, Homo sapiens
tgagtcgtttcagacgagt

SEQ ID NO: 2432 - DNA, 65 bp, Macaca mulatta rhadinovirus
aagtacatcctaattttaactctaaaaggggttccttgtaaaattatttaagttatggtgtactt

SEQ ID NO: 2433 - DNA, 24 bp, Macaca mulatta rhadinovirus
catcctaattttaactctaaaagg

SEQ ID NO: 2434 - DNA, 21 bp, Homo sapiens
tcctaattttaaaactaaagg

SEQ ID NO: 2435 - DNA, 23 bp, Homo sapiens
cctaactcagaggctctaagagg

SEQ ID NO: 2436 - DNA, 19 bp, Homo sapiens
atcctttgactctaaaagg

SEQ ID NO: 2437 - DNA, 19 bp, Homo sapiens
tccagctaactctgaaagg

SEQ ID NO: 2438 - DNA, 23 bp, Homo sapiens
catctcattccaactctaaaagg

SEQ ID NO: 2439 - DNA, 18 bp, Homo sapiens
tcctatcactctaaaggg

SEQ ID NO: 2440 - DNA, 19 bp, Homo sapiens
ctaatcttaaccataaagg

SEQ ID NO: 2441 - DNA, 19 bp, Homo sapiens
tcctaattaccctggaagg

SEQ ID NO: 2442 - DNA, 21 bp, Homo sapiens
tccttcaggaactctaaaggg

SEQ ID NO: 2443 - DNA, 22 bp, Homo sapiens
tcctaatttgtacaaaaaaagg

SEQ ID NO: 2444 - DNA, 20 bp, Homo sapiens
atcctcacaactctaggagg

SEQ ID NO: 2445 - DNA, 64 bp, Cryphonectria hypovirus
gctaaagtgaaagtcctggaggatagcttcaaacctcttgattccggccggaagtcactagagc

SEQ ID NO: 2446 - DNA, 17 bp, Cryphonectria hypovirus
ccggaagtcactagagc

SEQ ID NO: 2447 - DNA, 19 bp, Homo sapiens
ccgaaagtctccccggagc

SEQ ID NO: 2448 - DNA, 19 bp, Homo sapiens
ccgaaagtgcagttagagc

SEQ ID NO: 2449 - DNA, 18 bp, Homo sapiens
cctgaagtcacccagggc

SEQ ID NO: 2450 - DNA, 19 bp, Homo sapiens
ccagaagttcaccgggagc

SEQ ID NO: 2451 - DNA, 18 bp, Homo sapiens
cagaagcccatactagag

SEQ ID NO: 2452 - DNA, 21 bp, Homo sapiens
ccgaaagtcacattgctagag

SEQ ID NO: 2453 - DNA, 18 bp, Homo sapiens
ccaggagtccctgagagc

SEQ ID NO: 2454 - DNA, 19 bp, Homo sapiens
ccgaaagtgcaaagagagc

SEQ ID NO: 2455 - DNA, 22 bp, Homo sapiens
cggaagtcctgaagctagagcg

SEQ ID NO: 2456 - DNA, 18 bp, Homo sapiens
cggaaagtcagctggagc

SEQ ID NO: 2457 - DNA, 19 bp, Homo sapiens
ccagaagtcaccttggagc

SEQ ID NO: 2458 - DNA, 19 bp, Homo sapiens
ccagacggccggctagagc

SEQ ID NO: 2459 - DNA, 65 bp, Alcelaphine herpesvirus 1
cccggggacggggccacctagccagccagcccggggacggggccacctagccagccagcccgggg

SEQ ID NO: 2460 - DNA, 24 bp, Alcelaphine herpesvirus 1
gccacctagccagccagcccgggg

SEQ ID NO: 2461 - DNA, 21 bp, Homo sapiens
cacccagggcagggcctgggg

SEQ ID NO: 2462 - DNA, 23 bp, Homo sapiens
gcacacactgggtcagcccgggg

SEQ ID NO: 2463 - DNA, 22 bp, Homo sapiens
gccacctacgccagctgcatgg

SEQ ID NO: 2464 - DNA, 20 bp, Homo sapiens
gccaaccccccagctcgggg

SEQ ID NO: 2465 - DNA, 22 bp, Homo sapiens
gccgctcggcacctgcccgggg

SEQ ID NO: 2466 - DNA, 19 bp, Homo sapiens
gccgcctgggccgcccggg

SEQ ID NO: 2467 - DNA, 20 bp, Homo sapiens
gccgcttgccagccagcccg

SEQ ID NO: 2468 - DNA, 21 bp, Homo sapiens
cagacagcggccggcccgggg

SEQ ID NO: 2469 - DNA, 22 bp, Homo sapiens
gccacccagttccctcccgggg

SEQ ID NO: 2470 - DNA, 19 bp, Homo sapiens
cccgccgcgccggcccggg

SEQ ID NO: 2471 - DNA, 19 bp, Homo sapiens
gccgccggcctcgcccggg

SEQ ID NO: 2472 - DNA, 20 bp, Homo sapiens
ccaccgccgccggcccgggg

SEQ ID NO: 2473 - DNA, 26 bp, Homo sapiens
accgcctggccagccacagctcgggg

SEQ ID NO: 2474 - DNA, 19 bp, Homo sapiens
gcacagggccagcccgggg

SEQ ID NO: 2475 - DNA, 19 bp, Homo sapiens
gccggctggccggcccggg

SEQ ID NO: 2476 - DNA, 18 bp, Homo sapiens
gccaccacacagcccggg

SEQ ID NO: 2477 - DNA, 18 bp, Homo sapiens
cctggccagccactggag

SEQ ID NO: 2478 - DNA, 20 bp, Homo sapiens
ccacctgcgccggcccgggg

SEQ ID NO: 2479 - DNA, 18 bp, Homo sapiens
gcttcctagcagcccggg

SEQ ID NO: 2480 - DNA, 22 bp, Homo sapiens
gccgcctgtccggagcccgggg

SEQ ID NO: 2481 - DNA, 21 bp, Homo sapiens
gccagcccagtcagcttgggg

SEQ ID NO: 2482 - DNA, 23 bp, Homo sapiens
gcctctggccgccgaacccgggg

SEQ ID NO: 2483 - DNA, 20 bp, Homo sapiens
acctgtgccctggcccgggg

SEQ ID NO: 2484 - DNA, 15 bp, Homo sapiens
gccacctgcccgggg

SEQ ID NO: 2485 - DNA, 22 bp, Homo sapiens
gccacttgtttagccagcctgg

SEQ ID NO: 2486 - DNA, 21 bp, Homo sapiens
gccacccagccagccatgggg

SEQ ID NO: 2487 - DNA, 19 bp, Homo sapiens
gccacctatcagctaagag

SEQ ID NO: 2488 - DNA, 18 bp, Homo sapiens
catctggccagccatgag

SEQ ID NO: 2489 - DNA, 19 bp, Homo sapiens
gccatcttgccggccagcc

SEQ ID NO: 2490 - DNA, 24 bp, Homo sapiens
gccatttcaaaagctagcccgggg

SEQ ID NO: 2491 - DNA, 22 bp, Homo sapiens
cctgccctccgctggcccgggg

SEQ ID NO: 2492 - DNA, 19 bp, Homo sapiens
ccatctggctggcccaggg

SEQ ID NO: 2493 - DNA, 21 bp, Homo sapiens
gccatctggccagcacaaggg

SEQ ID NO: 2494 - DNA, 17 bp, Homo sapiens
gccgcctgccagcccgg

SEQ ID NO: 2495 - DNA, 18 bp, Homo sapiens
gccgcttgcccgcccggg

SEQ ID NO: 2496 - DNA, 21 bp, Homo sapiens
gcccctgcagccggcccgggg

SEQ ID NO: 2497 - DNA, 22 bp, Homo sapiens
cctgccaagtgctggcccgggg

SEQ ID NO: 2498 - DNA, 23 bp, Homo sapiens
gccacctaacccagatcctgggg

SEQ ID NO: 2499 - DNA, 21 bp, Homo sapiens
gccgctcacgccagcccgggg

SEQ ID NO: 2500 - DNA, 19 bp, Homo sapiens
gccatcttgccagcccggg

SEQ ID NO: 2501 - DNA, 18 bp, Homo sapiens
gccacctagtggccagcc

SEQ ID NO: 2502 - DNA, 18 bp, Homo sapiens
gccacccagccggctggg

SEQ ID NO: 2503 - DNA, 22 bp, Homo sapiens
gccttctggcaggagcccgggg

SEQ ID NO: 2504 - DNA, 22 bp, Homo sapiens
ccaccggccggccggcccgggg

SEQ ID NO: 2505 - DNA, 21 bp, Homo sapiens
cccatccctgctggcccgggg

SEQ ID NO: 2506 - DNA, 17 bp, Homo sapiens
ctagccagcctccaggg

SEQ ID NO: 2507 - DNA, 23 bp, Homo sapiens
ccacctggcgcccaggcccgggg

SEQ ID NO: 2508 - DNA, 22 bp, Homo sapiens
gccactgcactccagcccgggg

SEQ ID NO: 2509 - DNA, 16 bp, Homo sapiens
cctgcagccagcccgg

SEQ ID NO: 2510 - DNA, 21 bp, Homo sapiens
cagccagcagctggcttgggg

SEQ ID NO: 2511 - DNA, 19 bp, Homo sapiens
cccgcgagccagcccgggg

SEQ ID NO: 2512 - DNA, 24 bp, Homo sapiens
gctcacacctgagccagcctgggg

SEQ ID NO: 2513 - DNA, 19 bp, Homo sapiens
gccatctgccagccagaag

SEQ ID NO: 2514 - DNA, 23 bp, Homo sapiens
gcaggaggctggccggcccgggg

SEQ ID NO: 2515 - DNA, 19 bp, Homo sapiens
gccgcctgccagccccggg

SEQ ID NO: 2516 - DNA, 19 bp, Homo sapiens
caccttggccagccccggg

SEQ ID NO: 2517 - DNA, 24 bp, Homo sapiens
gccgcctctagtgccagcccgggg

SEQ ID NO: 2518 - DNA, 23 bp, Homo sapiens
gctggctggctggctggcccggg

SEQ ID NO: 2519 - DNA, 21 bp, Homo sapiens
gccgctttgccagccagccag

SEQ ID NO: 2520 - DNA, 23 bp, Homo sapiens
ccggggcctcagctggcccgggg

SEQ ID NO: 2521 - DNA, 68 bp, Human herpesvirus 6B
gcgctgtggatttgtcttctacgctagattttttttaagcagtggattgtcacaatctaaagaagcgc

SEQ ID NO: 2522 - DNA, 24 bp, Human herpesvirus 6B
tgtggatttgtcttctacgctaga

SEQ ID NO: 2523 - DNA, 19 bp, Homo sapiens
tgaggatctgctttgtgct

SEQ ID NO: 2524 - DNA, 18 bp, Homo sapiens
tgtggattttctttcaca

SEQ ID NO: 2525 - DNA, 24 bp, Homo sapiens
tgtggatttgtcttaccatctgga

SEQ ID NO: 2526 - DNA, 29 bp, Homo sapiens
tgtggatttgtctattagatctagcgtag

SEQ ID NO: 2527 - DNA, 16 bp, Homo sapiens
tgtggattttctggct

SEQ ID NO: 2528 - DNA, 21 bp, Homo sapiens
tgtggatgtgtcttctccaga

SEQ ID NO: 2529 - DNA, 69 bp, Alcelaphine herpesvirus 1
cacagttttgctttgaagtgcccaatagaagcatttccattcacacttctagcatcttatttgactgtg

SEQ ID NO: 2530 - DNA, 24 bp, Alcelaphine herpesvirus 1
tgaagtgcccaatagaagcatttc

SEQ ID NO: 2531 - DNA, 21 bp, Homo sapiens
tgaggtgccaacaaagcattt

SEQ ID NO: 2532 - DNA, 22 bp, Homo sapiens
tgaggtgccaacaaaggcattt

SEQ ID NO: 2533 - DNA, 20 bp, Homo sapiens
tgaagtgccataatagaggc

SEQ ID NO: 2534 - DNA, 24 bp, Homo sapiens
tgaaggtagtccaagaagcatttc

SEQ ID NO: 2535 - DNA, 24 bp, Homo sapiens
tggagtgcctaccgaaagcatttc

SEQ ID NO: 2536 - DNA, 24 bp, Homo sapiens
tgaagtgccaaaagactggcattt

SEQ ID NO: 2537 - DNA, 19 bp, Homo sapiens
tgaagttttaaaaacattt

SEQ ID NO: 2538 - DNA, 20 bp, Homo sapiens
tgaggtgcttttaagcattt

SEQ ID NO: 2539 - DNA, 20 bp, Homo sapiens
tgaaatgccaaaaggcattt

SEQ ID NO: 2540 - DNA, 18 bp, Homo sapiens
tgagctgcccaagcattt

SEQ ID NO: 2541 - DNA, 20 bp, Homo sapiens
aagtgcccggtggaggcatc

SEQ ID NO: 2542 - DNA, 16 bp, Homo sapiens
gttcccaaaagcattt

SEQ ID NO: 2543 - DNA, 21 bp, Homo sapiens
tgaagtgcccattttcatttc

SEQ ID NO: 2544 - DNA, 16 bp, Homo sapiens
tgaagtgctgaacatt

SEQ ID NO: 2545 - DNA, 25 bp, Homo sapiens
tgaagtgccagtgccttatcatttc

SEQ ID NO: 2546 - DNA, 26 bp, Homo sapiens
tgaaatgcttgggacaaaagtatttc

SEQ ID NO: 2547 - DNA, 60 bp, Alcelaphine herpesvirus 1
cagcccccacctacataaattaaacccactgaaagcaaaatttgtcagtaggtggagctg

SEQ ID NO: 2548 - DNA, 20 bp, Alcelaphine herpesvirus 1
tttgtcagtaggtggagctg

SEQ ID NO: 2549 - DNA, 17 bp, Homo sapiens
tttgtcaagatgggctg

SEQ ID NO: 2550 - DNA, 19 bp, Homo sapiens
tgtggagggggtggagctg

SEQ ID NO: 2551 - DNA, 18 bp, Homo sapiens
tttggcagtaaatagctg

SEQ ID NO: 2552 - DNA, 21 bp, Homo sapiens
tttgtcagtaagtgtttgctg

SEQ ID NO: 2553 - DNA, 15 bp, Homo sapiens
tttgtcagatggact

SEQ ID NO: 2554 - DNA, 20 bp, Homo sapiens
tttgtcagactcaaaagctg

SEQ ID NO: 2555 - DNA, 18 bp, Homo sapiens
tttgtcactttaaagctg

SEQ ID NO: 2556 - DNA, 18 bp, Homo sapiens
tgtcagtaagaatagctg

SEQ ID NO: 2557 - DNA, 17 bp, Homo sapiens
tttctcagtagggggct

SEQ ID NO: 2558 - DNA, 19 bp, Homo sapiens
tctgcatctggtggagctg

SEQ ID NO: 2559 - DNA, 20 bp, Homo sapiens
tttgtcggagctgaaggctg

SEQ ID NO: 2560 - DNA, 21 bp, Homo sapiens
tttgtcaagtaatacatgctg

SEQ ID NO: 2561 - DNA, 20 bp, Homo sapiens
tctgtctccacgtggagctg

SEQ ID NO: 2562 - DNA, 19 bp, Homo sapiens
tttgtcagttgcttggctg

SEQ ID NO: 2563 - DNA, 17 bp, Homo sapiens
tttgtcagtagctcaac

SEQ ID NO: 2564 - DNA, 21 bp, Homo sapiens
tttgtcagctctaccaagctg

SEQ ID NO: 2565 - DNA, 18 bp, Homo sapiens
cttgggagggtggagctg

SEQ ID NO: 2566 - DNA, 19 bp, Homo sapiens
tttgtcaggagggatactg

SEQ ID NO: 2567 - DNA, 17 bp, Homo sapiens
tttgccaagtggagctg

SEQ ID NO: 2568 - DNA, 20 bp, Homo sapiens
cttgtcaggctacagagctg

SEQ ID NO: 2569 - DNA, 20 bp, Homo sapiens
ttcgtcagtgatcagggctg

SEQ ID NO: 2570 - DNA, 21 bp, Homo sapiens
tttgtcagcgtctctaggctg

SEQ ID NO: 2571 - DNA, 19 bp, Homo sapiens
tttgtgagtagacaggctg

SEQ ID NO: 2572 - DNA, 19 bp, Homo sapiens
tttgtagcctctggagctg

SEQ ID NO: 2573 - DNA, 20 bp, Homo sapiens
tttgatcaaacctggagctg

SEQ ID NO: 2574 - DNA, 16 bp, Homo sapiens
tttgtcaggagagctg

SEQ ID NO: 2575 - DNA, 19 bp, Homo sapiens
tctgtcagtatgggggctg

SEQ ID NO: 2576 - DNA, 19 bp, Homo sapiens
cttggcaacggtggagctg

SEQ ID NO: 2577 - DNA, 21 bp, Homo sapiens
tttgtcagtgagtaacttctg

SEQ ID NO: 2578 - DNA, 19 bp, Homo sapiens
tttgtagtagctatagctg

SEQ ID NO: 2579 - DNA, 19 bp, Homo sapiens
tctgtcagtggcccatctg

SEQ ID NO: 2580 - DNA, 19 bp, Homo sapiens
ttgtcgcctcccggagctg

SEQ ID NO: 2581 - DNA, 22 bp, Homo sapiens
tttgtcagctgtcagtaggctg

SEQ ID NO: 2582 - DNA, 19 bp, Homo sapiens
tgttgatggggtggagctg

SEQ ID NO: 2583 - DNA, 18 bp, Homo sapiens
tttgccaatcaggagctg

SEQ ID NO: 2584 - DNA, 18 bp, Homo sapiens
tctgtcagtaatctgctg

SEQ ID NO: 2585 - DNA, 18 bp, Homo sapiens
tttatcagttcagggctg

SEQ ID NO: 2586 - DNA, 18 bp, Homo sapiens
tttgccagcctggggctg

SEQ ID NO: 2587 - DNA, 18 bp, Homo sapiens
tttgtcagagtttggctg

SEQ ID NO: 2588 - DNA, 19 bp, Homo sapiens
tttgtcagtgtgacagctg

SEQ ID NO: 2589 - DNA, 17 bp, Homo sapiens
tttggcaggtggggctg

SEQ ID NO: 2590 - DNA, 17 bp, Homo sapiens
tttacaaggtggagctg

SEQ ID NO: 2591 - DNA, 18 bp, Homo sapiens
tttgtcaggatggagctg

SEQ ID NO: 2592 - DNA, 18 bp, Homo sapiens
tttgtcagttgatttctg

SEQ ID NO: 2593 - DNA, 19 bp, Homo sapiens
cttgttgctattggagctg

SEQ ID NO: 2594 - DNA, 18 bp, Homo sapiens
tttatcaacctggggctg

SEQ ID NO: 2595 - DNA, 20 bp, Homo sapiens
tttgttgtaaacagcagctg

SEQ ID NO: 2596 - DNA, 20 bp, Homo sapiens
tttgacaagcactggggctg

SEQ ID NO: 2597 - DNA, 17 bp, Homo sapiens
tgtggcaggtggggctg

SEQ ID NO: 2598 - DNA, 20 bp, Homo sapiens
tctgtcagtggccagggctg

SEQ ID NO: 2599 - DNA, 19 bp, Homo sapiens
tttgtggatctcagagctg

SEQ ID NO: 2600 - DNA, 19 bp, Homo sapiens
tctggtaaaggtggagctg

SEQ ID NO: 2601 - DNA, 23 bp, Homo sapiens
tttgtcagacctttgtggagctg

SEQ ID NO: 2602 - DNA, 18 bp, Homo sapiens
tttgttaggtggagactg

SEQ ID NO: 2603 - DNA, 15 bp, Homo sapiens
tttgtcaggggagct

SEQ ID NO: 2604 - DNA, 22 bp, Homo sapiens
tttgtcagtaaggaaaatgctg

SEQ ID NO: 2605 - DNA, 21 bp, Homo sapiens
ttcgtcagtgtgcctcagctg

SEQ ID NO: 2606 - DNA, 15 bp, Homo sapiens
tttgcagtaggagct

SEQ ID NO: 2607 - DNA, 20 bp, Homo sapiens
tttgttagagccggcagctg

SEQ ID NO: 2608 - DNA, 17 bp, Homo sapiens
tttgataggtagggctg

SEQ ID NO: 2609 - DNA, 19 bp, Homo sapiens
tttgtcaatgtttaagctg

SEQ ID NO: 2610 - DNA, 64 bp, Cryphonectria hypovirus
gcatctgggatgaactacacgacttacgtctccgcgaaggaggccagttcatcatagcagatgc

SEQ ID NO: 2611 - DNA, 17 bp, Cryphonectria hypovirus
ttcatcatagcagatgc

SEQ ID NO: 2612 - DNA, 18 bp, Homo sapiens
ttcatcacaaaacaatgc

SEQ ID NO: 2613 - DNA, 18 bp, Homo sapiens
tccatcatggctagatgc

SEQ ID NO: 2614 - DNA, 18 bp, Homo sapiens
ttcatcacactcaggatg

SEQ ID NO: 2615 - DNA, 20 bp, Homo sapiens
tccatcactttgggcagatg

SEQ ID NO: 2616 - DNA, 22 bp, Homo sapiens
ttcatcatagggatcttagatg

SEQ ID NO: 2617 - DNA, 18 bp, Homo sapiens
ttcaccataaactgatgc

SEQ ID NO: 2618 - DNA, 18 bp, Homo sapiens
ttcatcatccgcaagtgc

SEQ ID NO: 2619 - DNA, 18 bp, Homo sapiens
ttcaccatcagtcaatgc

SEQ ID NO: 2620 - DNA, 19 bp, Homo sapiens
ttcaccactgctttagatg

SEQ ID NO: 2621 - DNA, 21 bp, Homo sapiens
ctcatcatagactgcagatgc

SEQ ID NO: 2622 - DNA, 18 bp, Homo sapiens
ctcatcataacttaatgc

SEQ ID NO: 2623 - DNA, 18 bp, Homo sapiens
tcatcatacagcaggatg

SEQ ID NO: 2624 - DNA, 19 bp, Homo sapiens
ttcaccacattccagatgc

SEQ ID NO: 2625 - DNA, 19 bp, Homo sapiens
ttcagcatagcagcagtgc

SEQ ID NO: 2626 - DNA, 19 bp, Homo sapiens
ctcgtcatagcagcagtgc

SEQ ID NO: 2627 - DNA, 18 bp, Homo sapiens
ttcatcaccagctgatgc

SEQ ID NO: 2628 - DNA, 18 bp, Homo sapiens
ttcaccatacactcatgc

SEQ ID NO: 2629 - DNA, 21 bp, Homo sapiens
tccatcattaatactagatgc

SEQ ID NO: 2630 - DNA, 23 bp, Homo sapiens
ctcatcattagctggcaggtgcg

SEQ ID NO: 2631 - DNA, 20 bp, Homo sapiens
tcatcacagactgtaggtgc

SEQ ID NO: 2632 - DNA, 79 bp, Macaca mulatta rhadinovirus
aggcgcgtattttacatgtggtacagggtagaaaaccttgtaggtttcagttgagtcaccctgccacgtaaacccgcct

SEQ ID NO: 2633 - DNA, 23 bp, Macaca mulatta rhadinovirus
caccctgccacgtaaacccgcct

SEQ ID NO: 2634 - DNA, 20 bp, Homo sapiens
tgcctgttatagacccgcct

SEQ ID NO: 2635 - DNA, 23 bp, Homo sapiens
caccccgccttcgcggcccgtct

SEQ ID NO: 2636 - DNA, 20 bp, Homo sapiens
cacgctgccacgtgacgccc

SEQ ID NO: 2637 - DNA, 18 bp, Homo sapiens
caccctgccccgtgcccc

SEQ ID NO: 2638 - DNA, 24 bp, Homo sapiens
actctgccatgtacacatttgcct

SEQ ID NO: 2639 - DNA, 20 bp, Homo sapiens
caccactgtcgcggtcgcct

SEQ ID NO: 2640 - DNA, 17 bp, Homo sapiens
ctgccgcggacccgcct

SEQ ID NO: 2641 - DNA, 18 bp, Homo sapiens
ccgccacagccaccgcct

SEQ ID NO: 2642 - DNA, 21 bp, Homo sapiens
ccctcgctcccggacccgcct

SEQ ID NO: 2643 - DNA, 19 bp, Homo sapiens
ccctgccacatcctcctgc

SEQ ID NO: 2644 - DNA, 18 bp, Homo sapiens
caccctgtcagcccctgc

SEQ ID NO: 2645 - DNA, 17 bp, Homo sapiens
caccctgctgtcctgcc

SEQ ID NO: 2646 - DNA, 20 bp, Homo sapiens
ctgccacgtcccttctgcct

SEQ ID NO: 2647 - DNA, 18 bp, Homo sapiens
cctgccacgtggccacct

SEQ ID NO: 2648 - DNA, 16 bp, Homo sapiens
caccactgcccaaacc

SEQ ID NO: 2649 - DNA, 22 bp, Homo sapiens
accctgcctgtagtgtggctcc

SEQ ID NO: 2650 - DNA, 21 bp, Homo sapiens
ccctgccagtcttctccgtct

SEQ ID NO: 2651 - DNA, 20 bp, Homo sapiens
caccctgcactctgtcgcct

SEQ ID NO: 2652 - DNA, 16 bp, Homo sapiens
cacccgccacatccgc

SEQ ID NO: 2653 - DNA, 18 bp, Homo sapiens
cccttcaccaacccgcct

SEQ ID NO: 2654 - DNA, 18 bp, Homo sapiens
cccatgccacggccgcct

SEQ ID NO: 2655 - DNA, 22 bp, Homo sapiens
caccctgcgctgccctctgcct

SEQ ID NO: 2656 - DNA, 21 bp, Homo sapiens
accctgcctgctgacttgcct

SEQ ID NO: 2657 - DNA, 18 bp, Homo sapiens
caccctgccgctcctgcc

SEQ ID NO: 2658 - DNA, 16 bp, Homo sapiens
accctgtccacccgcc

SEQ ID NO: 2659 - DNA, 23 bp, Homo sapiens
caccctgctgatgtaggacacct

SEQ ID NO: 2660 - DNA, 15 bp, Homo sapiens
caccctgcacatccc

SEQ ID NO: 2661 - DNA, 19 bp, Homo sapiens
cccgccaccacgcccgcct

SEQ ID NO: 2662 - DNA, 17 bp, Homo sapiens
ctgccacgtcccagacc

SEQ ID NO: 2663 - DNA, 20 bp, Homo sapiens
caccctgcctccatttgcct

SEQ ID NO: 2664 - DNA, 20 bp, Homo sapiens
ccccgctcagcgacccgcct

SEQ ID NO: 2665 - DNA, 17 bp, Homo sapiens
ctgccacgcccctgcct

SEQ ID NO: 2666 - DNA, 24 bp, Homo sapiens
ccctgccacctgtagagcttgcct

SEQ ID NO: 2667 - DNA, 23 bp, Homo sapiens
cacccgtgccgtcagccccgtct

SEQ ID NO: 2668 - DNA, 21 bp, Homo sapiens
cctgccacgccaggcctgcct

SEQ ID NO: 2669 - DNA, 21 bp, Homo sapiens
cctgccacgtacggtccgcct

SEQ ID NO: 2670 - DNA, 20 bp, Homo sapiens
caccctgctgctgtgcacct

SEQ ID NO: 2671 - DNA, 21 bp, Homo sapiens
cctctgccacagaacctgcct

SEQ ID NO: 2672 - DNA, 17 bp, Homo sapiens
caccctgcccacccgcc

SEQ ID NO: 2673 - DNA, 19 bp, Homo sapiens
ccctgccagccccctgcct

SEQ ID NO: 2674 - DNA, 16 bp, Homo sapiens
caccccgcccccgccc

SEQ ID NO: 2675 - DNA, 20 bp, Homo sapiens
cctgccacgctccgccgcct

SEQ ID NO: 2676 - DNA, 64 bp, Alcelaphine herpesvirus 1
cacttaagctatgattcctgtagtgctctttcctaagctgagcctattttgcccattttaagtg

SEQ ID NO: 2677 - DNA, 24 bp, Alcelaphine herpesvirus 1
tatgattcctgtagtgctctttcc

SEQ ID NO: 2678 - DNA, 19 bp, Homo sapiens
tgagtcctgctctctttcc

SEQ ID NO: 2679 - DNA, 21 bp, Homo sapiens
tatgtttcctgtatcatttcc

SEQ ID NO: 2680 - DNA, 18 bp, Homo sapiens
tatgatatctgtagtgct

SEQ ID NO: 2681 - DNA, 21 bp, Homo sapiens
tataattcttgtagacattct

SEQ ID NO: 2682 - DNA, 16 bp, Homo sapiens
tcctataactctttcc

SEQ ID NO: 2683 - DNA, 21 bp, Homo sapiens
tggttccagtgacaccctttc

SEQ ID NO: 2684 - DNA, 20 bp, Homo sapiens
tatgattcttttctctttcc

SEQ ID NO: 2685 - DNA, 21 bp, Homo sapiens
tatgattcctgaagaaattcc

SEQ ID NO: 2686 - DNA, 19 bp, Homo sapiens
tgattcctgttgtaatgct

SEQ ID NO: 2687 - DNA, 18 bp, Homo sapiens
tatggttcctcctctttc

SEQ ID NO: 2688 - DNA, 16 bp, Homo sapiens
attcctgttagttttc

SEQ ID NO: 2689 - DNA, 20 bp, Homo sapiens
tgattccttgtgccattttc

SEQ ID NO: 2690 - DNA, 20 bp, Homo sapiens
tgattcctgagagttttttc

SEQ ID NO: 2691 - DNA, 20 bp, Homo sapiens
taattcctgataaaatcttt

SEQ ID NO: 2692 - DNA, 21 bp, Homo sapiens
tgtttccttctttgctctttc

SEQ ID NO: 2693 - DNA, 19 bp, Homo sapiens
atgattctttatgctcttt

SEQ ID NO: 2694 - DNA, 16 bp, Homo sapiens
tatgatcctgttcctt

SEQ ID NO: 2695 - DNA, 21 bp, Homo sapiens
tatgattccatgtagggttct

SEQ ID NO: 2696 - DNA, 18 bp, Homo sapiens
tatgtccagtgctctttc

SEQ ID NO: 2697 - DNA, 20 bp, Homo sapiens
tgaattctgaagctctttcc

SEQ ID NO: 2698 - DNA, 66 bp, Macaca mulatta rhadinovirus
tgtggaaaacattaagagttgttattgaaaatattttttggtaacaaaaccatgttttaggtccca

SEQ ID NO: 2699 - DNA, 24 bp, Macaca mulatta rhadinovirus
tggaaaacattaagagttgttatt

SEQ ID NO: 2700 - DNA, 25 bp, Homo sapiens
tgtaaaacattaactaaaagttatt

SEQ ID NO: 2701 - DNA, 18 bp, Homo sapiens
tggaaggcattaaaagtt

SEQ ID NO: 2702 - DNA, 20 bp, Homo sapiens
tggaaaacatttgagaagtt

SEQ ID NO: 2703 - DNA, 23 bp, Homo sapiens
gaaaacattatccttttgttatt

SEQ ID NO: 2704 - DNA, 20 bp, Homo sapiens
tggaaaacgtatgaattgtt

SEQ ID NO: 2705 - DNA, 20 bp, Homo sapiens
tggagaatatcaagagtcac

SEQ ID NO: 2706 - DNA, 20 bp, Homo sapiens
tggagacattaagaaaaatt

SEQ ID NO: 2707 - DNA, 18 bp, Homo sapiens
tggaaaactttaattgtt

SEQ ID NO: 2708 - DNA, 19 bp, Homo sapiens
ggaaaacattaattttatt

SEQ ID NO: 2709 - DNA, 20 bp, Homo sapiens
gggaaacattaattgttgtt

SEQ ID NO: 2710 - DNA, 17 bp, Homo sapiens
tggaaaacataagtatt

SEQ ID NO: 2711 - DNA, 23 bp, Homo sapiens
tgggaaacattaaaatgatcatt

SEQ ID NO: 2712 - DNA, 22 bp, Homo sapiens
tggaaaacgtaagaacattatt

SEQ ID NO: 2713 - DNA, 113 bp, Cryphonectria hypovirus
atgcgttgttggcgcacgatccaacaaagtcgaggattacgttggggctgctggtacattcctgacgaatcctaagtggttaaagaatgggttgagaattgctggcagggcgt

SEQ ID NO: 2714 - DNA, 24 bp, Cryphonectria hypovirus
gaggattacgttggggctgctggt

SEQ ID NO: 2715 - DNA, 22 bp, Homo sapiens
gaggatgctgggggctgctggt

SEQ ID NO: 2716 - DNA, 24 bp, Homo sapiens
agaccagacgttggggctgttggt

SEQ ID NO: 2717 - DNA, 22 bp, Homo sapiens
gaggattactttccctgttggt

SEQ ID NO: 2718 - DNA, 71 bp, Cryphonectria hypovirus
tctcaggacatctctagttacttcgtggatcagattttccaaatcgaagcgaacaagagaataacctggga

SEQ ID NO: 2719 - DNA, 24 bp, Cryphonectria hypovirus
catctctagttacttcgtggatca

SEQ ID NO: 2720 - DNA, 15 bp, Homo sapiens
catctctagctgtga

SEQ ID NO: 2721 - DNA, 18 bp, Homo sapiens
tctttagttactaccatg

SEQ ID NO: 2722 - DNA, 19 bp, Homo sapiens
catctttaattactttgca

SEQ ID NO: 2723 - DNA, 18 bp, Homo sapiens
catctctagtgattgaac

SEQ ID NO: 2724 - DNA, 19 bp, Homo sapiens
ctacgcacttcgtgggtca

SEQ ID NO: 2725 - DNA, 20 bp, Homo sapiens
cctcccacctttgtggatca

SEQ ID NO: 2726 - DNA, 17 bp, Homo sapiens
catctttaattactcat

SEQ ID NO: 2727 - DNA, 19 bp, Homo sapiens
catctcagttactataatc

SEQ ID NO: 2728 - DNA, 18 bp, Homo sapiens
catttctgttacttcatg

SEQ ID NO: 2729 - DNA, 19 bp, Homo sapiens
ctgttcactttgtggatca

SEQ ID NO: 2730 - DNA, 21 bp, Homo sapiens
catcctagttaatttggatca

SEQ ID NO: 2731 - DNA, 17 bp, Homo sapiens
catctccagttatttgt

SEQ ID NO: 2732 - DNA, 21 bp, Homo sapiens
catttctagtaaagtgggtca

SEQ ID NO: 2733 - DNA, 16 bp, Homo sapiens
cagtttttgtggatca

SEQ ID NO: 2734 - DNA, 23 bp, Homo sapiens
catttctaagttattcatggatc

SEQ ID NO: 2735 - DNA, 22 bp, Homo sapiens
acctctagttgccaccagatca

SEQ ID NO: 2736 - DNA, 20 bp, Homo sapiens
ctccacgccttcgtggatca

SEQ ID NO: 2737 - DNA, 104 bp, Alcelaphine herpesvirus 1
ctagtttattaaataaaaaaaagggaaaacctgtttatctaacctggtcttctattaggtaatcccaggtacagttaatcccctactattatataatcttctag

SEQ ID NO: 2738 - DNA, 24 bp, Alcelaphine herpesvirus 1
taatcccaggtacagttaatcccc

SEQ ID NO: 2739 - DNA, 16 bp, Homo sapiens
tcccaggtctaacccc

SEQ ID NO: 2740 - DNA, 18 bp, Homo sapiens
caatcctaggtacaatca

SEQ ID NO: 2741 - DNA, 17 bp, Homo sapiens
atctgggtacaattaat

SEQ ID NO: 2742 - DNA, 20 bp, Homo sapiens
aatcccaggggctgtgatcc

SEQ ID NO: 2743 - DNA, 20 bp, Homo sapiens
cattttagcagattaatccc

SEQ ID NO: 2744 - DNA, 17 bp, Homo sapiens
taatcccaggtggctcc

SEQ ID NO: 2745 - DNA, 21 bp, Homo sapiens
aatcacaaatatagttaatcc

SEQ ID NO: 2746 - DNA, 18 bp, Homo sapiens
atcccaggcgcccgctcc

SEQ ID NO: 2747 - DNA, 19 bp, Homo sapiens
atcccaaatatggttggtc

SEQ ID NO: 2748 - DNA, 20 bp, Homo sapiens
atcccagggcatagtgcctc

SEQ ID NO: 2749 - DNA, 21 bp, Homo sapiens
taatccttaactagttaatcc

SEQ ID NO: 2750 - DNA, 17 bp, Homo sapiens
tccggtacagcaacccc

SEQ ID NO: 2751 - DNA, 24 bp, Homo sapiens
taatcccaggatcaagagaattcc

SEQ ID NO: 2752 - DNA, 19 bp, Homo sapiens
atcccagatgcttgctccc

SEQ ID NO: 2753 - DNA, 18 bp, Homo sapiens
taacttcaggtacatgct

SEQ ID NO: 2754 - DNA, 15 bp, Homo sapiens
atcccaggtgcctcc

SEQ ID NO: 2755 - DNA, 24 bp, Homo sapiens
taatcccatggtgcaaggatttcc

SEQ ID NO: 2756 - DNA, 17 bp, Homo sapiens
cccaggtatgtcattcc

SEQ ID NO: 2757 - DNA, 17 bp, Homo sapiens
atcccaggtccaggccc

SEQ ID NO: 2758 - DNA, 20 bp, Homo sapiens
atcccaggtcctggatcccc

SEQ ID NO: 2759 - DNA, 18 bp, Homo sapiens
atcccagagttcaattcc

SEQ ID NO: 2760 - DNA, 19 bp, Homo sapiens
taatcctggctccagatcc

SEQ ID NO: 2761 - DNA, 18 bp, Homo sapiens
tctaggtcagccaacccc

SEQ ID NO: 2762 - DNA, 15 bp, Homo sapiens
taatcccagttaatc

SEQ ID NO: 2763 - DNA, 21 bp, Homo sapiens
taatctcaggtacagccgacc

SEQ ID NO: 2764 - DNA, 17 bp, Homo sapiens
ccagggtgctaatcccc

SEQ ID NO: 2765 - DNA, 20 bp, Homo sapiens
tcccagatgctaagattccc

SEQ ID NO: 2766 - DNA, 16 bp, Homo sapiens
taatcccaggatttcc

SEQ ID NO: 2767 - DNA, 16 bp, Homo sapiens
tcccaggctagtctcc

SEQ ID NO: 2768 - DNA, 22 bp, Homo sapiens
taatcccaggcacagaacaccc

SEQ ID NO: 2769 - DNA, 18 bp, Homo sapiens
atcctttggagttaatcc

SEQ ID NO: 2770 - DNA, 21 bp, Homo sapiens
tcccaggtaaaccaagtctcc

SEQ ID NO: 2771 - DNA, 22 bp, Homo sapiens
tcccaggtacaacagcctcccc

SEQ ID NO: 2772 - DNA, 15 bp, Homo sapiens
cccaggtaaattccc

SEQ ID NO: 2773 - DNA, 21 bp, Homo sapiens
aatcccaggtctttagtctcc

SEQ ID NO: 2774 - DNA, 20 bp, Homo sapiens
tcccaggtcagttggacccc

SEQ ID NO: 2775 - DNA, 99 bp, Cryphonectria hypovirus
gacttcttgacttccgccgaagtggatagattcaaacaggctgcctcagattttggcatcatgttggaaatcggaaccacccggaagattacagaagtc

SEQ ID NO: 2776 - DNA, 24 bp, Cryphonectria hypovirus
tcggaaccacccggaagattacag

SEQ ID NO: 2777 - DNA, 16 bp, Homo sapiens
tcggaacccccgggac

SEQ ID NO: 2778 - DNA, 18 bp, Homo sapiens
gggaccacccggtttcac

SEQ ID NO: 2779 - DNA, 18 bp, Homo sapiens
ccggagccgtccgggacc

SEQ ID NO: 2780 - DNA, 21 bp, Homo sapiens
ggaatcagtgaatgattacag

SEQ ID NO: 2781 - DNA, 70 bp, Macaca mulatta rhadinovirus
taataggcctacgataaaatgtcaacatatattttttaatttgtgtttcattaacagccatggtgtatta

SEQ ID NO: 2782 - DNA, 24 bp, Macaca mulatta rhadinovirus
ttcattaacagccatggtgtatta

SEQ ID NO: 2783 - DNA, 22 bp, Homo sapiens
ttcttactaaaatggtgtatta

SEQ ID NO: 2784 - DNA, 18 bp, Homo sapiens
tcattaacagtagagtgt

SEQ ID NO: 2785 - DNA, 19 bp, Homo sapiens
ttcattaacattcattttg

SEQ ID NO: 2786 - DNA, 21 bp, Homo sapiens
tcaacagagctatggtgtatt

SEQ ID NO: 2787 - DNA, 17 bp, Homo sapiens
ttcgttaacagctgtgt

SEQ ID NO: 2788 - DNA, 19 bp, Homo sapiens
ttcttgacagccacaatgt

SEQ ID NO: 2789 - DNA, 18 bp, Homo sapiens
ttcattaaagcctgtatt

SEQ ID NO: 2790 - DNA, 24 bp, Homo sapiens
ttcatgaatggccacagcaatatt

SEQ ID NO: 2791 - DNA, 19 bp, Homo sapiens
ttcattaatagccactgtg

SEQ ID NO: 2792 - DNA, 19 bp, Homo sapiens
tccattaacagttatgaca

SEQ ID NO: 2793 - DNA, 20 bp, Homo sapiens
ttcattaacgacaatagtgt

SEQ ID NO: 2794 - DNA, 22 bp, Homo sapiens
ttcattaatgctaccatggtgt

SEQ ID NO: 2795 - DNA, 18 bp, Homo sapiens
ttcattaacaccagtggt

SEQ ID NO: 2796 - DNA, 110 bp, Cryphonectria hypovirus
ccaaactcaggaaggtgacaaattcaggaattcatggattgccgggtgattttctccagaattacccacgcattcccgatcatgattttaaacgccttcgtgatgtttgg

SEQ ID NO: 2797 - DNA, 24 bp, Cryphonectria hypovirus
atggattgccgggtgattttctcc

SEQ ID NO: 2798 - DNA, 19 bp, Homo sapiens
gggttgccggaagcttctc

SEQ ID NO: 2799 - DNA, 20 bp, Homo sapiens
atggattgcagtccttttct

SEQ ID NO: 2800 - DNA, 19 bp, Homo sapiens
gattgcaattcattttctc

SEQ ID NO: 2801 - DNA, 21 bp, Homo sapiens
tagattgcaaaaattttctcc

SEQ ID NO: 2802 - DNA, 18 bp, Homo sapiens
tggattttatgattttct

SEQ ID NO: 2803 - DNA, 18 bp, Homo sapiens
atggcagctggtgatttt

SEQ ID NO: 2804 - DNA, 20 bp, Homo sapiens
ggattgctgaaggattttct

SEQ ID NO: 2805 - DNA, 20 bp, Homo sapiens
atggactgccttcattttct

SEQ ID NO: 2806 - DNA, 20 bp, Homo sapiens
tgggtgccgggtacttttct

SEQ ID NO: 2807 - DNA, 22 bp, Homo sapiens
atggatttgctaagttttctcc

SEQ ID NO: 2808 - DNA, 19 bp, Homo sapiens
atggattgttgcgctttct

SEQ ID NO: 2809 - DNA, 19 bp, Homo sapiens
tggattgctgatgttcttc

SEQ ID NO: 2810 - DNA, 16 bp, Homo sapiens
tggattgtgtaatttt

SEQ ID NO: 2811 - DNA, 15 bp, Homo sapiens
ggattgtaattttct

SEQ ID NO: 2812 - DNA, 19 bp, Homo sapiens
atgaagctggtgattttct

SEQ ID NO: 2813 - DNA, 23 bp, Homo sapiens
atagattgctttcagtttttttc

SEQ ID NO: 2814 - DNA, 22 bp, Homo sapiens
atagattgcaaaaattttctcc

SEQ ID NO: 2815 - DNA, 18 bp, Homo sapiens
atggatgttggtgttctc

SEQ ID NO: 2816 - DNA, 19 bp, Homo sapiens
atggagaaggtgattttct

SEQ ID NO: 2817 - DNA, 19 bp, Homo sapiens
ggaaagggtgattttctcc

SEQ ID NO: 2818 - DNA, 17 bp, Homo sapiens
atggctggggtgatttt

SEQ ID NO: 2819 - DNA, 15 bp, Homo sapiens
ggatgatgattttct

SEQ ID NO: 2820 - DNA, 20 bp, Homo sapiens
atggattcccgggtgacttc

SEQ ID NO: 2821 - DNA, 16 bp, Homo sapiens
atggatgccattttct

SEQ ID NO: 2822 - DNA, 23 bp, Homo sapiens
tggattgcagggtgggggtctcc

SEQ ID NO: 2823 - DNA, 21 bp, Homo sapiens
tggatgttgtctgttttctcc

SEQ ID NO: 2824 - DNA, 17 bp, Homo sapiens
cggttgctgcctttctc

SEQ ID NO: 2825 - DNA, 19 bp, Homo sapiens
tggattgcctatttttctc

SEQ ID NO: 2826 - DNA, 17 bp, Homo sapiens
atggattttgtaatttt

SEQ ID NO: 2827 - DNA, 20 bp, Homo sapiens
atggattgtctgaggatctt

SEQ ID NO: 2828 - DNA, 130 bp, Alcelaphine herpesvirus 1
gccacctagccagccagcccggggacggggccacctagccagccagcccggggacggggccacctagccagccagcccggggacggggccacctagccagccagcccggggacggggccacctagccagc

SEQ ID NO: 2829 - DNA, 24 bp, Alcelaphine herpesvirus 1
agccagcccggggacggggccacc

SEQ ID NO: 2830 - DNA, 22 bp, Homo sapiens
agtcagtgtggtgaggggccac

SEQ ID NO: 2831 - DNA, 21 bp, Homo sapiens
agcagcagagatggggtcacc

SEQ ID NO: 2832 - DNA, 24 bp, Homo sapiens
gccagccctgggtgctctggtcac

SEQ ID NO: 2833 - DNA, 18 bp, Homo sapiens
gccagcacggggggtgcc

SEQ ID NO: 2834 - DNA, 20 bp, Homo sapiens
agccagccagggggcggggc

SEQ ID NO: 2835 - DNA, 19 bp, Homo sapiens
agctggcacagggggccac

SEQ ID NO: 2836 - DNA, 21 bp, Homo sapiens
agccggccagggacagtcacc

SEQ ID NO: 2837 - DNA, 17 bp, Homo sapiens
gccggcccggggtcccc

SEQ ID NO: 2838 - DNA, 28 bp, Homo sapiens
gccagcccgggagatgcgctggtggccc

SEQ ID NO: 2839 - DNA, 19 bp, Homo sapiens
gctcagcttggggacagcc

SEQ ID NO: 2840 - DNA, 22 bp, Homo sapiens
gcgagtccggggaccctcaggc

SEQ ID NO: 2841 - DNA, 22 bp, Homo sapiens
cagcccgcgcactggggccacc

SEQ ID NO: 2842 - DNA, 23 bp, Homo sapiens
gccagggacggggtggggctgcc

SEQ ID NO: 2843 - DNA, 20 bp, Homo sapiens
gccagcccgcccgggccgcc

SEQ ID NO: 2844 - DNA, 22 bp, Homo sapiens
gcagcccgggaagggggtcacc

SEQ ID NO: 2845 - DNA, 17 bp, Homo sapiens
gccagcctgggggccac

SEQ ID NO: 2846 - DNA, 22 bp, Homo sapiens
agctggcccggaggtcccagcc

SEQ ID NO: 2847 - DNA, 16 bp, Homo sapiens
agccggccggcggggc

SEQ ID NO: 2848 - DNA, 18 bp, Homo sapiens
agccagccctgggattgg

SEQ ID NO: 2849 - DNA, 18 bp, Homo sapiens
gccagctggctgggccac

SEQ ID NO: 2850 - DNA, 17 bp, Homo sapiens
gctgccccggcggccac

SEQ ID NO: 2851 - DNA, 21 bp, Homo sapiens
agtgagcagagatggggccac

SEQ ID NO: 2852 - DNA, 19 bp, Homo sapiens
gccggcctgggacagggcc

SEQ ID NO: 2853 - DNA, 26 bp, Homo sapiens
agcccgccccgggtcgtcggtggccc

SEQ ID NO: 2854 - DNA, 23 bp, Homo sapiens
gctgcccgcgtcctggggccacc

SEQ ID NO: 2855 - DNA, 17 bp, Homo sapiens
gccagcccggggcggga

SEQ ID NO: 2856 - DNA, 18 bp, Homo sapiens
gccgcccggggcgccgcc

SEQ ID NO: 2857 - DNA, 17 bp, Homo sapiens
agccagcccgggcgggg

SEQ ID NO: 2858 - DNA, 24 bp, Homo sapiens
gccagcccgaggagcatcggtggc

SEQ ID NO: 2859 - DNA, 21 bp, Homo sapiens
agctacccccacggggccacc

SEQ ID NO: 2860 - DNA, 17 bp, Homo sapiens
gccggccaggaggccac

SEQ ID NO: 2861 - DNA, 19 bp, Homo sapiens
cagcccagggtcacagcca

SEQ ID NO: 2862 - DNA, 21 bp, Homo sapiens
agccaacccgtgggggctgcc

SEQ ID NO: 2863 - DNA, 20 bp, Homo sapiens
gccagccctggggcaagaac

SEQ ID NO: 2864 - DNA, 20 bp, Homo sapiens
gctagctccggccgggccac

SEQ ID NO: 2865 - DNA, 17 bp, Homo sapiens
cattcggggggagccac

SEQ ID NO: 2866 - DNA, 19 bp, Homo sapiens
agccagctgtggggatgag

SEQ ID NO: 2867 - DNA, 18 bp, Homo sapiens
gctggcccgagggaggcc

SEQ ID NO: 2868 - DNA, 19 bp, Homo sapiens
gccggctctgggacggggc

SEQ ID NO: 2869 - DNA, 20 bp, Homo sapiens
gccacctgcagggggccacc

SEQ ID NO: 2870 - DNA, 17 bp, Homo sapiens
gccgcccggggcgccgc

SEQ ID NO: 2871 - DNA, 21 bp, Homo sapiens
agccagcccaggaacgcaggc

SEQ ID NO: 2872 - DNA, 19 bp, Homo sapiens
agccaccccggtggctacc

SEQ ID NO: 2873 - DNA, 19 bp, Homo sapiens
acctagcccaaggggttgc

SEQ ID NO: 2874 - DNA, 19 bp, Homo sapiens
gccagcctggggagagcac

SEQ ID NO: 2875 - DNA, 22 bp, Homo sapiens
actggcccggggaaaagtcacc

SEQ ID NO: 2876 - DNA, 22 bp, Homo sapiens
gcttggccggaacggggttacc

SEQ ID NO: 2877 - DNA, 18 bp, Homo sapiens
gctgcccggggactcacc

SEQ ID NO: 2878 - DNA, 21 bp, Homo sapiens
gccggcctgaggacggacagc

SEQ ID NO: 2879 - DNA, 22 bp, Homo sapiens
accgcccggggccatcggtggc

SEQ ID NO: 2880 - DNA, 21 bp, Homo sapiens
gccagcccgggatggaagcac

SEQ ID NO: 2881 - DNA, 25 bp, Homo sapiens
agccagcctagggagcattggtggc

SEQ ID NO: 2882 - DNA, 19 bp, Homo sapiens
gcggcccgggggagcggcc

SEQ ID NO: 2883 - DNA, 20 bp, Homo sapiens
cagaacaaggcggggccgcc

SEQ ID NO: 2884 - DNA, 19 bp, Homo sapiens
agccagcctgggtatgggc

SEQ ID NO: 2885 - DNA, 17 bp, Homo sapiens
cagctcggggtgagacc

SEQ ID NO: 2886 - DNA, 19 bp, Homo sapiens
agccagcctgggagctgcc

SEQ ID NO: 2887 - DNA, 23 bp, Homo sapiens
gccggcccagggggtcacagtgc

SEQ ID NO: 2888 - DNA, 22 bp, Homo sapiens
gccatgcccggggggatccgcc

SEQ ID NO: 2889 - DNA, 18 bp, Homo sapiens
gctcggggacgtgccacc

SEQ ID NO: 2890 - DNA, 19 bp, Homo sapiens
gccactcgggggccaaacc

SEQ ID NO: 2891 - DNA, 23 bp, Homo sapiens
agctggcccgaggtgcagctgcc

SEQ ID NO: 2892 - DNA, 21 bp, Homo sapiens
gccagcccgccttgggtcgcc

SEQ ID NO: 2893 - DNA, 19 bp, Homo sapiens
agtccaggaggcggggcca

SEQ ID NO: 2894 - DNA, 26 bp, Homo sapiens
agctggcccggaggcacgctggtggc

SEQ ID NO: 2895 - DNA, 19 bp, Homo sapiens
agccagcctggaggtggcc

SEQ ID NO: 2896 - DNA, 18 bp, Homo sapiens
gccggcccgggacagacc

SEQ ID NO: 2897 - DNA, 21 bp, Homo sapiens
gcctggtaggatggggccacc

SEQ ID NO: 2898 - DNA, 25 bp, Homo sapiens
agccagcctgggggtacacagtacc

SEQ ID NO: 2899 - DNA, 21 bp, Homo sapiens
agccagctcgggaggtggggc

SEQ ID NO: 2900 - DNA, 22 bp, Homo sapiens
actcagcccggcgcgggccgcc

SEQ ID NO: 2901 - DNA, 18 bp, Homo sapiens
agccagccgggcggctgc

SEQ ID NO: 2902 - DNA, 18 bp, Homo sapiens
gccaccctgggcgccgcc

SEQ ID NO: 2903 - DNA, 22 bp, Homo sapiens
gccggctcagggacaggctgcc

SEQ ID NO: 2904 - DNA, 22 bp, Homo sapiens
agtcagccccacagcggggcca

SEQ ID NO: 2905 - DNA, 17 bp, Homo sapiens
gccagcccggccgccac

SEQ ID NO: 2906 - DNA, 21 bp, Homo sapiens
gctcagcccggggacccaggc

SEQ ID NO: 2907 - DNA, 18 bp, Homo sapiens
gccagcccgggagttgcc

SEQ ID NO: 2908 - DNA, 24 bp, Homo sapiens
gccggcagtgccgacggggctgcc

SEQ ID NO: 2909 - DNA, 20 bp, Homo sapiens
agccagcccgggtccgccgg

SEQ ID NO: 2910 - DNA, 19 bp, Homo sapiens
gccagacccgggcgccgcc

SEQ ID NO: 2911 - DNA, 18 bp, Homo sapiens
agccacccggggacttgg

SEQ ID NO: 2912 - DNA, 17 bp, Homo sapiens
gccaacctgggagccac

SEQ ID NO: 2913 - DNA, 23 bp, Homo sapiens
agccacccggggccggggccgcc

SEQ ID NO: 2914 - DNA, 19 bp, Homo sapiens
agctggcctgggacaggcc

SEQ ID NO: 2915 - DNA, 16 bp, Homo sapiens
agacagcccggaggcc

SEQ ID NO: 2916 - DNA, 20 bp, Homo sapiens
agccagccggtataggccac

SEQ ID NO: 2917 - DNA, 21 bp, Homo sapiens
gcccggcagcgcggggccacc

SEQ ID NO: 2918 - DNA, 22 bp, Homo sapiens
ccagtctaaagccggggccacc

SEQ ID NO: 2919 - DNA, 20 bp, Homo sapiens
agacagcccgggggtgagac

SEQ ID NO: 2920 - DNA, 16 bp, Homo sapiens
agccagccaaggggcc

SEQ ID NO: 2921 - DNA, 19 bp, Homo sapiens
agccagtcaggctggccac

SEQ ID NO: 2922 - DNA, 19 bp, Homo sapiens
gccagcccggggatgcgcc

SEQ ID NO: 2923 - DNA, 19 bp, Homo sapiens
gccggcccagggatcggcc

SEQ ID NO: 2924 - DNA, 21 bp, Homo sapiens
agcagcctgggacaagccgcc

SEQ ID NO: 2925 - DNA, 19 bp, Homo sapiens
gctcagggtataaaccacc

SEQ ID NO: 2926 - DNA, 22 bp, Homo sapiens
gccattcaccttccggggccac

SEQ ID NO: 2927 - DNA, 21 bp, Homo sapiens
gcagcccgggcccgggccacc

SEQ ID NO: 2928 - DNA, 19 bp, Homo sapiens
agccacactgagatggggc

SEQ ID NO: 2929 - DNA, 24 bp, Homo sapiens
gctagcccgggcttcgtcggtggc

SEQ ID NO: 2930 - DNA, 21 bp, Homo sapiens
gccaccctggggtgagctgcc

SEQ ID NO: 2931 - DNA, 22 bp, Homo sapiens
agccaggcctgccggggccacc

SEQ ID NO: 2932 - DNA, 20 bp, Homo sapiens
gccaggctgggtagggccac

SEQ ID NO: 2933 - DNA, 24 bp, Homo sapiens
actagtccgcaaatgggggccacc

SEQ ID NO: 2934 - DNA, 21 bp, Homo sapiens
agccagcctgagggtccatgc

SEQ ID NO: 2935 - DNA, 19 bp, Homo sapiens
agccagcctggggacagag

SEQ ID NO: 2936 - DNA, 18 bp, Homo sapiens
agccgcccgggagggggc

SEQ ID NO: 2937 - DNA, 19 bp, Homo sapiens
aactgggggatggggccac

SEQ ID NO: 2938 - DNA, 21 bp, Homo sapiens
ccagtcggggacggggccgcc

SEQ ID NO: 2939 - DNA, 19 bp, Homo sapiens
gccagtttgggaacagggc

SEQ ID NO: 2940 - DNA, 17 bp, Homo sapiens
cccgggacggggccgcc

SEQ ID NO: 2941 - DNA, 18 bp, Homo sapiens
agctgcccgggggtggga

SEQ ID NO: 2942 - DNA, 24 bp, Homo sapiens
agccagcctggtggccaggctgcc

SEQ ID NO: 2943 - DNA, 18 bp, Homo sapiens
agccgcccgggggtggcc

SEQ ID NO: 2944 - DNA, 22 bp, Homo sapiens
cagcccggggacggggccagcc

SEQ ID NO: 2945 - DNA, 19 bp, Homo sapiens
cagcccagagtggggccac

SEQ ID NO: 2946 - DNA, 21 bp, Homo sapiens
gccagtccgggggagcggacc

SEQ ID NO: 2947 - DNA, 22 bp, Homo sapiens
agctgagcctggagaggccacc

SEQ ID NO: 2948 - DNA, 23 bp, Homo sapiens
agccagcccgggggtccaatggg

SEQ ID NO: 2949 - DNA, 20 bp, Homo sapiens
gccggcccgagggctggcgc

SEQ ID NO: 2950 - DNA, 24 bp, Homo sapiens
cagaaacaagggacggggccaccg

SEQ ID NO: 2951 - DNA, 19 bp, Homo sapiens
gcctggggccgaggccacc

SEQ ID NO: 2952 - DNA, 17 bp, Homo sapiens
agccagcctggaggccc

SEQ ID NO: 2953 - DNA, 19 bp, Homo sapiens
agccagcccgagggtggaa

SEQ ID NO: 2954 - DNA, 20 bp, Homo sapiens
agctgggcccgggggaccac

SEQ ID NO: 2955 - DNA, 19 bp, Homo sapiens
gcctaggggcggggccacc

SEQ ID NO: 2956 - DNA, 21 bp, Homo sapiens
agccagcctgagccagctgcc

SEQ ID NO: 2957 - DNA, 20 bp, Homo sapiens
agacagcctggggggctgcc

SEQ ID NO: 2958 - DNA, 20 bp, Homo sapiens
agccagacattcggggccac

SEQ ID NO: 2959 - DNA, 20 bp, Homo sapiens
gccggcccggggccgcggcc

SEQ ID NO: 2960 - DNA, 20 bp, Homo sapiens
agcggcccggggtggctgcc

SEQ ID NO: 2961 - DNA, 19 bp, Homo sapiens
cagtttggggaggagccac

SEQ ID NO: 2962 - DNA, 22 bp, Homo sapiens
gccagcccaacgtcggggtcac

SEQ ID NO: 2963 - DNA, 18 bp, Homo sapiens
gccacccggggacgctgg

SEQ ID NO: 2964 - DNA, 18 bp, Homo sapiens
agccagcctggggtggag

SEQ ID NO: 2965 - DNA, 22 bp, Homo sapiens
agctgggcctggagaggccacc

SEQ ID NO: 2966 - DNA, 17 bp, Homo sapiens
gcggcccggggggcgcc

SEQ ID NO: 2967 - DNA, 17 bp, Homo sapiens
agctgcccgaggggccc

SEQ ID NO: 2968 - DNA, 23 bp, Homo sapiens
agcccgccccctccggggccacc

SEQ ID NO: 2969 - DNA, 21 bp, Homo sapiens
gctgggcctggaggggccacc

SEQ ID NO: 2970 - DNA, 22 bp, Homo sapiens
agctgtgcctggagaggtcacc

SEQ ID NO: 2971 - DNA, 20 bp, Homo sapiens
gcggcccggccggggctgcc

SEQ ID NO: 2972 - DNA, 25 bp, Homo sapiens
agccagccctggggacgggcacgcc

SEQ ID NO: 2973 - DNA, 22 bp, Homo sapiens
agccggccaggaagaggccacc

SEQ ID NO: 2974 - DNA, 18 bp, Homo sapiens
cagcccggggacggcgcc

SEQ ID NO: 2975 - DNA, 19 bp, Homo sapiens
agccacctaaggggctgcc

SEQ ID NO: 2976 - DNA, 21 bp, Homo sapiens
agccacctcggggacagggcc

SEQ ID NO: 2977 - DNA, 22 bp, Homo sapiens
gcccagtggggacggggctgcc

SEQ ID NO: 2978 - DNA, 84 bp, Cryphonectria hypovirus
cgagattcctgtacacagcttgcgaaaggggaagtggtcacgcactggtgaccgcattccaacctgcgttgtacaagaaattcg

SEQ ID NO: 2979 - DNA, 24 bp, Cryphonectria hypovirus
gaccgcattccaacctgcgttgta

SEQ ID NO: 2980 - DNA, 18 bp, Homo sapiens
gcattccagcctgggtta

SEQ ID NO: 2981 - DNA, 18 bp, Homo sapiens
actgcattccagcctggt

SEQ ID NO: 2982 - DNA, 19 bp, Homo sapiens
actgcattccagtctgggt

SEQ ID NO: 2983 - DNA, 17 bp, Homo sapiens
cgcattccagtctctgt

SEQ ID NO: 2984 - DNA, 19 bp, Homo sapiens
actgcattccagcctgggt

SEQ ID NO: 2985 - DNA, 19 bp, Homo sapiens
ccgcatccaacttgttttg

SEQ ID NO: 2986 - DNA, 16 bp, Homo sapiens
gcattccatctgatta

SEQ ID NO: 2987 - DNA, 19 bp, Homo sapiens
accgcattccagcctggat

SEQ ID NO: 2988 - DNA, 19 bp, Homo sapiens
actgcattccagcctaggt

SEQ ID NO: 2989 - DNA, 21 bp, Homo sapiens
ccgcattctggcactccgagt

SEQ ID NO: 2990 - DNA, 19 bp, Homo sapiens
actgcattccagcctgagt

SEQ ID NO: 2991 - DNA, 19 bp, Homo sapiens
gcttttcagctgcattgta

SEQ ID NO: 2992 - DNA, 21 bp, Homo sapiens
accgcattccagcttgggcta

SEQ ID NO: 2993 - DNA, 16 bp, Homo sapiens
actgcattccagcttg

SEQ ID NO: 2994 - DNA, 84 bp, Human herpesvirus 6B
tttattaggtgggaaaacaggatgctctatgaacacattcatttgctacatttgaattaattttgtttctttacataacataga

SEQ ID NO: 2995 - DNA, 24 bp, Human herpesvirus 6B
atttgctacatttgaattaatttt

SEQ ID NO: 2996 - DNA, 18 bp, Homo sapiens
cttgctaagaattaattt

SEQ ID NO: 2997 - DNA, 21 bp, Homo sapiens
ttgctatatttaaacaatttt

SEQ ID NO: 2998 - DNA, 23 bp, Homo sapiens
atttgcagcatttgaaagtaatt

SEQ ID NO: 2999 - DNA, 62 bp, Cryphonectria hypovirus
catgggataagtcaaagatgtaccaagccttgggtttcgcagcaggcggtactatccccatg

SEQ ID NO: 3000 - DNA, 24 bp, Cryphonectria hypovirus
taagtcaaagatgtaccaagcctt

SEQ ID NO: 3001 - DNA, 22 bp, Homo sapiens
caagtcaagctgtccaggcctt

SEQ ID NO: 3002 - DNA, 20 bp, Homo sapiens
gtcggaataattcaagcctt

SEQ ID NO: 3003 - DNA, 18 bp, Homo sapiens
gtcaaaccccatccaagc

SEQ ID NO: 3004 - DNA, 23 bp, Homo sapiens
taagtcaaagtgtggagctcctt

SEQ ID NO: 3005 - DNA, 17 bp, Homo sapiens
agacaaagatgtgcctc

SEQ ID NO: 3006 - DNA, 20 bp, Homo sapiens
gtcaagaagggccaagcctt

SEQ ID NO: 3007 - DNA, 21 bp, Homo sapiens
taagtcaaggatggactctgc

SEQ ID NO: 3008 - DNA, 17 bp, Homo sapiens
aagtcagggacaagcct

SEQ ID NO: 3009 - DNA, 22 bp, Homo sapiens
agctcgattggtatcaagcctt

SEQ ID NO: 3010 - DNA, 18 bp, Homo sapiens
tgagacagcatcaagcct

SEQ ID NO: 3011 - DNA, 70 bp, Cryphonectria hypovirus
atgcgtcgctactccccgcaaggatggtggtttcaacatcacgttgccttgccggggtattgcgtcgcgt

SEQ ID NO: 3012 - DNA, 24 bp, Cryphonectria hypovirus
tccccgcaaggatggtggtttcaa

SEQ ID NO: 3013 - DNA, 18 bp, Homo sapiens
cccaggatggtggtttca

SEQ ID NO: 3014 - DNA, 21 bp, Homo sapiens
cccctgcgaggcaagcggttt

SEQ ID NO: 3015 - DNA, 17 bp, Homo sapiens
cctccaaggatgcctca

SEQ ID NO: 3016 - DNA, 20 bp, Homo sapiens
tctccgcaaagggtggagcc

SEQ ID NO: 3017 - DNA, 16 bp, Homo sapiens
tctccgcggaggtggc

SEQ ID NO: 3018 - DNA, 19 bp, Homo sapiens
tccctccaaggatgggacc

SEQ ID NO: 3019 - DNA, 18 bp, Homo sapiens
tccctgcaggatgggcga

SEQ ID NO: 3020 - DNA, 19 bp, Homo sapiens
cccttaaggatggtgccct

SEQ ID NO: 3021 - DNA, 18 bp, Homo sapiens
tccccgcaggggggtccc

SEQ ID NO: 3022 - DNA, 22 bp, Homo sapiens
tccctgccaggatgatgcttca

SEQ ID NO: 3023 - DNA, 18 bp, Homo sapiens
tccccgtgggaatggtgg

SEQ ID NO: 3024 - DNA, 20 bp, Homo sapiens
tccccgcaggagtgggcaca

SEQ ID NO: 3025 - DNA, 17 bp, Homo sapiens
tccctgcaggatgttgg

SEQ ID NO: 3026 - DNA, 21 bp, Homo sapiens
ccccgtgaggagaagtttcaa

SEQ ID NO: 3027 - DNA, 20 bp, Homo sapiens
tctacgcaaggatgttcctc

SEQ ID NO: 3028 - DNA, 18 bp, Homo sapiens
tcctgcaagaggtggctt

SEQ ID NO: 3029 - DNA, 16 bp, Homo sapiens
gcaggattagcttcaa

SEQ ID NO: 3030 - DNA, 24 bp, Homo sapiens
tctccatgagccagttggtttcaa

SEQ ID NO: 3031 - DNA, 18 bp, Homo sapiens
cccgccagggtggtggtc

SEQ ID NO: 3032 - DNA, 22 bp, Homo sapiens
tctccgccagggtggtcctcca

SEQ ID NO: 3033 - DNA, 19 bp, Homo sapiens
cccagtagcaatggtttca

SEQ ID NO: 3034 - DNA, 18 bp, Homo sapiens
tcccctaaggatgggcct

SEQ ID NO: 3035 - DNA, 18 bp, Homo sapiens
tccccgtagagatggctt

SEQ ID NO: 3036 - DNA, 22 bp, Homo sapiens
tcctcacagcatgatggtttca

SEQ ID NO: 3037 - DNA, 17 bp, Homo sapiens
caaggatattatttcaa

SEQ ID NO: 3038 - DNA, 16 bp, Homo sapiens
cccgcatcagtggttt

SEQ ID NO: 3039 - DNA, 18 bp, Homo sapiens
tccttgcaggtggtggct

SEQ ID NO: 3040 - DNA, 19 bp, Homo sapiens
tccccaaatggtggtttca

SEQ ID NO: 3041 - DNA, 15 bp, Homo sapiens
cccccgcaggggtgg

SEQ ID NO: 3042 - DNA, 131 bp, Alcelaphine herpesvirus 1
cagcccggggacggggccacctagccagccagcccggggacggggccacctagccagccagcccggggacggggccacctagccagccagcccggggacggggccacctagccagccagcccggggacggg

SEQ ID NO: 3043 - DNA, 60 bp, Cryphonectria hypovirus
gtaagactgcctaaccgtttcaaagcagtggcgttgctcaacggacgtaaggcagattat

SEQ ID NO: 3044 - DNA, 23 bp, Cryphonectria hypovirus
tcaacggacgtaaggcagattat

SEQ ID NO: 3045 - DNA, 19 bp, Homo sapiens
tcaacagatgtagctggca

SEQ ID NO: 3046 - DNA, 20 bp, Homo sapiens
ggctggtggaggcagattat

SEQ ID NO: 3047 - DNA, 21 bp, Homo sapiens
tccacttttttaaggcagatt

SEQ ID NO: 3048 - DNA, 18 bp, Homo sapiens
tcaatggcatgcagatta

SEQ ID NO: 3049 - DNA, 22 bp, Homo sapiens
tcgacgaatgcacgcagattat

SEQ ID NO: 3050 - DNA, 18 bp, Homo sapiens
ggttgccaggcagattat

SEQ ID NO: 3051 - DNA, 130 bp, Macaca mulatta rhadinovirus
cgccggcctcccccggctcccggccctccgccccgccggcccgggcccgcggccgccgcccccggccgccccgcgccgcgcgccgggccgctttcggttcgcggggccgggggtcccgcggggggccggg

SEQ ID NO: 3052 - DNA, 24 bp, Macaca mulatta rhadinovirus
tcggttcgcggggccgggggtccc

SEQ ID NO: 3053 - DNA, 24 bp, Homo sapiens
tcgtttcgcggggcctccgggacc

SEQ ID NO: 3054 - DNA, 21 bp, Homo sapiens
cggttcagctctgggggtccc

SEQ ID NO: 3055 - DNA, 20 bp, Homo sapiens
ccggttcgcgccgaggggtc

SEQ ID NO: 3056 - DNA, 17 bp, Homo sapiens
gggcgggttgggggtcc

SEQ ID NO: 3057 - DNA, 20 bp, Homo sapiens
gcggcagggctgggggtccc

SEQ ID NO: 3058 - DNA, 19 bp, Homo sapiens
ggtgggggtcgggggtccc

SEQ ID NO: 3059 - DNA, 18 bp, Homo sapiens
ggttgcggggggagtccc

SEQ ID NO: 3060 - DNA, 21 bp, Homo sapiens
cgggagggggctgggggtccc

SEQ ID NO: 3061 - DNA, 23 bp, Homo sapiens
tcggtgcgcgggagccgggttcc

SEQ ID NO: 3062 - DNA, 72 bp, Cryphonectria hypovirus
gtcgagggtgtagcggccggtcgttcaatgtatcctccgggatttttggtcggtcgttacgataccatcgat

SEQ ID NO: 3063 - DNA, 24 bp, Cryphonectria hypovirus
tagcggccggtcgttcaatgtatc

SEQ ID NO: 3064 - DNA, 20 bp, Homo sapiens
ggatggcctgatcaatgtat

SEQ ID NO: 3065 - DNA, 15 bp, Homo sapiens
gcggccggcgtctgt

SEQ ID NO: 3066 - DNA, 18 bp, Homo sapiens
tagcagctgccaatgtat

SEQ ID NO: 3067 - DNA, 73 bp, Macaca mulatta rhadinovirus
gggtgccgctccgccgggcccggccgactcccgggagcgccccggtccggccgagcccggcggcgccgcgccc

SEQ ID NO: 3068 - DNA, 24 bp, Macaca mulatta rhadinovirus
tccggccgagcccggcggcgccgc

SEQ ID NO: 3069 - DNA, 20 bp, Homo sapiens
tccggccggctctggcggcg

SEQ ID NO: 3070 - DNA, 20 bp, Homo sapiens
ggcccagcccggctacgggc

SEQ ID NO: 3071 - DNA, 21 bp, Homo sapiens
tccggccagcctggctggggc

SEQ ID NO: 3072 - DNA, 20 bp, Homo sapiens
ccggccgagtggagcgctgc

SEQ ID NO: 3073 - DNA, 18 bp, Homo sapiens
tccgtcgagcccaagccg

SEQ ID NO: 3074 - DNA, 22 bp, Homo sapiens
ggctcccggctggcggcgccgc

SEQ ID NO: 3075 - DNA, 23 bp, Homo sapiens
tccgtggttattggcggcgccgc

SEQ ID NO: 3076 - DNA, 22 bp, Homo sapiens
tcgggccgactcgcggcgccgc

SEQ ID NO: 3077 - DNA, 25 bp, Homo sapiens
ggccgagccggtgcgcggcgccgcc

SEQ ID NO: 3078 - DNA, 23 bp, Homo sapiens
tccagccgggtccgggttcccgc

SEQ ID NO: 3079 - DNA, 21 bp, Homo sapiens
cggccgggctcgtggcgccgc

SEQ ID NO: 3080 - DNA, 24 bp, Homo sapiens
tccggccgcgcccgcgctggccgc

SEQ ID NO: 3081 - DNA, 20 bp, Homo sapiens
gccgggctcggtggcgccgc

SEQ ID NO: 3082 - DNA, 23 bp, Homo sapiens
cctccacagcccggcggcgccgc

SEQ ID NO: 3083 - DNA, 22 bp, Homo sapiens
tcccgccggcagccggcgccgc

SEQ ID NO: 3084 - DNA, 18 bp, Homo sapiens
tccggccgggccgctccg

SEQ ID NO: 3085 - DNA, 19 bp, Homo sapiens
tccggccgggactcggtgg

SEQ ID NO: 3086 - DNA, 18 bp, Homo sapiens
cggccgagcccggggcgc

SEQ ID NO: 3087 - DNA, 21 bp, Homo sapiens
tctgggcctcggcggcgccgc

SEQ ID NO: 3088 - DNA, 24 bp, Homo sapiens
tcccgccgagccccttcctgccgc

SEQ ID NO: 3089 - DNA, 20 bp, Homo sapiens
tcaggctggcggcggcgtcg

SEQ ID NO: 3090 - DNA, 19 bp, Homo sapiens
tccggcccggctcggctcg

SEQ ID NO: 3091 - DNA, 16 bp, Homo sapiens
tcgggccgggggcgcc

SEQ ID NO: 3092 - DNA, 20 bp, Homo sapiens
ggccgacggcgcggtgctgc

SEQ ID NO: 3093 - DNA, 21 bp, Homo sapiens
tcctgctgctggcggcgctgc

SEQ ID NO: 3094 - DNA, 18 bp, Homo sapiens
tccggccgacgccgccgc

SEQ ID NO: 3095 - DNA, 22 bp, Homo sapiens
ccggccgagccaggcagggcgc

SEQ ID NO: 3096 - DNA, 19 bp, Homo sapiens
cctggccgggcccggttgc

SEQ ID NO: 3097 - DNA, 20 bp, Homo sapiens
cggccgagctcatcagccgc

SEQ ID NO: 3098 - DNA, 21 bp, Homo sapiens
tccgctcgagctttgcgccgc

SEQ ID NO: 3099 - DNA, 17 bp, Homo sapiens
tccggccgactcggtgg

SEQ ID NO: 3100 - DNA, 19 bp, Homo sapiens
tccggccggctccgcgccg

SEQ ID NO: 3101 - DNA, 22 bp, Homo sapiens
tccggctcagcccagacgccgc

SEQ ID NO: 3102 - DNA, 18 bp, Homo sapiens
tccgccgagcccgcgccg

SEQ ID NO: 3103 - DNA, 18 bp, Homo sapiens
ggccagggctcgacgccg

SEQ ID NO: 3104 - DNA, 19 bp, Homo sapiens
tccggccggtcccaggccg

SEQ ID NO: 3105 - DNA, 22 bp, Homo sapiens
tccggccgggcgcggagcccgc

SEQ ID NO: 3106 - DNA, 24 bp, Homo sapiens
tccggccgtagccgcagccgccgc

SEQ ID NO: 3107 - DNA, 19 bp, Homo sapiens
tccagccgggcctggtggc

SEQ ID NO: 3108 - DNA, 20 bp, Homo sapiens
cggctgggctcaggcgccgc

SEQ ID NO: 3109 - DNA, 17 bp, Homo sapiens
tccggccgggctggcgg

SEQ ID NO: 3110 - DNA, 23 bp, Homo sapiens
tccggccgagccctccccgccgc

SEQ ID NO: 3111 - DNA, 19 bp, Homo sapiens
cccggccgggtcaacgtcg

SEQ ID NO: 3112 - DNA, 24 bp, Homo sapiens
tccggccggggccggcctgagggc

SEQ ID NO: 3113 - DNA, 23 bp, Homo sapiens
tccggccagggctcagaaaccgc

SEQ ID NO: 3114 - DNA, 18 bp, Homo sapiens
gggcggcggcggcgctgc

SEQ ID NO: 3115 - DNA, 24 bp, Homo sapiens
tccgcgccgatggggcggcgctgc

SEQ ID NO: 3116 - DNA, 20 bp, Homo sapiens
ccggccgagctcactgccgc

SEQ ID NO: 3117 - DNA, 22 bp, Homo sapiens
ggtcgagcccgctcagcgccgc

SEQ ID NO: 3118 - DNA, 21 bp, Homo sapiens
cggccggcagcgcggtgccgc

SEQ ID NO: 3119 - DNA, 16 bp, Homo sapiens
ggccgggcccgggccg

SEQ ID NO: 3120 - DNA, 19 bp, Homo sapiens
gcctggctggcggcgctgc

SEQ ID NO: 3121 - DNA, 18 bp, Homo sapiens
tccgccgagcccggcccg

SEQ ID NO: 3122 - DNA, 23 bp, Homo sapiens
ccggctgggaagcgcggcgccgc

SEQ ID NO: 3123 - DNA, 24 bp, Homo sapiens
cggccgagctgctttacggcgccg

SEQ ID NO: 3124 - DNA, 20 bp, Homo sapiens
cggcgcggtggcggcgccgc

SEQ ID NO: 3125 - DNA, 29 bp, Homo sapiens
tcctgccgagcccgcctcgtgcggcgccg

SEQ ID NO: 3126 - DNA, 19 bp, Homo sapiens
tccggccgggcctggccgc

SEQ ID NO: 3127 - DNA, 22 bp, Homo sapiens
tctcgggtgccggcggcgccgc

SEQ ID NO: 3128 - DNA, 20 bp, Homo sapiens
gccgagcctcaattcgccgc

SEQ ID NO: 3129 - DNA, 23 bp, Homo sapiens
tccagccgggcctccgcggccgc

SEQ ID NO: 3130 - DNA, 20 bp, Homo sapiens
tcgcggcctgggcggcgccg

SEQ ID NO: 3131 - DNA, 21 bp, Homo sapiens
tccagccgggcctgcagctgc

SEQ ID NO: 3132 - DNA, 21 bp, Homo sapiens
cctggccgagcgcagcgccgc

SEQ ID NO: 3133 - DNA, 19 bp, Homo sapiens
tcaggccgggccctcgccg

SEQ ID NO: 3134 - DNA, 18 bp, Homo sapiens
gggggcccggcggcgccg

SEQ ID NO: 3135 - DNA, 73 bp, Alcelaphine herpesvirus 1
ccagcccggggacggggccacctagccagccagcccggggacggggccacctagccagccagcccggggacgg

SEQ ID NO: 3136 - DNA, 70 bp, Macaca mulatta rhadinovirus
ctgctagtagggctgctgggctgctagtagggctcctgggctgctagtagggctgctgggctgctagtag

SEQ ID NO: 3137 - DNA, 24 bp, Macaca mulatta rhadinovirus
ctgctagtagggctgctgggctgc

SEQ ID NO: 3138 - DNA, 22 bp, Homo sapiens
ctgcctggtacccactgggctg

SEQ ID NO: 3139 - DNA, 19 bp, Homo sapiens
ctggtgtggactgggctgc

SEQ ID NO: 3140 - DNA, 18 bp, Homo sapiens
ctgctctttgctgggctg

SEQ ID NO: 3141 - DNA, 18 bp, Homo sapiens
ctgctgtttgctgggctg

SEQ ID NO: 3142 - DNA, 17 bp, Homo sapiens
ctgctgtagggtggctg

SEQ ID NO: 3143 - DNA, 23 bp, Homo sapiens
ctgctactggggctgctctcggc

SEQ ID NO: 3144 - DNA, 20 bp, Homo sapiens
ctgttagtagagttacttgc

SEQ ID NO: 3145 - DNA, 19 bp, Homo sapiens
ctgctgggctgctgggctg

SEQ ID NO: 3146 - DNA, 22 bp, Homo sapiens
ctggtggtgggcagtgggctgc

SEQ ID NO: 3147 - DNA, 21 bp, Homo sapiens
ctgccagtagggctcagttgc

SEQ ID NO: 3148 - DNA, 22 bp, Homo sapiens
ctgctgatcactgctgggctgc

SEQ ID NO: 3149 - DNA, 22 bp, Homo sapiens
ctgctggtggtgctgtccccgg

SEQ ID NO: 3150 - DNA, 18 bp, Homo sapiens
ctgtgggtgggcgggctg

SEQ ID NO: 3151 - DNA, 21 bp, Homo sapiens
ctgctggtggagttcttgctg

SEQ ID NO: 3152 - DNA, 22 bp, Homo sapiens
ctgctggcagggtccacgctgc

SEQ ID NO: 3153 - DNA, 20 bp, Homo sapiens
ctgctggtgggggaaggctg

SEQ ID NO: 3154 - DNA, 16 bp, Homo sapiens
ctagtgccctgggctg

SEQ ID NO: 3155 - DNA, 21 bp, Homo sapiens
ctgctggtgggaagcaggctg

SEQ ID NO: 3156 - DNA, 20 bp, Homo sapiens
ctgctagtcgggctgcgtgc

SEQ ID NO: 3157 - DNA, 21 bp, Homo sapiens
ctgctgggagggctggtatgc

SEQ ID NO: 3158 - DNA, 19 bp, Homo sapiens
ctgctagtcgggctgcgtg

SEQ ID NO: 3159 - DNA, 23 bp, Homo sapiens
ccgctgcggggctgctgggctgc

SEQ ID NO: 3160 - DNA, 19 bp, Homo sapiens
gcctcgggctgctgggctg

SEQ ID NO: 3161 - DNA, 21 bp, Homo sapiens
ctgctggaactgctgggttgc

SEQ ID NO: 3162 - DNA, 22 bp, Homo sapiens
ctcctgtctccctgctgggctg

SEQ ID NO: 3163 - DNA, 19 bp, Homo sapiens
tgctaatagggcagtgctg

SEQ ID NO: 3164 - DNA, 18 bp, Homo sapiens
ctgctggtggagctgctg

SEQ ID NO: 3165 - DNA, 18 bp, Homo sapiens
ctgctactggggctgctg

SEQ ID NO: 3166 - DNA, 19 bp, Homo sapiens
ctgctactggggctgctgg

SEQ ID NO: 3167 - DNA, 25 bp, Homo sapiens
ctgctactggggctgctggagctgc

SEQ ID NO: 3168 - DNA, 23 bp, Homo sapiens
ctgctggcagggcttctacctgc

SEQ ID NO: 3169 - DNA, 16 bp, Homo sapiens
ctgcggtagggccggc

SEQ ID NO: 3170 - DNA, 15 bp, Homo sapiens
ctgctgtgcctgggt

SEQ ID NO: 3171 - DNA, 20 bp, Homo sapiens
ctgctggtagaggtaggctg

SEQ ID NO: 3172 - DNA, 22 bp, Homo sapiens
ctgctggtggagggattggctg

SEQ ID NO: 3173 - DNA, 17 bp, Homo sapiens
ctgctgtggggctgctg

SEQ ID NO: 3174 - DNA, 23 bp, Homo sapiens
tgttagtagagttggggttttgc

SEQ ID NO: 3175 - DNA, 88 bp, Cryphonectria hypovirus
cttgcagttcacccaccatgttcgaatttacccgcccccccgttttggcagggaaacagctttcggctcatggtgtaggaattacaag

SEQ ID NO: 3176 - DNA, 24 bp, Cryphonectria hypovirus
caccatgttcgaatttacccgccc

SEQ ID NO: 3177 - DNA, 17 bp, Homo sapiens
ccatgttcacacctgcc

SEQ ID NO: 3178 - DNA, 17 bp, Homo sapiens
caccatgttgaacgtcc

SEQ ID NO: 3179 - DNA, 15 bp, Homo sapiens
accatgttttcccac

SEQ ID NO: 3180 - DNA, 17 bp, Homo sapiens
caccatgttgaccaggc

SEQ ID NO: 3181 - DNA, 21 bp, Homo sapiens
caccatgttcgttccctgccc

SEQ ID NO: 3182 - DNA, 16 bp, Homo sapiens
ccatgttcgtctgccc

SEQ ID NO: 3183 - DNA, 80 bp, Cryphonectria hypovirus
tgggaagacttgcgcgaccctgagtatttaaaggatttactatccgacactcaggcaatcgacaaagtgcgagtctacca

SEQ ID NO: 3184 - DNA, 24 bp, Cryphonectria hypovirus
accctgagtatttaaaggatttac

SEQ ID NO: 3185 - DNA, 17 bp, Homo sapiens
accctgaggtttagaga

SEQ ID NO: 3186 - DNA, 21 bp, Homo sapiens
acccagtcaatagaggattta

SEQ ID NO: 3187 - DNA, 17 bp, Homo sapiens
ccctgcttgaaggattt

SEQ ID NO: 3188 - DNA, 17 bp, Homo sapiens
ctcaggccaaaggattt

SEQ ID NO: 3189 - DNA, 22 bp, Homo sapiens
cctgggtattttacaggtttac

SEQ ID NO: 3190 - DNA, 16 bp, Homo sapiens
ctgaatatttagactt

SEQ ID NO: 3191 - DNA, 17 bp, Homo sapiens
ccctggtatttaagaaa

SEQ ID NO: 3192 - DNA, 22 bp, Homo sapiens
ctgagtaaaagacaagggttta

SEQ ID NO: 3193 - DNA, 19 bp, Homo sapiens
cctgagtagctgggtttac

SEQ ID NO: 3194 - DNA, 21 bp, Homo sapiens
cctgggtcagcaaaaggattt

SEQ ID NO: 3195 - DNA, 19 bp, Homo sapiens
ctgaatatttgaaatttac

SEQ ID NO: 3196 - DNA, 16 bp, Homo sapiens
cccagagtatttagga

SEQ ID NO: 3197 - DNA, 21 bp, Homo sapiens
ctgagtaaagaagggatttac

SEQ ID NO: 3198 - DNA, 16 bp, Homo sapiens
actctaagtatttgga

SEQ ID NO: 3199 - DNA, 18 bp, Homo sapiens
ctgagtatttgaaactta

SEQ ID NO: 3200 - DNA, 17 bp, Homo sapiens
actctgaatatttaagg

SEQ ID NO: 3201 - DNA, 23 bp, Homo sapiens
accctgaagggctcagaggattt

SEQ ID NO: 3202 - DNA, 18 bp, Homo sapiens
gaattttaaaggatttac

SEQ ID NO: 3203 - DNA, 17 bp, Homo sapiens
accctaagcaaggattt

SEQ ID NO: 3204 - DNA, 16 bp, Homo sapiens
ctgagcagaggattta

SEQ ID NO: 3205 - DNA, 17 bp, Homo sapiens
tgagtatcagggattta

SEQ ID NO: 3206 - DNA, 15 bp, Homo sapiens
ctgataaaggattta

SEQ ID NO: 3207 - DNA, 19 bp, Homo sapiens
cctgaggatttagttagat

SEQ ID NO: 3208 - DNA, 21 bp, Homo sapiens
acccagttctaaaggatttac

SEQ ID NO: 3209 - DNA, 17 bp, Homo sapiens
tgagtattatgaattca

SEQ ID NO: 3210 - DNA, 16 bp, Homo sapiens
ctgagcaaaaggattt

SEQ ID NO: 3211 - DNA, 19 bp, Homo sapiens
acactgagtatttaaagga

SEQ ID NO: 3212 - DNA, 119 bp, Human herpesvirus 6B
tctaatggaaatgcgatggctgttagtgagggacttacacgtgttttatttaacctgtgacggtaaagattcacatgttgtcatgcctttactgcaaacggccgttgaaaactgttggg

SEQ ID NO: 3213 - DNA, 24 bp, Human herpesvirus 6B
ttagtgagggacttacacgtgttt

SEQ ID NO: 3214 - DNA, 20 bp, Homo sapiens
gtgaaggatttctgttgttt

SEQ ID NO: 3215 - DNA, 21 bp, Homo sapiens
ttagtaagtgggtatgtgttt

SEQ ID NO: 3216 - DNA, 21 bp, Homo sapiens
ttagtgagggctgtgatgttt

SEQ ID NO: 3217 - DNA, 18 bp, Homo sapiens
tcagtgaggacatgtgtt

SEQ ID NO: 3218 - DNA, 60 bp, Cryphonectria hypovirus
tcgtgttgctgagctgcttgccgagatccagactctggagcaagcggtctcaaaatacga

SEQ ID NO: 3219 - DNA, 24 bp, Cryphonectria hypovirus
gagctgcttgccgagatccagact

SEQ ID NO: 3220 - DNA, 23 bp, Homo sapiens
gagtagctgccgaaggggtccag

SEQ ID NO: 3221 - DNA, 18 bp, Homo sapiens
gagctatttgccgaagac

SEQ ID NO: 3222 - DNA, 23 bp, Homo sapiens
gagcagggatggaggtccagact

SEQ ID NO: 3223 - DNA, 19 bp, Homo sapiens
gagctgcctgcccaggcag

SEQ ID NO: 3224 - DNA, 19 bp, Homo sapiens
gagctgctcgcctcccaga

SEQ ID NO: 3225 - DNA, 21 bp, Homo sapiens
ggctgcttgccgaaactcaga

SEQ ID NO: 3226 - DNA, 18 bp, Homo sapiens
gagctgctttccgctccc

SEQ ID NO: 3227 - DNA, 19 bp, Homo sapiens
gagctgcttgctcaggtcc

SEQ ID NO: 3228 - DNA, 18 bp, Homo sapiens
gagctgcttctgagaacc

SEQ ID NO: 3229 - DNA, 19 bp, Homo sapiens
gagctgcttttcgaggatc

SEQ ID NO: 3230 - DNA, 18 bp, Homo sapiens
gagctgtcttgctgcaag

SEQ ID NO: 3231 - DNA, 18 bp, Homo sapiens
gagctgctgcacctagac

SEQ ID NO: 3232 - DNA, 18 bp, Homo sapiens
gagcttctaggtccagac

SEQ ID NO: 3233 - DNA, 22 bp, Homo sapiens
gctgcttagccccagccaggct

SEQ ID NO: 3234 - DNA, 21 bp, Homo sapiens
gctgcttgggttgtccaggct

SEQ ID NO: 3235 - DNA, 74 bp, Macaca mulatta rhadinovirus
ataaaccctatatgaggaaattttattagtacgtttgtgtaactgcaaaataaaattttaaataaatactttat

SEQ ID NO: 3236 - DNA, 24 bp, Macaca mulatta rhadinovirus
aggaaattttattagtacgtttgt

SEQ ID NO: 3237 - DNA, 26 bp, Homo sapiens
agaggttttattagttgctggtttgt

SEQ ID NO: 3238 - DNA, 18 bp, Homo sapiens
aggagtttttattagtac

SEQ ID NO: 3239 - DNA, 19 bp, Homo sapiens
ggaagttttattagcacat

SEQ ID NO: 3240 - DNA, 77 bp, Alcelaphine herpesvirus 1
gcatatatccgttttctcctttgtatgaacccggtgggcaagggccacataaaaacattagaggggcaacgggctgc

SEQ ID NO: 3241 - DNA, 24 bp, Alcelaphine herpesvirus 1
tcctttgtatgaacccggtgggca

SEQ ID NO: 3242 - DNA, 21 bp, Homo sapiens
tccggcgggacccggtgggca

SEQ ID NO: 3243 - DNA, 21 bp, Homo sapiens
tccctgtatgagcttggtggg

SEQ ID NO: 3244 - DNA, 22 bp, Homo sapiens
ccctggagctgagcccggtggg

SEQ ID NO: 3245 - DNA, 20 bp, Homo sapiens
ctttgggctggtggtgggca

SEQ ID NO: 3246 - DNA, 22 bp, Homo sapiens
tccttctgtgttttggtgggca

SEQ ID NO: 3247 - DNA, 18 bp, Homo sapiens
tcctttgtaagagtggtg

SEQ ID NO: 3248 - DNA, 21 bp, Homo sapiens
tcctttgtatgataccatgta

SEQ ID NO: 3249 - DNA, 20 bp, Homo sapiens
cttgtatgaattcacctgtg

SEQ ID NO: 3250 - DNA, 19 bp, Homo sapiens
tcctctgtatgaactcagc

SEQ ID NO: 3251 - DNA, 22 bp, Homo sapiens
tcctttgcatgagttcctcgtg

SEQ ID NO: 3252 - DNA, 17 bp, Homo sapiens
tcctttgtgtgtggtgg

SEQ ID NO: 3253 - DNA, 17 bp, Homo sapiens
ctttgtatgagcctgta

SEQ ID NO: 3254 - DNA, 16 bp, Homo sapiens
tttgtatgggtcaggc

SEQ ID NO: 3255 - DNA, 24 bp, Homo sapiens
tcctttgtgctgggtccagaatca

SEQ ID NO: 3256 - DNA, 25 bp, Homo sapiens
tcttttgtatagggtctatcaggca

SEQ ID NO: 3257 - DNA, 20 bp, Homo sapiens
tctgtgggccttggtgggca

SEQ ID NO: 3258 - DNA, 20 bp, Homo sapiens
ctttgctggtttggtgggca

SEQ ID NO: 3259 - DNA, 19 bp, Homo sapiens
tttggttaaatggtgggca

SEQ ID NO: 3260 - DNA, 20 bp, Homo sapiens
ctttgtatcaacatatggca

SEQ ID NO: 3261 - DNA, 76 bp, Cryphonectria hypovirus
ttgcgccacagcggacgtacatcaatcagattcgttacttgactgatgcacacaaagaaaatgccgcatggtacaa

SEQ ID NO: 3262 - DNA, 24 bp, Cryphonectria hypovirus
cagcggacgtacatcaatcagatt

SEQ ID NO: 3263 - DNA, 24 bp, Homo sapiens
cagggacttcaaattgatcagatt

SEQ ID NO: 3264 - DNA, 20 bp, Homo sapiens
agtggagactcaatcagatt

SEQ ID NO: 3265 - DNA, 22 bp, Homo sapiens
agcagatgaatataatcagatt

SEQ ID NO: 3266 - DNA, 20 bp, Homo sapiens
gctatgacgtcgatcagatt

SEQ ID NO: 3267 - DNA, 22 bp, Homo sapiens
gctgggtgtccctaatcagatt

SEQ ID NO: 3268 - DNA, 75 bp, Macaca mulatta rhadinovirus
tgtaacttcacgctaccctaaacgtacaatactgggactagaacccagaggtagttagaatatacggtagttaca

SEQ ID NO: 3269 - DNA, 24 bp, Macaca mulatta rhadinovirus
tcacgctaccctaaacgtacaata

SEQ ID NO: 3270 - DNA, 21 bp, Homo sapiens
tcacgtacttactgtacaata

SEQ ID NO: 3271 - DNA, 18 bp, Homo sapiens
gctactctttgcacaata

SEQ ID NO: 3272 - DNA, 20 bp, Homo sapiens
tcacgctacccaggacacgc

SEQ ID NO: 3273 - DNA, 20 bp, Homo sapiens
gcgactgtaaacgtacaata

SEQ ID NO: 3274 - DNA, 17 bp, Homo sapiens
tcacttaccctaaagca

SEQ ID NO: 3275 - DNA, 19 bp, Homo sapiens
acactttaaacgtacaata

SEQ ID NO: 3276 - DNA, 19 bp, Homo sapiens
accacctaaacgtacaata

SEQ ID NO: 3277 - DNA, 18 bp, Homo sapiens
cgctaccctaagacacgt

SEQ ID NO: 3278 - DNA, 60 bp, Cryphonectria hypovirus
ggccatcttcctcatgatgccgcgatttgtcaagaaatacgcgattggggctgcatggct

SEQ ID NO: 3279 - DNA, 24 bp, Cryphonectria hypovirus
ttcctcatgatgccgcgatttgtc

SEQ ID NO: 3280 - DNA, 22 bp, Homo sapiens
ttcgtcatgatgtccaagctgt

SEQ ID NO: 3281 - DNA, 23 bp, Homo sapiens
ttcttcatgctcagcaatttgtc

SEQ ID NO: 3282 - DNA, 18 bp, Homo sapiens
ttccttttgaggatttgt

SEQ ID NO: 3283 - DNA, 22 bp, Homo sapiens
ttcctcatgggcctgacttgtc

SEQ ID NO: 3284 - DNA, 21 bp, Homo sapiens
ctcatgatcctgaaacaatgt

SEQ ID NO: 3285 - DNA, 19 bp, Homo sapiens
ctcctgtgctgcgatttgt

SEQ ID NO: 3286 - DNA, 16 bp, Homo sapiens
ctcatatcagatttgt

SEQ ID NO: 3287 - DNA, 69 bp, Cryphonectria hypovirus
acacccttacaccgatgataagaccaacgagcagagaataaaccgcgttggcagaatcatgaagggtgt

SEQ ID NO: 3288 - DNA, 22 bp, Cryphonectria hypovirus
ttggcagaatcatgaagggtgt

SEQ ID NO: 3289 - DNA, 18 bp, Homo sapiens
ttggagaatcatgcatgt

SEQ ID NO: 3290 - DNA, 16 bp, Homo sapiens
ttggaggccaagggtg

SEQ ID NO: 3291 - DNA, 17 bp, Homo sapiens
ctggcagagtgagggtg

SEQ ID NO: 3292 - DNA, 17 bp, Homo sapiens
ttggcagaatctgtggt

SEQ ID NO: 3293 - DNA, 19 bp, Homo sapiens
ttgacagaattgtggctat

SEQ ID NO: 3294 - DNA, 19 bp, Homo sapiens
ttggcataatcatgagaac

SEQ ID NO: 3295 - DNA, 20 bp, Homo sapiens
ttggtgaatcatgcactagt

SEQ ID NO: 3296 - DNA, 20 bp, Homo sapiens
ctggcagagccacggggtgt

SEQ ID NO: 3297 - DNA, 20 bp, Homo sapiens
ttggagaatcacagtggtgt

SEQ ID NO: 3298 - DNA, 24 bp, Homo sapiens
ttggcagagcatccctttgggtgt

SEQ ID NO: 3299 - DNA, 19 bp, Homo sapiens
ttggcagaatgatgttagt

SEQ ID NO: 3300 - DNA, 22 bp, Homo sapiens
ttggttaggctctgaagggtgt

SEQ ID NO: 3301 - DNA, 22 bp, Homo sapiens
ttggcagaatacatgaaaaggt

SEQ ID NO: 3302 - DNA, 16 bp, Homo sapiens
tggggaaaaagggtgt

SEQ ID NO: 3303 - DNA, 22 bp, Homo sapiens
tggcagaaggagggaagggtgt

SEQ ID NO: 3304 - DNA, 19 bp, Homo sapiens
ttggcagagccatgttggt

SEQ ID NO: 3305 - DNA, 17 bp, Homo sapiens
ttggcaaatcatgcttg

SEQ ID NO: 3306 - DNA, 17 bp, Homo sapiens
ttgacacctgaagggtg

SEQ ID NO: 3307 - DNA, 19 bp, Homo sapiens
ttggaggtacgaagggtgt

SEQ ID NO: 3308 - DNA, 19 bp, Homo sapiens
ttggcagactgctgggtgt

SEQ ID NO: 3309 - DNA, 19 bp, Homo sapiens
ttggagaattatgaaaggt

SEQ ID NO: 3310 - DNA, 17 bp, Homo sapiens
ttggcagaataaaagtg

SEQ ID NO: 3311 - DNA, 78 bp, Macaca mulatta rhadinovirus
gctgggctgctagtagggctgctgggctgctagtagggctgcctgctggcttgcttgcttgcttgctagtggggccgc

SEQ ID NO: 3312 - DNA, 24 bp, Macaca mulatta rhadinovirus
tggcttgcttgcttgcttgctagt

SEQ ID NO: 3313 - DNA, 22 bp, Homo sapiens
tggttttcttctctttgctagt

SEQ ID NO: 3314 - DNA, 22 bp, Homo sapiens
tggatttgtttgcttgcttgct

SEQ ID NO: 3315 - DNA, 25 bp, Homo sapiens
tggcttgcttttctggcttgctggt

SEQ ID NO: 3316 - DNA, 22 bp, Homo sapiens
tggctgtgcttgcttgctcact

SEQ ID NO: 3317 - DNA, 22 bp, Homo sapiens
tggttttttgtttgcttgcttg

SEQ ID NO: 3318 - DNA, 17 bp, Homo sapiens
tgccttgcttgctgcct

SEQ ID NO: 3319 - DNA, 69 bp, Macaca mulatta rhadinovirus
tcgacaactacctccgaaagtgtgtcctgttggatgttttgtggattaggtaaaacagaaagttgtgga

SEQ ID NO: 3320 - DNA, 24 bp, Macaca mulatta rhadinovirus
tgttttgtggattaggtaaaacag

SEQ ID NO: 3321 - DNA, 23 bp, Homo sapiens
tgttttgtgacattttaaaacag

SEQ ID NO: 3322 - DNA, 19 bp, Homo sapiens
tgttctgtgggattaaaac

SEQ ID NO: 3323 - DNA, 26 bp, Homo sapiens
tgttttgtgtattggtaatccaacag

SEQ ID NO: 3324 - DNA, 19 bp, Homo sapiens
tgttttgtgaggttgtaca

SEQ ID NO: 3325 - DNA, 20 bp, Homo sapiens
tgtttagtggatcattaaaa

SEQ ID NO: 3326 - DNA, 19 bp, Homo sapiens
tattttgtggagtggggca

SEQ ID NO: 3327 - DNA, 21 bp, Homo sapiens
tgttttgtgagcacaaaacag

SEQ ID NO: 3328 - DNA, 17 bp, Homo sapiens
tgtttgtggaggaagca

SEQ ID NO: 3329 - DNA, 18 bp, Homo sapiens
tgttttggggaggaaaca

SEQ ID NO: 3330 - DNA, 20 bp, Homo sapiens
tgttttgtgggatgggataa

SEQ ID NO: 3331 - DNA, 15 bp, Homo sapiens
gttttggggtaaaac

SEQ ID NO: 3332 - DNA, 19 bp, Homo sapiens
tgtttggtggattagaaca

SEQ ID NO: 3333 - DNA, 16 bp, Homo sapiens
tgtgttgtggaagaac

SEQ ID NO: 3334 - DNA, 20 bp, Homo sapiens
tgttttgtggttgtcacggt

SEQ ID NO: 3335 - DNA, 18 bp, Homo sapiens
tgttttgtgggctagagt

SEQ ID NO: 3336 - DNA, 17 bp, Homo sapiens
tattttgtgggaaagca

SEQ ID NO: 3337 - DNA, 18 bp, Homo sapiens
tggtttcaggtaagacag

SEQ ID NO: 3338 - DNA, 61 bp, Cryphonectria hypovirus
gcaccaaccatccttatcgactccggtagagatgtcgtcatccataaaggaaggatggtgc

SEQ ID NO: 3339 - DNA, 17 bp, Cryphonectria hypovirus
taaaggaaggatggtgc

SEQ ID NO: 3340 - DNA, 19 bp, Homo sapiens
taaaggaaagaagagatgc

SEQ ID NO: 3341 - DNA, 19 bp, Homo sapiens
taaagaatgagaatggtgc

SEQ ID NO: 3342 - DNA, 18 bp, Homo sapiens
taaagggagacaatggtg

SEQ ID NO: 3343 - DNA, 18 bp, Homo sapiens
taaaggacaggaagaggc

SEQ ID NO: 3344 - DNA, 18 bp, Homo sapiens
taaaagaaacctgggtgc

SEQ ID NO: 3345 - DNA, 18 bp, Homo sapiens
taaagaaaccaggggtgc

SEQ ID NO: 3346 - DNA, 18 bp, Homo sapiens
taaaggaaccaggggtgc

SEQ ID NO: 3347 - DNA, 19 bp, Homo sapiens
taaagaaaaaagcctggtg

SEQ ID NO: 3348 - DNA, 18 bp, Homo sapiens
aaaagacagtgatggtgc

SEQ ID NO: 3349 - DNA, 19 bp, Homo sapiens
taaaagaaacgtaatggtg

SEQ ID NO: 3350 - DNA, 18 bp, Homo sapiens
taagggaaaacaatggtg

SEQ ID NO: 3351 - DNA, 18 bp, Homo sapiens
taaaggaaagaagaaagc

SEQ ID NO: 3352 - DNA, 18 bp, Homo sapiens
taaaggaaaggaatgtgc

SEQ ID NO: 3353 - DNA, 20 bp, Homo sapiens
aaaggaacggaacatggtgc

SEQ ID NO: 3354 - DNA, 20 bp, Homo sapiens
taaagaaacaggaaatggtg

SEQ ID NO: 3355 - DNA, 18 bp, Homo sapiens
taaaggaagaacatttgc

SEQ ID NO: 3356 - DNA, 20 bp, Homo sapiens
aagagaaggacatgtggtgc

SEQ ID NO: 3357 - DNA, 18 bp, Homo sapiens
caaaggatggacttggtg

SEQ ID NO: 3358 - DNA, 18 bp, Homo sapiens
caaaggaagggtgggtgc

SEQ ID NO: 3359 - DNA, 88 bp, Cryphonectria hypovirus
cctagtggtatgttcttttcatctgagttagtggccaagcaatacaaggttgctcaactaactcccgttgaaaatcccatccacccgg

SEQ ID NO: 3360 - DNA, 24 bp, Cryphonectria hypovirus
tgagttagtggccaagcaatacaa

SEQ ID NO: 3361 - DNA, 19 bp, Homo sapiens
tgagttatgaccaatacaa

SEQ ID NO: 3362 - DNA, 17 bp, Homo sapiens
tgagtcagtggtcagca

SEQ ID NO: 3363 - DNA, 21 bp, Homo sapiens
tgagttagttggctagaaata

SEQ ID NO: 3364 - DNA, 18 bp, Homo sapiens
agttagtggctaagtcaa

SEQ ID NO: 3365 - DNA, 24 bp, Homo sapiens
tgtagtttgacttgggcaatacaa

SEQ ID NO: 3366 - DNA, 22 bp, Homo sapiens
tgggtcagtggtcatcttggca

SEQ ID NO: 3367 - DNA, 18 bp, Homo sapiens
tgggtgagtggccaagca

SEQ ID NO: 3368 - DNA, 19 bp, Homo sapiens
tggattaataagcaataca

SEQ ID NO: 3369 - DNA, 23 bp, Homo sapiens
tgagctagtggctcccacataca

SEQ ID NO: 3370 - DNA, 22 bp, Homo sapiens
tgagctaggctgggcagtacaa

SEQ ID NO: 3371 - DNA, 21 bp, Homo sapiens
tgaggtagaagtcaagcaata

SEQ ID NO: 3372 - DNA, 17 bp, Homo sapiens
tgggtcagtggccagca

SEQ ID NO: 3373 - DNA, 21 bp, Homo sapiens
tgattagtggttccattgcaa

SEQ ID NO: 3374 - DNA, 18 bp, Homo sapiens
gagttaggtaagtaatac

SEQ ID NO: 3375 - DNA, 61 bp, Cryphonectria hypovirus
ctggaactggtggaacttgtctatgcgcaaattacagaggacgaggaacaccgtataccag

SEQ ID NO: 3376 - DNA, 23 bp, Cryphonectria hypovirus
ggacgaggaacaccgtataccag

SEQ ID NO: 3377 - DNA, 22 bp, Homo sapiens
ggatgggagaccagtataccag

SEQ ID NO: 3378 - DNA, 21 bp, Homo sapiens
ggacgaggagcatgctgcaca

SEQ ID NO: 3379 - DNA, 21 bp, Homo sapiens
ggggaggaacaactggtgtac

SEQ ID NO: 3380 - DNA, 18 bp, Homo sapiens
ggacgagggtaggaacca

SEQ ID NO: 3381 - DNA, 23 bp, Homo sapiens
ggaaggggaacatcacacaccag

SEQ ID NO: 3382 - DNA, 23 bp, Homo sapiens
gaacgaggaacgtatgtgtccag

SEQ ID NO: 3383 - DNA, 19 bp, Homo sapiens
ggacaaggagcatgcatcc

SEQ ID NO: 3384 - DNA, 21 bp, Homo sapiens
ggacagggacacacataccag

SEQ ID NO: 3385 - DNA, 16 bp, Homo sapiens
ggcaggaacactgcca

SEQ ID NO: 3386 - DNA, 21 bp, Homo sapiens
gacgaggagcacacaatccag

SEQ ID NO: 3387 - DNA, 21 bp, Homo sapiens
ggacgagggagcaatgaccag

SEQ ID NO: 3388 - DNA, 19 bp, Homo sapiens
ggcgggaggcccataccag

SEQ ID NO: 3389 - DNA, 21 bp, Homo sapiens
ggacgaggacgctggagccag

SEQ ID NO: 3390 - DNA, 18 bp, Homo sapiens
gaacggggaacaccagca

SEQ ID NO: 3391 - DNA, 22 bp, Homo sapiens
ggaggggaacatcacacaccag

SEQ ID NO: 3392 - DNA, 16 bp, Homo sapiens
ggcaggaacactatcc

SEQ ID NO: 3393 - DNA, 22 bp, Homo sapiens
ggacgaggaagacagcaaccag

SEQ ID NO: 3394 - DNA, 20 bp, Homo sapiens
ggacgaagggcgctgcccag

SEQ ID NO: 3395 - DNA, 24 bp, Homo sapiens
ggacaaggggcaccaaaaagccag

SEQ ID NO: 3396 - DNA, 22 bp, Homo sapiens
ggggaggaacaggtacagccag

SEQ ID NO: 3397 - DNA, 18 bp, Homo sapiens
gggaggaacacgcagtcc

SEQ ID NO: 3398 - DNA, 19 bp, Homo sapiens
ggacgaggatcaaacacac

SEQ ID NO: 3399 - DNA, 16 bp, Homo sapiens
ggagaggggcacacca

SEQ ID NO: 3400 - DNA, 21 bp, Homo sapiens
ggaaggggaacatcacacacc

SEQ ID NO: 3401 - DNA, 22 bp, Homo sapiens
ggcggggaacatcacacaccag

SEQ ID NO: 3402 - DNA, 21 bp, Homo sapiens
ggcaaggaacagaatagccag

SEQ ID NO: 3403 - DNA, 21 bp, Homo sapiens
ggtgaggaacatggccctcag

SEQ ID NO: 3404 - DNA, 21 bp, Homo sapiens
ggaaggggaacgtcacacacc

SEQ ID NO: 3405 - DNA, 19 bp, Homo sapiens
ggaggggaacacctcccag

SEQ ID NO: 3406 - DNA, 63 bp, Cryphonectria hypovirus
ggacgcgggaatttccttgatgattacgagaacttcgtttcaggcatcaaggttcctgccgcc

SEQ ID NO: 3407 - DNA, 22 bp, Cryphonectria hypovirus
aggcatcaaggttcctgccgcc

SEQ ID NO: 3408 - DNA, 17 bp, Homo sapiens
gacacctcactgccgcc

SEQ ID NO: 3409 - DNA, 20 bp, Homo sapiens
aggcgcagtcagctgccgcc

SEQ ID NO: 3410 - DNA, 18 bp, Homo sapiens
ggcatctgccctgccgcc

SEQ ID NO: 3411 - DNA, 19 bp, Homo sapiens
aggcaaagttcctgctgcc

SEQ ID NO: 3412 - DNA, 20 bp, Homo sapiens
aggcgctcgggtctgccgcc

SEQ ID NO: 3413 - DNA, 18 bp, Homo sapiens
ggcatgaaggtcccttgc

SEQ ID NO: 3414 - DNA, 15 bp, Homo sapiens
ggcaccgtctgccgc

SEQ ID NO: 3415 - DNA, 18 bp, Homo sapiens
ggcgctcaggctgccgcc

SEQ ID NO: 3416 - DNA, 16 bp, Homo sapiens
aggcctcagctgccgc

SEQ ID NO: 3417 - DNA, 19 bp, Homo sapiens
aggcacaaggttcaacagc

SEQ ID NO: 3418 - DNA, 15 bp, Homo sapiens
ggcacaaggtaccgc

SEQ ID NO: 3419 - DNA, 17 bp, Homo sapiens
aggcatgggctgctgcc

SEQ ID NO: 3420 - DNA, 22 bp, Homo sapiens
aagcatcccaccgcctgctgcc

SEQ ID NO: 3421 - DNA, 17 bp, Homo sapiens
aggcttcaaggtctgcc

SEQ ID NO: 3422 - DNA, 19 bp, Homo sapiens
agcattttcctttgccgcc

SEQ ID NO: 3423 - DNA, 15 bp, Homo sapiens
aggcatcaagactgc

SEQ ID NO: 3424 - DNA, 16 bp, Homo sapiens
aggcatcaggtttgcc

SEQ ID NO: 3425 - DNA, 20 bp, Homo sapiens
ggcgctcaggggctgccgcc

SEQ ID NO: 3426 - DNA, 21 bp, Homo sapiens
aggcaccagcacgatgccgcc

SEQ ID NO: 3427 - DNA, 17 bp, Homo sapiens
ggtatcagggttcaccg

SEQ ID NO: 3428 - DNA, 20 bp, Homo sapiens
ggctctcggttcctgccgcc

SEQ ID NO: 3429 - DNA, 19 bp, Homo sapiens
aagcatcaacccttcctgc

SEQ ID NO: 3430 - DNA, 16 bp, Homo sapiens
aggcatcagggtttgc

SEQ ID NO: 3431 - DNA, 16 bp, Homo sapiens
ggctccttcctgccgc

SEQ ID NO: 3432 - DNA, 17 bp, Homo sapiens
aggcatcggcgagccgc

SEQ ID NO: 3433 - DNA, 19 bp, Homo sapiens
agggatcagggaacctcgc

SEQ ID NO: 3434 - DNA, 19 bp, Homo sapiens
ggccgtcacgccctgccgc

SEQ ID NO: 3435 - DNA, 24 bp, Homo sapiens
aggcctcaggtgcttcttgctgcc

SEQ ID NO: 3436 - DNA, 17 bp, Homo sapiens
ggcagcttcctgctgcc

SEQ ID NO: 3437 - DNA, 18 bp, Homo sapiens
aggctcaaagttgctgcc

SEQ ID NO: 3438 - DNA, 17 bp, Homo sapiens
ggcagagcttcctgccg

SEQ ID NO: 3439 - DNA, 20 bp, Homo sapiens
agacatcacccggctgccgc

SEQ ID NO: 3440 - DNA, 21 bp, Homo sapiens
ggtcattaaggttccatgtgc

SEQ ID NO: 3441 - DNA, 17 bp, Homo sapiens
aggcaccagggcgccgc

SEQ ID NO: 3442 - DNA, 20 bp, Homo sapiens
aggcgccccctgccctgccg

SEQ ID NO: 3443 - DNA, 21 bp, Homo sapiens
agtcattttcatcctgccgcc

SEQ ID NO: 3444 - DNA, 17 bp, Homo sapiens
aggttcaaggctttgcc

SEQ ID NO: 3445 - DNA, 19 bp, Homo sapiens
aggttcacgagatttgccg

SEQ ID NO: 3446 - DNA, 20 bp, Homo sapiens
agccaggccttcctgccgcc

SEQ ID NO: 3447 - DNA, 18 bp, Homo sapiens
ggcgtcaagcctgctgcc

SEQ ID NO: 3448 - DNA, 21 bp, Homo sapiens
ggttcaagtgattctgccgcc

SEQ ID NO: 3449 - DNA, 17 bp, Homo sapiens
ggcagcagcccctgccg

SEQ ID NO: 3450 - DNA, 19 bp, Homo sapiens
agcatcaagggcacctgcc

SEQ ID NO: 3451 - DNA, 19 bp, Homo sapiens
ggcatcaagagaacgctgc

SEQ ID NO: 3452 - DNA, 20 bp, Homo sapiens
gccctgcggttcctgccgcc

SEQ ID NO: 3453 - DNA, 20 bp, Homo sapiens
ggctcaagtgatcttgctgc

SEQ ID NO: 3454 - DNA, 17 bp, Homo sapiens
agacatcttcctgttgc

SEQ ID NO: 3455 - DNA, 18 bp, Homo sapiens
aagcatcattcctgctgc

SEQ ID NO: 3456 - DNA, 18 bp, Homo sapiens
agccatcaaggggctgcc

SEQ ID NO: 3457 - DNA, 19 bp, Homo sapiens
ggcactgccagctgccgcc

SEQ ID NO: 3458 - DNA, 22 bp, Homo sapiens
aggctcagccgcctctgccgcc

SEQ ID NO: 3459 - DNA, 17 bp, Homo sapiens
gcgtctcctctgccgcc

SEQ ID NO: 3460 - DNA, 17 bp, Homo sapiens
aggctcaaggtcctgcc

SEQ ID NO: 3461 - DNA, 18 bp, Homo sapiens
ggcagtcaagatgccgcc

SEQ ID NO: 3462 - DNA, 17 bp, Homo sapiens
aggcatcaggatctgcc

SEQ ID NO: 3463 - DNA, 17 bp, Homo sapiens
aggcggcaaagtgccgc

SEQ ID NO: 3464 - DNA, 15 bp, Homo sapiens
aggctcagctcctgc

SEQ ID NO: 3465 - DNA, 19 bp, Homo sapiens
agcatcaaggtttacaacc

SEQ ID NO: 3466 - DNA, 21 bp, Homo sapiens
ggctgccctatttctgccgcc

SEQ ID NO: 3467 - DNA, 20 bp, Homo sapiens
ggcatcaagcttctgctgcc

SEQ ID NO: 3468 - DNA, 18 bp, Homo sapiens
ggcaccaaggccactgcc

SEQ ID NO: 3469 - DNA, 17 bp, Homo sapiens
aggcaccaaggctttgc

SEQ ID NO: 3470 - DNA, 19 bp, Homo sapiens
aggctcagggtctcccgcc

SEQ ID NO: 3471 - DNA, 18 bp, Homo sapiens
ggcggccgacctgctgcc

SEQ ID NO: 3472 - DNA, 17 bp, Homo sapiens
aggcagcaaggtccgcc

SEQ ID NO: 3473 - DNA, 20 bp, Homo sapiens
ggcattaaggtcaggttgcc

SEQ ID NO: 3474 - DNA, 19 bp, Homo sapiens
agatatcctctctgccgcc

SEQ ID NO: 3475 - DNA, 16 bp, Homo sapiens
aggcatcaggctctgc

SEQ ID NO: 3476 - DNA, 18 bp, Homo sapiens
ggcattgagtttcctgcc

SEQ ID NO: 3477 - DNA, 24 bp, Homo sapiens
aggtttcaagtcccagctgctgcc

SEQ ID NO: 3478 - DNA, 18 bp, Homo sapiens
aggctcagttcctgctgc

SEQ ID NO: 3479 - DNA, 16 bp, Homo sapiens
agacatcaggcccggc

SEQ ID NO: 3480 - DNA, 19 bp, Homo sapiens
ggccgtcacaccctgccgc

SEQ ID NO: 3481 - DNA, 18 bp, Homo sapiens
aggcaccagcggtgccgc

SEQ ID NO: 3482 - DNA, 16 bp, Homo sapiens
ggcatctggccgccgc

SEQ ID NO: 3483 - DNA, 20 bp, Homo sapiens
aggcagtgaggccccctgcc

SEQ ID NO: 3484 - DNA, 19 bp, Homo sapiens
aggcagcaggggccccgcc

SEQ ID NO: 3485 - DNA, 18 bp, Homo sapiens
aggtttcaaggccctgcc

SEQ ID NO: 3486 - DNA, 19 bp, Homo sapiens
aggcatcaaggtctagacc

SEQ ID NO: 3487 - DNA, 20 bp, Homo sapiens
aggtgcagggacctgccgcc

SEQ ID NO: 3488 - DNA, 17 bp, Homo sapiens
aggcaccaaggtcacgc

SEQ ID NO: 3489 - DNA, 19 bp, Homo sapiens
ggtgtcaaggctctgaggc

SEQ ID NO: 3490 - DNA, 18 bp, Homo sapiens
aggcatcaaggttaacac

SEQ ID NO: 3491 - DNA, 20 bp, Homo sapiens
ggcgcgctcccgctgccgcc

SEQ ID NO: 3492 - DNA, 22 bp, Homo sapiens
aggcaccagatggcactgctgc

SEQ ID NO: 3493 - DNA, 17 bp, Homo sapiens
agacatcaaatgctgcc

SEQ ID NO: 3494 - DNA, 15 bp, Homo sapiens
agcacgactgccgcc

SEQ ID NO: 3495 - DNA, 16 bp, Homo sapiens
aggatcaggccgccgc

SEQ ID NO: 3496 - DNA, 19 bp, Homo sapiens
aagcatcctctctgccgcc

SEQ ID NO: 3497 - DNA, 19 bp, Homo sapiens
aggcgctggtgctgccgcc

SEQ ID NO: 3498 - DNA, 18 bp, Homo sapiens
ggcatggagtcccgccgc

SEQ ID NO: 3499 - DNA, 109 bp, Murid herpesvirus 4
acaagctctgtcagattcaaaaaataattggtggccaacttctagaaaataatacccaaacaccttgcgctctcacgctggaacttgaacacttgctctgtaatgctgt

SEQ ID NO: 3500 - DNA, 24 bp, Murid herpesvirus 4
tctgtcagattcaaaaaataattg

SEQ ID NO: 3501 - DNA, 20 bp, Homo sapiens
tctttcagattcaaggaaca

SEQ ID NO: 3502 - DNA, 23 bp, Homo sapiens
tctgtcagtttgaaaatgcattg

SEQ ID NO: 3503 - DNA, 21 bp, Homo sapiens
tctgtcagttacaggtaattg

SEQ ID NO: 3504 - DNA, 20 bp, Homo sapiens
tctgtcagattttaagaata

SEQ ID NO: 3505 - DNA, 26 bp, Homo sapiens
tctatgcagtatttaaaaaataattg

SEQ ID NO: 3506 - DNA, 19 bp, Homo sapiens
tctgttagttcaaaatata

SEQ ID NO: 3507 - DNA, 23 bp, Homo sapiens
tcaacaaattcaaaaggtaattg

SEQ ID NO: 3508 - DNA, 21 bp, Homo sapiens
tctgcagattgggaataattg

SEQ ID NO: 3509 - DNA, 88 bp, Cryphonectria hypovirus 1
gaggtgtcggttgacggaaagagttttggccagggcggcaaccgttatagattcgtctttcgctatgactctttgctgtcgacacctt

SEQ ID NO: 3510 - DNA, 24 bp, Cryphonectria hypovirus 1
tgacggaaagagttttggccaggg

SEQ ID NO: 3511 - DNA, 19 bp, Homo sapiens
ggaaggacactggccaggg

SEQ ID NO: 3512 - DNA, 18 bp, Homo sapiens
gatggagggagagccagg

SEQ ID NO: 3513 - DNA, 18 bp, Homo sapiens
tgaggggaggaggccagg

SEQ ID NO: 3514 - DNA, 20 bp, Homo sapiens
ggagaggcggaggaccaggg

SEQ ID NO: 3515 - DNA, 24 bp, Homo sapiens
tggcggagggaggcggatcccggg

SEQ ID NO: 3516 - DNA, 20 bp, Homo sapiens
cgaggacaacctggccaggg

SEQ ID NO: 3517 - DNA, 18 bp, Homo sapiens
ggaagagccaggtcaggg

SEQ ID NO: 3518 - DNA, 18 bp, Homo sapiens
ggaaagttccaggcaggg

SEQ ID NO: 3519 - DNA, 20 bp, Homo sapiens
gatgggaagcagggccaggg

SEQ ID NO: 3520 - DNA, 22 bp, Homo sapiens
cggtggggagccccggctaggg

SEQ ID NO: 3521 - DNA, 23 bp, Homo sapiens
ggtgtaggtttgcttggccaggg

SEQ ID NO: 3522 - DNA, 22 bp, Homo sapiens
gacggaaagtccccggctgggg

SEQ ID NO: 3523 - DNA, 18 bp, Homo sapiens
tgacggacaatggccagg

SEQ ID NO: 3524 - DNA, 22 bp, Homo sapiens
tgacagaaggagaatatcgggg

SEQ ID NO: 3525 - DNA, 21 bp, Homo sapiens
tggcgggcaaggtggccaggg

SEQ ID NO: 3526 - DNA, 19 bp, Homo sapiens
tggcggcaaggggaccagg

SEQ ID NO: 3527 - DNA, 18 bp, Homo sapiens
tgagggaaagaagctggg

SEQ ID NO: 3528 - DNA, 22 bp, Homo sapiens
tgacagagagatggagccaggg

SEQ ID NO: 3529 - DNA, 21 bp, Homo sapiens
tgaggaaggggagggccaggg

SEQ ID NO: 3530 - DNA, 22 bp, Homo sapiens
tgaagggaaggtggggccaggg

SEQ ID NO: 3531 - DNA, 20 bp, Homo sapiens
gaaagagtccctgctcaggg

SEQ ID NO: 3532 - DNA, 18 bp, Homo sapiens
ggaaagtggtggccaggg

SEQ ID NO: 3533 - DNA, 24 bp, Homo sapiens
tgaaggaaagagtttgtggttggg

SEQ ID NO: 3534 - DNA, 16 bp, Homo sapiens
tgactgggagggccag

SEQ ID NO: 3535 - DNA, 24 bp, Homo sapiens
tggcgggtggaagtgtggccaggg

SEQ ID NO: 3536 - DNA, 19 bp, Homo sapiens
tgaggggaagaaagccagg

SEQ ID NO: 3537 - DNA, 18 bp, Homo sapiens
tgagggaggctggccagg

SEQ ID NO: 3538 - DNA, 22 bp, Homo sapiens
tggcaggaagagttttgtgggg

SEQ ID NO: 3539 - DNA, 20 bp, Homo sapiens
ggaaggagttttggtcaggg

SEQ ID NO: 3540 - DNA, 19 bp, Homo sapiens
gatggaattttggtcaggg

SEQ ID NO: 3541 - DNA, 18 bp, Homo sapiens
tgaggggaggaagccagg

SEQ ID NO: 3542 - DNA, 18 bp, Homo sapiens
gatggagagggggccagg

SEQ ID NO: 3543 - DNA, 22 bp, Homo sapiens
gatagagggtgactggccaggg

SEQ ID NO: 3544 - DNA, 24 bp, Homo sapiens
tgacgaaggaggtgcgagccgggg

SEQ ID NO: 3545 - DNA, 22 bp, Homo sapiens
tgacggggggagtgacaaaggg

SEQ ID NO: 3546 - DNA, 23 bp, Homo sapiens
tgagggaagggttccggcccggg

SEQ ID NO: 3547 - DNA, 19 bp, Homo sapiens
ggaagggtcacagccaggg

SEQ ID NO: 3548 - DNA, 17 bp, Homo sapiens
gatgggaagaggccagg

SEQ ID NO: 3549 - DNA, 17 bp, Homo sapiens
ggaagttctggccaggg

SEQ ID NO: 3550 - DNA, 103 bp, Cryphonectria hypovirus 1
gtccgattcgatacaagaaccctgtcatgtctcaccaggctgccgaaatctgtggattgaagcctggggagtatgaagtggatgataggtatcaggaaaggat

SEQ ID NO: 3551 - DNA, 24 bp, Cryphonectria hypovirus 1
ttgaagcctggggagtatgaagtg

SEQ ID NO: 3552 - DNA, 26 bp, Homo sapiens
ttggggcctggagaccaatggaagtg

SEQ ID NO: 3553 - DNA, 24 bp, Homo sapiens
tgaagcatatttgagtatggagtg

SEQ ID NO: 3554 - DNA, 20 bp, Homo sapiens
ttgaagccctggggagtctg

SEQ ID NO: 3555 - DNA, 24 bp, Homo sapiens
tcgaagttttccttgtatgaagtg

SEQ ID NO: 3556 - DNA, 19 bp, Homo sapiens
ttgaagcctgggggtgcat

SEQ ID NO: 3557 - DNA, 19 bp, Homo sapiens
ctggagcctggggaaagtg

SEQ ID NO: 3558 - DNA, 22 bp, Homo sapiens
ttggggcctggggagggaagtg

SEQ ID NO: 3559 - DNA, 19 bp, Homo sapiens
ttgaggtccggggagtaga

SEQ ID NO: 3560 - DNA, 21 bp, Homo sapiens
ttgagcctgggggcacaggtg

SEQ ID NO: 3561 - DNA, 23 bp, Homo sapiens
ttggggcctggggggcttgggtg

SEQ ID NO: 3562 - DNA, 22 bp, Homo sapiens
aaagaggtgggagtgtggggtg

SEQ ID NO: 3563 - DNA, 23 bp, Homo sapiens
ttggggctgggaacactggagtg

SEQ ID NO: 3564 - DNA, 63 bp, Saimiriine herpesvirus 2
ttttaattcttgtaacaaatgtactagtaatattttctactaatggccctacgggagttagaa

SEQ ID NO: 3565 - DNA, 24 bp, Saimiriine herpesvirus 2
attcttgtaacaaatgtactagta

SEQ ID NO: 3566 - DNA, 17 bp, Homo sapiens
attcttgagcaaatgta

SEQ ID NO: 3567 - DNA, 23 bp, Homo sapiens
attcttataacaaatttactgta

SEQ ID NO: 3568 - DNA, 22 bp, Homo sapiens
tgcttacctagatgtactagta

SEQ ID NO: 3569 - DNA, 20 bp, Homo sapiens
ttcatgtaacactactagta

SEQ ID NO: 3570 - DNA, 16 bp, Homo sapiens
tcttgtagtacttagt

SEQ ID NO: 3571 - DNA, 18 bp, Homo sapiens
atttttgtaactactagt

SEQ ID NO: 3572 - DNA, 68 bp, Cryphonectria hypovirus 1
tcattgacaacttcaagatttgcttccccgtaaacgggaaatggatctatggtcaagggttgtcatgg

SEQ ID NO: 3573 - DNA, 24 bp, Cryphonectria hypovirus 1
atggatctatggtcaagggttgtc

SEQ ID NO: 3574 - DNA, 18 bp, Homo sapiens
tgggtctatggtcagggc

SEQ ID NO: 3575 - DNA, 20 bp, Homo sapiens
tggggttgggcaagggttgt

SEQ ID NO: 3576 - DNA, 19 bp, Homo sapiens
atgggtaagtaagggttgt

SEQ ID NO: 3577 - DNA, 21 bp, Homo sapiens
atggagttatgttaggttgtc

SEQ ID NO: 3578 - DNA, 21 bp, Homo sapiens
tggataacattgggggttgtc

SEQ ID NO: 3579 - DNA, 18 bp, Homo sapiens
atggtcttggggggttgt

SEQ ID NO: 3580 - DNA, 21 bp, Homo sapiens
tggatttttggtcaaaatgtt

SEQ ID NO: 3581 - DNA, 18 bp, Homo sapiens
tggatttgtgtcaagagc

SEQ ID NO: 3582 - DNA, 74 bp, Cryphonectria hypovirus 1
ggcgatgcctccgttccaacctctctattgtccaaccgacagcacgcgaggttctggaacgagaaggacatccc

SEQ ID NO: 3583 - DNA, 24 bp, Cryphonectria hypovirus 1
cagcacgcgaggttctggaacgag

SEQ ID NO: 3584 - DNA, 23 bp, Homo sapiens
caggctgttcgttctggaatgag

SEQ ID NO: 3585 - DNA, 16 bp, Homo sapiens
cagcggcgactccgga

SEQ ID NO: 3586 - DNA, 23 bp, Homo sapiens
cagcacgagacgggtgggatgag

SEQ ID NO: 3587 - DNA, 22 bp, Homo sapiens
acacgcggggtgaaggaacgag

SEQ ID NO: 3588 - DNA, 19 bp, Homo sapiens
gcgaggctgctgggatgag

SEQ ID NO: 3589 - DNA, 19 bp, Homo sapiens
cagcacgccaagagactgg

SEQ ID NO: 3590 - DNA, 17 bp, Homo sapiens
cgcgaggcggcgacgag

SEQ ID NO: 3591 - DNA, 20 bp, Homo sapiens
gcagcaaactctgggacgag

SEQ ID NO: 3592 - DNA, 18 bp, Homo sapiens
gcggggccctggggcgag

SEQ ID NO: 3593 - DNA, 17 bp, Homo sapiens
cgcgaggtcccggcgag

SEQ ID NO: 3594 - DNA, 19 bp, Homo sapiens
gcggcggggactccgggcg

SEQ ID NO: 3595 - DNA, 21 bp, Homo sapiens
gcccgcgaggccaggggcgag

SEQ ID NO: 3596 - DNA, 18 bp, Homo sapiens
cagcacgcagctgagcga

SEQ ID NO: 3597 - DNA, 18 bp, Homo sapiens
agcatgcgaggtccgcgg

SEQ ID NO: 3598 - DNA, 19 bp, Homo sapiens
cagcacatggggaggacga

SEQ ID NO: 3599 - DNA, 20 bp, Homo sapiens
gctgtgggttctggaacgag

SEQ ID NO: 3600 - DNA, 17 bp, Homo sapiens
gcaccgggtcctgggcg

SEQ ID NO: 3601 - DNA, 17 bp, Homo sapiens
cagcgcgaggggtcacg

SEQ ID NO: 3602 - DNA, 19 bp, Homo sapiens
cagagaggaggttctggaa

SEQ ID NO: 3603 - DNA, 18 bp, Homo sapiens
cagcacgtcctggagtga

SEQ ID NO: 3604 - DNA, 18 bp, Homo sapiens
gctgaggccctgggcgag

SEQ ID NO: 3605 - DNA, 20 bp, Homo sapiens
agcacggactctgggatgag

SEQ ID NO: 3606 - DNA, 23 bp, Homo sapiens
gcgcgcgaggccgctggaacgag

SEQ ID NO: 3607 - DNA, 25 bp, Homo sapiens
cagtgggcgggtggcgtggggcgag

SEQ ID NO: 3608 - DNA, 17 bp, Homo sapiens
gcgcgctaggttggcga

SEQ ID NO: 3609 - DNA, 19 bp, Homo sapiens
cagcacgcaggccaagtgg

SEQ ID NO: 3610 - DNA, 77 bp, Molluscum contagiosum virus
tgcttgttttgtgccccgggacaacaacggtttgccccgcgaagaactgttcgtgcctgcacgcacgagacaaagca

SEQ ID NO: 3611 - DNA, 24 bp, Molluscum contagiosum virus
ttcgtgcctgcacgcacgagacaa

SEQ ID NO: 3612 - DNA, 19 bp, Homo sapiens
gtgcctgcactgtgaacca

SEQ ID NO: 3613 - DNA, 18 bp, Homo sapiens
ttcatgcttgcacgcaca

SEQ ID NO: 3614 - DNA, 17 bp, Homo sapiens
ttcctgcctgcagcaga

SEQ ID NO: 3615 - DNA, 16 bp, Homo sapiens
gtgcctgcggcagaca

SEQ ID NO: 3616 - DNA, 20 bp, Homo sapiens
ttcgtgcctgtggcctacga

SEQ ID NO: 3617 - DNA, 16 bp, Homo sapiens
ttcttgcctgcaaaga

SEQ ID NO: 3618 - DNA, 17 bp, Homo sapiens
gtacctgcttcgagaca

SEQ ID NO: 3619 - DNA, 61 bp, Murid herpesvirus 4
accggtccttgagaaagtatacgccctcgccttttgagttgttatttactggaggcctggt

SEQ ID NO: 3620 - DNA, 24 bp, Murid herpesvirus 4
tccttgagaaagtatacgccctcg

SEQ ID NO: 3621 - DNA, 23 bp, Homo sapiens
tccttgaagcagccacgttttcg

SEQ ID NO: 3622 - DNA, 17 bp, Homo sapiens
cccttgagaaatgtcct

SEQ ID NO: 3623 - DNA, 18 bp, Homo sapiens
tccttgagcagagtcctc

SEQ ID NO: 3624 - DNA, 17 bp, Homo sapiens
ctgagaaaagctgccct

SEQ ID NO: 3625 - DNA, 21 bp, Homo sapiens
tccttgaagttttcgttctcg

SEQ ID NO: 3626 - DNA, 25 bp, Homo sapiens
tcctcgagggcttcctgcgctctcg

SEQ ID NO: 3627 - DNA, 15 bp, Homo sapiens
cctgagaaagccctc

SEQ ID NO: 3628 - DNA, 21 bp, Homo sapiens
cttgagaaagtggcaccctcg

SEQ ID NO: 3629 - DNA, 19 bp, Homo sapiens
tctctgagaaagtggcttc

SEQ ID NO: 3630 - DNA, 20 bp, Homo sapiens
tgagaaagtgtgtatatgcc

SEQ ID NO: 3631 - DNA, 22 bp, Homo sapiens
tccttgagggaagtaggctctc

SEQ ID NO: 3632 - DNA, 60 bp, Cryphonectria hypovirus 1
gtgacccgtcatccacgctcttgatcccgacaatgggaacaagaggagatcacgtgccac

SEQ ID NO: 3633 - DNA, 24 bp, Cryphonectria hypovirus 1
cccgtcatccacgctcttgatccc

SEQ ID NO: 3634 - DNA, 21 bp, Homo sapiens
cctgtcatccactgtcctccc

SEQ ID NO: 3635 - DNA, 21 bp, Homo sapiens
cctcgtccacgccgtcatccc

SEQ ID NO: 3636 - DNA, 17 bp, Homo sapiens
cccgtcgtcctgctccc

SEQ ID NO: 3637 - DNA, 22 bp, Homo sapiens
ccgccccttcgcgctcttggtc

SEQ ID NO: 3638 - DNA, 16 bp, Homo sapiens
cctgtcaccccttgat

SEQ ID NO: 3639 - DNA, 19 bp, Homo sapiens
gtttccaatccctttgatc

SEQ ID NO: 3640 - DNA, 18 bp, Homo sapiens
tcatccacgttcgctccc

SEQ ID NO: 3641 - DNA, 18 bp, Homo sapiens
cccgtcatcccgtgtctt

SEQ ID NO: 3642 - DNA, 16 bp, Homo sapiens
atctcctaccttgatc

SEQ ID NO: 3643 - DNA, 21 bp, Homo sapiens
cctgctcagcttcttgatccc

SEQ ID NO: 3644 - DNA, 19 bp, Homo sapiens
cctttatccacgcattgat

SEQ ID NO: 3645 - DNA, 19 bp, Homo sapiens
ccgtcaccataatgattcc

SEQ ID NO: 3646 - DNA, 22 bp, Homo sapiens
cccgtcatccgtttccaatccc

SEQ ID NO: 3647 - DNA, 21 bp, Homo sapiens
cctgtctccatgtcgcctccc

SEQ ID NO: 3648 - DNA, 19 bp, Homo sapiens
ccatcatccatgcccttcc

SEQ ID NO: 3649 - DNA, 21 bp, Homo sapiens
ccgtcatccacagaggattcc

SEQ ID NO: 3650 - DNA, 23 bp, Homo sapiens
cctgtcatccacgctgccatccc

SEQ ID NO: 3651 - DNA, 20 bp, Homo sapiens
cccgtcatgcacagatgatc

SEQ ID NO: 3652 - DNA, 19 bp, Homo sapiens
cccgccatccacgtcttcc

SEQ ID NO: 3653 - DNA, 15 bp, Homo sapiens
catcatccacttgat

SEQ ID NO: 3654 - DNA, 17 bp, Homo sapiens
gtcatccatgcttgccc

SEQ ID NO: 3655 - DNA, 15 bp, Homo sapiens
gtcacccactgatcc

SEQ ID NO: 3656 - DNA, 18 bp, Homo sapiens
cccatcatccacgtgtcc

SEQ ID NO: 3657 - DNA, 16 bp, Homo sapiens
gcatctgctcttgatc

SEQ ID NO: 3658 - DNA, 16 bp, Homo sapiens
cctgtctccacgcttc

SEQ ID NO: 3659 - DNA, 23 bp, Homo sapiens
cccgtcatctaggttttaagccc

SEQ ID NO: 3660 - DNA, 17 bp, Homo sapiens
cctgcatccacagtgat

SEQ ID NO: 3661 - DNA, 21 bp, Homo sapiens
cctgttcactggctcttgatc

SEQ ID NO: 3662 - DNA, 67 bp, Cryphonectria hypovirus 1
atggtcaccccaaggtggatgctgccgttcattgtaacggtttcggtatacaattggtggtggccgt

SEQ ID NO: 3663 - DNA, 21 bp, Cryphonectria hypovirus 1
tatacaattggtggtggccgt

SEQ ID NO: 3664 - DNA, 19 bp, Homo sapiens
tatacaattgagtggacca

SEQ ID NO: 3665 - DNA, 19 bp, Homo sapiens
tacacaattgctgagtcgt

SEQ ID NO: 3666 - DNA, 15 bp, Homo sapiens
tatacaggtggtggc

SEQ ID NO: 3667 - DNA, 24 bp, Homo sapiens
tatgcaactggtgatgatggctgt

SEQ ID NO: 3668 - DNA, 18 bp, Homo sapiens
tgacagagatgtggccgt

SEQ ID NO: 3669 - DNA, 18 bp, Homo sapiens
tgacacgatggtggctgt

SEQ ID NO: 3670 - DNA, 84 bp, Cryphonectria hypovirus 1
gccttgcgttacaatcgatactttgaacttcaccttcctttcggggaagatgaagatcatttggagcgcatcttaacgtcgggt

SEQ ID NO: 3671 - DNA, 24 bp, Cryphonectria hypovirus 1
aatcgatactttgaacttcacctt

SEQ ID NO: 3672 - DNA, 21 bp, Homo sapiens
cgatgttctttctttcacctt

SEQ ID NO: 3673 - DNA, 20 bp, Homo sapiens
gagcttttgggcttcacctt

SEQ ID NO: 3674 - DNA, 18 bp, Homo sapiens
atcaatactttgatttca

SEQ ID NO: 3675 - DNA, 18 bp, Homo sapiens
atcattgaacttcacctt

SEQ ID NO: 3676 - DNA, 17 bp, Homo sapiens
gactggaacttcacctt

SEQ ID NO: 3677 - DNA, 18 bp, Homo sapiens
gacagtgaacttcacctt

SEQ ID NO: 3678 - DNA, 94 bp, Cryphonectria hypovirus 1
tgaaaccttccggaactacgatgaaatcaaagccgttctcgaggtcattcttgagaacgagcctgacatcctcgttggagctgaagaaggttca

SEQ ID NO: 3679 - DNA, 24 bp, Cryphonectria hypovirus 1
tgagaacgagcctgacatcctcgt

SEQ ID NO: 3680 - DNA, 20 bp, Homo sapiens
gacgatgaggaaatcctcgt

SEQ ID NO: 3681 - DNA, 21 bp, Homo sapiens
tgaggacgatgtaatcctcgt

SEQ ID NO: 3682 - DNA, 18 bp, Homo sapiens
tgggaatgagcctgacac

SEQ ID NO: 3683 - DNA, 21 bp, Homo sapiens
tgagaggtgggccaccctcgt

SEQ ID NO: 3684 - DNA, 117 bp, Rana tigrina ranavirus
agagcttttcagactaaaaatgtgttacaatatttatagactaaggataagattatctctatattctttcagaagatatggagattgtaccaacatttatagactctccaacgctct

SEQ ID NO: 3685 - DNA, 24 bp, Rana tigrina ranavirus
tacaatatttatagactaaggata

SEQ ID NO: 3686 - DNA, 19 bp, Homo sapiens
tacaatatgtataggacca

SEQ ID NO: 3687 - DNA, 21 bp, Homo sapiens
tacaatatttggacagaggat

SEQ ID NO: 3688 - DNA, 20 bp, Homo sapiens
taaatatttataggtaaagg

SEQ ID NO: 3689 - DNA, 83 bp, Cryphonectria hypovirus 1
acgtgactgctaatgcagactgggttcggtcagagacgacgataaattttatctctgaccaacccggcaaggctcagtcacgt

SEQ ID NO: 3690 - DNA, 24 bp, Cryphonectria hypovirus 1
tctgaccaacccggcaaggctcag

SEQ ID NO: 3691 - DNA, 19 bp, Homo sapiens
ctgaagaacgaaggctcag

SEQ ID NO: 3692 - DNA, 24 bp, Homo sapiens
tctgaccaattagtgtaagctcag

SEQ ID NO: 3693 - DNA, 23 bp, Homo sapiens
ctgaccaacggagcagggttcag

SEQ ID NO: 3694 - DNA, 19 bp, Homo sapiens
tctggcagccagaggctca

SEQ ID NO: 3695 - DNA, 18 bp, Homo sapiens
tgaccgagagaggctcag

SEQ ID NO: 3696 - DNA, 19 bp, Homo sapiens
tctgtgccagccaggctca

SEQ ID NO: 3697 - DNA, 19 bp, Homo sapiens
tctggcggcggtaggctca

SEQ ID NO: 3698 - DNA, 23 bp, Homo sapiens
tctgaccagcccagcccacacag

SEQ ID NO: 3699 - DNA, 15 bp, Homo sapiens
cctgaccagcaggct

SEQ ID NO: 3700 - DNA, 23 bp, Homo sapiens
tctgctcaagtcacaaggctcag

SEQ ID NO: 3701 - DNA, 23 bp, Homo sapiens
tctggcagctcctggaggctcag

SEQ ID NO: 3702 - DNA, 19 bp, Homo sapiens
tctgaccacctcaaaggct

SEQ ID NO: 3703 - DNA, 23 bp, Homo sapiens
ctgactgatagggtgaggctcag

SEQ ID NO: 3704 - DNA, 19 bp, Homo sapiens
tctgaccaatcggtggctc

SEQ ID NO: 3705 - DNA, 21 bp, Homo sapiens
tctggcaacccgggagcagct

SEQ ID NO: 3706 - DNA, 22 bp, Homo sapiens
tctgacccactgacaggctcag

SEQ ID NO: 3707 - DNA, 16 bp, Homo sapiens
tctgacccgcaggctc

SEQ ID NO: 3708 - DNA, 24 bp, Homo sapiens
tctggctaacacggtgaaacccag

SEQ ID NO: 3709 - DNA, 91 bp, Cryphonectria hypovirus 1
atctcgtccccatggaagaggcgaaagaggcacctaggcagcagcttgttcctaggcgttcaactttcgtcgataaccatgaggaggaggt

SEQ ID NO: 3710 - DNA, 24 bp, Cryphonectria hypovirus 1
cgttcaactttcgtcgataaccat

SEQ ID NO: 3711 - DNA, 21 bp, Homo sapiens
attcaactttcacataatcat

SEQ ID NO: 3712 - DNA, 19 bp, Homo sapiens
gttcaactgttctgtgaac

SEQ ID NO: 3713 - DNA, 18 bp, Homo sapiens
gttcaactttagtagata

SEQ ID NO: 3714 - DNA, 79 bp, Rana tigrina ranavirus
gcctcagggttccagacacgttccgccggaggactttgcggccagggtggcagagtccctgagcctggacctgagaggt

SEQ ID NO: 3715 - DNA, 24 bp, Rana tigrina ranavirus
tccctgagcctggacctgagaggt

SEQ ID NO: 3716 - DNA, 29 bp, Homo sapiens
tccatgagcctgggtttctacctctcagg

SEQ ID NO: 3717 - DNA, 24 bp, Homo sapiens
tccctgagcccgggtgctgggggt

SEQ ID NO: 3718 - DNA, 21 bp, Homo sapiens
tccctgagcctcaggggaggt

SEQ ID NO: 3719 - DNA, 24 bp, Homo sapiens
cccttgagcctgggagtttgaggt

SEQ ID NO: 3720 - DNA, 25 bp, Homo sapiens
tccctgagcctgactttacctctcg

SEQ ID NO: 3721 - DNA, 25 bp, Homo sapiens
cctctgggtctggggaaggaggggt

SEQ ID NO: 3722 - DNA, 21 bp, Homo sapiens
tcttcgaaaggcctgagaggt

SEQ ID NO: 3723 - DNA, 23 bp, Homo sapiens
cctggagcctggattgatctggt

SEQ ID NO: 3724 - DNA, 21 bp, Homo sapiens
tccttgggcctggacttgggt

SEQ ID NO: 3725 - DNA, 25 bp, Homo sapiens
ctgggcctggacttgtacctctcag

SEQ ID NO: 3726 - DNA, 20 bp, Homo sapiens
cctgagcctgggtctggggc

SEQ ID NO: 3727 - DNA, 16 bp, Homo sapiens
cccttgagcctgggag

SEQ ID NO: 3728 - DNA, 22 bp, Homo sapiens
tgagcctggcagctcaaggggt

SEQ ID NO: 3729 - DNA, 24 bp, Homo sapiens
tccctgaacctggacttgaccagt

SEQ ID NO: 3730 - DNA, 21 bp, Homo sapiens
tccctgaggtctgctggaggt

SEQ ID NO: 3731 - DNA, 24 bp, Homo sapiens
tctttggcctggactgtacctcta

SEQ ID NO: 3732 - DNA, 21 bp, Homo sapiens
tcactgagcctgggaccaggt

SEQ ID NO: 3733 - DNA, 18 bp, Homo sapiens
cccctgagcttgggccta

SEQ ID NO: 3734 - DNA, 19 bp, Homo sapiens
tctcctgaggcttgagagg

SEQ ID NO: 3735 - DNA, 22 bp, Homo sapiens
tccctgactgaaaatgagaggt

SEQ ID NO: 3736 - DNA, 18 bp, Homo sapiens
tccctgagtctggggccg

SEQ ID NO: 3737 - DNA, 27 bp, Homo sapiens
tccctgagcccgggtccccgctgaggt

SEQ ID NO: 3738 - DNA, 19 bp, Homo sapiens
tctctgagccttgactctg

SEQ ID NO: 3739 - DNA, 22 bp, Homo sapiens
ccttgagcctgggggcacaggt

SEQ ID NO: 3740 - DNA, 16 bp, Homo sapiens
tccctgagctggaaag

SEQ ID NO: 3741 - DNA, 22 bp, Homo sapiens
tccctgactgaaactgagaggt

SEQ ID NO: 3742 - DNA, 19 bp, Homo sapiens
tccttgatcctggaccagg

SEQ ID NO: 3743 - DNA, 22 bp, Homo sapiens
tccctgagactggatttgatag

SEQ ID NO: 3744 - DNA, 23 bp, Homo sapiens
tccctgagtcaggagacctgggt

SEQ ID NO: 3745 - DNA, 17 bp, Homo sapiens
tctctgagcctggtctg

SEQ ID NO: 3746 - DNA, 29 bp, Homo sapiens
tctttgagcctggctatgtacctctcagg

SEQ ID NO: 3747 - DNA, 18 bp, Homo sapiens
cctgagccctgggccaag

SEQ ID NO: 3748 - DNA, 60 bp, Rana tigrina ranavirus
tgcccggttgctgctgctgctcacgctccttgcgcgcattctctgcagtggcaaagggca

SEQ ID NO: 3749 - DNA, 24 bp, Rana tigrina ranavirus
ggttgctgctgctgctcacgctcc

SEQ ID NO: 3750 - DNA, 21 bp, Homo sapiens
ggctgctgctgctgcagactc

SEQ ID NO: 3751 - DNA, 20 bp, Homo sapiens
ggtggccccctgctcacgct

SEQ ID NO: 3752 - DNA, 21 bp, Homo sapiens
ggttcttgctgctctcgctcc

SEQ ID NO: 3753 - DNA, 18 bp, Homo sapiens
gttgctgctgctgctgct

SEQ ID NO: 3754 - DNA, 18 bp, Homo sapiens
gttgctgctgctgctgcc

SEQ ID NO: 3755 - DNA, 23 bp, Homo sapiens
tgtccacctgctgctcgtgctcc

SEQ ID NO: 3756 - DNA, 19 bp, Homo sapiens
ggttgctgctgctgctgct

SEQ ID NO: 3757 - DNA, 18 bp, Homo sapiens
gttgctgctgctgctgac

SEQ ID NO: 3758 - DNA, 18 bp, Homo sapiens
gttgctgttgctgctgct

SEQ ID NO: 3759 - DNA, 19 bp, Homo sapiens
ggtgctgctgttgacgctc

SEQ ID NO: 3760 - DNA, 22 bp, Homo sapiens
ggctgctgctgctgctgctgct

SEQ ID NO: 3761 - DNA, 18 bp, Homo sapiens
agttgctgctccgtgctc

SEQ ID NO: 3762 - DNA, 23 bp, Homo sapiens
gcttgctgctgctgctggcgtcc

SEQ ID NO: 3763 - DNA, 19 bp, Homo sapiens
ggctgctgctgctgctgct

SEQ ID NO: 3764 - DNA, 19 bp, Homo sapiens
ggttgtgctgctgctggcc

SEQ ID NO: 3765 - DNA, 24 bp, Homo sapiens
ggtgctgctgtgagtcttgtgctc

SEQ ID NO: 3766 - DNA, 18 bp, Homo sapiens
ggttctgctgctgttgct

SEQ ID NO: 3767 - DNA, 19 bp, Homo sapiens
ggctgctgttgctgctgct

SEQ ID NO: 3768 - DNA, 20 bp, Homo sapiens
ggttgctactgtcactgctc

SEQ ID NO: 3769 - DNA, 21 bp, Homo sapiens
gttgctgctgtcagctcgctc

SEQ ID NO: 3770 - DNA, 24 bp, Homo sapiens
ggctgctgctgctgctacagctcc

SEQ ID NO: 3771 - DNA, 19 bp, Homo sapiens
gattgctgctgctgctgct

SEQ ID NO: 3772 - DNA, 18 bp, Homo sapiens
gcttgctgctgacccagc

SEQ ID NO: 3773 - DNA, 23 bp, Homo sapiens
ggttactgtgtcacattcatgct

SEQ ID NO: 3774 - DNA, 21 bp, Homo sapiens
gttgctgctgactcacgttcc

SEQ ID NO: 3775 - DNA, 23 bp, Homo sapiens
ggttgctgcttgctgttcgctcc

SEQ ID NO: 3776 - DNA, 22 bp, Homo sapiens
gggaagctgttgctcacgctcc

SEQ ID NO: 3777 - DNA, 18 bp, Homo sapiens
ggctgctgttgctgctac

SEQ ID NO: 3778 - DNA, 18 bp, Homo sapiens
ggctgctgctgctgctac

SEQ ID NO: 3779 - DNA, 22 bp, Homo sapiens
ggctgctgtgctcctcatgctc

SEQ ID NO: 3780 - DNA, 23 bp, Homo sapiens
ggatgctgctgtttggaggctcc

SEQ ID NO: 3781 - DNA, 26 bp, Homo sapiens
ggttgcgctgctgaaagtgtgcgctc

SEQ ID NO: 3782 - DNA, 87 bp, Cryphonectria hypovirus 1
ggttcttcgccaacatggcggtcctcgcaggtgtcaagacccatctcttgaaactgcagactgcgacgtacggcgatttggagaacc

SEQ ID NO: 3783 - DNA, 24 bp, Cryphonectria hypovirus 1
aaactgcagactgcgacgtacggc

SEQ ID NO: 3784 - DNA, 24 bp, Homo sapiens
aaactgcaggtttgcaaacttggc

SEQ ID NO: 3785 - DNA, 21 bp, Homo sapiens
ggactgcagactgtgtcgagc

SEQ ID NO: 3786 - DNA, 24 bp, Homo sapiens
aaactgcagagctggagagatggc

SEQ ID NO: 3787 - DNA, 20 bp, Homo sapiens
ctgcagacgccctgcatggc

SEQ ID NO: 3788 - DNA, 21 bp, Homo sapiens
cagactgcggactgcagtggc

SEQ ID NO: 3789 - DNA, 20 bp, Homo sapiens
actggaggctgccccatggc

SEQ ID NO: 3790 - DNA, 19 bp, Homo sapiens
ctgagactgctcacacggc

SEQ ID NO: 3791 - DNA, 21 bp, Homo sapiens
aaactgcgggcttcgatcacg

SEQ ID NO: 3792 - DNA, 18 bp, Homo sapiens
accgcaggctgcggccgt

SEQ ID NO: 3793 - DNA, 20 bp, Homo sapiens
ctgcagacagcaatgatggc

SEQ ID NO: 3794 - DNA, 22 bp, Homo sapiens
cgcaggctgcgggagctacggc

SEQ ID NO: 3795 - DNA, 22 bp, Homo sapiens
aaactgcaaactgcagtgtggc

SEQ ID NO: 3796 - DNA, 22 bp, Homo sapiens
aactgcgggcccggcgtacggc

SEQ ID NO: 3797 - DNA, 17 bp, Homo sapiens
aactgcagatcatacgg

SEQ ID NO: 3798 - DNA, 24 bp, Homo sapiens
aaactgcaaactgccaaatgcggc

SEQ ID NO: 3799 - DNA, 19 bp, Homo sapiens
actgcagctgcttgtctgg

SEQ ID NO: 3800 - DNA, 19 bp, Homo sapiens
ctgtcacacgacgtatggc

SEQ ID NO: 3801 - DNA, 20 bp, Homo sapiens
aactgcaggatcagtgcggc

SEQ ID NO: 3802 - DNA, 21 bp, Homo sapiens
actgcaggctgtaggcaccac

SEQ ID NO: 3803 - DNA, 18 bp, Homo sapiens
tgcagactgtatcatggc

SEQ ID NO: 3804 - DNA, 19 bp, Homo sapiens
actgcaggctgtggtccag

SEQ ID NO: 3805 - DNA, 16 bp, Homo sapiens
ctgcagactgtgcagg

SEQ ID NO: 3806 - DNA, 21 bp, Homo sapiens
actgcggacctcgactgcggc

SEQ ID NO: 3807 - DNA, 18 bp, Homo sapiens
ggactgcagacggcgggg

SEQ ID NO: 3808 - DNA, 122 bp, Cryphonectria hypovirus 1
gtacttctacaccagcgggaacatgcagagatcggcatgtggcaagcgcaggtcaacgagctcagagcccagaaccttgcccttcagtcacagctgagatcagcatgcacccgaagaagcac

SEQ ID NO: 3809 - DNA, 24 bp, Cryphonectria hypovirus 1
ccagaaccttgcccttcagtcaca

SEQ ID NO: 3810 - DNA, 19 bp, Homo sapiens
ccaggtctttgcccttcaa

SEQ ID NO: 3811 - DNA, 20 bp, Homo sapiens
ccagggcttgcccttcttcc

SEQ ID NO: 3812 - DNA, 19 bp, Homo sapiens
ccagagtctgcacagtcac

SEQ ID NO: 3813 - DNA, 17 bp, Homo sapiens
cagatgtccttcagtca

SEQ ID NO: 3814 - DNA, 21 bp, Homo sapiens
aggactctagttttcagtcac

SEQ ID NO: 3815 - DNA, 19 bp, Homo sapiens
agaatctgcccctcgctca

SEQ ID NO: 3816 - DNA, 17 bp, Homo sapiens
ccagaccttgcctacca

SEQ ID NO: 3817 - DNA, 18 bp, Homo sapiens
cagaaccttgcctcctca

SEQ ID NO: 3818 - DNA, 20 bp, Homo sapiens
cagaaccttgactcctcaca

SEQ ID NO: 3819 - DNA, 20 bp, Homo sapiens
cagaacctttctttccaaca

SEQ ID NO: 3820 - DNA, 21 bp, Homo sapiens
ccagcacttccttcagtcaca

SEQ ID NO: 3821 - DNA, 23 bp, Homo sapiens
ccagatctcctggttcagtcaca

SEQ ID NO: 3822 - DNA, 17 bp, Homo sapiens
ccagagcctgccccatc

SEQ ID NO: 3823 - DNA, 17 bp, Homo sapiens
caaaactccccttcagt

SEQ ID NO: 3824 - DNA, 16 bp, Homo sapiens
ccaggacctgccctca

SEQ ID NO: 3825 - DNA, 23 bp, Homo sapiens
cctgaattttgccctcaaatgca

SEQ ID NO: 3826 - DNA, 26 bp, Homo sapiens
agagtcttccttcagctctggtcaca

SEQ ID NO: 3827 - DNA, 21 bp, Homo sapiens
cacaaccttgccctcctcaca

SEQ ID NO: 3828 - DNA, 15 bp, Homo sapiens
cagccttccttcagt

SEQ ID NO: 3829 - DNA, 19 bp, Homo sapiens
caaaagcttttcagtcaca

SEQ ID NO: 3830 - DNA, 20 bp, Homo sapiens
aaaactggtcttcagtcaca

SEQ ID NO: 3831 - DNA, 17 bp, Homo sapiens
aaacttttctcagtcac

SEQ ID NO: 3832 - DNA, 22 bp, Homo sapiens
ccagagcctgccctttcccaca

SEQ ID NO: 3833 - DNA, 21 bp, Homo sapiens
ccagaaccgtagctcagtcac

SEQ ID NO: 3834 - DNA, 20 bp, Homo sapiens
ccagaaccttctcaaaaaca

SEQ ID NO: 3835 - DNA, 17 bp, Homo sapiens
accttgccccagtcgca

SEQ ID NO: 3836 - DNA, 19 bp, Homo sapiens
cccgggccttgcccccgcc

SEQ ID NO: 3837 - DNA, 19 bp, Homo sapiens
gaatcctgccccaagcaca

SEQ ID NO: 3838 - DNA, 22 bp, Homo sapiens
cagagctttagccccaatcaca

SEQ ID NO: 3839 - DNA, 21 bp, Homo sapiens
ccaagggtctgccttcagtca

SEQ ID NO: 3840 - DNA, 20 bp, Homo sapiens
ccagaaccttttttttctgt

SEQ ID NO: 3841 - DNA, 19 bp, Homo sapiens
cagagtcctgccaactcgc

SEQ ID NO: 3842 - DNA, 18 bp, Homo sapiens
agaaccttctccttaaat

SEQ ID NO: 3843 - DNA, 18 bp, Homo sapiens
gaactttattcagtcaca

SEQ ID NO: 3844 - DNA, 20 bp, Homo sapiens
ccagaacctcgctcttcggc

SEQ ID NO: 3845 - DNA, 20 bp, Homo sapiens
gaataaatccttcagtcaca

SEQ ID NO: 3846 - DNA, 26 bp, Homo sapiens
cagaaccttgtctcttaccctcttgt

SEQ ID NO: 3847 - DNA, 20 bp, Homo sapiens
ccagagcttggcccacctgc

SEQ ID NO: 3848 - DNA, 18 bp, Homo sapiens
cagaaccttcttgatcac

SEQ ID NO: 3849 - DNA, 18 bp, Homo sapiens
ccaggactctgtccttca

SEQ ID NO: 3850 - DNA, 18 bp, Homo sapiens
caaaaccttgtctttagt

SEQ ID NO: 3851 - DNA, 20 bp, Homo sapiens
agaactttgccttcaataca

SEQ ID NO: 3852 - DNA, 20 bp, Homo sapiens
ccaggtctttgcccttctca

SEQ ID NO: 3853 - DNA, 20 bp, Homo sapiens
cagaaatgtcttcagtcaca

SEQ ID NO: 3854 - DNA, 23 bp, Homo sapiens
ccagaacctttttgtaagttaca

SEQ ID NO: 3855 - DNA, 22 bp, Homo sapiens
agcattttgctcttcaaccaca

SEQ ID NO: 3856 - DNA, 20 bp, Homo sapiens
agcaccttgctccagtcaca

SEQ ID NO: 3857 - DNA, 20 bp, Homo sapiens
ccgcaggcccttcagtcaca

SEQ ID NO: 3858 - DNA, 24 bp, Homo sapiens
ccagggaccctgccttcagtcgca

SEQ ID NO: 3859 - DNA, 21 bp, Homo sapiens
ccaaagctgtgattcagtcac

SEQ ID NO: 3860 - DNA, 20 bp, Homo sapiens
agaaccttcctgtcgttaca

SEQ ID NO: 3861 - DNA, 19 bp, Homo sapiens
ccagcagtcttccagtcac

SEQ ID NO: 3862 - DNA, 22 bp, Homo sapiens
cagggaccttgcctcccccaca

SEQ ID NO: 3863 - DNA, 20 bp, Homo sapiens
caggtgtttcgtcagtcaca

SEQ ID NO: 3864 - DNA, 22 bp, Homo sapiens
ccagggccctgtctcagccaca

SEQ ID NO: 3865 - DNA, 19 bp, Homo sapiens
ccagagccctgccctgagc

SEQ ID NO: 3866 - DNA, 20 bp, Homo sapiens
ggagatttgcccttatccca

SEQ ID NO: 3867 - DNA, 26 bp, Homo sapiens
agagtcttccttcagttctggtcaca

SEQ ID NO: 3868 - DNA, 18 bp, Homo sapiens
gaacatcaattcagtcac

SEQ ID NO: 3869 - DNA, 15 bp, Homo sapiens
ccagaacctgctcac

SEQ ID NO: 3870 - DNA, 17 bp, Homo sapiens
cgaaaacctttcagtca

SEQ ID NO: 3871 - DNA, 20 bp, Homo sapiens
cagtgtgtctttcagtcaca

SEQ ID NO: 3872 - DNA, 23 bp, Homo sapiens
caggtctttgcccctcctttaca

SEQ ID NO: 3873 - DNA, 21 bp, Homo sapiens
ccagaggcttgtccagccaca

SEQ ID NO: 3874 - DNA, 25 bp, Homo sapiens
cctgggccttgccctgcctttcaca

SEQ ID NO: 3875 - DNA, 18 bp, Homo sapiens
cagaacctgctcttctgc

SEQ ID NO: 3876 - DNA, 18 bp, Homo sapiens
ccagaaccatgtctacac

SEQ ID NO: 3877 - DNA, 21 bp, Homo sapiens
gaccttgccttggaagtcaca

SEQ ID NO: 3878 - DNA, 77 bp, Cryphonectria hypovirus 1
tcgcagctacatcaacaagatacggtacctgaccgatgaaaatcggtcgggcgccagtatgattgatcgcgctgtga

SEQ ID NO: 3879 - DNA, 24 bp, Cryphonectria hypovirus 1
tacggtacctgaccgatgaaaatc

SEQ ID NO: 3880 - DNA, 25 bp, Homo sapiens
tacggtacttgattaattgatttta

SEQ ID NO: 3881 - DNA, 18 bp, Homo sapiens
ggtacctgtgcaatcaaa

SEQ ID NO: 3882 - DNA, 19 bp, Homo sapiens
ggtaaaacacgatgaaaat

SEQ ID NO: 3883 - DNA, 19 bp, Homo sapiens
agcatgactgatgaaaatc

SEQ ID NO: 3884 - DNA, 18 bp, Homo sapiens
gtacctgagattagaatc

SEQ ID NO: 3885 - DNA, 19 bp, Homo sapiens
ggtacttaaacatgaaaat

SEQ ID NO: 3886 - DNA, 61 bp, Rana tigrina ranavirus
atggctgtgctggtccaaacagtgaggctggtgcactaactgctggatcactaactgctgt

SEQ ID NO: 3887 - DNA, 19 bp, Rana tigrina ranavirus
ctggatcactaactgctgt

SEQ ID NO: 3888 - DNA, 17 bp, Homo sapiens
ctggacaccgctgctgt

SEQ ID NO: 3889 - DNA, 21 bp, Homo sapiens
ctggaccactgtgcaggctgt

SEQ ID NO: 3890 - DNA, 17 bp, Homo sapiens
ctgtccctgactgctgt

SEQ ID NO: 3891 - DNA, 19 bp, Homo sapiens
ccggatcacgacctgctgt

SEQ ID NO: 3892 - DNA, 17 bp, Homo sapiens
ctagaagccactgctgt

SEQ ID NO: 3893 - DNA, 20 bp, Homo sapiens
ctgggacaccctgccgctgt

SEQ ID NO: 3894 - DNA, 18 bp, Homo sapiens
tgaaaaacaaactgctgt

SEQ ID NO: 3895 - DNA, 19 bp, Homo sapiens
ctggactcactgctgctgt

SEQ ID NO: 3896 - DNA, 16 bp, Homo sapiens
ctgagatcactgctgt

SEQ ID NO: 3897 - DNA, 16 bp, Homo sapiens
tggatcactactatgt

SEQ ID NO: 3898 - DNA, 17 bp, Homo sapiens
tggatcaccagcgctgt

SEQ ID NO: 3899 - DNA, 16 bp, Homo sapiens
ctgaatcacctgctgt

SEQ ID NO: 3900 - DNA, 18 bp, Homo sapiens
tggaccactggactatgt

SEQ ID NO: 3901 - DNA, 16 bp, Homo sapiens
ctggaccccatgctgt

SEQ ID NO: 3902 - DNA, 16 bp, Homo sapiens
ctggaccacctgttgt

SEQ ID NO: 3903 - DNA, 19 bp, Homo sapiens
ctgggccagcaaccgctgc

SEQ ID NO: 3904 - DNA, 17 bp, Homo sapiens
ccgggtcagaccgctgt

SEQ ID NO: 3905 - DNA, 16 bp, Homo sapiens
ctggcaccactgttgt

SEQ ID NO: 3906 - DNA, 20 bp, Homo sapiens
ctggatcagtccatcactgt

SEQ ID NO: 3907 - DNA, 17 bp, Homo sapiens
ctggccccaactgctgt

SEQ ID NO: 3908 - DNA, 16 bp, Homo sapiens
tggatcacaaccttgt

SEQ ID NO: 3909 - DNA, 15 bp, Homo sapiens
tagaacaactgctgt

SEQ ID NO: 3910 - DNA, 20 bp, Homo sapiens
ctggatcataaactctctgt

SEQ ID NO: 3911 - DNA, 19 bp, Homo sapiens
ctggcacaaagactgctgt

SEQ ID NO: 3912 - DNA, 17 bp, Homo sapiens
tgggtcaccaacactgt

SEQ ID NO: 3913 - DNA, 18 bp, Homo sapiens
ctcgattcagactgctgt

SEQ ID NO: 3914 - DNA, 18 bp, Homo sapiens
tacacgactgactgctgt

SEQ ID NO: 3915 - DNA, 16 bp, Homo sapiens
tggaccacactgctgt

SEQ ID NO: 3916 - DNA, 17 bp, Homo sapiens
ctggatcatgaccgtgt

SEQ ID NO: 3917 - DNA, 19 bp, Homo sapiens
ctgaccaactgactgctgt

SEQ ID NO: 3918 - DNA, 18 bp, Homo sapiens
ctgatatcccactgctgt

SEQ ID NO: 3919 - DNA, 16 bp, Homo sapiens
ctgggcacactgctgt

SEQ ID NO: 3920 - DNA, 16 bp, Homo sapiens
tggattcaactgctgt

SEQ ID NO: 3921 - DNA, 17 bp, Homo sapiens
ctggactgctatgctgt

SEQ ID NO: 3922 - DNA, 19 bp, Homo sapiens
ctgggcttcctactgctgt

SEQ ID NO: 3923 - DNA, 15 bp, Homo sapiens
ctggctaactgctgt

SEQ ID NO: 3924 - DNA, 17 bp, Homo sapiens
tgcatcactaatgatgt

SEQ ID NO: 3925 - DNA, 17 bp, Homo sapiens
tggaccacgtactctgt

SEQ ID NO: 3926 - DNA, 20 bp, Homo sapiens
ctggaccacccacttgttgt

SEQ ID NO: 3927 - DNA, 16 bp, Homo sapiens
ccggaccagctgctgt

SEQ ID NO: 3928 - DNA, 16 bp, Homo sapiens
tgaactcaactgctgt

SEQ ID NO: 3929 - DNA, 19 bp, Homo sapiens
tggatttggcaactgctgt

SEQ ID NO: 3930 - DNA, 16 bp, Homo sapiens
ctggcatcactgctgt

SEQ ID NO: 3931 - DNA, 18 bp, Homo sapiens
gggtcactaacctgctgc

SEQ ID NO: 3932 - DNA, 19 bp, Homo sapiens
ctagatcactttcccttgt

SEQ ID NO: 3933 - DNA, 18 bp, Homo sapiens
tggattctatactgctgt

SEQ ID NO: 3934 - DNA, 130 bp, Cryphonectria hypovirus 1
aagcaaaactggaggacaccgcgcgcaaggtgtgtagtgtatggcaatataacatcatgatcgcttcatctgtcgcgtttctagtgccattatacttcacactctatgtgccgtacctgcaattctactt

SEQ ID NO: 3935 - DNA, 24 bp, Cryphonectria hypovirus 1
ctagtgccattatacttcacactc

SEQ ID NO: 3936 - DNA, 21 bp, Homo sapiens
tgctgagtgtacttcacactc

SEQ ID NO: 3937 - DNA, 20 bp, Homo sapiens
ccagatttatacttcatact

SEQ ID NO: 3938 - DNA, 21 bp, Homo sapiens
gtgccactgggcttcatgctc

SEQ ID NO: 3939 - DNA, 17 bp, Homo sapiens
gtgccaagcacttcaca

SEQ ID NO: 3940 - DNA, 16 bp, Homo sapiens
gtccaaatacttcaca

SEQ ID NO: 3941 - DNA, 22 bp, Homo sapiens
ctagtctgttaaccccacactc

SEQ ID NO: 3942 - DNA, 19 bp, Homo sapiens
cagtgccattgcggtactt

SEQ ID NO: 3943 - DNA, 21 bp, Homo sapiens
cagtgccatgaaatcatgctc

SEQ ID NO: 3944 - DNA, 18 bp, Homo sapiens
tagtgcaaacttcacgct

SEQ ID NO: 3945 - DNA, 16 bp, Homo sapiens
atgcatcacttcacat

SEQ ID NO: 3946 - DNA, 24 bp, Homo sapiens
ctagtgtccttattccccacactc

SEQ ID NO: 3947 - DNA, 19 bp, Homo sapiens
gtgtcatcagctcacactc

SEQ ID NO: 3948 - DNA, 21 bp, Homo sapiens
gtgccattgcacattgcactc

SEQ ID NO: 3949 - DNA, 20 bp, Homo sapiens
tgccaagttacttcacattc

SEQ ID NO: 3950 - DNA, 20 bp, Homo sapiens
ctattgctcaatttcacact

SEQ ID NO: 3951 - DNA, 19 bp, Homo sapiens
taagtgccattgctacact

SEQ ID NO: 3952 - DNA, 22 bp, Homo sapiens
ctagtgcttctcaatcacactc

SEQ ID NO: 3953 - DNA, 127 bp, Molluscum contagiosum virus
gtgtgtgtgtgtgcgctcacacggaacgagaacaagtgtgtgtgtgcgctcacacggaacgagaacaagtgtgtgtgtgtgtgcgctcacacggaacgagaacaagtgtgtgtgtgcgcgctcacac

SEQ ID NO: 3954 - DNA, 24 bp, Molluscum contagiosum virus
tcacacggaacgagaacaagtgtg

SEQ ID NO: 3955 - DNA, 21 bp, Homo sapiens
tcacacggggcagtgggtgtg

SEQ ID NO: 3956 - DNA, 19 bp, Homo sapiens
tcacacggagtagaaaatg

SEQ ID NO: 3957 - DNA, 24 bp, Homo sapiens
tcgcaggctcaaagggcaagtgtg

SEQ ID NO: 3958 - DNA, 21 bp, Homo sapiens
tcacctggggggacaagtgtg

SEQ ID NO: 3959 - DNA, 23 bp, Homo sapiens
cactggagagcagggcaagtgtg

SEQ ID NO: 3960 - DNA, 16 bp, Homo sapiens
ccacagggacaagtgt

SEQ ID NO: 3961 - DNA, 21 bp, Homo sapiens
tcacacgggtggtcatgtgtg

SEQ ID NO: 3962 - DNA, 18 bp, Homo sapiens
cacccaagaacaggtgtg

SEQ ID NO: 3963 - DNA, 19 bp, Homo sapiens
tcacacgggagaggagcat

SEQ ID NO: 3964 - DNA, 19 bp, Homo sapiens
tcacatgagggcaagtgtg

SEQ ID NO: 3965 - DNA, 22 bp, Homo sapiens
tcacatgaatgcctcaagtgtg

SEQ ID NO: 3966 - DNA, 81 bp, Cryphonectria hypovirus 1
ccaggcgattacatattgcttccaccggtgctctggttggtctggaccaatctttgctacggctacgcgtgtgacgcctgg

SEQ ID NO: 3967 - DNA, 24 bp, Cryphonectria hypovirus 1
caccggtgctctggttggtctgga

SEQ ID NO: 3968 - DNA, 21 bp, Homo sapiens
cgttggtcaggctggtctgga

SEQ ID NO: 3969 - DNA, 23 bp, Homo sapiens
cactgtgctcatgaacggtctgg

SEQ ID NO: 3970 - DNA, 19 bp, Homo sapiens
ggtcccagggttggtctgg

SEQ ID NO: 3971 - DNA, 17 bp, Homo sapiens
ccaggtgtctggtctgg

SEQ ID NO: 3972 - DNA, 22 bp, Homo sapiens
cacttggggtggttggtctgga

SEQ ID NO: 3973 - DNA, 19 bp, Homo sapiens
cactgcgtgttctggctgg

SEQ ID NO: 3974 - DNA, 16 bp, Homo sapiens
cagtgccttggtctgg

SEQ ID NO: 3975 - DNA, 20 bp, Homo sapiens
cctgtgctctgagaccttgg

SEQ ID NO: 3976 - DNA, 21 bp, Homo sapiens
cacgggtgggatttggtttgg

SEQ ID NO: 3977 - DNA, 21 bp, Homo sapiens
cactggtctctgtaaactgga

SEQ ID NO: 3978 - DNA, 20 bp, Homo sapiens
ccggtgtctgggctcctgga

SEQ ID NO: 3979 - DNA, 21 bp, Homo sapiens
cactgtgggcttttggtctgg

SEQ ID NO: 3980 - DNA, 18 bp, Homo sapiens
cacaggtgctctgggtgg

SEQ ID NO: 3981 - DNA, 17 bp, Homo sapiens
ggtcaggctggtctgga

SEQ ID NO: 3982 - DNA, 19 bp, Homo sapiens
ccagtgctctggtttctgg

SEQ ID NO: 3983 - DNA, 17 bp, Homo sapiens
ggtgctctggctgctgg

SEQ ID NO: 3984 - DNA, 19 bp, Homo sapiens
ccgtgctctggggctctgg

SEQ ID NO: 3985 - DNA, 15 bp, Homo sapiens
gtgctctggtgctgg

SEQ ID NO: 3986 - DNA, 18 bp, Homo sapiens
tgcccaggttggtctgga

SEQ ID NO: 3987 - DNA, 15 bp, Homo sapiens
ggtctctggttctag

SEQ ID NO: 3988 - DNA, 18 bp, Homo sapiens
gcggtcccgttggtctgg

SEQ ID NO: 3989 - DNA, 19 bp, Homo sapiens
cggtgttctggttaacaga

SEQ ID NO: 3990 - DNA, 20 bp, Homo sapiens
cagggccttggttggtctgg

SEQ ID NO: 3991 - DNA, 18 bp, Homo sapiens
cactggatgctggtctgg

SEQ ID NO: 3992 - DNA, 19 bp, Homo sapiens
ggtctctgaagtccctgga

SEQ ID NO: 3993 - DNA, 20 bp, Homo sapiens
ggtggtctagtttggtctgg

SEQ ID NO: 3994 - DNA, 19 bp, Homo sapiens
cactggggctctgggttgg

SEQ ID NO: 3995 - DNA, 15 bp, Homo sapiens
ggtctctggggctgg

SEQ ID NO: 3996 - DNA, 22 bp, Homo sapiens
ccgggctctggcctgcattgga

SEQ ID NO: 3997 - DNA, 131 bp, Cryphonectria hypovirus 1
tgacgaaatgccacacattaggagtgtgaggaacacgggcatccatgggctacctggggatttcttgtcgaattaccctagactgcctacgcctgtatttcatcgcctccgcgatttgtgggatgatgtca

SEQ ID NO: 3998 - DNA, 24 bp, Cryphonectria hypovirus 1
tgaggaacacgggcatccatgggc

SEQ ID NO: 3999 - DNA, 17 bp, Homo sapiens
tgaggaacacaggtggg

SEQ ID NO: 4000 - DNA, 21 bp, Homo sapiens
tgaggacagtgctccatgggc

SEQ ID NO: 4001 - DNA, 21 bp, Homo sapiens
ggagcgcgcgcggccatgggc

SEQ ID NO: 4002 - DNA, 21 bp, Homo sapiens
tgagaaacatgggttaggggg

SEQ ID NO: 4003 - DNA, 19 bp, Homo sapiens
tgaggaacagggtagaggg

SEQ ID NO: 4004 - DNA, 22 bp, Homo sapiens
tgaggaggcatccgctatgggc

SEQ ID NO: 4005 - DNA, 24 bp, Homo sapiens
tgagaaactaacttgttcatgggc

SEQ ID NO: 4006 - DNA, 21 bp, Homo sapiens
tgaggaaccatgggcactggg

SEQ ID NO: 4007 - DNA, 22 bp, Homo sapiens
tggggaacatccgcctgtgggc

SEQ ID NO: 4008 - DNA, 23 bp, Homo sapiens
tgaggtggagattgtccatgggc

SEQ ID NO: 4009 - DNA, 16 bp, Homo sapiens
tggggaacacgggggg

SEQ ID NO: 4010 - DNA, 22 bp, Homo sapiens
tggggaacagagccccatgggc

SEQ ID NO: 4011 - DNA, 19 bp, Homo sapiens
tggggggcacaggcagcgg

SEQ ID NO: 4012 - DNA, 19 bp, Homo sapiens
tgggagagcactccatggg

SEQ ID NO: 4013 - DNA, 21 bp, Homo sapiens
tgggggacacaggccaggggc

SEQ ID NO: 4014 - DNA, 21 bp, Homo sapiens
tgggggacacaggcacagggc

SEQ ID NO: 4015 - DNA, 22 bp, Homo sapiens
tgaagaactgtagtctatgggc

SEQ ID NO: 4016 - DNA, 17 bp, Homo sapiens
ggatgcgggcaccaggc

SEQ ID NO: 4017 - DNA, 19 bp, Homo sapiens
tgggaacacgggcacaggg

SEQ ID NO: 4018 - DNA, 22 bp, Homo sapiens
tgggggacacagacggggtggg

SEQ ID NO: 4019 - DNA, 25 bp, Homo sapiens
tgaggaacgcggtcaggaggtgggc

SEQ ID NO: 4020 - DNA, 21 bp, Homo sapiens
tgggaagcaccctctatgggc

SEQ ID NO: 4021 - DNA, 18 bp, Homo sapiens
tgaggaacgtgggcctcc

SEQ ID NO: 4022 - DNA, 22 bp, Homo sapiens
tgggggacacggacggggtggg

SEQ ID NO: 4023 - DNA, 18 bp, Homo sapiens
gaaacatgggagatgggc

SEQ ID NO: 4024 - DNA, 18 bp, Homo sapiens
tgaggaaagtcccatggg

SEQ ID NO: 4025 - DNA, 20 bp, Homo sapiens
ggagaacagccatccatggg

SEQ ID NO: 4026 - DNA, 19 bp, Homo sapiens
cgggaacacgggctgtggg

SEQ ID NO: 4027 - DNA, 60 bp, Cryphonectria hypovirus 1
gatcgttatgccaaggaagatcctccgcgataactgggagattccatttgacatccgatc

SEQ ID NO: 4028 - DNA, 24 bp, Cryphonectria hypovirus 1
tatgccaaggaagatcctccgcga

SEQ ID NO: 4029 - DNA, 16 bp, Homo sapiens
gccaggaccctccgcg

SEQ ID NO: 4030 - DNA, 21 bp, Homo sapiens
gctcgggaagatcctccgcga

SEQ ID NO: 4031 - DNA, 20 bp, Homo sapiens
atgctgaggaagatatttcc

SEQ ID NO: 4032 - DNA, 22 bp, Homo sapiens
tatgccaagggagcatttccca

SEQ ID NO: 4033 - DNA, 18 bp, Homo sapiens
tatgttaagggagactcc

SEQ ID NO: 4034 - DNA, 21 bp, Homo sapiens
tgccaaaggaggtcccatccg

SEQ ID NO: 4035 - DNA, 17 bp, Homo sapiens
cctggggatcctccgcg

SEQ ID NO: 4036 - DNA, 17 bp, Homo sapiens
tgccaaggaaaggtccg

SEQ ID NO: 4037 - DNA, 17 bp, Homo sapiens
atgccaaggaagctgcg

SEQ ID NO: 4038 - DNA, 18 bp, Homo sapiens
catgccaggaccacctcc

SEQ ID NO: 4039 - DNA, 19 bp, Homo sapiens
tatgccaccctcctccgcg

SEQ ID NO: 4040 - DNA, 15 bp, Homo sapiens
tgccagtcctccgcg

SEQ ID NO: 4041 - DNA, 21 bp, Homo sapiens
tgtggcagaagatccttcgcg

SEQ ID NO: 4042 - DNA, 77 bp, Cryphonectria hypovirus 1
gcagaaagactttcaccaaccctccatactgccatacttcgcatggctgtggaggcaagggtttgatgttaaactgc

SEQ ID NO: 4043 - DNA, 24 bp, Cryphonectria hypovirus 1
tgtggaggcaagggtttgatgtta

SEQ ID NO: 4044 - DNA, 21 bp, Homo sapiens
tgtggagatagggtcttgtta

SEQ ID NO: 4045 - DNA, 20 bp, Homo sapiens
gtgggggtgggggtttcatg

SEQ ID NO: 4046 - DNA, 18 bp, Homo sapiens
tgggggcaagggttccac

SEQ ID NO: 4047 - DNA, 17 bp, Homo sapiens
tgtggggcgagggtttg

SEQ ID NO: 4048 - DNA, 21 bp, Homo sapiens
gtggaggcaggggaggggttg

SEQ ID NO: 4049 - DNA, 24 bp, Homo sapiens
tatggaggtagggggtgggatgtt

SEQ ID NO: 4050 - DNA, 16 bp, Homo sapiens
tgtgggggaggggagt

SEQ ID NO: 4051 - DNA, 18 bp, Homo sapiens
gtggaggcggctggtgtt

SEQ ID NO: 4052 - DNA, 18 bp, Homo sapiens
tgtggtggccttgatgtt

SEQ ID NO: 4053 - DNA, 21 bp, Homo sapiens
tgtcgaggcagggtctctgtt

SEQ ID NO: 4054 - DNA, 20 bp, Homo sapiens
tggaggcaggggtccacctt

SEQ ID NO: 4055 - DNA, 109 bp, Cryphonectria hypovirus 1
catccgagctttcagaccccgctaaagcaagggaggaggaacaaagcgtgacgaaatcgctcctgtttatccatctcatggcattggcgggcgtcaggcagtccgaatg

SEQ ID NO: 4056 - DNA, 24 bp, Cryphonectria hypovirus 1
tctcatggcattggcgggcgtcag

SEQ ID NO: 4057 - DNA, 18 bp, Homo sapiens
tctggcattggtgaccca

SEQ ID NO: 4058 - DNA, 20 bp, Homo sapiens
ctcaggctggcgggcgtcag

SEQ ID NO: 4059 - DNA, 19 bp, Homo sapiens
tctcatggattggtgggca

SEQ ID NO: 4060 - DNA, 18 bp, Homo sapiens
tcccatggcttggggtgt

SEQ ID NO: 4061 - DNA, 21 bp, Homo sapiens
tctcatggatgttgggctcag

SEQ ID NO: 4062 - DNA, 19 bp, Homo sapiens
tctcacggtgttgcccagg

SEQ ID NO: 4063 - DNA, 17 bp, Homo sapiens
tctgtggcgccaggcgt

SEQ ID NO: 4064 - DNA, 19 bp, Homo sapiens
tctcatggcatggtctgca

SEQ ID NO: 4065 - DNA, 19 bp, Homo sapiens
tcgcatggcagatgggtgt

SEQ ID NO: 4066 - DNA, 19 bp, Homo sapiens
tcacagtactggcgggtgt

SEQ ID NO: 4067 - DNA, 17 bp, Homo sapiens
tcatggtttggcaaagt

SEQ ID NO: 4068 - DNA, 17 bp, Homo sapiens
tcgtggtttggcaaagt

SEQ ID NO: 4069 - DNA, 19 bp, Homo sapiens
tcttctggcattgtggtca

SEQ ID NO: 4070 - DNA, 20 bp, Homo sapiens
tctcatggctttggcagcca

SEQ ID NO: 4071 - DNA, 17 bp, Homo sapiens
tcccatggcatgggtgt

SEQ ID NO: 4072 - DNA, 90 bp, Cryphonectria hypovirus 1
accttacagcgcgaatcacaattgcacgaccgtgatcctcaaggggatcatgtaccgtagtgcactaggttttgtattcgcgtatatggt

SEQ ID NO: 4073 - DNA, 24 bp, Cryphonectria hypovirus 1
tagtgcactaggttttgtattcgc

SEQ ID NO: 4074 - DNA, 21 bp, Homo sapiens
tgccttgggttttgtgtttgc

SEQ ID NO: 4075 - DNA, 130 bp, Cryphonectria hypovirus 1
gtagtcgaactggcttacacccagcttgtccaggacgaaaaggaacgcataccagaaccgaagggaactaagattctggacatgccgaattggaagcctggcaactgggccaagttaatagacgagacgc

SEQ ID NO: 4076 - DNA, 24 bp, Cryphonectria hypovirus 1
aaaggaacgcataccagaaccgaa

SEQ ID NO: 4077 - DNA, 17 bp, Homo sapiens
aagggcagaaccagcca

SEQ ID NO: 4078 - DNA, 22 bp, Homo sapiens
aaaggaagtggcgcagaaccga

SEQ ID NO: 4079 - DNA, 21 bp, Homo sapiens
aaaagaacggccatagggccg

SEQ ID NO: 4080 - DNA, 20 bp, Homo sapiens
ggaagaacgcacatcctaga

SEQ ID NO: 4081 - DNA, 22 bp, Homo sapiens
tgaggaacgctttagagccgaa

SEQ ID NO: 4082 - DNA, 18 bp, Homo sapiens
aaaggaaccataagctcg

SEQ ID NO: 4083 - DNA, 23 bp, Homo sapiens
aaaggaacaggagaggaactgaa

SEQ ID NO: 4084 - DNA, 21 bp, Homo sapiens
ggaggggcgcttccaaaaccg

SEQ ID NO: 4085 - DNA, 18 bp, Homo sapiens
aaagaatgcataccagaa

SEQ ID NO: 4086 - DNA, 24 bp, Homo sapiens
aaaggaactgtacctttagccgaa

SEQ ID NO: 4087 - DNA, 23 bp, Homo sapiens
aaggagttccctagagaaccgaa

SEQ ID NO: 4088 - DNA, 20 bp, Homo sapiens
ggaagaacgcatttaactga

SEQ ID NO: 4089 - DNA, 22 bp, Homo sapiens
aaaggaacacgtgctcactgaa

SEQ ID NO: 4090 - DNA, 15 bp, Homo sapiens
aaaggaaccagaccg

SEQ ID NO: 4091 - DNA, 16 bp, Homo sapiens
aggtaccagaactgaa

SEQ ID NO: 4092 - DNA, 21 bp, Homo sapiens
aaggaaaacaccagaactgaa

SEQ ID NO: 4093 - DNA, 18 bp, Homo sapiens
ggaggaacactgaactga

SEQ ID NO: 4094 - DNA, 23 bp, Homo sapiens
aaaggaactggtgcaggactgaa

SEQ ID NO: 4095 - DNA, 21 bp, Homo sapiens
gggacacggagaagaaccgaa

SEQ ID NO: 4096 - DNA, 17 bp, Homo sapiens
aaggaacgtatccaccc

SEQ ID NO: 4097 - DNA, 83 bp, Cryphonectria hypovirus 1
cggtgctgaggggttacaaagccgcgttcactccgcatgtcgagcttgacatgccgaacgcaacttcgtacaacttagcaccg

SEQ ID NO: 4098 - DNA, 24 bp, Cryphonectria hypovirus 1
catgccgaacgcaacttcgtacaa

SEQ ID NO: 4099 - DNA, 20 bp, Homo sapiens
catgccgactgcagtccacg

SEQ ID NO: 4100 - DNA, 23 bp, Homo sapiens
atgccaaatggccccttgtacaa

SEQ ID NO: 4101 - DNA, 17 bp, Homo sapiens
cgccggaacttcgtgca

SEQ ID NO: 4102 - DNA, 19 bp, Homo sapiens
catgccgaaagcggccgca

SEQ ID NO: 4103 - DNA, 21 bp, Homo sapiens
catgccgaagcagccgtcaca

SEQ ID NO: 4104 - DNA, 23 bp, Homo sapiens
catgtcaacatgtacttcgtaca

SEQ ID NO: 4105 - DNA, 128 bp, Cryphonectria hypovirus 1
gtaggcgtgtaccgaacgaccccggcccagaagaccagggctgatgcttgttaggcaacggcaataagaccgaagcaagcacagagactggaaaagtaagccggatccgtcgacgtaggatcgtctac

SEQ ID NO: 4106 - DNA, 24 bp, Cryphonectria hypovirus 1
aagcaagcacagagactggaaaag

SEQ ID NO: 4107 - DNA, 16 bp, Homo sapiens
gcaaagcaaactggaa

SEQ ID NO: 4108 - DNA, 18 bp, Homo sapiens
agccaggcacagagtgga

SEQ ID NO: 4109 - DNA, 23 bp, Homo sapiens
aagcaaagtacagagatgcctag

SEQ ID NO: 4110 - DNA, 19 bp, Homo sapiens
aagcaggagcaggcagaaa

SEQ ID NO: 4111 - DNA, 16 bp, Homo sapiens
aagaagcacagggaaa

SEQ ID NO: 4112 - DNA, 21 bp, Homo sapiens
aagcaagcagagagaccatgg

SEQ ID NO: 4113 - DNA, 18 bp, Homo sapiens
aagaaagcacagaaaagg

SEQ ID NO: 4114 - DNA, 18 bp, Homo sapiens
gccagtggaaactggaaa

SEQ ID NO: 4115 - DNA, 22 bp, Homo sapiens
aaacgggtcacaactggaaaag

SEQ ID NO: 4116 - DNA, 21 bp, Homo sapiens
aaccacaggggactggagaag

SEQ ID NO: 4117 - DNA, 18 bp, Homo sapiens
agcagacacagagagaga

SEQ ID NO: 4118 - DNA, 19 bp, Homo sapiens
aagcacagaaaacaggaaa

SEQ ID NO: 4119 - DNA, 24 bp, Homo sapiens
agcagacacagagggaccacagaa

SEQ ID NO: 4120 - DNA, 19 bp, Homo sapiens
gcagggcagaaacccaaaa

SEQ ID NO: 4121 - DNA, 19 bp, Homo sapiens
aagcaagctgaagggaaaa

SEQ ID NO: 4122 - DNA, 19 bp, Homo sapiens
aagcaagcaagagcaagaa

SEQ ID NO: 4123 - DNA, 19 bp, Homo sapiens
ggacaagcacggaacagaa

SEQ ID NO: 4124 - DNA, 16 bp, Homo sapiens
aagcacaggtggaaaa

SEQ ID NO: 4125 - DNA, 17 bp, Homo sapiens
aaggaagcacaggagga

SEQ ID NO: 4126 - DNA, 19 bp, Homo sapiens
aagcaagcccagcgagggg

SEQ ID NO: 4127 - DNA, 19 bp, Homo sapiens
aacaggcaaagctggaaaa

SEQ ID NO: 4128 - DNA, 17 bp, Homo sapiens
agcaaacacaggaggga

SEQ ID NO: 4129 - DNA, 20 bp, Homo sapiens
aggaagcacagcagggagga

SEQ ID NO: 4130 - DNA, 21 bp, Homo sapiens
gcaagcacgtacacttaaaag

SEQ ID NO: 4131 - DNA, 17 bp, Homo sapiens
agcaagcaagggagcgg

SEQ ID NO: 4132 - DNA, 22 bp, Homo sapiens
agaagcacagagggaccaggaa

SEQ ID NO: 4133 - DNA, 19 bp, Homo sapiens
gcaagtgattctggaaaag

SEQ ID NO: 4134 - DNA, 20 bp, Homo sapiens
aagcaaggggaaaactggaa

SEQ ID NO: 4135 - DNA, 21 bp, Homo sapiens
agacaggtatttctggaaaag

SEQ ID NO: 4136 - DNA, 20 bp, Homo sapiens
aagcaagcaagagatgatgg

SEQ ID NO: 4137 - DNA, 17 bp, Homo sapiens
gcaagcacagaaaagaa

SEQ ID NO: 4138 - DNA, 19 bp, Homo sapiens
agcaggcacagaggagaaa

SEQ ID NO: 4139 - DNA, 20 bp, Homo sapiens
aagcacggcacagagaggaa

SEQ ID NO: 4140 - DNA, 18 bp, Homo sapiens
aagcacggcacagagagg

SEQ ID NO: 4141 - DNA, 24 bp, Homo sapiens
aagctagcagccctgctggggaag

SEQ ID NO: 4142 - DNA, 21 bp, Homo sapiens
aagtcagcagcactggaaaag

SEQ ID NO: 4143 - DNA, 20 bp, Homo sapiens
gctcgcacggggactggaaa

SEQ ID NO: 4144 - DNA, 22 bp, Homo sapiens
gcaagcaagaaagctgggaaag

SEQ ID NO: 4145 - DNA, 18 bp, Homo sapiens
gccaggaggctggaaaag

SEQ ID NO: 4146 - DNA, 17 bp, Homo sapiens
aacacagagaagaaaaa

SEQ ID NO: 4147 - DNA, 16 bp, Homo sapiens
agaaagcagagactgg

SEQ ID NO: 4148 - DNA, 21 bp, Homo sapiens
agtgagcacacactagaaaag

SEQ ID NO: 4149 - DNA, 21 bp, Homo sapiens
aaacaaagcaggttggaaaag

SEQ ID NO: 4150 - DNA, 20 bp, Homo sapiens
aagcaagctagagagacagg

SEQ ID NO: 4151 - DNA, 19 bp, Homo sapiens
aagcaacacaggaccaaaa

SEQ ID NO: 4152 - DNA, 21 bp, Homo sapiens
aagctggtgcacctggaaaag

SEQ ID NO: 4153 - DNA, 19 bp, Homo sapiens
gcatcacatcttggaaaag

SEQ ID NO: 4154 - DNA, 23 bp, Homo sapiens
aagctgtgcaaaggctggaaaag

SEQ ID NO: 4155 - DNA, 19 bp, Homo sapiens
aaggagcacagaaaggaaa

SEQ ID NO: 4156 - DNA, 20 bp, Homo sapiens
gcaaacacagaagagaaaag

SEQ ID NO: 4157 - DNA, 18 bp, Homo sapiens
acccagagactggggaag

SEQ ID NO: 4158 - DNA, 17 bp, Homo sapiens
gcaaactactggaaaag

SEQ ID NO: 4159 - DNA, 16 bp, Homo sapiens
agaagcacaggacagg

SEQ ID NO: 4160 - DNA, 18 bp, Homo sapiens
aagcaagcacggaggtgg

SEQ ID NO: 4161 - DNA, 19 bp, Homo sapiens
aagcaagcagcaagtctgg

SEQ ID NO: 4162 - DNA, 22 bp, Homo sapiens
aagcaaacataggacgtgaaaa

SEQ ID NO: 4163 - DNA, 22 bp, Homo sapiens
aagcaagcaaggcagagaaaag

SEQ ID NO: 4164 - DNA, 18 bp, Homo sapiens
aagcaagctaggactgaa

SEQ ID NO: 4165 - DNA, 20 bp, Homo sapiens
gcagtggaggactggaaaag

SEQ ID NO: 4166 - DNA, 24 bp, Homo sapiens
aagctagtgttagatctggaaaag

SEQ ID NO: 4167 - DNA, 18 bp, Homo sapiens
aagcaagctcaggtggaa

SEQ ID NO: 4168 - DNA, 18 bp, Homo sapiens
gcaagaggaatagaaaag

SEQ ID NO: 4169 - DNA, 21 bp, Homo sapiens
aagcaagctcaggggcactgg

SEQ ID NO: 4170 - DNA, 19 bp, Homo sapiens
aagcaagcgagaggcgcgg

SEQ ID NO: 4171 - DNA, 27 bp, Homo sapiens
aagcaagcatggaagctcatgaaaaag

SEQ ID NO: 4172 - DNA, 22 bp, Homo sapiens
aagtaatcacagaaaaccggaa

SEQ ID NO: 4173 - DNA, 19 bp, Homo sapiens
aaggagcacagaaaagaaa

SEQ ID NO: 4174 - DNA, 21 bp, Homo sapiens
aagcagggcagaggggctaag

SEQ ID NO: 4175 - DNA, 21 bp, Homo sapiens
gccagagcgagactgggaaag

SEQ ID NO: 4176 - DNA, 20 bp, Homo sapiens
agcaaacatgggaggtagaa

SEQ ID NO: 4177 - DNA, 20 bp, Homo sapiens
aagcaatcacagaaacaaga

SEQ ID NO: 4178 - DNA, 21 bp, Homo sapiens
aagcaaacctaactgggaaag

SEQ ID NO: 4179 - DNA, 19 bp, Homo sapiens
aagcaggcaagaggcctgg

SEQ ID NO: 4180 - DNA, 18 bp, Homo sapiens
gcaagcacaaagacaagg

SEQ ID NO: 4181 - DNA, 19 bp, Homo sapiens
caagccggggactggaaaa

SEQ ID NO: 4182 - DNA, 21 bp, Homo sapiens
aagcaacacagaggagcaagg

SEQ ID NO: 4183 - DNA, 18 bp, Homo sapiens
aggacagaagactggaaa

SEQ ID NO: 4184 - DNA, 24 bp, Homo sapiens
agcaagcatgtgagcctggagaag

SEQ ID NO: 4185 - DNA, 17 bp, Homo sapiens
agccaagcacagggagg

SEQ ID NO: 4186 - DNA, 22 bp, Homo sapiens
aagcgggcacagaagtatctgg

SEQ ID NO: 4187 - DNA, 18 bp, Homo sapiens
acaggcacagagctaaaa

SEQ ID NO: 4188 - DNA, 18 bp, Homo sapiens
acaggcacagagaactga

SEQ ID NO: 4189 - DNA, 18 bp, Homo sapiens
agcaagcacaaagaccgg

SEQ ID NO: 4190 - DNA, 18 bp, Homo sapiens
aagcagtcacagatgaaa

SEQ ID NO: 4191 - DNA, 19 bp, Homo sapiens
gcaggacaaaatggaaaag

SEQ ID NO: 4192 - DNA, 18 bp, Homo sapiens
aaacaagtacagagactg

SEQ ID NO: 4193 - DNA, 20 bp, Homo sapiens
aagaagcttttggactggaa

SEQ ID NO: 4194 - DNA, 18 bp, Homo sapiens
agcaagcaaagaggatag

SEQ ID NO: 4195 - DNA, 18 bp, Homo sapiens
gcaagcacagagacggga

SEQ ID NO: 4196 - DNA, 23 bp, Homo sapiens
aagaaagcacagaggacatgaga

SEQ ID NO: 4197 - DNA, 22 bp, Homo sapiens
gcaagacattcatttggaaaag

SEQ ID NO: 4198 - DNA, 17 bp, Homo sapiens
agccagtcactggaaaa

SEQ ID NO: 4199 - DNA, 16 bp, Homo sapiens
acaagcacaggaggga

SEQ ID NO: 4200 - DNA, 17 bp, Homo sapiens
aagaagcacagaggtgg

SEQ ID NO: 4201 - DNA, 17 bp, Homo sapiens
agcagcacagaatgaaa

SEQ ID NO: 4202 - DNA, 19 bp, Homo sapiens
agcaggagctaagactgga

SEQ ID NO: 4203 - DNA, 19 bp, Homo sapiens
acagtaacaatagactgga

SEQ ID NO: 4204 - DNA, 21 bp, Homo sapiens
gccagcacagagtgacccagg

SEQ ID NO: 4205 - DNA, 17 bp, Homo sapiens
gcaagcgcagactagaa

SEQ ID NO: 4206 - DNA, 16 bp, Homo sapiens
aagaagcacaggaaga

SEQ ID NO: 4207 - DNA, 20 bp, Homo sapiens
agcaggggcagagacttgga

SEQ ID NO: 4208 - DNA, 18 bp, Homo sapiens
aagcaatatagagactag

SEQ ID NO: 4209 - DNA, 19 bp, Homo sapiens
agcaagcactgacacaagg

SEQ ID NO: 4210 - DNA, 22 bp, Homo sapiens
agctgagcacagaatgtgggaa

SEQ ID NO: 4211 - DNA, 19 bp, Homo sapiens
aagcacagcacggggactg

SEQ ID NO: 4212 - DNA, 16 bp, Homo sapiens
agcaagacagaaaagg

SEQ ID NO: 4213 - DNA, 19 bp, Homo sapiens
agcaggcacagagtcagaa

SEQ ID NO: 4214 - DNA, 21 bp, Homo sapiens
gcaggcccagaacaaaaaaag

SEQ ID NO: 4215 - DNA, 16 bp, Homo sapiens
gcaagcacaggaggga

SEQ ID NO: 4216 - DNA, 24 bp, Homo sapiens
agctgcatatggagactggggaag

SEQ ID NO: 4217 - DNA, 19 bp, Homo sapiens
aagtcagcacagagaccag

SEQ ID NO: 4218 - DNA, 20 bp, Homo sapiens
aagcaagcaagaaaaaggaa

SEQ ID NO: 4219 - DNA, 22 bp, Homo sapiens
acagcagtgaggattggaaaag

SEQ ID NO: 4220 - DNA, 69 bp, Cryphonectria hypovirus 1
gggttgcccgaaagtatgggctacgcgcttcgttgtaaagctacccatacaaaacccttcggcgcactc

SEQ ID NO: 4221 - DNA, 24 bp, Cryphonectria hypovirus 1
tacccatacaaaacccttcggcgc

SEQ ID NO: 4222 - DNA, 18 bp, Homo sapiens
ccatacaagatccaacac

SEQ ID NO: 4223 - DNA, 20 bp, Homo sapiens
tacctatacaaaagtcaagc

SEQ ID NO: 4224 - DNA, 19 bp, Homo sapiens
taccttacaaaacttcggc

SEQ ID NO: 4225 - DNA, 19 bp, Homo sapiens
cccatacaaagcttttcag

SEQ ID NO: 4226 - DNA, 16 bp, Homo sapiens
ccacacaaaatcctgc

SEQ ID NO: 4227 - DNA, 72 bp, Cryphonectria hypovirus 1
gatccagctgtggtgcctaaggacatcagggacaagtaccccctggttccgaacggtgaccacaacgagatc

SEQ ID NO: 4228 - DNA, 24 bp, Cryphonectria hypovirus 1
tgtggtgcctaaggacatcaggga

SEQ ID NO: 4229 - DNA, 18 bp, Homo sapiens
tgcggtgcctgctcgggg

SEQ ID NO: 4230 - DNA, 19 bp, Homo sapiens
tgtggtgcctgaaggcgtc

SEQ ID NO: 4231 - DNA, 19 bp, Homo sapiens
tgtggtgctgagtcgaggg

SEQ ID NO: 4232 - DNA, 20 bp, Homo sapiens
tgtggtgccctgagggcacc

SEQ ID NO: 4233 - DNA, 19 bp, Homo sapiens
tgtggtgctgagggcagga

SEQ ID NO: 4234 - DNA, 22 bp, Homo sapiens
tgtggtgctggggggtcatggg

SEQ ID NO: 4235 - DNA, 17 bp, Homo sapiens
tgtggtgcctgagcagg

SEQ ID NO: 4236 - DNA, 19 bp, Homo sapiens
tgtggagcagacatcaggg

SEQ ID NO: 4237 - DNA, 17 bp, Homo sapiens
gtggtgcctggggaggg

SEQ ID NO: 4238 - DNA, 18 bp, Homo sapiens
tgtggtgcctacctaggg

SEQ ID NO: 4239 - DNA, 18 bp, Homo sapiens
gtggtgcctggaccaggg

SEQ ID NO: 4240 - DNA, 22 bp, Homo sapiens
tgtggtgctctgaggacacggg

SEQ ID NO: 4241 - DNA, 22 bp, Homo sapiens
tgtggtgctaagaggccaggga

SEQ ID NO: 4242 - DNA, 19 bp, Homo sapiens
tgtgctgctatatcaggga

SEQ ID NO: 4243 - DNA, 23 bp, Homo sapiens
tgtgtgcccctcctacatcaggg

SEQ ID NO: 4244 - DNA, 21 bp, Homo sapiens
tggggttctggatatcaggga

SEQ ID NO: 4245 - DNA, 21 bp, Homo sapiens
tggtgcccctggcatcaggga

SEQ ID NO: 4246 - DNA, 21 bp, Homo sapiens
tgtggtgctaagaagaaggga

SEQ ID NO: 4247 - DNA, 72 bp, Cryphonectria hypovirus 1
ctctcccagtttactcaatatacaccgcgagttctcaacgaactcgtcgtgtggttgaaaggactaggggag

SEQ ID NO: 4248 - DNA, 24 bp, Cryphonectria hypovirus 1
gtcgtgtggttgaaaggactaggg

SEQ ID NO: 4249 - DNA, 18 bp, Homo sapiens
gtcctgtggttggagagg

SEQ ID NO: 4250 - DNA, 26 bp, Homo sapiens
gtcatgtggttgaagacagttttggg

SEQ ID NO: 4251 - DNA, 15 bp, Homo sapiens
tgtggttgagacagg

SEQ ID NO: 4252 - DNA, 19 bp, Homo sapiens
gtcgtgtggttgcagggct

SEQ ID NO: 4253 - DNA, 131 bp, Cryphonectria hypovirus 1
catctcaggagttttagtgttaccgtcctgcgcaagcaaagatgagaactatacctttgacaacaaagggtatagggatcggaaaggccgctgcagtaggattcagacaaataaattttctcttgaaaatg

SEQ ID NO: 4254 - DNA, 24 bp, Cryphonectria hypovirus 1
tctcaggagttttagtgttaccgt

SEQ ID NO: 4255 - DNA, 18 bp, Homo sapiens
cctaaaattttagtgtta

SEQ ID NO: 4256 - DNA, 24 bp, Homo sapiens
tctcagagttttatataaaactgt

SEQ ID NO: 4257 - DNA, 19 bp, Homo sapiens
tcttagaagttttaaaatc

SEQ ID NO: 4258 - DNA, 18 bp, Homo sapiens
aggagtatcaggtactgt

SEQ ID NO: 4259 - DNA, 17 bp, Homo sapiens
tctcaagagtttctgct

SEQ ID NO: 4260 - DNA, 22 bp, Homo sapiens
aggagtttttaggtattaccgt

SEQ ID NO: 4261 - DNA, 21 bp, Homo sapiens
tcaggggcttttagtcaccgt

SEQ ID NO: 4262 - DNA, 20 bp, Homo sapiens
ctcaggagtttgaagttgct

SEQ ID NO: 4263 - DNA, 62 bp, Cryphonectria hypovirus 1
ttttcttttgttggctattccctttcaccgtgcgtacggtgggaagagaacaacaaagaaaa

SEQ ID NO: 4264 - DNA, 23 bp, Cryphonectria hypovirus 1
tgggaagagaacaacaaagaaaa

SEQ ID NO: 4265 - DNA, 17 bp, Homo sapiens
tgggaaagaacacagag

SEQ ID NO: 4266 - DNA, 22 bp, Homo sapiens
tgggaagagagggaactgagaa

SEQ ID NO: 4267 - DNA, 21 bp, Homo sapiens
tgggagaaaccgtcaaagaaa

SEQ ID NO: 4268 - DNA, 21 bp, Homo sapiens
gggaggagctgtcacaaagaa

SEQ ID NO: 4269 - DNA, 18 bp, Homo sapiens
tgggagaggaacacaaag

SEQ ID NO: 4270 - DNA, 23 bp, Homo sapiens
ggggagagagaaacaaaagaaaa

SEQ ID NO: 4271 - DNA, 17 bp, Homo sapiens
gggaaaaaagcaaagaa

SEQ ID NO: 4272 - DNA, 20 bp, Homo sapiens
tgggaagatggacagcaaag

SEQ ID NO: 4273 - DNA, 25 bp, Homo sapiens
tgggaagagggagaactacaggaaa

SEQ ID NO: 4274 - DNA, 17 bp, Homo sapiens
tgggaaaaggacaaaga

SEQ ID NO: 4275 - DNA, 19 bp, Homo sapiens
tgggagaaagtaaagaaaa

SEQ ID NO: 4276 - DNA, 17 bp, Homo sapiens
ggggggagaaaagaaaa

SEQ ID NO: 4277 - DNA, 19 bp, Homo sapiens
tgggaaaaggaagcaaaga

SEQ ID NO: 4278 - DNA, 22 bp, Homo sapiens
tgggaatgaggactggggaaga

SEQ ID NO: 4279 - DNA, 20 bp, Homo sapiens
tgggaagagcgcagctgaaa

SEQ ID NO: 4280 - DNA, 19 bp, Homo sapiens
tgggaaaagaatgccaaaa

SEQ ID NO: 4281 - DNA, 18 bp, Homo sapiens
gggaagaggacagtagaa

SEQ ID NO: 4282 - DNA, 18 bp, Homo sapiens
tgggaaaaaaataaagaa

SEQ ID NO: 4283 - DNA, 21 bp, Homo sapiens
gggaagagacacacacaagga

SEQ ID NO: 4284 - DNA, 19 bp, Homo sapiens
tgagaagaggacagcaaaa

SEQ ID NO: 4285 - DNA, 24 bp, Homo sapiens
tgggaagagacagaccaacaggaa

SEQ ID NO: 4286 - DNA, 18 bp, Homo sapiens
tgggtaagagaacaatca

SEQ ID NO: 4287 - DNA, 16 bp, Homo sapiens
tgggaggacaacaaag

SEQ ID NO: 4288 - DNA, 18 bp, Homo sapiens
gggacaggccaaagaaaa

SEQ ID NO: 4289 - DNA, 19 bp, Homo sapiens
gggaagagcaccccagaga

SEQ ID NO: 4290 - DNA, 23 bp, Homo sapiens
tggagcagagatggcaaagaaaa

SEQ ID NO: 4291 - DNA, 18 bp, Homo sapiens
gggaagaggccagagaaa

SEQ ID NO: 4292 - DNA, 21 bp, Homo sapiens
taggaagaggggacagaaaga

SEQ ID NO: 4293 - DNA, 16 bp, Homo sapiens
gggaagagaacgaaga

SEQ ID NO: 4294 - DNA, 18 bp, Homo sapiens
gaaggacaataaagaaaa

SEQ ID NO: 4295 - DNA, 18 bp, Homo sapiens
tggaaagagactaagaaa

SEQ ID NO: 4296 - DNA, 21 bp, Homo sapiens
tgggggtaactagacaaagaa

SEQ ID NO: 4297 - DNA, 18 bp, Homo sapiens
taggaagccacaaagaaa

SEQ ID NO: 4298 - DNA, 20 bp, Homo sapiens
agaactgaatgacaaagaaa

SEQ ID NO: 4299 - DNA, 18 bp, Homo sapiens
taggaagagacagtgaag

SEQ ID NO: 4300 - DNA, 19 bp, Homo sapiens
ggaaagaaaagcaggagaa

SEQ ID NO: 4301 - DNA, 18 bp, Homo sapiens
tgggaagaggacaaaaga

SEQ ID NO: 4302 - DNA, 19 bp, Homo sapiens
gggaagaggacggacagag

SEQ ID NO: 4303 - DNA, 17 bp, Homo sapiens
tggaaggagaaaagaaa

SEQ ID NO: 4304 - DNA, 18 bp, Homo sapiens
tgggaagttgcaaagaaa

SEQ ID NO: 4305 - DNA, 18 bp, Homo sapiens
taggaagagaaggcatag

SEQ ID NO: 4306 - DNA, 16 bp, Homo sapiens
tgggggagaaaagaaa

SEQ ID NO: 4307 - DNA, 15 bp, Homo sapiens
gggaagcacaaagaa

SEQ ID NO: 4308 - DNA, 21 bp, Homo sapiens
tgggaatgagagagcaaaaga

SEQ ID NO: 4309 - DNA, 21 bp, Homo sapiens
tgggaagagagcaaatccaag

SEQ ID NO: 4310 - DNA, 20 bp, Homo sapiens
tgggagaaaacgtagggaaa

SEQ ID NO: 4311 - DNA, 20 bp, Homo sapiens
tgagaggaaaacaagggaaa

SEQ ID NO: 4312 - DNA, 17 bp, Homo sapiens
gggaaaaaaaaaagaaa

SEQ ID NO: 4313 - DNA, 23 bp, Homo sapiens
tagaaagagaacagcaggggaaa

SEQ ID NO: 4314 - DNA, 22 bp, Homo sapiens
gggaggaggacggacaggaaaa

SEQ ID NO: 4315 - DNA, 23 bp, Homo sapiens
tgggaagagatagggtgaaagaa

SEQ ID NO: 4316 - DNA, 16 bp, Homo sapiens
tgggggagacacaaag

SEQ ID NO: 4317 - DNA, 21 bp, Homo sapiens
tgggaaaagaatgaaccacaa

SEQ ID NO: 4318 - DNA, 18 bp, Homo sapiens
ggaaacagaacaacaaag

SEQ ID NO: 4319 - DNA, 16 bp, Homo sapiens
ggaaagaacacagaga

SEQ ID NO: 4320 - DNA, 19 bp, Homo sapiens
gggaagaggatacataaaa

SEQ ID NO: 4321 - DNA, 18 bp, Homo sapiens
tgagaggagagaaagaaa

SEQ ID NO: 4322 - DNA, 20 bp, Homo sapiens
tgggaagaaatacaggaaag

SEQ ID NO: 4323 - DNA, 20 bp, Homo sapiens
tgggagagggcagggcaaag

SEQ ID NO: 4324 - DNA, 17 bp, Homo sapiens
tgggagaagaaaagaaa

SEQ ID NO: 4325 - DNA, 18 bp, Homo sapiens
gggaagagactgacaaag

SEQ ID NO: 4326 - DNA, 19 bp, Homo sapiens
tgaggaggaatcaaagaaa

SEQ ID NO: 4327 - DNA, 21 bp, Homo sapiens
taggaagagccctaaagaaaa

SEQ ID NO: 4328 - DNA, 18 bp, Homo sapiens
tgggaagacattgagaaa

SEQ ID NO: 4329 - DNA, 23 bp, Homo sapiens
tgggaagaaggtcagcagggaaa

SEQ ID NO: 4330 - DNA, 22 bp, Homo sapiens
tgggaaaagctatataacagag

SEQ ID NO: 4331 - DNA, 18 bp, Homo sapiens
tgggaaaagacaaagaaa

SEQ ID NO: 4332 - DNA, 19 bp, Homo sapiens
gggaggggagaaaagaaaa

SEQ ID NO: 4333 - DNA, 23 bp, Homo sapiens
tgggaagagaatacctgggagaa

SEQ ID NO: 4334 - DNA, 21 bp, Homo sapiens
ggaagagaaatgccaggaaaa

SEQ ID NO: 4335 - DNA, 20 bp, Homo sapiens
tgggcagtgaacaaagaaaa

SEQ ID NO: 4336 - DNA, 22 bp, Homo sapiens
tgcgacaaagcgacaaagaaaa

SEQ ID NO: 4337 - DNA, 20 bp, Homo sapiens
gggaagagaaccattgaaga

SEQ ID NO: 4338 - DNA, 17 bp, Homo sapiens
agaagaacaacaaagaa

SEQ ID NO: 4339 - DNA, 19 bp, Homo sapiens
tgggaagagaaggttaaga

SEQ ID NO: 4340 - DNA, 19 bp, Homo sapiens
tggggagagaacatgaaag

SEQ ID NO: 4341 - DNA, 18 bp, Homo sapiens
ggaagggcagcaaagaaa

SEQ ID NO: 4342 - DNA, 19 bp, Homo sapiens
gggaagagagacagggaaa

SEQ ID NO: 4343 - DNA, 21 bp, Homo sapiens
tggaaagagacaccgagaaaa

SEQ ID NO: 4344 - DNA, 18 bp, Homo sapiens
tgagaagaaacaaagaaa

SEQ ID NO: 4345 - DNA, 22 bp, Homo sapiens
tggaaagaggggcagtggagaa

SEQ ID NO: 4346 - DNA, 16 bp, Homo sapiens
gggaagagacaagaga

SEQ ID NO: 4347 - DNA, 20 bp, Homo sapiens
tgggaagagaaacaactgaa

SEQ ID NO: 4348 - DNA, 21 bp, Homo sapiens
tgggaagaaagctgcagaaaa

SEQ ID NO: 4349 - DNA, 22 bp, Homo sapiens
tgggaaaagtcaatggggaaaa

SEQ ID NO: 4350 - DNA, 16 bp, Homo sapiens
tgggaagagagaaaga

SEQ ID NO: 4351 - DNA, 17 bp, Homo sapiens
tgggaagaaacagaaag

SEQ ID NO: 4352 - DNA, 19 bp, Homo sapiens
tgggagagaagacaggaga

SEQ ID NO: 4353 - DNA, 16 bp, Homo sapiens
gggaagagaagagaaa

SEQ ID NO: 4354 - DNA, 26 bp, Homo sapiens
ggaagagaatgggacatcaaggaaaa

SEQ ID NO: 4355 - DNA, 17 bp, Homo sapiens
tggaaagagaaacagag

SEQ ID NO: 4356 - DNA, 24 bp, Homo sapiens
tgagaagagagacagttgcaaaga

SEQ ID NO: 4357 - DNA, 23 bp, Homo sapiens
tgggaagagaatcacaccacaga

SEQ ID NO: 4358 - DNA, 29 bp, Homo sapiens
tggaaagagattatgacagtggagaaaat

SEQ ID NO: 4359 - DNA, 20 bp, Homo sapiens
tggaaagagagcactgagaa

SEQ ID NO: 4360 - DNA, 16 bp, Homo sapiens
gggaagaagaaagaaa

SEQ ID NO: 4361 - DNA, 15 bp, Homo sapiens
tggaaagagaaaaga

SEQ ID NO: 4362 - DNA, 21 bp, Homo sapiens
gggaagtataaacaaagaaaa

SEQ ID NO: 4363 - DNA, 17 bp, Homo sapiens
gggaagaacacgaagaa

SEQ ID NO: 4364 - DNA, 20 bp, Homo sapiens
gggaagggagataaagaaaa

SEQ ID NO: 4365 - DNA, 19 bp, Homo sapiens
tgggaagggcaaaagaaaa

SEQ ID NO: 4366 - DNA, 20 bp, Homo sapiens
tgggaagagaagaatacaaa

SEQ ID NO: 4367 - DNA, 21 bp, Homo sapiens
tgggaaaagaacaaaacggaa

SEQ ID NO: 4368 - DNA, 22 bp, Homo sapiens
tggaaagagaacaaacctgaaa

SEQ ID NO: 4369 - DNA, 17 bp, Homo sapiens
ggaagagaaacaagaaa

SEQ ID NO: 4370 - DNA, 17 bp, Homo sapiens
tggggagacgacaaaga

SEQ ID NO: 4371 - DNA, 22 bp, Homo sapiens
tggggagaaaacaataagaaaa

SEQ ID NO: 4372 - DNA, 16 bp, Homo sapiens
tggaaagagagcaaag

SEQ ID NO: 4373 - DNA, 18 bp, Homo sapiens
tgagaaggggcaaagaaa

SEQ ID NO: 4374 - DNA, 19 bp, Homo sapiens
tgggaagaggagaaaaaaa

SEQ ID NO: 4375 - DNA, 19 bp, Homo sapiens
tgggagcggagcaacaaaa

SEQ ID NO: 4376 - DNA, 18 bp, Homo sapiens
tgggtagccacaaagaaa

SEQ ID NO: 4377 - DNA, 19 bp, Homo sapiens
tgagaagattaaaacaaag

SEQ ID NO: 4378 - DNA, 21 bp, Homo sapiens
tgagaaactgctaacaaagaa

SEQ ID NO: 4379 - DNA, 21 bp, Homo sapiens
tggtaacaaacagcaaagaaa

SEQ ID NO: 4380 - DNA, 22 bp, Homo sapiens
tgggaagagaaagacaagagaa

SEQ ID NO: 4381 - DNA, 23 bp, Homo sapiens
tggaaaaataacagcaaggaaaa

SEQ ID NO: 4382 - DNA, 26 bp, Homo sapiens
tgggtagagaaggatacggtgaagaa

SEQ ID NO: 4383 - DNA, 17 bp, Homo sapiens
ggaaagaggcagcaaag

SEQ ID NO: 4384 - DNA, 22 bp, Homo sapiens
tgggaagagatccatgggaaaa

SEQ ID NO: 4385 - DNA, 18 bp, Homo sapiens
gggagaaagaaaacaaag

SEQ ID NO: 4386 - DNA, 17 bp, Homo sapiens
gggagagagacagaaag

SEQ ID NO: 4387 - DNA, 19 bp, Homo sapiens
tgagaagaaaagcagagaa

SEQ ID NO: 4388 - DNA, 19 bp, Homo sapiens
tgggaaaagggtaacagag

SEQ ID NO: 4389 - DNA, 20 bp, Homo sapiens
ggaagagagtgcatcagaga

SEQ ID NO: 4390 - DNA, 21 bp, Homo sapiens
tgggaagaggaaacatgggaa

SEQ ID NO: 4391 - DNA, 22 bp, Homo sapiens
gggaagaggacagacgtgaaaa

SEQ ID NO: 4392 - DNA, 20 bp, Homo sapiens
tgggaagatggtaactaaaa

SEQ ID NO: 4393 - DNA, 19 bp, Homo sapiens
gggaaaacagcaaagaaaa

SEQ ID NO: 4394 - DNA, 24 bp, Homo sapiens
gggaagagtcaggctgacagggaa

SEQ ID NO: 4395 - DNA, 19 bp, Homo sapiens
gggaaggagaaacaaagaa

SEQ ID NO: 4396 - DNA, 17 bp, Homo sapiens
tgagaagaggcagagaa

SEQ ID NO: 4397 - DNA, 17 bp, Homo sapiens
taggaaaacaacaaaga

SEQ ID NO: 4398 - DNA, 20 bp, Homo sapiens
tgggacagacgcaaagaaaa

SEQ ID NO: 4399 - DNA, 18 bp, Homo sapiens
tgggaagaaaaaaagaaa

SEQ ID NO: 4400 - DNA, 18 bp, Homo sapiens
tggaaaaagacagagaaa

SEQ ID NO: 4401 - DNA, 21 bp, Homo sapiens
gaactagaataacaaagaaaa

SEQ ID NO: 4402 - DNA, 17 bp, Homo sapiens
tgagaagagcaaggaga

SEQ ID NO: 4403 - DNA, 19 bp, Homo sapiens
tgggaagaggcagcaagga

SEQ ID NO: 4404 - DNA, 15 bp, Homo sapiens
gggaagacaaagaaa

SEQ ID NO: 4405 - DNA, 17 bp, Homo sapiens
tgggaagaggcaagaga

SEQ ID NO: 4406 - DNA, 18 bp, Homo sapiens
tgggaagaacaacaggga

SEQ ID NO: 4407 - DNA, 19 bp, Homo sapiens
ggggagggcaccaaagaaa

SEQ ID NO: 4408 - DNA, 19 bp, Homo sapiens
tgggaaaaatctccaaaga

SEQ ID NO: 4409 - DNA, 25 bp, Homo sapiens
tggaaagactaggaataataaagaa

SEQ ID NO: 4410 - DNA, 15 bp, Homo sapiens
tgggaaaaaacaaag

SEQ ID NO: 4411 - DNA, 21 bp, Homo sapiens
tgagaagaggacagaagaaaa

SEQ ID NO: 4412 - DNA, 18 bp, Homo sapiens
tgggaagaaacaaggaga

SEQ ID NO: 4413 - DNA, 23 bp, Homo sapiens
tgggaggagggaagcaacagaga

SEQ ID NO: 4414 - DNA, 19 bp, Homo sapiens
taggaagagaatgggcaaa

SEQ ID NO: 4415 - DNA, 25 bp, Homo sapiens
tgggaagagtataaacatgggaaaa

SEQ ID NO: 4416 - DNA, 18 bp, Homo sapiens
tggaaagagacaggaaag

SEQ ID NO: 4417 - DNA, 22 bp, Homo sapiens
tgggaagcatcatcaaagaaaa

SEQ ID NO: 4418 - DNA, 20 bp, Homo sapiens
taggaagaggacagtgaaag

SEQ ID NO: 4419 - DNA, 16 bp, Homo sapiens
aggaggagcaaagaaa

SEQ ID NO: 4420 - DNA, 20 bp, Homo sapiens
tgggagagaacagaccaaaa

SEQ ID NO: 4421 - DNA, 23 bp, Homo sapiens
gggaagagagaaaaagcagagaa

SEQ ID NO: 4422 - DNA, 22 bp, Homo sapiens
tgagaagacgtgaacagagaga

SEQ ID NO: 4423 - DNA, 15 bp, Homo sapiens
tggaaagcacaaaga

SEQ ID NO: 4424 - DNA, 22 bp, Homo sapiens
gggagagagcacaggcaggaaa

SEQ ID NO: 4425 - DNA, 22 bp, Homo sapiens
gggaagggaccatctaaagaaa

SEQ ID NO: 4426 - DNA, 21 bp, Homo sapiens
gggaagaggactccagagaaa

SEQ ID NO: 4427 - DNA, 23 bp, Homo sapiens
tgggaagagggccagacctggaa

SEQ ID NO: 4428 - DNA, 20 bp, Homo sapiens
tgggaagagtagcaaggaga

SEQ ID NO: 4429 - DNA, 19 bp, Homo sapiens
tgggagatttccaaagaaa

SEQ ID NO: 4430 - DNA, 18 bp, Homo sapiens
tgggaaaagatcaagaaa

SEQ ID NO: 4431 - DNA, 21 bp, Homo sapiens
tgagaagaggcgaaaaagaaa

SEQ ID NO: 4432 - DNA, 16 bp, Homo sapiens
gggaagagacagagaa

SEQ ID NO: 4433 - DNA, 16 bp, Homo sapiens
tgggagagacaaagaa

SEQ ID NO: 4434 - DNA, 23 bp, Homo sapiens
aggatgaagaacagcaaagaaaa

SEQ ID NO: 4435 - DNA, 19 bp, Homo sapiens
tgggaaaagacacgaggaa

SEQ ID NO: 4436 - DNA, 20 bp, Homo sapiens
gggaagagagcaaacctcag

SEQ ID NO: 4437 - DNA, 16 bp, Homo sapiens
ggaaaaggcaaagaaa

SEQ ID NO: 4438 - DNA, 17 bp, Homo sapiens
gggaagagaataaaaga

SEQ ID NO: 4439 - DNA, 18 bp, Homo sapiens
ggagagtcgcaaagaaaa

SEQ ID NO: 4440 - DNA, 20 bp, Homo sapiens
gggaagaggggacaaggaaa

SEQ ID NO: 4441 - DNA, 21 bp, Homo sapiens
tgggaagcagagcaagtaaag

SEQ ID NO: 4442 - DNA, 18 bp, Homo sapiens
tggcaagagagaaagaaa

SEQ ID NO: 4443 - DNA, 20 bp, Homo sapiens
ggaagagaacacattcaaga

SEQ ID NO: 4444 - DNA, 20 bp, Homo sapiens
aggatttggaataacaaaga

SEQ ID NO: 4445 - DNA, 19 bp, Homo sapiens
tggaaagaaattaaagaaa

SEQ ID NO: 4446 - DNA, 26 bp, Homo sapiens
gggaagagagagccaggcagagaaaa

SEQ ID NO: 4447 - DNA, 18 bp, Homo sapiens
ggaaggaggcacaaagaa

SEQ ID NO: 4448 - DNA, 65 bp, Sheeppox virus
gtatatacttagatgagtcatttaaaacttgtctatttagttttagttctttctctaacttatac

SEQ ID NO: 4449 - DNA, 23 bp, Sheeppox virus
ttagttctttctctaacttatac

SEQ ID NO: 4450 - DNA, 15 bp, Homo sapiens
ttagttctctaactt

SEQ ID NO: 4451 - DNA, 19 bp, Homo sapiens
ttagttctctctctcctac

SEQ ID NO: 4452 - DNA, 23 bp, Homo sapiens
ttacttctttctaccctattata

SEQ ID NO: 4453 - DNA, 19 bp, Homo sapiens
ttagttcttttgcctcata

SEQ ID NO: 4454 - DNA, 72 bp, Bovine herpesvirus 1
ccgcatcaccgaccaggcgggcgcggggagcgggctctgctgcgtgttttcgcgcgtgtatggggagtgcgg

SEQ ID NO: 4455 - DNA, 24 bp, Bovine herpesvirus 1
ttcgcgcgtgtatggggagtgcgg

SEQ ID NO: 4456 - DNA, 24 bp, Homo sapiens
ttcgacgcgtggcgctgagtgcgg

SEQ ID NO: 4457 - DNA, 18 bp, Homo sapiens
ttcgcgcgtgcgtgtgcg

SEQ ID NO: 4458 - DNA, 61 bp, Bovine herpesvirus 1
cacccgcgcgcgccggccaacacggcctgccttacggccgtggcggtgggcggcgcggggg

SEQ ID NO: 4459 - DNA, 23 bp, Bovine herpesvirus 1
cgtggcggtgggcggcgcggggg

SEQ ID NO: 4460 - DNA, 21 bp, Homo sapiens
gtggcggtgggtgggaggggg

SEQ ID NO: 4461 - DNA, 19 bp, Homo sapiens
gtgcggtgggcggaggggg

SEQ ID NO: 4462 - DNA, 18 bp, Homo sapiens
cgggcgtggggcgcgggg

SEQ ID NO: 4463 - DNA, 17 bp, Homo sapiens
cgtggcgggggtggagg

SEQ ID NO: 4464 - DNA, 26 bp, Homo sapiens
gtggcggtgggactctgcggcggggg

SEQ ID NO: 4465 - DNA, 15 bp, Homo sapiens
cgtggggtgggcggg

SEQ ID NO: 4466 - DNA, 20 bp, Homo sapiens
cggggcggtgggcgggcagg

SEQ ID NO: 4467 - DNA, 17 bp, Homo sapiens
ggggcggccgcgcgggg

SEQ ID NO: 4468 - DNA, 19 bp, Homo sapiens
cggggcggtgggcgggcgg

SEQ ID NO: 4469 - DNA, 18 bp, Homo sapiens
ggcggtggggggcggggg

SEQ ID NO: 4470 - DNA, 18 bp, Homo sapiens
cggggcggtgggccgggg

SEQ ID NO: 4471 - DNA, 19 bp, Homo sapiens
cgggtggtgggcggcccgg

SEQ ID NO: 4472 - DNA, 19 bp, Homo sapiens
tggcggtgggcggccaagg

SEQ ID NO: 4473 - DNA, 21 bp, Homo sapiens
cgcggggaggcggcgcggggg

SEQ ID NO: 4474 - DNA, 18 bp, Homo sapiens
tggcggtgggcggctccg

SEQ ID NO: 4475 - DNA, 20 bp, Homo sapiens
gtggcagtgggggatggggg

SEQ ID NO: 4476 - DNA, 19 bp, Homo sapiens
gcggcgcggggcgcggggg

SEQ ID NO: 4477 - DNA, 19 bp, Homo sapiens
ggggtggccagcgcggggg

SEQ ID NO: 4478 - DNA, 22 bp, Homo sapiens
cgtgtgcccctgggtgtggggg

SEQ ID NO: 4479 - DNA, 21 bp, Homo sapiens
cgggcggtgggcggccggggg

SEQ ID NO: 4480 - DNA, 25 bp, Homo sapiens
cgggcggggggcggcggcgcggggg

SEQ ID NO: 4481 - DNA, 18 bp, Homo sapiens
cgtggcggtgtgcgcggg

SEQ ID NO: 4482 - DNA, 29 bp, Homo sapiens
atggcggtgggcggcgcccgcgcgggggc

SEQ ID NO: 4483 - DNA, 19 bp, Homo sapiens
gtggcggtgggtgggaggg

SEQ ID NO: 4484 - DNA, 24 bp, Homo sapiens
cgtggggtgggcggagcccggggg

SEQ ID NO: 4485 - DNA, 20 bp, Homo sapiens
cgtcggtgagggcgcggggg

SEQ ID NO: 4486 - DNA, 18 bp, Homo sapiens
catggcggtgggctgggg

SEQ ID NO: 4487 - DNA, 20 bp, Homo sapiens
gtggcggtgggcgggtgggg

SEQ ID NO: 4488 - DNA, 16 bp, Homo sapiens
gtggcggctcgcgggg

SEQ ID NO: 4489 - DNA, 18 bp, Homo sapiens
ggcggtgggagatggggg

SEQ ID NO: 4490 - DNA, 20 bp, Homo sapiens
cgtggcgggggttgcggggg

SEQ ID NO: 4491 - DNA, 20 bp, Homo sapiens
cggggcggtggcggcggggg

SEQ ID NO: 4492 - DNA, 20 bp, Homo sapiens
cgtggcgggggcgtgcaggg

SEQ ID NO: 4493 - DNA, 19 bp, Homo sapiens
ggggcgcggggcgcggggg

SEQ ID NO: 4494 - DNA, 18 bp, Homo sapiens
ggcgggcgggcgcggggg

SEQ ID NO: 4495 - DNA, 19 bp, Homo sapiens
gtgggtgggcgcgcggggg

SEQ ID NO: 4496 - DNA, 20 bp, Homo sapiens
ggggctgcgcggcgcggggg

SEQ ID NO: 4497 - DNA, 23 bp, Homo sapiens
ggcggtgggctggagggcggggg

SEQ ID NO: 4498 - DNA, 18 bp, Homo sapiens
cgtggcgggggcgggcgg

SEQ ID NO: 4499 - DNA, 20 bp, Homo sapiens
cctggcggtggtactggggg

SEQ ID NO: 4500 - DNA, 22 bp, Homo sapiens
gtggcggtgggggcggtggggg

SEQ ID NO: 4501 - DNA, 17 bp, Homo sapiens
cgggcggtggggcgggg

SEQ ID NO: 4502 - DNA, 22 bp, Homo sapiens
cgggcggcgccgggcgtggggg

SEQ ID NO: 4503 - DNA, 19 bp, Homo sapiens
tggcagagcggcgcggggg

SEQ ID NO: 4504 - DNA, 19 bp, Homo sapiens
cgtggtgactgcgcggggg

SEQ ID NO: 4505 - DNA, 18 bp, Homo sapiens
cgtggtggtgggcgccgg

SEQ ID NO: 4506 - DNA, 18 bp, Homo sapiens
cggggcggtgggacgggg

SEQ ID NO: 4507 - DNA, 17 bp, Homo sapiens
gtggggagggtgcgggg

SEQ ID NO: 4508 - DNA, 20 bp, Homo sapiens
ggtggcgggcggcgtggggg

SEQ ID NO: 4509 - DNA, 17 bp, Homo sapiens
cgtggggcagcgcgggg

SEQ ID NO: 4510 - DNA, 19 bp, Homo sapiens
ggcgggggcggcgtggggg

SEQ ID NO: 4511 - DNA, 19 bp, Homo sapiens
gtggcggtggggatggggg

SEQ ID NO: 4512 - DNA, 23 bp, Homo sapiens
cgtggcgatgggcggaaaaacgg

SEQ ID NO: 4513 - DNA, 18 bp, Homo sapiens
cgggcggtggtctcgggg

SEQ ID NO: 4514 - DNA, 17 bp, Homo sapiens
gtggcggtagggtggag

SEQ ID NO: 4515 - DNA, 19 bp, Homo sapiens
gtggcggtgggggtggggg

SEQ ID NO: 4516 - DNA, 19 bp, Homo sapiens
ggtggtgggcgccgatggg

SEQ ID NO: 4517 - DNA, 22 bp, Homo sapiens
cggggcggtgggcgggcagggg

SEQ ID NO: 4518 - DNA, 17 bp, Homo sapiens
tggcggtggcgttgggg

SEQ ID NO: 4519 - DNA, 17 bp, Homo sapiens
gtggcagtgggctgggg

SEQ ID NO: 4520 - DNA, 17 bp, Homo sapiens
gtgggggtgggcggtgg

SEQ ID NO: 4521 - DNA, 73 bp, Bovine herpesvirus 1
acgagattgtgaacctgcgcctggagatcgagcgcgcccgcgacgcggactttggggcgttttgccgcttcgt

SEQ ID NO: 4522 - DNA, 24 bp, Bovine herpesvirus 1
gcggactttggggcgttttgccgc

SEQ ID NO: 4523 - DNA, 19 bp, Homo sapiens
gcactttgggaagtgctgc

SEQ ID NO: 4524 - DNA, 18 bp, Homo sapiens
tttggagccttttgttgc

SEQ ID NO: 4525 - DNA, 18 bp, Homo sapiens
gaactttggggcttctgc

SEQ ID NO: 4526 - DNA, 20 bp, Homo sapiens
gcgggctttggggcccctgc

SEQ ID NO: 4527 - DNA, 18 bp, Homo sapiens
gcactttggggtgctcgc

SEQ ID NO: 4528 - DNA, 18 bp, Homo sapiens
gggttttggggcaggcca

SEQ ID NO: 4529 - DNA, 16 bp, Homo sapiens
gcggacttcggggtcc

SEQ ID NO: 4530 - DNA, 19 bp, Homo sapiens
gctgggttttgggggtcgc

SEQ ID NO: 4531 - DNA, 18 bp, Homo sapiens
gcgggctttgaggcctgc

SEQ ID NO: 4532 - DNA, 18 bp, Homo sapiens
gggctttggggccctctg

SEQ ID NO: 4533 - DNA, 16 bp, Homo sapiens
ggctttggtgccttgc

SEQ ID NO: 4534 - DNA, 18 bp, Homo sapiens
ggacaggccgtgttttgc

SEQ ID NO: 4535 - DNA, 19 bp, Homo sapiens
ggatgtttcattttgctgc

SEQ ID NO: 4536 - DNA, 17 bp, Homo sapiens
gggctctggggtgctgc

SEQ ID NO: 4537 - DNA, 16 bp, Homo sapiens
ggaccttggggcctgc

SEQ ID NO: 4538 - DNA, 75 bp, Bovine herpesvirus 1
gcggctcgcgcggcgggtaagcggacgagcctgccgcggcggcggcgggccccgtggacgccgccctcgagccgc

SEQ ID NO: 4539 - DNA, 24 bp, Bovine herpesvirus 1
ccccgtggacgccgccctcgagcc

SEQ ID NO: 4540 - DNA, 25 bp, Homo sapiens
ccgcggacgccgcctggggagagcc

SEQ ID NO: 4541 - DNA, 17 bp, Homo sapiens
cccgtggaacgtcgtgc

SEQ ID NO: 4542 - DNA, 19 bp, Homo sapiens
ccccgtgggtgcgcctagc

SEQ ID NO: 4543 - DNA, 19 bp, Homo sapiens
ccccgggacgccgccgagc

SEQ ID NO: 4544 - DNA, 18 bp, Homo sapiens
ccccgtggcgccccggag

SEQ ID NO: 4545 - DNA, 20 bp, Homo sapiens
ccccgtgggcctgggcgggc

SEQ ID NO: 4546 - DNA, 23 bp, Homo sapiens
ccttgaggacgccgtctctagcc

SEQ ID NO: 4547 - DNA, 20 bp, Homo sapiens
ccccgcgcccagccctcgag

SEQ ID NO: 4548 - DNA, 18 bp, Homo sapiens
cccttggacgccgccatc

SEQ ID NO: 4549 - DNA, 23 bp, Homo sapiens
cctggacaccaaagttcttgggc

SEQ ID NO: 4550 - DNA, 21 bp, Homo sapiens
cccgcgtgggctcctcgagcc

SEQ ID NO: 4551 - DNA, 17 bp, Homo sapiens
ccccgcgggcctactcg

SEQ ID NO: 4552 - DNA, 24 bp, Homo sapiens
ccccgtggatgtcccgcggccgag

SEQ ID NO: 4553 - DNA, 24 bp, Homo sapiens
ccacgtggatgctgccctcggagc

SEQ ID NO: 4554 - DNA, 22 bp, Homo sapiens
cctcggggacgccgtgagggcc

SEQ ID NO: 4555 - DNA, 18 bp, Homo sapiens
ccccgcgggcgccgctcc

SEQ ID NO: 4556 - DNA, 18 bp, Homo sapiens
ccggggccggccctcgag

SEQ ID NO: 4557 - DNA, 21 bp, Homo sapiens
ccccgtggctgccgtgtggcc

SEQ ID NO: 4558 - DNA, 16 bp, Homo sapiens
gtggagccgccccagc

SEQ ID NO: 4559 - DNA, 20 bp, Homo sapiens
cccgtggacctgcccgcgcc

SEQ ID NO: 4560 - DNA, 19 bp, Homo sapiens
ccccgtggaggcctgggcc

SEQ ID NO: 4561 - DNA, 21 bp, Homo sapiens
cgctcgccccgccctcgggcc

SEQ ID NO: 4562 - DNA, 18 bp, Homo sapiens
ccccgaggacgctcgagc

SEQ ID NO: 4563 - DNA, 19 bp, Homo sapiens
ccctggggacgccgcggag

SEQ ID NO: 4564 - DNA, 22 bp, Homo sapiens
cccgtggaccccggctagggcc

SEQ ID NO: 4565 - DNA, 19 bp, Homo sapiens
ccccgtgggcttctcagag

SEQ ID NO: 4566 - DNA, 24 bp, Homo sapiens
cccgtggaggtcctctcttcgggc

SEQ ID NO: 4567 - DNA, 19 bp, Homo sapiens
cctcgtggcgccgccctcg

SEQ ID NO: 4568 - DNA, 20 bp, Homo sapiens
ccccgtgggtgcctgccccg

SEQ ID NO: 4569 - DNA, 21 bp, Homo sapiens
cccggggcgccgcccgcagcc

SEQ ID NO: 4570 - DNA, 20 bp, Homo sapiens
cctcatggacgccctgggcc

SEQ ID NO: 4571 - DNA, 20 bp, Homo sapiens
ccgttgacgatgcctcgagc

SEQ ID NO: 4572 - DNA, 18 bp, Homo sapiens
ccaccgtgggtgccgagc

SEQ ID NO: 4573 - DNA, 19 bp, Homo sapiens
ccgcgtggacgctgccacc

SEQ ID NO: 4574 - DNA, 19 bp, Homo sapiens
cctcgaggacgccgacgag

SEQ ID NO: 4575 - DNA, 23 bp, Homo sapiens
ccccgtgggctcgctggggagcc

SEQ ID NO: 4576 - DNA, 19 bp, Homo sapiens
gcggcaccgccctcgggcc

SEQ ID NO: 4577 - DNA, 84 bp, Ectromelia virus
cgatgaatactttaatgacgttatacctctacataatgcttatagcgtgcaacgttgatataatgtcttatctcgtatatattg

SEQ ID NO: 4578 - DNA, 24 bp, Ectromelia virus
tataatgtcttatctcgtatatat

SEQ ID NO: 4579 - DNA, 20 bp, Homo sapiens
taatgtttcacctcgtatat

SEQ ID NO: 4580 - DNA, 21 bp, Homo sapiens
atgtcttataacaaaatatat

SEQ ID NO: 4581 - DNA, 19 bp, Homo sapiens
taatgtcttatttttacat

SEQ ID NO: 4582 - DNA, 66 bp, Rana tigrina ranavirus
tgagtttgtccacaagtttgagggcaagaacctgtttgcctctgtagactactgtgtaaagactca

SEQ ID NO: 4583 - DNA, 24 bp, Rana tigrina ranavirus
tccacaagtttgagggcaagaacc

SEQ ID NO: 4584 - DNA, 19 bp, Homo sapiens
tccacaaagggcaaggacc

SEQ ID NO: 4585 - DNA, 18 bp, Homo sapiens
cataagtttgagccaaaa

SEQ ID NO: 4586 - DNA, 19 bp, Homo sapiens
tccacaaggttgcaagaac

SEQ ID NO: 4587 - DNA, 17 bp, Homo sapiens
caagcctggcaggaacc

SEQ ID NO: 4588 - DNA, 24 bp, Homo sapiens
tccacagtgaagcaggcaagaacc

SEQ ID NO: 4589 - DNA, 18 bp, Homo sapiens
acaagctttggcaggaac

SEQ ID NO: 4590 - DNA, 20 bp, Homo sapiens
ccactatgggggcaggagcc

SEQ ID NO: 4591 - DNA, 18 bp, Homo sapiens
tccatgagtttgagacca

SEQ ID NO: 4592 - DNA, 19 bp, Homo sapiens
caggagtttgagacgaacc

SEQ ID NO: 4593 - DNA, 16 bp, Homo sapiens
cacaggctgacaagaa

SEQ ID NO: 4594 - DNA, 23 bp, Homo sapiens
cccgcaccttgagggtgggagcc

SEQ ID NO: 4595 - DNA, 16 bp, Homo sapiens
agcaagggcaaggacc

SEQ ID NO: 4596 - DNA, 19 bp, Homo sapiens
cacaagttggagtgagacc

SEQ ID NO: 4597 - DNA, 22 bp, Homo sapiens
cacacagggagaggggcaagaa

SEQ ID NO: 4598 - DNA, 17 bp, Homo sapiens
tccttaagtttgaagca

SEQ ID NO: 4599 - DNA, 20 bp, Homo sapiens
tccacaaatttggattgagc

SEQ ID NO: 4600 - DNA, 19 bp, Homo sapiens
tccaggagtttgagaccaa

SEQ ID NO: 4601 - DNA, 21 bp, Homo sapiens
cacagaaacagggcaagggcc

SEQ ID NO: 4602 - DNA, 18 bp, Homo sapiens
cacaagctaagtgagggc

SEQ ID NO: 4603 - DNA, 23 bp, Homo sapiens
tcccctccatgagggcaggaacc

SEQ ID NO: 4604 - DNA, 16 bp, Homo sapiens
tccgcgtggggcaaga

SEQ ID NO: 4605 - DNA, 18 bp, Homo sapiens
tcctgtcaggggcaagac

SEQ ID NO: 4606 - DNA, 25 bp, Homo sapiens
cccacaaaatagctgagggtgagaa

SEQ ID NO: 4607 - DNA, 19 bp, Homo sapiens
agtctaaagggcaagagcc

SEQ ID NO: 4608 - DNA, 17 bp, Homo sapiens
aagtttgaggaaagacc

SEQ ID NO: 4609 - DNA, 21 bp, Homo sapiens
tccgaggatgagggcgaggac

SEQ ID NO: 4610 - DNA, 22 bp, Homo sapiens
ccatacagacagggcaaggacc

SEQ ID NO: 4611 - DNA, 18 bp, Homo sapiens
cacgagtttgagaacaga

SEQ ID NO: 4612 - DNA, 21 bp, Homo sapiens
tccaaagtttccaggcaagaa

SEQ ID NO: 4613 - DNA, 21 bp, Homo sapiens
tccatcagtttaagtaggaac

SEQ ID NO: 4614 - DNA, 22 bp, Homo sapiens
tccacaagctcccaccaggggc

SEQ ID NO: 4615 - DNA, 19 bp, Homo sapiens
tcctcaggatggcaagaac

SEQ ID NO: 4616 - DNA, 18 bp, Homo sapiens
gcatgattgggcaagaac

SEQ ID NO: 4617 - DNA, 19 bp, Homo sapiens
tccgagaaaggcaagggcc

SEQ ID NO: 4618 - DNA, 22 bp, Homo sapiens
tcgggcagccagggcaagggcc

SEQ ID NO: 4619 - DNA, 22 bp, Homo sapiens
tccgcaggagcctgggcaagaa

SEQ ID NO: 4620 - DNA, 17 bp, Homo sapiens
tccacaaatttggcaga

SEQ ID NO: 4621 - DNA, 18 bp, Homo sapiens
tccagaagtttgagacca

SEQ ID NO: 4622 - DNA, 17 bp, Homo sapiens
tccaggtcagcaggaac

SEQ ID NO: 4623 - DNA, 20 bp, Homo sapiens
cccatgagtttgaggttaca

SEQ ID NO: 4624 - DNA, 22 bp, Homo sapiens
tctacaaagttcgcagcaagaa

SEQ ID NO: 4625 - DNA, 18 bp, Homo sapiens
tccaggagtttgagacca

SEQ ID NO: 4626 - DNA, 18 bp, Homo sapiens
acaggcaaggcaagggcc

SEQ ID NO: 4627 - DNA, 21 bp, Homo sapiens
tctgcaagtttgaggagcaag

SEQ ID NO: 4628 - DNA, 19 bp, Homo sapiens
tcaacattgctggggcaag

SEQ ID NO: 4629 - DNA, 19 bp, Homo sapiens
tccatgagcaggcaaggac

SEQ ID NO: 4630 - DNA, 15 bp, Homo sapiens
acaagaaaggcaaga

SEQ ID NO: 4631 - DNA, 22 bp, Homo sapiens
tccgagagtttacagccaagaa

SEQ ID NO: 4632 - DNA, 20 bp, Homo sapiens
tccaggagtttgagactggc

SEQ ID NO: 4633 - DNA, 18 bp, Homo sapiens
ccacaagccggtaagaac

SEQ ID NO: 4634 - DNA, 65 bp, Bovine herpesvirus 1
gccgagtggcggtcaacagcctcgcgccgggagagcccggtgcgaggcgcccggtgccgcttggc

SEQ ID NO: 4635 - DNA, 17 bp, Bovine herpesvirus 1
gcccggtgccgcttggc

SEQ ID NO: 4636 - DNA, 19 bp, Homo sapiens
gcccagtgcccaaattggc

SEQ ID NO: 4637 - DNA, 20 bp, Homo sapiens
gcaccggatccgagcttggc

SEQ ID NO: 4638 - DNA, 18 bp, Homo sapiens
gcccagtgccccgggggc

SEQ ID NO: 4639 - DNA, 18 bp, Homo sapiens
gcccgctgccacgctggc

SEQ ID NO: 4640 - DNA, 18 bp, Homo sapiens
gctcggcgccatcttggc

SEQ ID NO: 4641 - DNA, 18 bp, Homo sapiens
gcgccggtgcacacgagc

SEQ ID NO: 4642 - DNA, 19 bp, Homo sapiens
gcccagtgccctggatggc

SEQ ID NO: 4643 - DNA, 19 bp, Homo sapiens
gctcagctgctgcttggcg

SEQ ID NO: 4644 - DNA, 18 bp, Homo sapiens
accctgcagccgcttggc

SEQ ID NO: 4645 - DNA, 18 bp, Homo sapiens
gcccagtaaacgcttggc

SEQ ID NO: 4646 - DNA, 18 bp, Homo sapiens
gcccgtatcccgcttggc

SEQ ID NO: 4647 - DNA, 19 bp, Homo sapiens
gccaggggaaccgcttggc

SEQ ID NO: 4648 - DNA, 20 bp, Homo sapiens
cctggtgccgcgtgtttggc

SEQ ID NO: 4649 - DNA, 18 bp, Homo sapiens
gccgggtgccaccctggc

SEQ ID NO: 4650 - DNA, 19 bp, Homo sapiens
acccggtgctccacatggc

SEQ ID NO: 4651 - DNA, 23 bp, Homo sapiens
gcccggcaggctgctgtttggcg

SEQ ID NO: 4652 - DNA, 78 bp, Rana tigrina ranavirus
ttgcgactggtgcaacaatggtttcgctgaaggtttgagacatggcgtgagacatggtgtgacctaaaccattcgcaa

SEQ ID NO: 4653 - DNA, 24 bp, Rana tigrina ranavirus
tggcgtgagacatggtgtgaccta

SEQ ID NO: 4654 - DNA, 19 bp, Homo sapiens
tgattccatggtgtggcct

SEQ ID NO: 4655 - DNA, 16 bp, Homo sapiens
tggcgtggtggcatga

SEQ ID NO: 4656 - DNA, 24 bp, Homo sapiens
tggtgtgaatggaaggttggtctg

SEQ ID NO: 4657 - DNA, 24 bp, Homo sapiens
tggcatgaggctgccagtggcttg

SEQ ID NO: 4658 - DNA, 21 bp, Homo sapiens
tggtgtggacacagcagacct

SEQ ID NO: 4659 - DNA, 19 bp, Homo sapiens
tggtttgggaaacggtgtg

SEQ ID NO: 4660 - DNA, 17 bp, Homo sapiens
gcgtgagatgtgtccct

SEQ ID NO: 4661 - DNA, 22 bp, Homo sapiens
tggtgtgaagtgtgggattcct

SEQ ID NO: 4662 - DNA, 20 bp, Homo sapiens
tgatgtgaggcaggagacct

SEQ ID NO: 4663 - DNA, 20 bp, Homo sapiens
tggtgagagacatggtggtg

SEQ ID NO: 4664 - DNA, 18 bp, Homo sapiens
tggtgtggagcatggcat

SEQ ID NO: 4665 - DNA, 15 bp, Homo sapiens
tggcgtgagggtgga

SEQ ID NO: 4666 - DNA, 22 bp, Homo sapiens
tggcctggggcgtctctgccta

SEQ ID NO: 4667 - DNA, 18 bp, Homo sapiens
tggtgtgaggctgcgcct

SEQ ID NO: 4668 - DNA, 23 bp, Homo sapiens
tggtgtgagtcatttctggtctg

SEQ ID NO: 4669 - DNA, 21 bp, Homo sapiens
tggagtgcagtggtgtgatct

SEQ ID NO: 4670 - DNA, 21 bp, Homo sapiens
tggtgtgagggtctgaacgct

SEQ ID NO: 4671 - DNA, 20 bp, Homo sapiens
tggttgagacatgaggacct

SEQ ID NO: 4672 - DNA, 19 bp, Homo sapiens
tggcgtgagctcctgacct

SEQ ID NO: 4673 - DNA, 18 bp, Homo sapiens
tggtgtgagggtgtccct

SEQ ID NO: 4674 - DNA, 17 bp, Homo sapiens
tggtggtgagatgtgac

SEQ ID NO: 4675 - DNA, 21 bp, Homo sapiens
tggtgtgaggagcagggcctg

SEQ ID NO: 4676 - DNA, 17 bp, Homo sapiens
tggtgtgaaacagtcta

SEQ ID NO: 4677 - DNA, 19 bp, Homo sapiens
tggtgtgagcatggctcac

SEQ ID NO: 4678 - DNA, 19 bp, Homo sapiens
tggtgtgagggtgcagccc

SEQ ID NO: 4679 - DNA, 16 bp, Homo sapiens
tggtgtgtggtgtgac

SEQ ID NO: 4680 - DNA, 19 bp, Homo sapiens
tggtgtgacacaccttgac

SEQ ID NO: 4681 - DNA, 18 bp, Homo sapiens
tggtgtggacatggtacg

SEQ ID NO: 4682 - DNA, 21 bp, Homo sapiens
tggagtgcaatggtgtgatct

SEQ ID NO: 4683 - DNA, 65 bp, Bovine herpesvirus 1
gtcccagcgcgcgaattcgtggacgccgtctggcagccgcggcggacgtcgctggcgctggtgat

SEQ ID NO: 4684 - DNA, 24 bp, Bovine herpesvirus 1
cagccgcggcggacgtcgctggcg

SEQ ID NO: 4685 - DNA, 22 bp, Homo sapiens
gctgctggcgctagcgctggcg

SEQ ID NO: 4686 - DNA, 19 bp, Homo sapiens
ccgccgcggcgctgctggc

SEQ ID NO: 4687 - DNA, 21 bp, Homo sapiens
gcggcggcggtgggactggcg

SEQ ID NO: 4688 - DNA, 19 bp, Homo sapiens
cagccgcgggggcgcgggc

SEQ ID NO: 4689 - DNA, 15 bp, Homo sapiens
cagccgcggcggcgg

SEQ ID NO: 4690 - DNA, 19 bp, Homo sapiens
cagccgcgtggggctctgg

SEQ ID NO: 4691 - DNA, 19 bp, Homo sapiens
gctgcggcggcggatggcg

SEQ ID NO: 4692 - DNA, 19 bp, Homo sapiens
gccgcggcaggtgagggcg

SEQ ID NO: 4693 - DNA, 18 bp, Homo sapiens
cagctccggctcgctggc

SEQ ID NO: 4694 - DNA, 21 bp, Homo sapiens
gccgcggcgggcagtaagctg

SEQ ID NO: 4695 - DNA, 19 bp, Homo sapiens
cagccgcggcggtcgcggc

SEQ ID NO: 4696 - DNA, 20 bp, Homo sapiens
gccgcggccggaacctggcg

SEQ ID NO: 4697 - DNA, 18 bp, Homo sapiens
cgcggcggcggtctggcg

SEQ ID NO: 4698 - DNA, 19 bp, Homo sapiens
cagccgccggctttgctgg

SEQ ID NO: 4699 - DNA, 22 bp, Homo sapiens
cagctggcgaacaggtcgctgg

SEQ ID NO: 4700 - DNA, 24 bp, Homo sapiens
cagcagcggcggctactctgctgg

SEQ ID NO: 4701 - DNA, 21 bp, Homo sapiens
cagccgcggtcggtcggccgg

SEQ ID NO: 4702 - DNA, 22 bp, Homo sapiens
gccgcggcggacgggctcggcg

SEQ ID NO: 4703 - DNA, 20 bp, Homo sapiens
gctgcagcggagtgagctgg

SEQ ID NO: 4704 - DNA, 22 bp, Homo sapiens
cagccgcggcgcacgggattgg

SEQ ID NO: 4705 - DNA, 19 bp, Homo sapiens
cagccgcggcggggtgtgg

SEQ ID NO: 4706 - DNA, 18 bp, Homo sapiens
cggcgtgcggccgctggc

SEQ ID NO: 4707 - DNA, 20 bp, Homo sapiens
gctccggcggctgccgctgg

SEQ ID NO: 4708 - DNA, 19 bp, Homo sapiens
cagccgtggctgggcctgg

SEQ ID NO: 4709 - DNA, 19 bp, Homo sapiens
cagccgcggcggggattgc

SEQ ID NO: 4710 - DNA, 20 bp, Homo sapiens
gccgcggcgggggattggcg

SEQ ID NO: 4711 - DNA, 19 bp, Homo sapiens
gctgcggcgacaccaggcg

SEQ ID NO: 4712 - DNA, 17 bp, Homo sapiens
gccgcggcgatgttgct

SEQ ID NO: 4713 - DNA, 16 bp, Homo sapiens
gccgcggcgcggtggc

SEQ ID NO: 4714 - DNA, 19 bp, Homo sapiens
gccgcggcgggcgcgggcg

SEQ ID NO: 4715 - DNA, 17 bp, Homo sapiens
cagccgcgctccgctgg

SEQ ID NO: 4716 - DNA, 17 bp, Homo sapiens
gccgcggcggcgagggc

SEQ ID NO: 4717 - DNA, 24 bp, Homo sapiens
cagccgcgcgcccgcgcgctggcg

SEQ ID NO: 4718 - DNA, 21 bp, Homo sapiens
cagctgccgcggacgccggcg

SEQ ID NO: 4719 - DNA, 20 bp, Homo sapiens
gccgcgcggacgttggagcg

SEQ ID NO: 4720 - DNA, 18 bp, Homo sapiens
cagcagcggtggcctggc

SEQ ID NO: 4721 - DNA, 16 bp, Homo sapiens
cagccgcggccggcgg

SEQ ID NO: 4722 - DNA, 16 bp, Homo sapiens
gcggcggccgctggcg

SEQ ID NO: 4723 - DNA, 17 bp, Homo sapiens
gctgcggcggaggctgc

SEQ ID NO: 4724 - DNA, 17 bp, Homo sapiens
gccgcggcgggccgggc

SEQ ID NO: 4725 - DNA, 17 bp, Homo sapiens
gccgaggcctcgctggc

SEQ ID NO: 4726 - DNA, 18 bp, Homo sapiens
agccgcggtggaggtggc

SEQ ID NO: 4727 - DNA, 18 bp, Homo sapiens
cagccgcgcgggcgccgc

SEQ ID NO: 4728 - DNA, 19 bp, Homo sapiens
cagctctggccacgctggc

SEQ ID NO: 4729 - DNA, 17 bp, Homo sapiens
gcagcggcggaggtggc

SEQ ID NO: 4730 - DNA, 19 bp, Homo sapiens
gctcgcggcgggcgtgccg

SEQ ID NO: 4731 - DNA, 86 bp, Rana tigrina ranavirus
gctgctcttgctgctcttgctgctcttgctgctcttgctgctcttgctgctcttgctgctcttgctgctcttgctgctcttgctgc

SEQ ID NO: 4732 - DNA, 24 bp, Rana tigrina ranavirus
tcttgctgctcttgctgctcttgc

SEQ ID NO: 4733 - DNA, 22 bp, Homo sapiens
ctgctgctccccgccttcttgc

SEQ ID NO: 4734 - DNA, 23 bp, Homo sapiens
ctccccgcttcttgctgcttttg

SEQ ID NO: 4735 - DNA, 16 bp, Homo sapiens
ttgctgcttattcttg

SEQ ID NO: 4736 - DNA, 19 bp, Homo sapiens
tcttcctgggctgctcttg

SEQ ID NO: 4737 - DNA, 20 bp, Homo sapiens
tctgctgctctttcgccttg

SEQ ID NO: 4738 - DNA, 18 bp, Homo sapiens
gctgctcttaaacatttg

SEQ ID NO: 4739 - DNA, 18 bp, Homo sapiens
tcttgttacttcttttgc

SEQ ID NO: 4740 - DNA, 24 bp, Homo sapiens
ttgctgtttttgagacagtcttgc

SEQ ID NO: 4741 - DNA, 25 bp, Homo sapiens
tctgtgttgctcttgtctgaactgc

SEQ ID NO: 4742 - DNA, 24 bp, Homo sapiens
tcttgctgctgtgacttctcttgc

SEQ ID NO: 4743 - DNA, 21 bp, Homo sapiens
tcttgccgctcttgctcctgc

SEQ ID NO: 4744 - DNA, 21 bp, Homo sapiens
tctttttgtttcttgctcttg

SEQ ID NO: 4745 - DNA, 19 bp, Homo sapiens
tcttgctgctgttgtatgc

SEQ ID NO: 4746 - DNA, 22 bp, Homo sapiens
tcttactgttctaatcttttgc

SEQ ID NO: 4747 - DNA, 19 bp, Homo sapiens
ttcctgctcttgctgttct

SEQ ID NO: 4748 - DNA, 18 bp, Homo sapiens
ttgctgctcctgctccct

SEQ ID NO: 4749 - DNA, 18 bp, Homo sapiens
tcttgctgccttgctggc

SEQ ID NO: 4750 - DNA, 23 bp, Homo sapiens
tcttgctgtactttagtccttgc

SEQ ID NO: 4751 - DNA, 24 bp, Homo sapiens
tcctgctgctcttcctgctcttgc

SEQ ID NO: 4752 - DNA, 19 bp, Homo sapiens
tcttgctgccttgcacctg

SEQ ID NO: 4753 - DNA, 20 bp, Homo sapiens
ctgcagactgctgctcttgc

SEQ ID NO: 4754 - DNA, 19 bp, Homo sapiens
tcttgcttttctgcttttg

SEQ ID NO: 4755 - DNA, 18 bp, Homo sapiens
tcttgcctgcttctcttg

SEQ ID NO: 4756 - DNA, 19 bp, Homo sapiens
tcctgctgagctgttcttg

SEQ ID NO: 4757 - DNA, 21 bp, Homo sapiens
tcttctgctttcagctcttgc

SEQ ID NO: 4758 - DNA, 25 bp, Homo sapiens
tcttgctctcttgccatgtgcaagg

SEQ ID NO: 4759 - DNA, 25 bp, Homo sapiens
tcttgctcttcttgccaatgattgc

SEQ ID NO: 4760 - DNA, 20 bp, Homo sapiens
tcttcctgctccttttcttg

SEQ ID NO: 4761 - DNA, 25 bp, Homo sapiens
tcttgttctcttgctgtcgtcttgc

SEQ ID NO: 4762 - DNA, 21 bp, Homo sapiens
tgttgctcaggctgcttttgc

SEQ ID NO: 4763 - DNA, 19 bp, Homo sapiens
tcttgctcctcttgccgtg

SEQ ID NO: 4764 - DNA, 22 bp, Homo sapiens
tcttttgctcactgccctcttg

SEQ ID NO: 4765 - DNA, 74 bp, Bovine herpesvirus 1
ctggccgaccgcggcggcggcgagcgcttccgcgtggcgagcgcggcggttgcgccgctgcagcggctggccgg

SEQ ID NO: 4766 - DNA, 24 bp, Bovine herpesvirus 1
ggttgcgccgctgcagcggctggc

SEQ ID NO: 4767 - DNA, 19 bp, Homo sapiens
ggctgcgctgctgtgtggc

SEQ ID NO: 4768 - DNA, 22 bp, Homo sapiens
ggtggtggctgcagcggctggc

SEQ ID NO: 4769 - DNA, 24 bp, Homo sapiens
ggttgggctgcgatctcggctggc

SEQ ID NO: 4770 - DNA, 22 bp, Homo sapiens
ggctgtgctgccgccggctggc

SEQ ID NO: 4771 - DNA, 23 bp, Homo sapiens
ggtgcgccgctgcggccaccggc

SEQ ID NO: 4772 - DNA, 21 bp, Homo sapiens
ggctgtcatgcagcggttggc

SEQ ID NO: 4773 - DNA, 26 bp, Homo sapiens
ggtctgcgcggcagccggcggctggc

SEQ ID NO: 4774 - DNA, 18 bp, Homo sapiens
ggctgcgctagtggctgg

SEQ ID NO: 4775 - DNA, 66 bp, Rana tigrina ranavirus
gatctcaaagaccgatatggaaactcaaaccgttatcgggtacaataaaccatgactgtccagatt

SEQ ID NO: 4776 - DNA, 24 bp, Rana tigrina ranavirus
tcaaagaccgatatggaaactcaa

SEQ ID NO: 4777 - DNA, 19 bp, Homo sapiens
aaagacagaggaaaaactc

SEQ ID NO: 4778 - DNA, 21 bp, Homo sapiens
tcaaagactttatgaagctca

SEQ ID NO: 4779 - DNA, 20 bp, Homo sapiens
tcaaagactaatatgtctca

SEQ ID NO: 4780 - DNA, 20 bp, Homo sapiens
ccacttatatggaaactcaa

SEQ ID NO: 4781 - DNA, 19 bp, Homo sapiens
aggccaacacggggaactc

SEQ ID NO: 4782 - DNA, 21 bp, Homo sapiens
tcaaagactgagtggaagccc

SEQ ID NO: 4783 - DNA, 18 bp, Homo sapiens
aagaccgatgaaaactca

SEQ ID NO: 4784 - DNA, 18 bp, Homo sapiens
tcaagagccagaaactca

SEQ ID NO: 4785 - DNA, 18 bp, Homo sapiens
ccgagaaatggaaactca

SEQ ID NO: 4786 - DNA, 21 bp, Homo sapiens
tcatggaccaatagaaattca

SEQ ID NO: 4787 - DNA, 21 bp, Homo sapiens
ccaaggtccctgggaaactca

SEQ ID NO: 4788 - DNA, 19 bp, Homo sapiens
agactgcagggaaactcaa

SEQ ID NO: 4789 - DNA, 19 bp, Homo sapiens
tctaaggagaatggaaact

SEQ ID NO: 4790 - DNA, 18 bp, Homo sapiens
tcaaagactgggatctca

SEQ ID NO: 4791 - DNA, 18 bp, Homo sapiens
tcaaagactgaatgatca

SEQ ID NO: 4792 - DNA, 18 bp, Homo sapiens
aagccatatgtggaaact

SEQ ID NO: 4793 - DNA, 20 bp, Homo sapiens
tcaaagacagacccaattca

SEQ ID NO: 4794 - DNA, 18 bp, Homo sapiens
tcaaagacgatgctctca

SEQ ID NO: 4795 - DNA, 16 bp, Homo sapiens
tcaaagatgaaaactc

SEQ ID NO: 4796 - DNA, 21 bp, Homo sapiens
aaagacatttcaagaaactca

SEQ ID NO: 4797 - DNA, 20 bp, Homo sapiens
aaaaactatatggaaattca

SEQ ID NO: 4798 - DNA, 19 bp, Homo sapiens
tcaaagaccattttactca

SEQ ID NO: 4799 - DNA, 18 bp, Homo sapiens
tcaaagaccagaaactca

SEQ ID NO: 4800 - DNA, 17 bp, Homo sapiens
agagacactgaaactca

SEQ ID NO: 4801 - DNA, 19 bp, Homo sapiens
tcaaagactgataatgtga

SEQ ID NO: 4802 - DNA, 19 bp, Homo sapiens
aaaaacctagtggaattca

SEQ ID NO: 4803 - DNA, 19 bp, Homo sapiens
tcaaagactgaggctctca

SEQ ID NO: 4804 - DNA, 21 bp, Homo sapiens
tcaaagacatcttggagttca

SEQ ID NO: 4805 - DNA, 19 bp, Homo sapiens
gaacaatatggaaactcaa

SEQ ID NO: 4806 - DNA, 22 bp, Homo sapiens
tcaaagacgaccaacagaggct

SEQ ID NO: 4807 - DNA, 22 bp, Homo sapiens
tcaaagacctgtcccaggctca

SEQ ID NO: 4808 - DNA, 17 bp, Homo sapiens
agagacaaggaaactca

SEQ ID NO: 4809 - DNA, 19 bp, Homo sapiens
tcaaaggtgatgaaactca

SEQ ID NO: 4810 - DNA, 20 bp, Homo sapiens
tcaaagaagaattggaaact

SEQ ID NO: 4811 - DNA, 83 bp, Rana tigrina ranavirus
cagtcccgttgcccatgagcaggtacactttggttcaggaaactgcccaagacatcatgtacactccgatgggaaaggaactg

SEQ ID NO: 4812 - DNA, 24 bp, Rana tigrina ranavirus
tgcccatgagcaggtacactttgg

SEQ ID NO: 4813 - DNA, 21 bp, Homo sapiens
tgcctgtgagcagggtcccgg

SEQ ID NO: 4814 - DNA, 23 bp, Homo sapiens
tgcctgtaatcccagcactttgg

SEQ ID NO: 4815 - DNA, 23 bp, Homo sapiens
tgcctgtaatcccaacactttgg

SEQ ID NO: 4816 - DNA, 23 bp, Homo sapiens
tgcctgtaatctcagcactttgg

SEQ ID NO: 4817 - DNA, 23 bp, Homo sapiens
tgcctgtaatcctggcactttgg

SEQ ID NO: 4818 - DNA, 23 bp, Homo sapiens
tgcctataatctcagcactttgg

SEQ ID NO: 4819 - DNA, 23 bp, Homo sapiens
tgcctgtaatatcagcactttgg

SEQ ID NO: 4820 - DNA, 21 bp, Homo sapiens
tgtccattgcagacactttgg

SEQ ID NO: 4821 - DNA, 23 bp, Homo sapiens
tgcctgtaatccctgcactttgg

SEQ ID NO: 4822 - DNA, 23 bp, Homo sapiens
tgcctgtaatcctaacactttgg

SEQ ID NO: 4823 - DNA, 20 bp, Homo sapiens
gccgtgagattgcactttgg

SEQ ID NO: 4824 - DNA, 24 bp, Homo sapiens
tgctgatgacatcaaacactttgg

SEQ ID NO: 4825 - DNA, 18 bp, Homo sapiens
tgcctatgaggcactttg

SEQ ID NO: 4826 - DNA, 23 bp, Homo sapiens
tgcctgtcatcccagcactttgg

SEQ ID NO: 4827 - DNA, 23 bp, Homo sapiens
tgcctgtaatcctagcactttgg

SEQ ID NO: 4828 - DNA, 23 bp, Homo sapiens
tgcttgtaattctaacactttgg

SEQ ID NO: 4829 - DNA, 19 bp, Homo sapiens
tgtccagagcaggtctgtg

SEQ ID NO: 4830 - DNA, 23 bp, Homo sapiens
tgcctgtgatcccagcactttgg

SEQ ID NO: 4831 - DNA, 19 bp, Homo sapiens
tgcctatgtcagcactttg

SEQ ID NO: 4832 - DNA, 23 bp, Homo sapiens
tgcccgtaatcccagcactttgg

SEQ ID NO: 4833 - DNA, 23 bp, Homo sapiens
tgcctataatcctagcactttgg

SEQ ID NO: 4834 - DNA, 22 bp, Homo sapiens
tgcctgtaatccagcactttgg

SEQ ID NO: 4835 - DNA, 16 bp, Homo sapiens
ccatgagcagcatttg

SEQ ID NO: 4836 - DNA, 23 bp, Homo sapiens
tgcccatagtcccagcattttgg

SEQ ID NO: 4837 - DNA, 23 bp, Homo sapiens
tgcctataatcccaacactttgg

SEQ ID NO: 4838 - DNA, 21 bp, Homo sapiens
tgcctggagcaggtcccatgg

SEQ ID NO: 4839 - DNA, 23 bp, Homo sapiens
tgcctataatcccagcactttgg

SEQ ID NO: 4840 - DNA, 23 bp, Homo sapiens
tgcctgtaaccctagcactttgg

SEQ ID NO: 4841 - DNA, 22 bp, Homo sapiens
gcctgtgatcccagcactttgg

SEQ ID NO: 4842 - DNA, 23 bp, Homo sapiens
tgcctgtaatccaagcactttgg

SEQ ID NO: 4843 - DNA, 23 bp, Homo sapiens
tgcctgtaatcccggcactttgg

SEQ ID NO: 4844 - DNA, 23 bp, Homo sapiens
tgctcctgggcagaggcttttgg

SEQ ID NO: 4845 - DNA, 17 bp, Homo sapiens
gcctgtgagcaggcttg

SEQ ID NO: 4846 - DNA, 23 bp, Homo sapiens
tgcctgtaattccagcactttgg

SEQ ID NO: 4847 - DNA, 21 bp, Homo sapiens
tgcccatgagatgtattttgg

SEQ ID NO: 4848 - DNA, 19 bp, Homo sapiens
tgcccatggctcagttttg

SEQ ID NO: 4849 - DNA, 23 bp, Homo sapiens
tgcctataattccagcactttgg

SEQ ID NO: 4850 - DNA, 23 bp, Homo sapiens
tgcctgtaatttcagcactttgg

SEQ ID NO: 4851 - DNA, 17 bp, Homo sapiens
tgaacaggtggacttgg

SEQ ID NO: 4852 - DNA, 23 bp, Homo sapiens
tgcctgtagtgccagcactttgg

SEQ ID NO: 4853 - DNA, 23 bp, Homo sapiens
tgcctgtaattacagcactttgg

SEQ ID NO: 4854 - DNA, 23 bp, Homo sapiens
tgcctgttaacccagcactttgg

SEQ ID NO: 4855 - DNA, 18 bp, Homo sapiens
tgtccatgagcagggaca

SEQ ID NO: 4856 - DNA, 22 bp, Homo sapiens
gcccatgggatgggcactttgg

SEQ ID NO: 4857 - DNA, 23 bp, Homo sapiens
tgcctgtaatctcaacactttgg

SEQ ID NO: 4858 - DNA, 22 bp, Homo sapiens
ccatgagcaccctgggctttgg

SEQ ID NO: 4859 - DNA, 23 bp, Homo sapiens
tgcctgtatgcacagcactttgg

SEQ ID NO: 4860 - DNA, 18 bp, Homo sapiens
tgcccagagtaggtacac

SEQ ID NO: 4861 - DNA, 23 bp, Homo sapiens
tgcctgtaaacctagcactttgg

SEQ ID NO: 4862 - DNA, 97 bp, Bovine herpesvirus 1
gcgcagagctgtaccagcgcctggacgcgctgttgctgccgctgcagggcttcgcggggctgcgcgcggcgcccggcgcgctggagcggctgtgcgc

SEQ ID NO: 4863 - DNA, 24 bp, Bovine herpesvirus 1
taccagcgcctggacgcgctgttg

SEQ ID NO: 4864 - DNA, 17 bp, Homo sapiens
ccagcgccgggtccatt

SEQ ID NO: 4865 - DNA, 19 bp, Homo sapiens
caccagcgtctgggtgcac

SEQ ID NO: 4866 - DNA, 23 bp, Homo sapiens
gcgcagcttggggcgcgctgttg

SEQ ID NO: 4867 - DNA, 15 bp, Homo sapiens
ccagcgcctgggcct

SEQ ID NO: 4868 - DNA, 19 bp, Homo sapiens
ccagcgccttggccccttg

SEQ ID NO: 4869 - DNA, 64 bp, Rana tigrina ranavirus
gggccatggtcaaggcgtctggaaactggccatccactttggccacagccgccgtcgccatccc

SEQ ID NO: 4870 - DNA, 19 bp, Rana tigrina ranavirus
cagccgccgtcgccatccc

SEQ ID NO: 4871 - DNA, 18 bp, Homo sapiens
cagccaccggcctgtccc

SEQ ID NO: 4872 - DNA, 17 bp, Homo sapiens
cagtaccccgccatccc

SEQ ID NO: 4873 - DNA, 18 bp, Homo sapiens
gccgctgccgccgccatc

SEQ ID NO: 4874 - DNA, 17 bp, Homo sapiens
cagccgccgccgcctcc

SEQ ID NO: 4875 - DNA, 16 bp, Homo sapiens
cagccgcctcacaccc

SEQ ID NO: 4876 - DNA, 15 bp, Homo sapiens
agccccagccatccc

SEQ ID NO: 4877 - DNA, 15 bp, Homo sapiens
agcgccgccgatccc

SEQ ID NO: 4878 - DNA, 18 bp, Homo sapiens
gcctgctgtcgccatccc

SEQ ID NO: 4879 - DNA, 17 bp, Homo sapiens
cagcagccgccacttcc

SEQ ID NO: 4880 - DNA, 17 bp, Homo sapiens
cagccgccaggccttcc

SEQ ID NO: 4881 - DNA, 17 bp, Homo sapiens
cagccgccgccgccccc

SEQ ID NO: 4882 - DNA, 16 bp, Homo sapiens
cagccgccgccgctcc

SEQ ID NO: 4883 - DNA, 16 bp, Homo sapiens
cagctcaccaccatcc

SEQ ID NO: 4884 - DNA, 19 bp, Homo sapiens
gccgccgcccggccgtccc

SEQ ID NO: 4885 - DNA, 20 bp, Homo sapiens
cagccgccgctcgcaagccc

SEQ ID NO: 4886 - DNA, 21 bp, Homo sapiens
ccgccggggtcccgctatccc

SEQ ID NO: 4887 - DNA, 18 bp, Homo sapiens
ccgccgccgccgggtccc

SEQ ID NO: 4888 - DNA, 17 bp, Homo sapiens
cagccaccttcatatcc

SEQ ID NO: 4889 - DNA, 16 bp, Homo sapiens
cagcgccgccgctccc

SEQ ID NO: 4890 - DNA, 16 bp, Homo sapiens
cagccaccagcatccc

SEQ ID NO: 4891 - DNA, 18 bp, Homo sapiens
gccaccgtgcacagtccc

SEQ ID NO: 4892 - DNA, 18 bp, Homo sapiens
gcttgaccacgccatccc

SEQ ID NO: 4893 - DNA, 18 bp, Homo sapiens
cagcgcgccgccagctcc

SEQ ID NO: 4894 - DNA, 17 bp, Homo sapiens
cagccgccgccgcagcc

SEQ ID NO: 4895 - DNA, 20 bp, Homo sapiens
cagccgccatcgccccgtcc

SEQ ID NO: 4896 - DNA, 18 bp, Homo sapiens
agccaccgccacttgtcc

SEQ ID NO: 4897 - DNA, 18 bp, Homo sapiens
cagccgccggaggctccc

SEQ ID NO: 4898 - DNA, 18 bp, Homo sapiens
gccgccgcaccacgttcc

SEQ ID NO: 4899 - DNA, 21 bp, Homo sapiens
cagccgctgcacggcgcgtcc

SEQ ID NO: 4900 - DNA, 20 bp, Homo sapiens
gccgccctccccgccgtccc

SEQ ID NO: 4901 - DNA, 19 bp, Homo sapiens
cagtgtcctcagccatccc

SEQ ID NO: 4902 - DNA, 16 bp, Homo sapiens
cagccgccgccgcgcc

SEQ ID NO: 4903 - DNA, 16 bp, Homo sapiens
cagctgccgccgcccc

SEQ ID NO: 4904 - DNA, 18 bp, Homo sapiens
cagccgccgccgcctccc

SEQ ID NO: 4905 - DNA, 19 bp, Homo sapiens
cagccgccgctgcaactcc

SEQ ID NO: 4906 - DNA, 16 bp, Homo sapiens
caaccgccggcgtccc

SEQ ID NO: 4907 - DNA, 19 bp, Homo sapiens
tgaccgcagttgccatccc

SEQ ID NO: 4908 - DNA, 20 bp, Homo sapiens
cagccgcccgccgctgtccc

SEQ ID NO: 4909 - DNA, 17 bp, Homo sapiens
cagcgccgccggctccc

SEQ ID NO: 4910 - DNA, 17 bp, Homo sapiens
cagctcgccaccatccc

SEQ ID NO: 4911 - DNA, 18 bp, Homo sapiens
ccgccgccgccagctccc

SEQ ID NO: 4912 - DNA, 18 bp, Homo sapiens
ccgccgccgccgagtccc

SEQ ID NO: 4913 - DNA, 19 bp, Homo sapiens
cagtcccctgagccatccc

SEQ ID NO: 4914 - DNA, 18 bp, Homo sapiens
ccgccgcctccggatccc

SEQ ID NO: 4915 - DNA, 18 bp, Homo sapiens
ccggccgccgcccgtccc

SEQ ID NO: 4916 - DNA, 17 bp, Homo sapiens
cagcgtcaccagatccc

SEQ ID NO: 4917 - DNA, 19 bp, Homo sapiens
ccgccgtcccatacatccc

SEQ ID NO: 4918 - DNA, 17 bp, Homo sapiens
cagccgccatgcaaccc

SEQ ID NO: 4919 - DNA, 16 bp, Homo sapiens
cagccgccgcgatccc

SEQ ID NO: 4920 - DNA, 19 bp, Homo sapiens
cacccgcggccgccgttcc

SEQ ID NO: 4921 - DNA, 19 bp, Homo sapiens
cagccgccccccccgtccc

SEQ ID NO: 4922 - DNA, 23 bp, Homo sapiens
gccgccgcccctgcgccatcccg

SEQ ID NO: 4923 - DNA, 16 bp, Homo sapiens
cagccacctcgaatcc

SEQ ID NO: 4924 - DNA, 20 bp, Homo sapiens
ccgccgtcgccacgaatccc

SEQ ID NO: 4925 - DNA, 18 bp, Homo sapiens
cagctgccaccccatccc

SEQ ID NO: 4926 - DNA, 18 bp, Homo sapiens
caaccgccgcctcatccc

SEQ ID NO: 4927 - DNA, 16 bp, Homo sapiens
caggccaacgccatcc

SEQ ID NO: 4928 - DNA, 19 bp, Homo sapiens
agccaccgagtccgccatc

SEQ ID NO: 4929 - DNA, 20 bp, Homo sapiens
cagcgccgtcacatggtccc

SEQ ID NO: 4930 - DNA, 17 bp, Homo sapiens
cagccgccgttgcctcc

SEQ ID NO: 4931 - DNA, 19 bp, Homo sapiens
cagccaccctgtgccatcc

SEQ ID NO: 4932 - DNA, 19 bp, Homo sapiens
cagccgccctctgcagccc

SEQ ID NO: 4933 - DNA, 16 bp, Homo sapiens
cagccaccagccgtcc

SEQ ID NO: 4934 - DNA, 18 bp, Homo sapiens
cagccgccgcccagcacc

SEQ ID NO: 4935 - DNA, 20 bp, Homo sapiens
gcccgccgctcgccgtcccg

SEQ ID NO: 4936 - DNA, 18 bp, Homo sapiens
gctcgccgccgttatccc

SEQ ID NO: 4937 - DNA, 19 bp, Homo sapiens
cagccaccagccctcatcc

SEQ ID NO: 4938 - DNA, 16 bp, Homo sapiens
cacccgcgcgccatcc

SEQ ID NO: 4939 - DNA, 19 bp, Homo sapiens
cagccgccgccgagaaccc

SEQ ID NO: 4940 - DNA, 18 bp, Homo sapiens
ccgccgccgctcagtccc

SEQ ID NO: 4941 - DNA, 17 bp, Homo sapiens
cagctgccgccgctccc

SEQ ID NO: 4942 - DNA, 19 bp, Homo sapiens
gcccgtccgccaccattcc

SEQ ID NO: 4943 - DNA, 18 bp, Homo sapiens
cagtcgccgtcgccgccc

SEQ ID NO: 4944 - DNA, 18 bp, Homo sapiens
agtccccatcgccatccc

SEQ ID NO: 4945 - DNA, 16 bp, Homo sapiens
cagcccgtcgcctccc

SEQ ID NO: 4946 - DNA, 16 bp, Homo sapiens
cagccaccaacgtccc

SEQ ID NO: 4947 - DNA, 18 bp, Homo sapiens
cagtggccgagccatccc

SEQ ID NO: 4948 - DNA, 19 bp, Homo sapiens
gccgccaggccggccatcc

SEQ ID NO: 4949 - DNA, 16 bp, Homo sapiens
caacccacgccatccc

SEQ ID NO: 4950 - DNA, 19 bp, Homo sapiens
gccgccgccgccgcgtccc

SEQ ID NO: 4951 - DNA, 18 bp, Homo sapiens
ccgctgccaccaggtccc

SEQ ID NO: 4952 - DNA, 16 bp, Homo sapiens
cagccgccgcgcctcc

SEQ ID NO: 4953 - DNA, 18 bp, Homo sapiens
cagctgccgccgcctccc

SEQ ID NO: 4954 - DNA, 15 bp, Homo sapiens
cagccgccgcgtccc

SEQ ID NO: 4955 - DNA, 18 bp, Homo sapiens
ccgccgccgccagcgtcc

SEQ ID NO: 4956 - DNA, 16 bp, Homo sapiens
caggcgccgccgctcc

SEQ ID NO: 4957 - DNA, 17 bp, Homo sapiens
cagccgccgccgcggcc

SEQ ID NO: 4958 - DNA, 20 bp, Homo sapiens
ccgccgagtcgggccatccc

SEQ ID NO: 4959 - DNA, 16 bp, Homo sapiens
cagccacccggatccc

SEQ ID NO: 4960 - DNA, 16 bp, Homo sapiens
cagcgccgccgcgtcc

SEQ ID NO: 4961 - DNA, 17 bp, Homo sapiens
cagccgccgagcctccc

SEQ ID NO: 4962 - DNA, 18 bp, Homo sapiens
cagccgccatcacacacc

SEQ ID NO: 4963 - DNA, 17 bp, Homo sapiens
cagccgctgaccatccc

SEQ ID NO: 4964 - DNA, 19 bp, Homo sapiens
cagtcgccgccgcggctcc

SEQ ID NO: 4965 - DNA, 18 bp, Homo sapiens
gccgccgcggcgcatccc

SEQ ID NO: 4966 - DNA, 18 bp, Homo sapiens
cagccgccgccgaaaccc

SEQ ID NO: 4967 - DNA, 18 bp, Homo sapiens
agccgtcgtccaccatcc

SEQ ID NO: 4968 - DNA, 19 bp, Homo sapiens
cagccaccaggactgtccc

SEQ ID NO: 4969 - DNA, 22 bp, Homo sapiens
cagccgcccttcctgctgtccc

SEQ ID NO: 4970 - DNA, 19 bp, Homo sapiens
cagttaccgccgcggtccc

SEQ ID NO: 4971 - DNA, 21 bp, Homo sapiens
tgaccgccgtgtagccgttcc

SEQ ID NO: 4972 - DNA, 19 bp, Homo sapiens
cagctgcgacgaccatccc

SEQ ID NO: 4973 - DNA, 18 bp, Homo sapiens
agccactgtcaccatccc

SEQ ID NO: 4974 - DNA, 19 bp, Homo sapiens
gccgccccccgccgccatc

SEQ ID NO: 4975 - DNA, 19 bp, Homo sapiens
gccgccgccgcctcgtccc

SEQ ID NO: 4976 - DNA, 18 bp, Homo sapiens
cagtcgcggagccatccc

SEQ ID NO: 4977 - DNA, 17 bp, Homo sapiens
cagccactcaccatccc

SEQ ID NO: 4978 - DNA, 19 bp, Homo sapiens
ccgccgccgcccgcgtccc

SEQ ID NO: 4979 - DNA, 17 bp, Homo sapiens
cagccaccttctatccc

SEQ ID NO: 4980 - DNA, 18 bp, Homo sapiens
caaccgccccattgtccc

SEQ ID NO: 4981 - DNA, 17 bp, Homo sapiens
cagccaccctcccatcc

SEQ ID NO: 4982 - DNA, 19 bp, Homo sapiens
cagccgccgccgcggtgcc

SEQ ID NO: 4983 - DNA, 15 bp, Homo sapiens
cagcccgccgcctcc

SEQ ID NO: 4984 - DNA, 18 bp, Homo sapiens
gctgccgccatccatccc

SEQ ID NO: 4985 - DNA, 21 bp, Homo sapiens
cagccgcctaccctgccatcc

SEQ ID NO: 4986 - DNA, 18 bp, Homo sapiens
cagccctcaagccatccc

SEQ ID NO: 4987 - DNA, 19 bp, Homo sapiens
cagccgccctcggcgtccc

SEQ ID NO: 4988 - DNA, 19 bp, Homo sapiens
cagccacctctgccgtccc

SEQ ID NO: 4989 - DNA, 19 bp, Homo sapiens
gcccgccgtctagcgaccc

SEQ ID NO: 4990 - DNA, 17 bp, Homo sapiens
cagtaccagcgccatcc

SEQ ID NO: 4991 - DNA, 19 bp, Homo sapiens
cagcaccatcagctatccc

SEQ ID NO: 4992 - DNA, 16 bp, Homo sapiens
cagccaccgcgctccc

SEQ ID NO: 4993 - DNA, 19 bp, Homo sapiens
cagccgccgccgcttgtcc

SEQ ID NO: 4994 - DNA, 21 bp, Homo sapiens
cagccgccgcccagctattcc

SEQ ID NO: 4995 - DNA, 19 bp, Homo sapiens
accgccctggcgccatccc

SEQ ID NO: 4996 - DNA, 17 bp, Homo sapiens
caggcgtgcaccatccc

SEQ ID NO: 4997 - DNA, 19 bp, Homo sapiens
gccgccttcccgccgtccc

SEQ ID NO: 4998 - DNA, 19 bp, Homo sapiens
agccgcgtgtagccatccc

SEQ ID NO: 4999 - DNA, 21 bp, Homo sapiens
cagccaccatcaccttgtccc

SEQ ID NO: 5000 - DNA, 18 bp, Homo sapiens
cagccgacatcaccatcc

SEQ ID NO: 5001 - DNA, 17 bp, Homo sapiens
caaccgccgtcactccc

SEQ ID NO: 5002 - DNA, 97 bp, Rana tigrina ranavirus
aagtggaccgggaggaccgaggaagagtctttcctgatctctgacatgatgggtcagatcaagacaggttggattagatctgggcccccgtcctctt

SEQ ID NO: 5003 - DNA, 21 bp, Rana tigrina ranavirus
gatctgggcccccgtcctctt

SEQ ID NO: 5004 - DNA, 17 bp, Homo sapiens
ctgggcttcatcctcct

SEQ ID NO: 5005 - DNA, 24 bp, Homo sapiens
gatctaggttcaagctgtcttctt

SEQ ID NO: 5006 - DNA, 17 bp, Homo sapiens
aatctgggcctcggcct

SEQ ID NO: 5007 - DNA, 18 bp, Homo sapiens
tctgggctgggccctctt

SEQ ID NO: 5008 - DNA, 19 bp, Homo sapiens
gatctggataatccttctt

SEQ ID NO: 5009 - DNA, 19 bp, Homo sapiens
gaccttctcctgtcctctt

SEQ ID NO: 5010 - DNA, 20 bp, Homo sapiens
tctgaggttcctttcctctt

SEQ ID NO: 5011 - DNA, 24 bp, Homo sapiens
gatccgggcccctagtaccctctt

SEQ ID NO: 5012 - DNA, 19 bp, Homo sapiens
gggccccacctgtcctctt

SEQ ID NO: 5013 - DNA, 24 bp, Homo sapiens
tctgggctcctgacagttctctta

SEQ ID NO: 5014 - DNA, 18 bp, Homo sapiens
gagctagattgtcctctt

SEQ ID NO: 5015 - DNA, 19 bp, Homo sapiens
gatctgggcccccagtcct

SEQ ID NO: 5016 - DNA, 18 bp, Homo sapiens
gatcctgggaatcctctt

SEQ ID NO: 5017 - DNA, 19 bp, Homo sapiens
gacttgggcccctggtcct

SEQ ID NO: 5018 - DNA, 19 bp, Homo sapiens
tgtccccccactccgtcct

SEQ ID NO: 5019 - DNA, 18 bp, Homo sapiens
tctgggcccttccagcct

SEQ ID NO: 5020 - DNA, 18 bp, Homo sapiens
ggcgccccctgtcttctt

SEQ ID NO: 5021 - DNA, 21 bp, Homo sapiens
gatctgggctcaccgcaacct

SEQ ID NO: 5022 - DNA, 21 bp, Homo sapiens
gactgggccctcctgcctctt

SEQ ID NO: 5023 - DNA, 17 bp, Homo sapiens
gacctgggccctgtcct

SEQ ID NO: 5024 - DNA, 18 bp, Homo sapiens
gatctgggcttccccatc

SEQ ID NO: 5025 - DNA, 18 bp, Homo sapiens
tggccccctcgtcctctt

SEQ ID NO: 5026 - DNA, 18 bp, Homo sapiens
aagccttcctgtcctctt

SEQ ID NO: 5027 - DNA, 18 bp, Homo sapiens
gcctgtccccgtcctctt

SEQ ID NO: 5028 - DNA, 21 bp, Homo sapiens
gatctgggccacctgttctct

SEQ ID NO: 5029 - DNA, 21 bp, Homo sapiens
aatctgggtccctctgatctt

SEQ ID NO: 5030 - DNA, 23 bp, Homo sapiens
gacctgggtctgaatgtcttctt

SEQ ID NO: 5031 - DNA, 19 bp, Homo sapiens
gaactagaattgtcctctt

SEQ ID NO: 5032 - DNA, 16 bp, Homo sapiens
gatctggggccctcct

SEQ ID NO: 5033 - DNA, 18 bp, Homo sapiens
aatctgggctccatcact

SEQ ID NO: 5034 - DNA, 22 bp, Homo sapiens
gatctgggtttttgcccctctt

SEQ ID NO: 5035 - DNA, 20 bp, Homo sapiens
ctgggccccccgcggctctt

SEQ ID NO: 5036 - DNA, 15 bp, Homo sapiens
gacctgggccctcct

SEQ ID NO: 5037 - DNA, 15 bp, Homo sapiens
gactgaacgtcctct

SEQ ID NO: 5038 - DNA, 20 bp, Homo sapiens
gacctgggtctgggcctctt

SEQ ID NO: 5039 - DNA, 17 bp, Homo sapiens
gatgtgggccccctcct

SEQ ID NO: 5040 - DNA, 18 bp, Homo sapiens
gatctgtgccaccctctt

SEQ ID NO: 5041 - DNA, 18 bp, Homo sapiens
gataactcctgtcctctt

SEQ ID NO: 5042 - DNA, 20 bp, Homo sapiens
tggctcctccctgtcctctt

SEQ ID NO: 5043 - DNA, 23 bp, Homo sapiens
atcttcatcctcctcgtcttctt

SEQ ID NO: 5044 - DNA, 19 bp, Homo sapiens
tctgggccctgcctctctt

SEQ ID NO: 5045 - DNA, 20 bp, Homo sapiens
gacctgggtccgagcagcct

SEQ ID NO: 5046 - DNA, 20 bp, Homo sapiens
gacttgggccccaggctctt

SEQ ID NO: 5047 - DNA, 21 bp, Homo sapiens
gatctgaggtctgtccatctc

SEQ ID NO: 5048 - DNA, 20 bp, Homo sapiens
aatctgggtcagtcattctt

SEQ ID NO: 5049 - DNA, 16 bp, Homo sapiens
tctgggcctgtctctt

SEQ ID NO: 5050 - DNA, 18 bp, Homo sapiens
gagctgggccaccctctt

SEQ ID NO: 5051 - DNA, 25 bp, Homo sapiens
gatccgggccctggtgattcctctt

SEQ ID NO: 5052 - DNA, 15 bp, Homo sapiens
gatctggcatcctct

SEQ ID NO: 5053 - DNA, 19 bp, Homo sapiens
gattggggtccaccctctt

SEQ ID NO: 5054 - DNA, 19 bp, Homo sapiens
gatccgggtgatgcctctt

SEQ ID NO: 5055 - DNA, 18 bp, Homo sapiens
gatctgtgcaatcctctt

SEQ ID NO: 5056 - DNA, 19 bp, Homo sapiens
tctgagccagcttcctctt

SEQ ID NO: 5057 - DNA, 19 bp, Homo sapiens
gatctgggtcctcagccct

SEQ ID NO: 5058 - DNA, 25 bp, Homo sapiens
gatctgggatctgctccctcctctt

SEQ ID NO: 5059 - DNA, 16 bp, Homo sapiens
gatgctggagtcctct

SEQ ID NO: 5060 - DNA, 65 bp, Ectromelia virus
ttcacaagtattattaaaaatgagtatcgatagttacattaccatatcatccatgctcatgtgga

SEQ ID NO: 5061 - DNA, 24 bp, Ectromelia virus
cacaagtattattaaaaatgagta

SEQ ID NO: 5062 - DNA, 22 bp, Homo sapiens
cactagttactgaaaatgagta

SEQ ID NO: 5063 - DNA, 23 bp, Homo sapiens
acaagtattattaagcatcagta

SEQ ID NO: 5064 - DNA, 15 bp, Homo sapiens
cacaagtattataag

SEQ ID NO: 5065 - DNA, 16 bp, Homo sapiens
caaatataaaatgagt

SEQ ID NO: 5066 - DNA, 19 bp, Homo sapiens
acaagtatttttaaaaatg

SEQ ID NO: 5067 - DNA, 18 bp, Homo sapiens
acaaggtaaaaaatgagt

SEQ ID NO: 5068 - DNA, 19 bp, Homo sapiens
gcacaattaaaaatgggta

SEQ ID NO: 5069 - DNA, 74 bp, Rana tigrina ranavirus
gagggtctggatggtgagcttggagagagcgtcttcgtcaatgacctgctctcctgtagccttgtccagctttc

SEQ ID NO: 5070 - DNA, 24 bp, Rana tigrina ranavirus
tggatggtgagcttggagagagcg

SEQ ID NO: 5071 - DNA, 19 bp, Homo sapiens
tgtgtggtggacagagagc

SEQ ID NO: 5072 - DNA, 22 bp, Homo sapiens
tggaatggatttttggagagag

SEQ ID NO: 5073 - DNA, 17 bp, Homo sapiens
ggtggaggaaagagagc

SEQ ID NO: 5074 - DNA, 21 bp, Homo sapiens
tggaaggtgtgccagggagag

SEQ ID NO: 5075 - DNA, 20 bp, Homo sapiens
gggtgggagtacttggggag

SEQ ID NO: 5076 - DNA, 22 bp, Homo sapiens
tgggtggggcccacagagagcg

SEQ ID NO: 5077 - DNA, 21 bp, Homo sapiens
tgaatgtgatgttggagagag

SEQ ID NO: 5078 - DNA, 18 bp, Homo sapiens
tggaggtggggggagggc

SEQ ID NO: 5079 - DNA, 18 bp, Homo sapiens
tggatggtgaggttatag

SEQ ID NO: 5080 - DNA, 22 bp, Homo sapiens
tggagggccagtggagggagcg

SEQ ID NO: 5081 - DNA, 17 bp, Homo sapiens
gggtgggaggaagagag

SEQ ID NO: 5082 - DNA, 17 bp, Homo sapiens
ggatggtgagcagagag

SEQ ID NO: 5083 - DNA, 18 bp, Homo sapiens
tggatggtgagtttgaaa

SEQ ID NO: 5084 - DNA, 18 bp, Homo sapiens
tgggtgtgggcttgggag

SEQ ID NO: 5085 - DNA, 18 bp, Homo sapiens
tgtccactgagcttggag

SEQ ID NO: 5086 - DNA, 17 bp, Homo sapiens
ggatggtggcagggagc

SEQ ID NO: 5087 - DNA, 18 bp, Homo sapiens
tggatgtgaacctaggag

SEQ ID NO: 5088 - DNA, 21 bp, Homo sapiens
ggatggtggcaagtgggggag

SEQ ID NO: 5089 - DNA, 19 bp, Homo sapiens
tggtgggactggggagggc

SEQ ID NO: 5090 - DNA, 19 bp, Homo sapiens
tgcatggtgagctgcagag

SEQ ID NO: 5091 - DNA, 22 bp, Homo sapiens
ggatggtggggaggagggggcg

SEQ ID NO: 5092 - DNA, 24 bp, Homo sapiens
tggatggtgaacttcccctcggcg

SEQ ID NO: 5093 - DNA, 21 bp, Homo sapiens
tggagggtgggggcgggagcg

SEQ ID NO: 5094 - DNA, 18 bp, Homo sapiens
ggatggtgtggagggggc

SEQ ID NO: 5095 - DNA, 63 bp, Bovine herpesvirus 1
gaagatcgatgtcccgccgccgctggcgcagctgcgcggcatcgcgtggtgggacgcgttttc

SEQ ID NO: 5096 - DNA, 24 bp, Bovine herpesvirus 1
catcgcgtggtgggacgcgttttc

SEQ ID NO: 5097 - DNA, 18 bp, Homo sapiens
tcgccgaggtgtgttttc

SEQ ID NO: 5098 - DNA, 23 bp, Homo sapiens
tctgtggcaaagaatgtgttttc

SEQ ID NO: 5099 - DNA, 15 bp, Homo sapiens
catccgtggtggggc

SEQ ID NO: 5100 - DNA, 78 bp, Bovine herpesvirus 1
cgctcgtgcggcagccgcccagcgaggtgcagaccgtcaacgcgctggacctcgtcacgtgcgcgctgctgctgggcg

SEQ ID NO: 5101 - DNA, 24 bp, Bovine herpesvirus 1
gacctcgtcacgtgcgcgctgctg

SEQ ID NO: 5102 - DNA, 19 bp, Homo sapiens
ccatgtcacgtgcccgctg

SEQ ID NO: 5103 - DNA, 19 bp, Homo sapiens
tcggaggcgtgcgctgctg

SEQ ID NO: 5104 - DNA, 20 bp, Homo sapiens
gacctcgtcacgtccacctg

SEQ ID NO: 5105 - DNA, 18 bp, Homo sapiens
gacctcgtcgtggccacc

SEQ ID NO: 5106 - DNA, 19 bp, Homo sapiens
gactttctcacgtgcggct

SEQ ID NO: 5107 - DNA, 18 bp, Homo sapiens
gacccgcagcgcgctgct

SEQ ID NO: 5108 - DNA, 18 bp, Homo sapiens
gacctcgctgtgtggctg

SEQ ID NO: 5109 - DNA, 19 bp, Homo sapiens
cctcgtcatgctcctgctg

SEQ ID NO: 5110 - DNA, 19 bp, Homo sapiens
ccttgccggcccgctgctg

SEQ ID NO: 5111 - DNA, 21 bp, Homo sapiens
gacctcacttgtgcgttgctg

SEQ ID NO: 5112 - DNA, 18 bp, Homo sapiens
gacctcgttgtggctctg

SEQ ID NO: 5113 - DNA, 17 bp, Homo sapiens
cttctcacgtgcagctg

SEQ ID NO: 5114 - DNA, 19 bp, Homo sapiens
ccttgttatgtcactgctg

SEQ ID NO: 5115 - DNA, 18 bp, Homo sapiens
gcctcgtcgagcgctgct

SEQ ID NO: 5116 - DNA, 70 bp, Bovine herpesvirus 1
ttggttccggccccggttccggctccggccccgattccggctccggccccgactccggctccggccccga

SEQ ID NO: 5117 - DNA, 24 bp, Bovine herpesvirus 1
gccccggttccggctccggccccg

SEQ ID NO: 5118 - DNA, 20 bp, Homo sapiens
cctcctcggctccggcctcg

SEQ ID NO: 5119 - DNA, 20 bp, Homo sapiens
caggcctggctccggccccg

SEQ ID NO: 5120 - DNA, 24 bp, Homo sapiens
gccccggctctcgctccggctccg

SEQ ID NO: 5121 - DNA, 21 bp, Homo sapiens
cctggtcccgaggaggctccg

SEQ ID NO: 5122 - DNA, 19 bp, Homo sapiens
ggatcccgccccggcctcg

SEQ ID NO: 5123 - DNA, 21 bp, Homo sapiens
cctggttccggatccttcccc

SEQ ID NO: 5124 - DNA, 18 bp, Homo sapiens
gccgcgacgctccggccc

SEQ ID NO: 5125 - DNA, 18 bp, Homo sapiens
gctgcggctccggctccg

SEQ ID NO: 5126 - DNA, 18 bp, Homo sapiens
gccgcggccctccggccc

SEQ ID NO: 5127 - DNA, 21 bp, Homo sapiens
gctccggctctggcttcctcg

SEQ ID NO: 5128 - DNA, 24 bp, Homo sapiens
gccacggctccggctctgcggggc

SEQ ID NO: 5129 - DNA, 24 bp, Homo sapiens
gctgcggctcgagctccggcttcg

SEQ ID NO: 5130 - DNA, 18 bp, Homo sapiens
gcctcggttcggcggggc

SEQ ID NO: 5131 - DNA, 23 bp, Homo sapiens
gcccgggttccagcacggcctcg

SEQ ID NO: 5132 - DNA, 20 bp, Homo sapiens
cggctccggctccggttccg

SEQ ID NO: 5133 - DNA, 24 bp, Homo sapiens
gctccggttccggctgcggctccg

SEQ ID NO: 5134 - DNA, 20 bp, Homo sapiens
gccccgcggctccggctccg

SEQ ID NO: 5135 - DNA, 22 bp, Homo sapiens
gccgtgtccggctctggctccg

SEQ ID NO: 5136 - DNA, 18 bp, Homo sapiens
gctccggttccgtcttcg

SEQ ID NO: 5137 - DNA, 23 bp, Homo sapiens
gcccgcaaccggctccggttccg

SEQ ID NO: 5138 - DNA, 18 bp, Homo sapiens
gccccgggttcgggcccc

SEQ ID NO: 5139 - DNA, 23 bp, Homo sapiens
gcctacgggcgccttcggccccg

SEQ ID NO: 5140 - DNA, 19 bp, Homo sapiens
gccccggtctggaggcccc

SEQ ID NO: 5141 - DNA, 18 bp, Homo sapiens
gccctgttccggctgccg

SEQ ID NO: 5142 - DNA, 21 bp, Homo sapiens
ccaggcgttcggctccggccc

SEQ ID NO: 5143 - DNA, 19 bp, Homo sapiens
gctcgggttccggggcccc

SEQ ID NO: 5144 - DNA, 21 bp, Homo sapiens
gccccggctccgctggctccg

SEQ ID NO: 5145 - DNA, 21 bp, Homo sapiens
cgcgctccggctctggccccg

SEQ ID NO: 5146 - DNA, 24 bp, Homo sapiens
gctcgggctcgggctccggccccg

SEQ ID NO: 5147 - DNA, 19 bp, Homo sapiens
gccccgctccggctccggc

SEQ ID NO: 5148 - DNA, 28 bp, Homo sapiens
actccggttccggctctccgcggggccg

SEQ ID NO: 5149 - DNA, 18 bp, Homo sapiens
ggctccggctccggctcc

SEQ ID NO: 5150 - DNA, 21 bp, Homo sapiens
gcctgtggggctccggctccg

SEQ ID NO: 5151 - DNA, 18 bp, Homo sapiens
ccgtcggtctccggcccc

SEQ ID NO: 5152 - DNA, 19 bp, Homo sapiens
gcttggggctccggctccg

SEQ ID NO: 5153 - DNA, 17 bp, Homo sapiens
ggttccagtccacctcg

SEQ ID NO: 5154 - DNA, 19 bp, Homo sapiens
gccctggctccgagcttcg

SEQ ID NO: 5155 - DNA, 20 bp, Homo sapiens
gccccggttctgctcttccc

SEQ ID NO: 5156 - DNA, 21 bp, Homo sapiens
gccccgcggctcctccggccc

SEQ ID NO: 5157 - DNA, 21 bp, Homo sapiens
cccggttctggctgcgctccg

SEQ ID NO: 5158 - DNA, 25 bp, Homo sapiens
ggttccgggtctcttcgcggggccg

SEQ ID NO: 5159 - DNA, 22 bp, Homo sapiens
gcgggatccggctccggctccg

SEQ ID NO: 5160 - DNA, 22 bp, Homo sapiens
gctccggctccggctccaaccc

SEQ ID NO: 5161 - DNA, 18 bp, Homo sapiens
gcctcggctccgcgcccc

SEQ ID NO: 5162 - DNA, 24 bp, Homo sapiens
gccccggtcccctgcccggccccg

SEQ ID NO: 5163 - DNA, 18 bp, Homo sapiens
gcccgctgctccggcccc

SEQ ID NO: 5164 - DNA, 18 bp, Homo sapiens
gccccgcctctggccccg

SEQ ID NO: 5165 - DNA, 17 bp, Homo sapiens
ggtcccggctctggccc

SEQ ID NO: 5166 - DNA, 24 bp, Homo sapiens
gctccggctccgggtctggctccg

SEQ ID NO: 5167 - DNA, 20 bp, Homo sapiens
gctccgggtctggctccggc

SEQ ID NO: 5168 - DNA, 25 bp, Homo sapiens
accccgggctccggctctgcggggc

SEQ ID NO: 5169 - DNA, 18 bp, Homo sapiens
cccagctggttctggccc

SEQ ID NO: 5170 - DNA, 18 bp, Homo sapiens
cccagttctcagcggtcc

SEQ ID NO: 5171 - DNA, 23 bp, Homo sapiens
gccatggccgcgctccggctccg

SEQ ID NO: 5172 - DNA, 19 bp, Homo sapiens
ccggttcctccgggtcccg

SEQ ID NO: 5173 - DNA, 18 bp, Homo sapiens
gccccggctcagcggccc

SEQ ID NO: 5174 - DNA, 25 bp, Homo sapiens
gctccagctttcggctctgcggggc

SEQ ID NO: 5175 - DNA, 18 bp, Homo sapiens
gccctggttccggtttcc

SEQ ID NO: 5176 - DNA, 19 bp, Homo sapiens
cccggtccccagggccccg

SEQ ID NO: 5177 - DNA, 23 bp, Homo sapiens
gcccggctccggctctggcttcg

SEQ ID NO: 5178 - DNA, 23 bp, Homo sapiens
gcccggccccggctccggctccg

SEQ ID NO: 5179 - DNA, 24 bp, Homo sapiens
gccccggctccggctccggccccg

SEQ ID NO: 5180 - DNA, 22 bp, Homo sapiens
gcccatggttcggccggccccg

SEQ ID NO: 5181 - DNA, 24 bp, Homo sapiens
gctgcagctccggctctggctccg

SEQ ID NO: 5182 - DNA, 23 bp, Homo sapiens
cccgaaggccggctccggcctcg

SEQ ID NO: 5183 - DNA, 25 bp, Homo sapiens
gcgcccggctcgactcggctccggc

SEQ ID NO: 5184 - DNA, 23 bp, Homo sapiens
gctcaggttcgcactcggccccg

SEQ ID NO: 5185 - DNA, 18 bp, Homo sapiens
gctccagcattctggccc

SEQ ID NO: 5186 - DNA, 17 bp, Homo sapiens
gcctggttccgatgccc

SEQ ID NO: 5187 - DNA, 22 bp, Homo sapiens
gccccggctccggcgccaaccc

SEQ ID NO: 5188 - DNA, 20 bp, Homo sapiens
cccggttccgcgccgctccg

SEQ ID NO: 5189 - DNA, 24 bp, Homo sapiens
cccggctccgggggtcaggcctcg

SEQ ID NO: 5190 - DNA, 18 bp, Homo sapiens
gccctggatcccaggtcc

SEQ ID NO: 5191 - DNA, 18 bp, Homo sapiens
cccggtcccggctgcggc

SEQ ID NO: 5192 - DNA, 23 bp, Homo sapiens
gccccggctcgcgcacggcctcg

SEQ ID NO: 5193 - DNA, 17 bp, Homo sapiens
accccgagctgctctgg

SEQ ID NO: 5194 - DNA, 18 bp, Homo sapiens
gccctggctctggccccg

SEQ ID NO: 5195 - DNA, 20 bp, Homo sapiens
gctcgccagctccggctccg

SEQ ID NO: 5196 - DNA, 19 bp, Homo sapiens
gcccgcagctccggcttcg

SEQ ID NO: 5197 - DNA, 25 bp, Homo sapiens
ccggttccggcgcaggtcggttccg

SEQ ID NO: 5198 - DNA, 24 bp, Homo sapiens
gctccggctccggctccggctccg

SEQ ID NO: 5199 - DNA, 19 bp, Homo sapiens
gctccggctccggctccag

SEQ ID NO: 5200 - DNA, 19 bp, Homo sapiens
ggctctggctccggctccg

SEQ ID NO: 5201 - DNA, 19 bp, Homo sapiens
ggctccggctccggctccg

SEQ ID NO: 5202 - DNA, 24 bp, Homo sapiens
gctccggtgtcaccgccggtcccg

SEQ ID NO: 5203 - DNA, 20 bp, Homo sapiens
gccccggtccccaggcttcg

SEQ ID NO: 5204 - DNA, 27 bp, Homo sapiens
gctccggcgcgtctggctctggctccg

SEQ ID NO: 5205 - DNA, 20 bp, Homo sapiens
gccccgccgctccggcctcg

SEQ ID NO: 5206 - DNA, 25 bp, Homo sapiens
cccggttctggcggcacaggccccg

SEQ ID NO: 5207 - DNA, 22 bp, Homo sapiens
accgcgggcggctccggccccg

SEQ ID NO: 5208 - DNA, 30 bp, Homo sapiens
gctccggcttctccaggctctgcggggccg

SEQ ID NO: 5209 - DNA, 20 bp, Homo sapiens
ccccggcctggctctggccc

SEQ ID NO: 5210 - DNA, 22 bp, Homo sapiens
gcctcgggtccggagggcctcc

SEQ ID NO: 5211 - DNA, 18 bp, Homo sapiens
gccctgggttcggctcca

SEQ ID NO: 5212 - DNA, 23 bp, Homo sapiens
gctccgggtttccagtggcctcg

SEQ ID NO: 5213 - DNA, 24 bp, Homo sapiens
gctccaggatccgctccggctccg

SEQ ID NO: 5214 - DNA, 18 bp, Homo sapiens
gttctggctccaaggccc

SEQ ID NO: 5215 - DNA, 19 bp, Homo sapiens
gcctggggctccggccccg

SEQ ID NO: 5216 - DNA, 20 bp, Homo sapiens
gccccggatccagctctggc

SEQ ID NO: 5217 - DNA, 20 bp, Homo sapiens
cggctccggctggggccccg

SEQ ID NO: 5218 - DNA, 108 bp, Rana tigrina ranavirus
gtactatcccctgaggggatggtgttttcggaagacgccatgagaaagctctacaaggggaccatcgacatgtttgtctccgacccatcttccctcctgaacgtagac

SEQ ID NO: 5219 - DNA, 24 bp, Rana tigrina ranavirus
acgccatgagaaagctctacaagg

SEQ ID NO: 5220 - DNA, 19 bp, Homo sapiens
gctgtgaagctctacgagg

SEQ ID NO: 5221 - DNA, 24 bp, Homo sapiens
gccatgaggaagctgactgtgagg

SEQ ID NO: 5222 - DNA, 18 bp, Homo sapiens
acgtcatgaaaaggtcta

SEQ ID NO: 5223 - DNA, 20 bp, Homo sapiens
gccatgagagagggcccagg

SEQ ID NO: 5224 - DNA, 22 bp, Homo sapiens
acccatgagagagctgcacagg

SEQ ID NO: 5225 - DNA, 26 bp, Homo sapiens
acgccatgagagaaatctctacaggg

SEQ ID NO: 5226 - DNA, 21 bp, Homo sapiens
acgccacgggaaatgccaagg

SEQ ID NO: 5227 - DNA, 19 bp, Homo sapiens
cgccatgagcggctgcagg

SEQ ID NO: 5228 - DNA, 19 bp, Homo sapiens
gccatgagagactcggagg

SEQ ID NO: 5229 - DNA, 18 bp, Homo sapiens
acgcgtgttctctacaag

SEQ ID NO: 5230 - DNA, 25 bp, Homo sapiens
gccatgaggaggtaagccagtaagg

SEQ ID NO: 5231 - DNA, 22 bp, Homo sapiens
gccatgaagaaagcaggtgagg

SEQ ID NO: 5232 - DNA, 20 bp, Homo sapiens
cactgtgagaaaacatcagg

SEQ ID NO: 5233 - DNA, 20 bp, Homo sapiens
gccatgagcaatccccgagg

SEQ ID NO: 5234 - DNA, 16 bp, Homo sapiens
gccatgagaagcaaag

SEQ ID NO: 5235 - DNA, 22 bp, Homo sapiens
gcctcaaatcagctctacaggg

SEQ ID NO: 5236 - DNA, 23 bp, Homo sapiens
gctgtgaggaggacccacacagg

SEQ ID NO: 5237 - DNA, 16 bp, Homo sapiens
gcgtgagaaaaccaag

SEQ ID NO: 5238 - DNA, 17 bp, Homo sapiens
gccatgaattctgcaag

SEQ ID NO: 5239 - DNA, 20 bp, Homo sapiens
cgcttgagaaagcttgtagg

SEQ ID NO: 5240 - DNA, 17 bp, Homo sapiens
atgagaaaagtacaagg

SEQ ID NO: 5241 - DNA, 17 bp, Homo sapiens
caccatgagggagtcag

SEQ ID NO: 5242 - DNA, 17 bp, Homo sapiens
gccatgaggaacacaag

SEQ ID NO: 5243 - DNA, 19 bp, Homo sapiens
gccatgaggaagtcgaagg

SEQ ID NO: 5244 - DNA, 21 bp, Homo sapiens
gctgtgagaaagccagtgagg

SEQ ID NO: 5245 - DNA, 20 bp, Homo sapiens
gccataagggagcaacaggg

SEQ ID NO: 5246 - DNA, 21 bp, Homo sapiens
gctatgagaagggccctaagg

SEQ ID NO: 5247 - DNA, 76 bp, Bovine herpesvirus 1
cgggcgctggaggcgagcgcgcagcgggcgacggcagccatcgaggccgtgctcgcgttcaacccgcacgcgcccg

SEQ ID NO: 5248 - DNA, 24 bp, Bovine herpesvirus 1
catcgaggccgtgctcgcgttcaa

SEQ ID NO: 5249 - DNA, 18 bp, Homo sapiens
gaggccgtgcctcttcaa

SEQ ID NO: 5250 - DNA, 21 bp, Homo sapiens
catctgaggtcaggcgttcaa

SEQ ID NO: 5251 - DNA, 17 bp, Homo sapiens
tcgaggccgtgcttgtc

SEQ ID NO: 5252 - DNA, 18 bp, Homo sapiens
ccgggccgccgcgttcaa

SEQ ID NO: 5253 - DNA, 63 bp, Equine herpesvirus 2
gttgagttggattggcagagtggacaacagaataaggctatactgagcaactccctctcttac

SEQ ID NO: 5254 - DNA, 23 bp, Equine herpesvirus 2
tactgagcaactccctctcttac

SEQ ID NO: 5255 - DNA, 23 bp, Homo sapiens
tactaagcaattcactgccttac

SEQ ID NO: 5256 - DNA, 16 bp, Homo sapiens
ctgaatcctctctctt

SEQ ID NO: 5257 - DNA, 18 bp, Homo sapiens
tggctctctctctcttac

SEQ ID NO: 5258 - DNA, 18 bp, Homo sapiens
tgatgcttcctctcttac

SEQ ID NO: 5259 - DNA, 22 bp, Homo sapiens
ctgttctctctctctctcttac

SEQ ID NO: 5260 - DNA, 18 bp, Homo sapiens
ctgagtgtcttctcctac

SEQ ID NO: 5261 - DNA, 18 bp, Homo sapiens
tactgagcagccctagct

SEQ ID NO: 5262 - DNA, 19 bp, Homo sapiens
cttagctgactctctctta

SEQ ID NO: 5263 - DNA, 23 bp, Homo sapiens
tactaagcagctgtgacttttac

SEQ ID NO: 5264 - DNA, 16 bp, Homo sapiens
ctgctccctctcttac

SEQ ID NO: 5265 - DNA, 18 bp, Homo sapiens
ctgagcaaatctcattac

SEQ ID NO: 5266 - DNA, 17 bp, Homo sapiens
cactgggcactctctta

SEQ ID NO: 5267 - DNA, 19 bp, Homo sapiens
ctgaaagtccctctcttac

SEQ ID NO: 5268 - DNA, 15 bp, Homo sapiens
tactgagcatctctt

SEQ ID NO: 5269 - DNA, 17 bp, Homo sapiens
tgagtgactctctccta

SEQ ID NO: 5270 - DNA, 84 bp, Equine herpesvirus 2
ccaggtaagggagcgagctgttggattattgtttctgacatcaatctgctcaaagcttaatctaccaactccctcccttacagg

SEQ ID NO: 5271 - DNA, 24 bp, Equine herpesvirus 2
tggattattgtttctgacatcaat

SEQ ID NO: 5272 - DNA, 16 bp, Homo sapiens
tagattattgtcatca

SEQ ID NO: 5273 - DNA, 21 bp, Homo sapiens
tggtattatttggacatcaat

SEQ ID NO: 5274 - DNA, 21 bp, Homo sapiens
tggattattgttcttttcctg

SEQ ID NO: 5275 - DNA, 19 bp, Homo sapiens
tgggtatagctgacatcaa

SEQ ID NO: 5276 - DNA, 19 bp, Homo sapiens
tgggtatattgaacatcaa

SEQ ID NO: 5277 - DNA, 75 bp, Bovine herpesvirus 1
cgctggcgccgcgcgcctacctggacgccgacggcacgccgctctgctaccgggtgtgctaccgcgcggtgggcg

SEQ ID NO: 5278 - DNA, 24 bp, Bovine herpesvirus 1
tacctggacgccgacggcacgccg

SEQ ID NO: 5279 - DNA, 20 bp, Homo sapiens
cacctggacgtggggcgtgc

SEQ ID NO: 5280 - DNA, 17 bp, Homo sapiens
cctggacgccgcccgcc

SEQ ID NO: 5281 - DNA, 27 bp, Homo sapiens
cctggacgccgacccccgcggcgtgcc

SEQ ID NO: 5282 - DNA, 21 bp, Homo sapiens
tacctggaggctgtcacgccg

SEQ ID NO: 5283 - DNA, 18 bp, Homo sapiens
cacctggacacggcgcgc

SEQ ID NO: 5284 - DNA, 20 bp, Homo sapiens
cctggacgttgcccacgtgc

SEQ ID NO: 5285 - DNA, 28 bp, Homo sapiens
tacctggatgcatgtgctgcggcgtgcc

SEQ ID NO: 5286 - DNA, 22 bp, Homo sapiens
tacctggaagcctccttcacgc

SEQ ID NO: 5287 - DNA, 21 bp, Homo sapiens
tacctgaacgtgtacgcgccg

SEQ ID NO: 5288 - DNA, 18 bp, Homo sapiens
tacccggacgccggcggc

SEQ ID NO: 5289 - DNA, 16 bp, Homo sapiens
cctggacgtcggcgcc

SEQ ID NO: 5290 - DNA, 20 bp, Homo sapiens
cctggacgcggtgagcgcgc

SEQ ID NO: 5291 - DNA, 20 bp, Homo sapiens
tacttggatgccaacaaagc

SEQ ID NO: 5292 - DNA, 68 bp, Bovine herpesvirus 1
gcgctgtacggcgcgagcgagacatacctggacgacgagccctatgtcgagcggcgcgtggtcagcgt

SEQ ID NO: 5293 - DNA, 24 bp, Bovine herpesvirus 1
tgtcgagcggcgcgtggtcagcgt

SEQ ID NO: 5294 - DNA, 22 bp, Homo sapiens
tgtctacagatgtggtcagtgt

SEQ ID NO: 5295 - DNA, 18 bp, Homo sapiens
tgagcggcggcgcgcggt

SEQ ID NO: 5296 - DNA, 117 bp, Tupaia herpesvirus
cgcccgctccggcgccggcgagggggtggtgtcgcgcggcccgggccggttcggccgactcggctggcgcgggcggccgtgccgcgtcccaccgcgccgtcgcgcgctctgcggccg

SEQ ID NO: 5297 - DNA, 24 bp, Tupaia herpesvirus
ctggcgcgggcggccgtgccgcgt

SEQ ID NO: 5298 - DNA, 18 bp, Homo sapiens
tggcctgggcggcccacg

SEQ ID NO: 5299 - DNA, 19 bp, Homo sapiens
ctgccgcgggcggccgcgc

SEQ ID NO: 5300 - DNA, 26 bp, Homo sapiens
ctggcgcgggcggctggaacgcggcc

SEQ ID NO: 5301 - DNA, 18 bp, Homo sapiens
ccggcgcgggcggcgcgt

SEQ ID NO: 5302 - DNA, 18 bp, Homo sapiens
tggtgcgggcggcgcggc

SEQ ID NO: 5303 - DNA, 16 bp, Homo sapiens
ctggcggggcgccgcg

SEQ ID NO: 5304 - DNA, 18 bp, Homo sapiens
ctggcttgggcggccgcg

SEQ ID NO: 5305 - DNA, 21 bp, Homo sapiens
ggcgcgggtgcagagccgcgt

SEQ ID NO: 5306 - DNA, 19 bp, Homo sapiens
ctggccgggcggcgttgcg

SEQ ID NO: 5307 - DNA, 19 bp, Homo sapiens
ctggcgcgggggagacgtg

SEQ ID NO: 5308 - DNA, 21 bp, Homo sapiens
ggcgcgggcggttgggagcgt

SEQ ID NO: 5309 - DNA, 68 bp, Human herpesvirus 5
gtgccgcgccgcctggagtcgcggttcggccggaccgtgcacgcgctctcgcggcccttcaacggcac

SEQ ID NO: 5310 - DNA, 22 bp, Human herpesvirus 5
tctcgcggcccttcaacggcac

SEQ ID NO: 5311 - DNA, 16 bp, Homo sapiens
tctcccggccctcgca

SEQ ID NO: 5312 - DNA, 23 bp, Homo sapiens
tcgcggcccgtctgggatggcac

SEQ ID NO: 5313 - DNA, 17 bp, Homo sapiens
cctcgcggctcttctgc

SEQ ID NO: 5314 - DNA, 19 bp, Homo sapiens
cctcgcggtcctcaacgca

SEQ ID NO: 5315 - DNA, 17 bp, Homo sapiens
tctcgcggccctgcagc

SEQ ID NO: 5316 - DNA, 18 bp, Homo sapiens
tctcgcagccttccagca

SEQ ID NO: 5317 - DNA, 22 bp, Homo sapiens
tccaacccttctttggtggcac

SEQ ID NO: 5318 - DNA, 17 bp, Homo sapiens
tctccggccctccgcgc

SEQ ID NO: 5319 - DNA, 20 bp, Homo sapiens
cctcgcggtccagtcggcac

SEQ ID NO: 5320 - DNA, 17 bp, Homo sapiens
tctcgcggcgcagggca

SEQ ID NO: 5321 - DNA, 20 bp, Homo sapiens
tctcatggcccttcgaggac

SEQ ID NO: 5322 - DNA, 18 bp, Homo sapiens
tctcgcaggccttccgcg

SEQ ID NO: 5323 - DNA, 18 bp, Homo sapiens
tctcgcgaccccgggggc

SEQ ID NO: 5324 - DNA, 20 bp, Homo sapiens
tctcgcggccccgcgccggc

SEQ ID NO: 5325 - DNA, 17 bp, Homo sapiens
tctcgcagcccctcggc

SEQ ID NO: 5326 - DNA, 19 bp, Homo sapiens
tcaccaagttcttcaacgg

SEQ ID NO: 5327 - DNA, 16 bp, Homo sapiens
ccgcggccctttcagc

SEQ ID NO: 5328 - DNA, 20 bp, Homo sapiens
tctcgcggttccttaactgc

SEQ ID NO: 5329 - DNA, 16 bp, Homo sapiens
tctcggcggccttggc

SEQ ID NO: 5330 - DNA, 17 bp, Homo sapiens
tcccgcggttcccggca

SEQ ID NO: 5331 - DNA, 17 bp, Homo sapiens
tcttgcagccctcccgg

SEQ ID NO: 5332 - DNA, 92 bp, Chimpanzee cytomegalovirus
tcgcccttccggagtgacgcacatagctcgccggggcccgccttctgtccaggccggttccaaagcggcgtgtctgagtcacccggaggcga

SEQ ID NO: 5333 - DNA, 24 bp, Chimpanzee cytomegalovirus
ttccaaagcggcgtgtctgagtca

SEQ ID NO: 5334 - DNA, 22 bp, Homo sapiens
ttccatggtgtggcctgagtca

SEQ ID NO: 5335 - DNA, 22 bp, Homo sapiens
ttccaaagtggagtgtgaaaat

SEQ ID NO: 5336 - DNA, 19 bp, Homo sapiens
ttccggaatggtgtgtcca

SEQ ID NO: 5337 - DNA, 16 bp, Homo sapiens
ttccaaagcgctgggt

SEQ ID NO: 5338 - DNA, 22 bp, Homo sapiens
ttctatagcatcgatctgagtc

SEQ ID NO: 5339 - DNA, 24 bp, Homo sapiens
ttccaaagcaggtgtaggaggtca

SEQ ID NO: 5340 - DNA, 18 bp, Homo sapiens
tccaaaaagtgtttgagt

SEQ ID NO: 5341 - DNA, 19 bp, Homo sapiens
ttccaaatcattttgagtc

SEQ ID NO: 5342 - DNA, 18 bp, Homo sapiens
ttccaaagtgtctgagtc

SEQ ID NO: 5343 - DNA, 21 bp, Homo sapiens
tccaaaggttggtttgagtca

SEQ ID NO: 5344 - DNA, 16 bp, Homo sapiens
ttcccaaggtctgagt

SEQ ID NO: 5345 - DNA, 21 bp, Homo sapiens
ttccaaaatgtgcttgagtca

SEQ ID NO: 5346 - DNA, 18 bp, Homo sapiens
tcccaaagcggcttgagt

SEQ ID NO: 5347 - DNA, 19 bp, Homo sapiens
ttccaaagcggtgcgtcca

SEQ ID NO: 5348 - DNA, 104 bp, Tupaia herpesvirus
gcagccgcaggatcgacacgaggaacggggtcagcacgcggtcgatggtgtagttggagtaggcgatgttgtcctccgcgccctggttggtcacctggcggcgc

SEQ ID NO: 5349 - DNA, 24 bp, Tupaia herpesvirus
tggagtaggcgatgttgtcctccg

SEQ ID NO: 5350 - DNA, 19 bp, Homo sapiens
tggagcaggtggtgtcacc

SEQ ID NO: 5351 - DNA, 21 bp, Homo sapiens
ggagtgggtgaagaccctccg

SEQ ID NO: 5352 - DNA, 21 bp, Homo sapiens
tggagtaggtcaaagtctccg

SEQ ID NO: 5353 - DNA, 18 bp, Homo sapiens
tggggtgggcagtcctcc

SEQ ID NO: 5354 - DNA, 21 bp, Homo sapiens
tgaggtaggaaatgtcctccg

SEQ ID NO: 5355 - DNA, 21 bp, Homo sapiens
tggaggtgggtggctgccctc

SEQ ID NO: 5356 - DNA, 19 bp, Homo sapiens
ggagtaggagacttgtcct

SEQ ID NO: 5357 - DNA, 19 bp, Homo sapiens
tgggtaggtcactgtcctc

SEQ ID NO: 5358 - DNA, 67 bp, Human herpesvirus 5
acgttgtcgcgattaaaaaccacgccaaataaacatacgcagcacaaaagatccacgcgaagaacgt

SEQ ID NO: 5359 - DNA, 24 bp, Human herpesvirus 5
acaaaagatccacgcgaagaacgt

SEQ ID NO: 5360 - DNA, 17 bp, Homo sapiens
caaaagacaaaagaacg

SEQ ID NO: 5361 - DNA, 21 bp, Homo sapiens
acaaaagacctgagagaacgt

SEQ ID NO: 5362 - DNA, 70 bp, Human herpesvirus 5
tgcgtctgcaacggcatcatgttcctacacgccttgcacctgggtggaacgagcgccgtcctgcagaccg

SEQ ID NO: 5363 - DNA, 24 bp, Human herpesvirus 5
catcatgttcctacacgccttgca

SEQ ID NO: 5364 - DNA, 20 bp, Homo sapiens
cattatgtatgtgccttgca

SEQ ID NO: 5365 - DNA, 18 bp, Homo sapiens
catcatgtcctgctctgc

SEQ ID NO: 5366 - DNA, 25 bp, Homo sapiens
catcatgtttttaaattagcttgca

SEQ ID NO: 5367 - DNA, 17 bp, Homo sapiens
atcatgttcctacaccc

SEQ ID NO: 5368 - DNA, 18 bp, Homo sapiens
catcatgtcccgttttgc

SEQ ID NO: 5369 - DNA, 19 bp, Homo sapiens
tcatgttcctgttattgca

SEQ ID NO: 5370 - DNA, 21 bp, Homo sapiens
catcatgttcttacatgaggc

SEQ ID NO: 5371 - DNA, 22 bp, Homo sapiens
catcatgtttttacatggggca

SEQ ID NO: 5372 - DNA, 19 bp, Homo sapiens
catgatgttcctatatacc

SEQ ID NO: 5373 - DNA, 22 bp, Homo sapiens
tcgtgcaagaacacgccttgca

SEQ ID NO: 5374 - DNA, 20 bp, Homo sapiens
tcatattctttacatttgca

SEQ ID NO: 5375 - DNA, 22 bp, Homo sapiens
cagcatgccacaacatgccttg

SEQ ID NO: 5376 - DNA, 20 bp, Homo sapiens
tgttcctattagctcttgca

SEQ ID NO: 5377 - DNA, 17 bp, Homo sapiens
atcatgttctcttttgc

SEQ ID NO: 5378 - DNA, 18 bp, Homo sapiens
catgttcctgctactgca

SEQ ID NO: 5379 - DNA, 18 bp, Homo sapiens
atcatgttcttacattgc

SEQ ID NO: 5380 - DNA, 22 bp, Homo sapiens
cattcacgttacgtgccttgca

SEQ ID NO: 5381 - DNA, 60 bp, Tupaia herpesvirus
tctgcgactgcacctgctcctccaggcatttgatcatctgcttgcggaacaggtcgcgga

SEQ ID NO: 5382 - DNA, 20 bp, Tupaia herpesvirus
cttgcggaacaggtcgcgga

SEQ ID NO: 5383 - DNA, 17 bp, Homo sapiens
ttggggacagatcatgg

SEQ ID NO: 5384 - DNA, 20 bp, Homo sapiens
ctggcggaacatgaacgcgg

SEQ ID NO: 5385 - DNA, 16 bp, Homo sapiens
cttgcagaacacacag

SEQ ID NO: 5386 - DNA, 16 bp, Homo sapiens
cctgcggaacccgcgg

SEQ ID NO: 5387 - DNA, 19 bp, Homo sapiens
cttgcgctcgggtcgcgga

SEQ ID NO: 5388 - DNA, 19 bp, Homo sapiens
cctgcggagtgtgcttgga

SEQ ID NO: 5389 - DNA, 17 bp, Homo sapiens
ttgggggacaccacgga

SEQ ID NO: 5390 - DNA, 16 bp, Homo sapiens
cttgctggagccacgg

SEQ ID NO: 5391 - DNA, 16 bp, Homo sapiens
cttgggaacagagtgg

SEQ ID NO: 5392 - DNA, 18 bp, Homo sapiens
cctgcggaacgggctgga

SEQ ID NO: 5393 - DNA, 15 bp, Homo sapiens
cttgcgaggccgcgg

SEQ ID NO: 5394 - DNA, 16 bp, Homo sapiens
ctcgcggaatgggcgg

SEQ ID NO: 5395 - DNA, 17 bp, Homo sapiens
cctgcggaagtggtgga

SEQ ID NO: 5396 - DNA, 17 bp, Homo sapiens
cttgtgaacaggttcgg

SEQ ID NO: 5397 - DNA, 19 bp, Homo sapiens
cttacggaacttaactgga

SEQ ID NO: 5398 - DNA, 19 bp, Homo sapiens
ttgctggagtggccacaga

SEQ ID NO: 5399 - DNA, 20 bp, Homo sapiens
cttgcagaaaagaccgtgga

SEQ ID NO: 5400 - DNA, 16 bp, Homo sapiens
cctgcggaggccgcgg

SEQ ID NO: 5401 - DNA, 15 bp, Homo sapiens
cttgcagaaaagtgg

SEQ ID NO: 5402 - DNA, 15 bp, Homo sapiens
cctgcggacccgcgg

SEQ ID NO: 5403 - DNA, 18 bp, Homo sapiens
ttgcggaaggcgaggcgg

SEQ ID NO: 5404 - DNA, 18 bp, Homo sapiens
cttgtggggcatcacgga

SEQ ID NO: 5405 - DNA, 15 bp, Homo sapiens
ctcgcggagccgcgg

SEQ ID NO: 5406 - DNA, 18 bp, Homo sapiens
ttgcggaacgagcaagga

SEQ ID NO: 5407 - DNA, 15 bp, Homo sapiens
cctgcggaacagcag

SEQ ID NO: 5408 - DNA, 17 bp, Homo sapiens
cttgcggaggctcccgg

SEQ ID NO: 5409 - DNA, 19 bp, Homo sapiens
cttagcgacgagtcgcgga

SEQ ID NO: 5410 - DNA, 18 bp, Homo sapiens
cttgcggatgaaagtgga

SEQ ID NO: 5411 - DNA, 18 bp, Homo sapiens
cttgcagacaagtgtgga

SEQ ID NO: 5412 - DNA, 20 bp, Homo sapiens
cttgtgaacagacaccagga

SEQ ID NO: 5413 - DNA, 19 bp, Homo sapiens
cttgcggagtgagccagga

SEQ ID NO: 5414 - DNA, 18 bp, Homo sapiens
ctcgcggaacaacgcgga

SEQ ID NO: 5415 - DNA, 16 bp, Homo sapiens
tcgcggaggccgcgga

SEQ ID NO: 5416 - DNA, 17 bp, Homo sapiens
cttgcgcgaagtcgcgg

SEQ ID NO: 5417 - DNA, 17 bp, Homo sapiens
ttgagggacagccacag

SEQ ID NO: 5418 - DNA, 19 bp, Homo sapiens
tcgggagccacagtcgcgg

SEQ ID NO: 5419 - DNA, 18 bp, Homo sapiens
cctgcggagccgggcgga

SEQ ID NO: 5420 - DNA, 15 bp, Homo sapiens
cttgcaggatcacgg

SEQ ID NO: 5421 - DNA, 17 bp, Homo sapiens
ctgggacaggtcatgga

SEQ ID NO: 5422 - DNA, 17 bp, Homo sapiens
cttgggaacaagctgga

SEQ ID NO: 5423 - DNA, 15 bp, Homo sapiens
cttgcggaaggacgg

SEQ ID NO: 5424 - DNA, 18 bp, Homo sapiens
ttgcagaataaacatgga

SEQ ID NO: 5425 - DNA, 20 bp, Homo sapiens
cctgcggagcccaggctgga

SEQ ID NO: 5426 - DNA, 18 bp, Homo sapiens
cttgcggaacggctccag

SEQ ID NO: 5427 - DNA, 16 bp, Homo sapiens
cttacaacggtcgcgg

SEQ ID NO: 5428 - DNA, 18 bp, Homo sapiens
cttgaggctggtcgcgga

SEQ ID NO: 5429 - DNA, 19 bp, Homo sapiens
ctggcggagcaggccgcgg

SEQ ID NO: 5430 - DNA, 18 bp, Homo sapiens
cttgcggagaagcgcaga

SEQ ID NO: 5431 - DNA, 22 bp, Homo sapiens
ctcgcggagcccccgccgcgga

SEQ ID NO: 5432 - DNA, 17 bp, Homo sapiens
cttggtgaggtcgcgga

SEQ ID NO: 5433 - DNA, 76 bp, Chimpanzee cytomegalovirus
gatccgggaccgccgtagcggggtgttttttaatttattttatatatacgctatgtatctactgtttttccgggtc

SEQ ID NO: 5434 - DNA, 24 bp, Chimpanzee cytomegalovirus
cgccgtagcggggtgttttttaat

SEQ ID NO: 5435 - DNA, 19 bp, Homo sapiens
gctgtactggctattcttt

SEQ ID NO: 5436 - DNA, 19 bp, Homo sapiens
cgcctggctcattttttaa

SEQ ID NO: 5437 - DNA, 63 bp, Human herpesvirus 5
gcgcctggacgttgcacgcggcgggtaccgaaagcggcgctaacgcggcaacggccacggcgc

SEQ ID NO: 5438 - DNA, 24 bp, Human herpesvirus 5
cgttgcacgcggcgggtaccgaaa

SEQ ID NO: 5439 - DNA, 21 bp, Homo sapiens
cgtgcgtgcggcgggcagcaa

SEQ ID NO: 5440 - DNA, 20 bp, Homo sapiens
gttgtgtggtgggtaccgaa

SEQ ID NO: 5441 - DNA, 21 bp, Homo sapiens
ttgcggtcgcggcgggtgccg

SEQ ID NO: 5442 - DNA, 22 bp, Homo sapiens
gttgcgcggcggcggcggcccg

SEQ ID NO: 5443 - DNA, 20 bp, Homo sapiens
gttgcacgtggagggcagca

SEQ ID NO: 5444 - DNA, 18 bp, Homo sapiens
cgttgcactcgggaatcc

SEQ ID NO: 5445 - DNA, 19 bp, Homo sapiens
gttgtacacagatactgga

SEQ ID NO: 5446 - DNA, 88 bp, Human herpesvirus 5
gcctgcgtcgcctatgcttcgcgcgtcaccacgacaccttccttgaagtggtagacgtcttcggcatgcggcaaatcgtcacgcaggc

SEQ ID NO: 5447 - DNA, 24 bp, Human herpesvirus 5
tcgcctatgcttcgcgcgtcacca

SEQ ID NO: 5448 - DNA, 18 bp, Homo sapiens
gcctatgctatcgcttcc

SEQ ID NO: 5449 - DNA, 21 bp, Homo sapiens
gctatgctcctacagtgtcac

SEQ ID NO: 5450 - DNA, 24 bp, Homo sapiens
tcacctgtgcaatcactgcgttac

SEQ ID NO: 5451 - DNA, 18 bp, Homo sapiens
ccgcctgtgcttcgtgca

SEQ ID NO: 5452 - DNA, 24 bp, Homo sapiens
gcttatgcttctccagatgttgcc

SEQ ID NO: 5453 - DNA, 21 bp, Homo sapiens
ccgcttgtgcttttctcacca

SEQ ID NO: 5454 - DNA, 22 bp, Homo sapiens
tcgcctgtattttgcatcatca

SEQ ID NO: 5455 - DNA, 23 bp, Homo sapiens
tcgtctagcttcaacatctgcca

SEQ ID NO: 5456 - DNA, 93 bp, Tupaia herpesvirus
gatgttcagcaggaagcgcatgatggacttcttggcgtcggtcgtcttgtcgtgccgctccatgagctccacgatccgctggctgttgagctc

SEQ ID NO: 5457 - DNA, 24 bp, Tupaia herpesvirus
tccatgagctccacgatccgctgg

SEQ ID NO: 5458 - DNA, 21 bp, Homo sapiens
tccgtggccaacatccgctgg

SEQ ID NO: 5459 - DNA, 23 bp, Homo sapiens
tccatgagtgccacggggggtgg

SEQ ID NO: 5460 - DNA, 15 bp, Homo sapiens
tccatgagtccagct

SEQ ID NO: 5461 - DNA, 21 bp, Homo sapiens
cccatgaggatgatttgctgg

SEQ ID NO: 5462 - DNA, 25 bp, Homo sapiens
tccatgagcctctgtgcggggctgg

SEQ ID NO: 5463 - DNA, 20 bp, Homo sapiens
catgagcttcgctgggctgg

SEQ ID NO: 5464 - DNA, 19 bp, Homo sapiens
tccagagctccagctgctg

SEQ ID NO: 5465 - DNA, 21 bp, Homo sapiens
tccagagctccatggccacgg

SEQ ID NO: 5466 - DNA, 16 bp, Homo sapiens
tccatgagcttccact

SEQ ID NO: 5467 - DNA, 23 bp, Homo sapiens
tccatgagcttccggaaagatgg

SEQ ID NO: 5468 - DNA, 24 bp, Homo sapiens
tccaggagctccacagccagctgg

SEQ ID NO: 5469 - DNA, 24 bp, Homo sapiens
tcctgggctcaagggatctgctgg

SEQ ID NO: 5470 - DNA, 25 bp, Homo sapiens
tccatgagctctgtaagtccgttgg

SEQ ID NO: 5471 - DNA, 16 bp, Homo sapiens
tcgatgagctccagct

SEQ ID NO: 5472 - DNA, 17 bp, Homo sapiens
tccatgagctcttgctg

SEQ ID NO: 5473 - DNA, 22 bp, Homo sapiens
tctgtgaactccttcacgctgg

SEQ ID NO: 5474 - DNA, 68 bp, Transmissible gastroenteritis virus
aggagattgctattagtaagtggggccatttttatattaatggttacaatttctttagcacatttcct

SEQ ID NO: 5475 - DNA, 24 bp, Transmissible gastroenteritis virus
tacaatttctttagcacatttcct

SEQ ID NO: 5476 - DNA, 20 bp, Homo sapiens
aatttctttagcaaaaacct

SEQ ID NO: 5477 - DNA, 15 bp, Homo sapiens
tttcttacatttcct

SEQ ID NO: 5478 - DNA, 18 bp, Homo sapiens
tttctttgggcatttcct

SEQ ID NO: 5479 - DNA, 20 bp, Homo sapiens
cagtttctcttgcatttcct

SEQ ID NO: 5480 - DNA, 17 bp, Homo sapiens
aatttctttagccattt

SEQ ID NO: 5481 - DNA, 20 bp, Homo sapiens
aatctctggacacattttct

SEQ ID NO: 5482 - DNA, 21 bp, Homo sapiens
atttctttggtcacattttct

SEQ ID NO: 5483 - DNA, 20 bp, Homo sapiens
caatttctgtggctcatcct

SEQ ID NO: 5484 - DNA, 21 bp, Homo sapiens
taaatttcttatagacatttc

SEQ ID NO: 5485 - DNA, 24 bp, Homo sapiens
caatttctttgtcatccattttct

SEQ ID NO: 5486 - DNA, 21 bp, Homo sapiens
caatttctttttatttttcct

SEQ ID NO: 5487 - DNA, 16 bp, Homo sapiens
tttctttgcatttcct

SEQ ID NO: 5488 - DNA, 22 bp, Homo sapiens
tgaatttctcaagttatttcct

SEQ ID NO: 5489 - DNA, 19 bp, Homo sapiens
taaatttctttgcctttcc

SEQ ID NO: 5490 - DNA, 19 bp, Homo sapiens
tacaatttctttcaatttc

SEQ ID NO: 5491 - DNA, 25 bp, Homo sapiens
caatttcttttttcaaatatttcct

SEQ ID NO: 5492 - DNA, 15 bp, Homo sapiens
atttctttcatttcc

SEQ ID NO: 5493 - DNA, 17 bp, Homo sapiens
tttctttcacatttcct

SEQ ID NO: 5494 - DNA, 22 bp, Homo sapiens
tacatttactagcacattttct

SEQ ID NO: 5495 - DNA, 18 bp, Homo sapiens
tacaatttccttatttcc

SEQ ID NO: 5496 - DNA, 18 bp, Homo sapiens
tacaactttctcatttcc

SEQ ID NO: 5497 - DNA, 15 bp, Homo sapiens
atttctttagtctcc

SEQ ID NO: 5498 - DNA, 20 bp, Homo sapiens
caatttcttataaatttcct

SEQ ID NO: 5499 - DNA, 22 bp, Homo sapiens
caatcagtaaagcgcatttcct

SEQ ID NO: 5500 - DNA, 19 bp, Homo sapiens
ttcccacagtacatttcct

SEQ ID NO: 5501 - DNA, 20 bp, Homo sapiens
atttctttgtcatctttcct

SEQ ID NO: 5502 - DNA, 19 bp, Homo sapiens
atttctccaggtatttcct

SEQ ID NO: 5503 - DNA, 17 bp, Homo sapiens
caatttcttaagcatcc

SEQ ID NO: 5504 - DNA, 66 bp, Tupaia herpesvirus
cagctgggtggccaggccggagaggctctggcccgggtccagcagcttctgcatgttgcccagctg

SEQ ID NO: 5505 - DNA, 24 bp, Tupaia herpesvirus
cagcagcttctgcatgttgcccag

SEQ ID NO: 5506 - DNA, 17 bp, Homo sapiens
acagcttctgcctggcc

SEQ ID NO: 5507 - DNA, 17 bp, Homo sapiens
acagcttctgtggctgc

SEQ ID NO: 5508 - DNA, 15 bp, Homo sapiens
agcagcttcttgtcc

SEQ ID NO: 5509 - DNA, 19 bp, Homo sapiens
cagcagattctgcactcca

SEQ ID NO: 5510 - DNA, 23 bp, Homo sapiens
cagagttttgctctgttgcccag

SEQ ID NO: 5511 - DNA, 18 bp, Homo sapiens
cagtgcttctgtgtcccc

SEQ ID NO: 5512 - DNA, 21 bp, Homo sapiens
gctggcttctgcgcacgcgcc

SEQ ID NO: 5513 - DNA, 18 bp, Homo sapiens
agcagcttctggcgggct

SEQ ID NO: 5514 - DNA, 22 bp, Homo sapiens
gctgcttctgctgcagcctcag

SEQ ID NO: 5515 - DNA, 23 bp, Homo sapiens
cagcaacttctgggccagctcag

SEQ ID NO: 5516 - DNA, 18 bp, Homo sapiens
agcttttcatctgcccag

SEQ ID NO: 5517 - DNA, 16 bp, Homo sapiens
caacagcttctggccc

SEQ ID NO: 5518 - DNA, 23 bp, Homo sapiens
cagggttttgctatgttgcccag

SEQ ID NO: 5519 - DNA, 17 bp, Homo sapiens
cagcagcttctgatgtt

SEQ ID NO: 5520 - DNA, 19 bp, Homo sapiens
gcaggcccgtgttgcccag

SEQ ID NO: 5521 - DNA, 21 bp, Homo sapiens
gcggctcttgacatgttgccc

SEQ ID NO: 5522 - DNA, 23 bp, Homo sapiens
cagggtctcgctatgttgcccag

SEQ ID NO: 5523 - DNA, 23 bp, Homo sapiens
cagggtctccctatgttgcccag

SEQ ID NO: 5524 - DNA, 18 bp, Homo sapiens
acagtttctgcactagtt

SEQ ID NO: 5525 - DNA, 18 bp, Homo sapiens
agcagcttccgccatcca

SEQ ID NO: 5526 - DNA, 17 bp, Homo sapiens
agcaggcatgttgccca

SEQ ID NO: 5527 - DNA, 18 bp, Homo sapiens
tcttgctctgttgcccag

SEQ ID NO: 5528 - DNA, 21 bp, Homo sapiens
gcagcttctgtccccacccag

SEQ ID NO: 5529 - DNA, 19 bp, Homo sapiens
cagcagcttcagaccagcc

SEQ ID NO: 5530 - DNA, 19 bp, Homo sapiens
cagcggctgctgcgtgttg

SEQ ID NO: 5531 - DNA, 19 bp, Homo sapiens
cagtagctctgtttgccca

SEQ ID NO: 5532 - DNA, 15 bp, Homo sapiens
cagagcttctgcccc

SEQ ID NO: 5533 - DNA, 18 bp, Homo sapiens
cagcagctctgggcagcc

SEQ ID NO: 5534 - DNA, 19 bp, Homo sapiens
gcttcaccatgttgcccag

SEQ ID NO: 5535 - DNA, 15 bp, Homo sapiens
acagcttctgcaccc

SEQ ID NO: 5536 - DNA, 23 bp, Homo sapiens
cagggtttcaccatgttgcccag

SEQ ID NO: 5537 - DNA, 23 bp, Homo sapiens
cagggtctcactatgttgcccag

SEQ ID NO: 5538 - DNA, 22 bp, Homo sapiens
cagggttttgcctgttgcccag

SEQ ID NO: 5539 - DNA, 23 bp, Homo sapiens
cagcagctctgggacctgctcag

SEQ ID NO: 5540 - DNA, 18 bp, Homo sapiens
tctcgctatgttgcccag

SEQ ID NO: 5541 - DNA, 23 bp, Homo sapiens
cagcgtcttgataggttgcccag

SEQ ID NO: 5542 - DNA, 23 bp, Homo sapiens
cagggttccaccatgttgcccag

SEQ ID NO: 5543 - DNA, 18 bp, Homo sapiens
cagcagctcctgcgtcgc

SEQ ID NO: 5544 - DNA, 22 bp, Homo sapiens
gcagtctcgctatgttgcccag

SEQ ID NO: 5545 - DNA, 17 bp, Homo sapiens
cagcagcttctctgcta

SEQ ID NO: 5546 - DNA, 19 bp, Homo sapiens
gcagcttctgctgactcag

SEQ ID NO: 5547 - DNA, 23 bp, Homo sapiens
cagagtctcactgtgttgcccag

SEQ ID NO: 5548 - DNA, 21 bp, Homo sapiens
cagcacgcttctggggtccag

SEQ ID NO: 5549 - DNA, 21 bp, Homo sapiens
cagcagctctgcagcaagtcc

SEQ ID NO: 5550 - DNA, 20 bp, Homo sapiens
cagggtctcgctatgttgcc

SEQ ID NO: 5551 - DNA, 20 bp, Homo sapiens
gccggcttctgcattgtgcc

SEQ ID NO: 5552 - DNA, 23 bp, Homo sapiens
cagcagctcttccacatgtccag

SEQ ID NO: 5553 - DNA, 19 bp, Homo sapiens
agtttcgctcgttgcccag

SEQ ID NO: 5554 - DNA, 19 bp, Homo sapiens
cagcagcttctgcatttgc

SEQ ID NO: 5555 - DNA, 19 bp, Homo sapiens
cagcagcttatgcgttttg

SEQ ID NO: 5556 - DNA, 16 bp, Homo sapiens
cagcagctgctggccc

SEQ ID NO: 5557 - DNA, 17 bp, Homo sapiens
gcagcttctcaaactca

SEQ ID NO: 5558 - DNA, 20 bp, Homo sapiens
cagggtctcactatgttgcc

SEQ ID NO: 5559 - DNA, 18 bp, Homo sapiens
gcagcttccgtggtgccc

SEQ ID NO: 5560 - DNA, 19 bp, Homo sapiens
gcagctcctggaggctcag

SEQ ID NO: 5561 - DNA, 23 bp, Homo sapiens
cagggtctcgccatgttgcccag

SEQ ID NO: 5562 - DNA, 24 bp, Homo sapiens
cagcagctcctaccccttgtccag

SEQ ID NO: 5563 - DNA, 15 bp, Homo sapiens
cagcagcttctggcc

SEQ ID NO: 5564 - DNA, 17 bp, Homo sapiens
cagcagctctgtggccc

SEQ ID NO: 5565 - DNA, 16 bp, Homo sapiens
cagcagctgctggtcc

SEQ ID NO: 5566 - DNA, 21 bp, Homo sapiens
caggggcttagggttgcccag

SEQ ID NO: 5567 - DNA, 22 bp, Homo sapiens
cagtagctctgcatctttccag

SEQ ID NO: 5568 - DNA, 21 bp, Homo sapiens
cagagcttcatgtttgcccag

SEQ ID NO: 5569 - DNA, 16 bp, Homo sapiens
gcagcttctcgtggcc

SEQ ID NO: 5570 - DNA, 19 bp, Homo sapiens
gcttcactatgttgcccag

SEQ ID NO: 5571 - DNA, 21 bp, Homo sapiens
gccggcttctgcactgcccag

SEQ ID NO: 5572 - DNA, 25 bp, Homo sapiens
cagcagcttctggggacatctccag

SEQ ID NO: 5573 - DNA, 19 bp, Homo sapiens
cagcagttagcatgttgcc

SEQ ID NO: 5574 - DNA, 19 bp, Homo sapiens
cagcggctctgtgatcttg

SEQ ID NO: 5575 - DNA, 16 bp, Homo sapiens
cagcagctgctgctcc

SEQ ID NO: 5576 - DNA, 23 bp, Homo sapiens
cagggtctcaccatgttgcccag

SEQ ID NO: 5577 - DNA, 23 bp, Homo sapiens
cagagtctcaccatgttgcccag

SEQ ID NO: 5578 - DNA, 21 bp, Homo sapiens
cagcagctctgcaatggccag

SEQ ID NO: 5579 - DNA, 15 bp, Homo sapiens
cagcacttctgcccc

SEQ ID NO: 5580 - DNA, 19 bp, Homo sapiens
cagcagctctgtgggccca

SEQ ID NO: 5581 - DNA, 27 bp, Homo sapiens
cagtggcctctgcatggaatctcccag

SEQ ID NO: 5582 - DNA, 20 bp, Homo sapiens
agtctcgctatgttgcccag

SEQ ID NO: 5583 - DNA, 17 bp, Homo sapiens
gcttctgcgtagcccag

SEQ ID NO: 5584 - DNA, 21 bp, Homo sapiens
cagcagcttctttggtctcag

SEQ ID NO: 5585 - DNA, 22 bp, Homo sapiens
cagcagctgctgcaggaaccag

SEQ ID NO: 5586 - DNA, 17 bp, Homo sapiens
gcttctgctctgctcag

SEQ ID NO: 5587 - DNA, 17 bp, Homo sapiens
cagcacttctgcctttg

SEQ ID NO: 5588 - DNA, 17 bp, Homo sapiens
cagagtttttgcatgtt

SEQ ID NO: 5589 - DNA, 16 bp, Homo sapiens
cagcacttctgcagcc

SEQ ID NO: 5590 - DNA, 19 bp, Homo sapiens
cagcagcttcttgatattg

SEQ ID NO: 5591 - DNA, 20 bp, Homo sapiens
agtttccccatgttgcccag

SEQ ID NO: 5592 - DNA, 24 bp, Homo sapiens
caggagtctcactatgttgcccag

SEQ ID NO: 5593 - DNA, 23 bp, Homo sapiens
gcagtttcactcttgttgcccag

SEQ ID NO: 5594 - DNA, 22 bp, Homo sapiens
cagcagcttctttacagtctcc

SEQ ID NO: 5595 - DNA, 18 bp, Homo sapiens
cagcagccttctgcgctg

SEQ ID NO: 5596 - DNA, 20 bp, Homo sapiens
agtttcatcatgttgctcag

SEQ ID NO: 5597 - DNA, 20 bp, Homo sapiens
gcagcttctgcttcactcag

SEQ ID NO: 5598 - DNA, 20 bp, Homo sapiens
gctttctgtatgttgcccag

SEQ ID NO: 5599 - DNA, 17 bp, Homo sapiens
cagcaacttttgctatt

SEQ ID NO: 5600 - DNA, 19 bp, Homo sapiens
agcttgctatgttgcccag

SEQ ID NO: 5601 - DNA, 19 bp, Homo sapiens
cagcagctctccctgcctg

SEQ ID NO: 5602 - DNA, 23 bp, Homo sapiens
cagcagcttcttacacatcccag

SEQ ID NO: 5603 - DNA, 16 bp, Homo sapiens
cagcagctcctgcccc

SEQ ID NO: 5604 - DNA, 23 bp, Homo sapiens
cagagtctcgctatgttgcccag

SEQ ID NO: 5605 - DNA, 23 bp, Homo sapiens
cagcagcttcttacacaccccag

SEQ ID NO: 5606 - DNA, 20 bp, Homo sapiens
agtttcaccatgttgcccag

SEQ ID NO: 5607 - DNA, 23 bp, Homo sapiens
cagggtttcaccacgttgcccag

SEQ ID NO: 5608 - DNA, 20 bp, Homo sapiens
cagggtttcaccatgttgcc

SEQ ID NO: 5609 - DNA, 22 bp, Homo sapiens
cagcggcttctgcctggaggcc

SEQ ID NO: 5610 - DNA, 24 bp, Homo sapiens
caggggcctcactatgttgcccag

SEQ ID NO: 5611 - DNA, 20 bp, Homo sapiens
cagggtttctccatgttgcc

SEQ ID NO: 5612 - DNA, 20 bp, Homo sapiens
agcttctgtaaactgtccag

SEQ ID NO: 5613 - DNA, 17 bp, Homo sapiens
cagcagcttttgcccag

SEQ ID NO: 5614 - DNA, 21 bp, Homo sapiens
cagtgtctcattgttgcccag

SEQ ID NO: 5615 - DNA, 22 bp, Homo sapiens
cagagtttcgcttgttgcccag

SEQ ID NO: 5616 - DNA, 24 bp, Homo sapiens
caccagcttctgcaagcctcccag

SEQ ID NO: 5617 - DNA, 19 bp, Homo sapiens
cagcagttttccccttgcc

SEQ ID NO: 5618 - DNA, 23 bp, Homo sapiens
cagagtctcactatgttgcccag

SEQ ID NO: 5619 - DNA, 17 bp, Homo sapiens
agcttctgtatctccag

SEQ ID NO: 5620 - DNA, 18 bp, Homo sapiens
agcagcttcccttgtcca

SEQ ID NO: 5621 - DNA, 22 bp, Homo sapiens
acagtctcgctatgttgcccag

SEQ ID NO: 5622 - DNA, 20 bp, Homo sapiens
agcctccctatgttgcccag

SEQ ID NO: 5623 - DNA, 24 bp, Homo sapiens
cagcagctcctccaccttgtccag

SEQ ID NO: 5624 - DNA, 24 bp, Homo sapiens
cagagttttttgctcgttgcccag

SEQ ID NO: 5625 - DNA, 64 bp, Tupaia herpesvirus
gtcgaagaggctggcgtgcgcgttccactcgtccgagacctgccgcaccgtcgcactgttaaac

SEQ ID NO: 5626 - DNA, 24 bp, Tupaia herpesvirus
tggcgtgcgcgttccactcgtccg

SEQ ID NO: 5627 - DNA, 21 bp, Homo sapiens
tggctgcgcgttcctctcccg

SEQ ID NO: 5628 - DNA, 18 bp, Homo sapiens
tggcgtgcgcgtccctcg

SEQ ID NO: 5629 - DNA, 17 bp, Homo sapiens
tggctgcgcgttccact

SEQ ID NO: 5630 - DNA, 78 bp, Chimpanzee cytomegalovirus
gcgcggcacagtgccaacgcgaagcgcgcatgcgcacgttgaactgcgcatgcgtcggcgtcggtgttgttgccgggc

SEQ ID NO: 5631 - DNA, 24 bp, Chimpanzee cytomegalovirus
acgcgaagcgcgcatgcgcacgtt

SEQ ID NO: 5632 - DNA, 21 bp, Homo sapiens
acgcaggcgcgcgtgcgtgcg

SEQ ID NO: 5633 - DNA, 20 bp, Homo sapiens
cgctgaggcggacgcacgtt

SEQ ID NO: 5634 - DNA, 18 bp, Homo sapiens
acgcgaagtgcttatgcg

SEQ ID NO: 5635 - DNA, 18 bp, Homo sapiens
gaagatgctgcgcacgtt

SEQ ID NO: 5636 - DNA, 97 bp, Chimpanzee cytomegalovirus
tcccgtaatactccgcgatcagttaccgtggcgacgtttcagggcgcatgcgcctctggaagcggtaccgcgggcgcgtcgtgggcacagtacgggg

SEQ ID NO: 5637 - DNA, 24 bp, Chimpanzee cytomegalovirus
tggaagcggtaccgcgggcgcgtc

SEQ ID NO: 5638 - DNA, 22 bp, Homo sapiens
cggggtccggggcgggcgcgtc

SEQ ID NO: 5639 - DNA, 19 bp, Homo sapiens
tggaagcggtgccgggggc

SEQ ID NO: 5640 - DNA, 107 bp, Transmissible gastroenteritis virus
aacagccgttattagttaattgcttatggccagtccctagctttgaagaagcagcttctacattttgttttgagggtgctggctttgatcaatgtaatggtgctgtt

SEQ ID NO: 5641 - DNA, 24 bp, Transmissible gastroenteritis virus
ttgcttatggccagtccctagctt

SEQ ID NO: 5642 - DNA, 24 bp, Homo sapiens
ttgtttatagccatggcctggctt

SEQ ID NO: 5643 - DNA, 18 bp, Homo sapiens
ttgcttatggttgtcccc

SEQ ID NO: 5644 - DNA, 22 bp, Homo sapiens
ttccttattagattcctagctt

SEQ ID NO: 5645 - DNA, 21 bp, Homo sapiens
ttgcgttatgaaatgtcctag

SEQ ID NO: 5646 - DNA, 18 bp, Homo sapiens
tgacacagttcctagctt

SEQ ID NO: 5647 - DNA, 62 bp, Chimpanzee cytomegalovirus
gctctgttcccgcatagctgatcccgtataaatataataacggagaaagcgtaacggagagc

SEQ ID NO: 5648 - DNA, 21 bp, Chimpanzee cytomegalovirus
ggagaaagcgtaacggagagc

SEQ ID NO: 5649 - DNA, 20 bp, Homo sapiens
gggaaagcgcggctcagagc

SEQ ID NO: 5650 - DNA, 17 bp, Homo sapiens
ggagagcggcggagagc

SEQ ID NO: 5651 - DNA, 19 bp, Homo sapiens
ggagaaagtgtcgcaccgg

SEQ ID NO: 5652 - DNA, 18 bp, Homo sapiens
ggtgagtagtcggagagc

SEQ ID NO: 5653 - DNA, 21 bp, Homo sapiens
gggaaggctggaaaagggagc

SEQ ID NO: 5654 - DNA, 19 bp, Homo sapiens
ggagggggcgcagaatagc

SEQ ID NO: 5655 - DNA, 18 bp, Homo sapiens
ggagagggcaccgagagc

SEQ ID NO: 5656 - DNA, 18 bp, Homo sapiens
ggagagaggtcggagagc

SEQ ID NO: 5657 - DNA, 19 bp, Homo sapiens
agagaaagtgtaagcagag

SEQ ID NO: 5658 - DNA, 22 bp, Homo sapiens
ggagaaagggtgaaactaggag

SEQ ID NO: 5659 - DNA, 18 bp, Homo sapiens
gaagaaagcgccgagggc

SEQ ID NO: 5660 - DNA, 15 bp, Homo sapiens
gaagaacgcggagag

SEQ ID NO: 5661 - DNA, 23 bp, Homo sapiens
ggagagacgtgcagatggagagc

SEQ ID NO: 5662 - DNA, 19 bp, Homo sapiens
ggagaaaggagctgggagc

SEQ ID NO: 5663 - DNA, 16 bp, Homo sapiens
agagattaacggagag

SEQ ID NO: 5664 - DNA, 20 bp, Homo sapiens
gaagggtaggcgcggagagc

SEQ ID NO: 5665 - DNA, 20 bp, Homo sapiens
ggagaaggatgtagcaggag

SEQ ID NO: 5666 - DNA, 18 bp, Homo sapiens
gggaaagcacaagagggc

SEQ ID NO: 5667 - DNA, 20 bp, Homo sapiens
ggtagagcgcggcggagagc

SEQ ID NO: 5668 - DNA, 18 bp, Homo sapiens
gaaagagcagcagagagc

SEQ ID NO: 5669 - DNA, 21 bp, Homo sapiens
ggagaaagcagtggcagacag

SEQ ID NO: 5670 - DNA, 19 bp, Homo sapiens
ggagaaaatgacttagagc

SEQ ID NO: 5671 - DNA, 17 bp, Homo sapiens
ggaggcggacggagagc

SEQ ID NO: 5672 - DNA, 20 bp, Homo sapiens
ggaggcaaggtagggagagc

SEQ ID NO: 5673 - DNA, 16 bp, Homo sapiens
ggagaaaacaggagag

SEQ ID NO: 5674 - DNA, 18 bp, Homo sapiens
ggagagcgcgggaggagc

SEQ ID NO: 5675 - DNA, 19 bp, Homo sapiens
gggatggcgtccagagagc

SEQ ID NO: 5676 - DNA, 16 bp, Homo sapiens
ggagaaagagcaggag

SEQ ID NO: 5677 - DNA, 23 bp, Homo sapiens
agagaaaagccggggcggagggc

SEQ ID NO: 5678 - DNA, 19 bp, Homo sapiens
gggacttataacggagggc

SEQ ID NO: 5679 - DNA, 18 bp, Homo sapiens
ggagaaagtgcgttacgg

SEQ ID NO: 5680 - DNA, 18 bp, Homo sapiens
ggagagcgcagggagagc

SEQ ID NO: 5681 - DNA, 21 bp, Homo sapiens
gaggaagcgggtgcggagagc

SEQ ID NO: 5682 - DNA, 24 bp, Homo sapiens
ggagaaagtgcaaattacaggagc

SEQ ID NO: 5683 - DNA, 19 bp, Homo sapiens
ggagaacgggcgcggagag

SEQ ID NO: 5684 - DNA, 16 bp, Homo sapiens
agaggagcacggagag

SEQ ID NO: 5685 - DNA, 20 bp, Homo sapiens
agagaggaagcctggagagc

SEQ ID NO: 5686 - DNA, 17 bp, Homo sapiens
ggagggcagcagagagc

SEQ ID NO: 5687 - DNA, 18 bp, Homo sapiens
ggagaaagttacgcaggc

SEQ ID NO: 5688 - DNA, 19 bp, Homo sapiens
ggagaaagttgccgggagc

SEQ ID NO: 5689 - DNA, 19 bp, Homo sapiens
agagaaattggcggagagc

SEQ ID NO: 5690 - DNA, 20 bp, Homo sapiens
agagagagagaccggagagc

SEQ ID NO: 5691 - DNA, 21 bp, Homo sapiens
ggagaaagagcctggtgggag

SEQ ID NO: 5692 - DNA, 16 bp, Homo sapiens
ggggaacgcggagagc

SEQ ID NO: 5693 - DNA, 16 bp, Homo sapiens
ggagaaaggctgagag

SEQ ID NO: 5694 - DNA, 20 bp, Homo sapiens
ggagaaagctctggaggagc

SEQ ID NO: 5695 - DNA, 16 bp, Homo sapiens
gggaaagcgtataaag

SEQ ID NO: 5696 - DNA, 20 bp, Homo sapiens
ggagaaagtgagtaggaagc

SEQ ID NO: 5697 - DNA, 23 bp, Homo sapiens
ggagaaacgaagacctggagggc

SEQ ID NO: 5698 - DNA, 20 bp, Homo sapiens
ggcagggagcttcagagagc

SEQ ID NO: 5699 - DNA, 19 bp, Homo sapiens
ggagaaggtggaggaaagc

SEQ ID NO: 5700 - DNA, 16 bp, Homo sapiens
ggaaaaagtgtaggag

SEQ ID NO: 5701 - DNA, 17 bp, Homo sapiens
gaaaggcaacagagggc

SEQ ID NO: 5702 - DNA, 22 bp, Homo sapiens
ggagaaagcctgagggaggagc

SEQ ID NO: 5703 - DNA, 18 bp, Homo sapiens
ggggaaagtacagagagc

SEQ ID NO: 5704 - DNA, 18 bp, Homo sapiens
agagaagggcagggagag

SEQ ID NO: 5705 - DNA, 16 bp, Homo sapiens
gggaaagctaacggag

SEQ ID NO: 5706 - DNA, 18 bp, Homo sapiens
gggacggaagcggagagc

SEQ ID NO: 5707 - DNA, 23 bp, Homo sapiens
ggagaaaggtggcaggaaggagc

SEQ ID NO: 5708 - DNA, 19 bp, Homo sapiens
ggataagatctcggagagc

SEQ ID NO: 5709 - DNA, 17 bp, Homo sapiens
ggagaaaggtggaagaa

SEQ ID NO: 5710 - DNA, 16 bp, Homo sapiens
ggaggcggcggagagc

SEQ ID NO: 5711 - DNA, 20 bp, Homo sapiens
ggagaaagagactggagagc

SEQ ID NO: 5712 - DNA, 19 bp, Homo sapiens
ggagaaagaggaagagagc

SEQ ID NO: 5713 - DNA, 17 bp, Homo sapiens
gagaaagcggggagagc

SEQ ID NO: 5714 - DNA, 19 bp, Homo sapiens
ggagaaagcggggctcagc

SEQ ID NO: 5715 - DNA, 20 bp, Homo sapiens
ggaaagggtagtaagggagc

SEQ ID NO: 5716 - DNA, 19 bp, Homo sapiens
ggacgaggctccggagagc

SEQ ID NO: 5717 - DNA, 23 bp, Homo sapiens
ggagaaaggcgtccacacagagc

SEQ ID NO: 5718 - DNA, 17 bp, Homo sapiens
ggaggagcgcggagagc

SEQ ID NO: 5719 - DNA, 19 bp, Homo sapiens
ggaggtgagcacagagagc

SEQ ID NO: 5720 - DNA, 16 bp, Homo sapiens
ggagagcacagagagc

SEQ ID NO: 5721 - DNA, 20 bp, Homo sapiens
ggatgaagtgtcacaaagag

SEQ ID NO: 5722 - DNA, 18 bp, Homo sapiens
ggagaaagggctgagggc

SEQ ID NO: 5723 - DNA, 16 bp, Homo sapiens
ggagaaagcaggagag

SEQ ID NO: 5724 - DNA, 19 bp, Homo sapiens
ggaggagggtctggagagc

SEQ ID NO: 5725 - DNA, 20 bp, Homo sapiens
ggggaagtgtgccgaagagc

SEQ ID NO: 5726 - DNA, 18 bp, Homo sapiens
agagaaagtaaagggagc

SEQ ID NO: 5727 - DNA, 18 bp, Homo sapiens
ggagaaagcggcaaccgg

SEQ ID NO: 5728 - DNA, 19 bp, Homo sapiens
agagaaaggcccggagagc

SEQ ID NO: 5729 - DNA, 15 bp, Homo sapiens
ggagaaaagtagagg

SEQ ID NO: 5730 - DNA, 20 bp, Homo sapiens
ggaggaaatgggcagagagc

SEQ ID NO: 5731 - DNA, 21 bp, Homo sapiens
ggagaagctgtgacagagagc

SEQ ID NO: 5732 - DNA, 16 bp, Homo sapiens
ggaaaaagcgaaggag

SEQ ID NO: 5733 - DNA, 21 bp, Homo sapiens
ggagaaagcagtggctaggag

SEQ ID NO: 5734 - DNA, 18 bp, Homo sapiens
agagagagaagggagagc

SEQ ID NO: 5735 - DNA, 18 bp, Homo sapiens
ggagaaactgggaagagc

SEQ ID NO: 5736 - DNA, 23 bp, Homo sapiens
ggagaagcggggccctggggagc

SEQ ID NO: 5737 - DNA, 17 bp, Homo sapiens
ggaggaggtcagagagc

SEQ ID NO: 5738 - DNA, 18 bp, Homo sapiens
ggagaaagcagtaaacag

SEQ ID NO: 5739 - DNA, 18 bp, Homo sapiens
gggaaagcgttgtaaaag

SEQ ID NO: 5740 - DNA, 17 bp, Homo sapiens
gggaagcacaagggagc

SEQ ID NO: 5741 - DNA, 17 bp, Homo sapiens
ggaggtaggcggagagc

SEQ ID NO: 5742 - DNA, 15 bp, Homo sapiens
ggaaaagccagagag

SEQ ID NO: 5743 - DNA, 22 bp, Homo sapiens
gggaaaagcgtagggaaggggc

SEQ ID NO: 5744 - DNA, 20 bp, Homo sapiens
ggagtgaggcaggagagagc

SEQ ID NO: 5745 - DNA, 19 bp, Homo sapiens
ggagaaagtgcacacaggc

SEQ ID NO: 5746 - DNA, 19 bp, Homo sapiens
ggaaaggcggccagagagc

SEQ ID NO: 5747 - DNA, 18 bp, Homo sapiens
gaggcaccggcggagagc

SEQ ID NO: 5748 - DNA, 18 bp, Homo sapiens
ggagaaagggcaggagag

SEQ ID NO: 5749 - DNA, 18 bp, Homo sapiens
gggtaaaccacggagagc

SEQ ID NO: 5750 - DNA, 17 bp, Homo sapiens
gggaaagcgtgaagaac

SEQ ID NO: 5751 - DNA, 17 bp, Homo sapiens
gggaaatgccagagagc

SEQ ID NO: 5752 - DNA, 18 bp, Homo sapiens
ggagaaagtatgagagag

SEQ ID NO: 5753 - DNA, 17 bp, Homo sapiens
gggaagacacggagagc

SEQ ID NO: 5754 - DNA, 21 bp, Homo sapiens
ggaggggggctaacggagagc

SEQ ID NO: 5755 - DNA, 19 bp, Homo sapiens
ggaggcaccggcggagagc

SEQ ID NO: 5756 - DNA, 16 bp, Homo sapiens
ggagtcaacggagagc

SEQ ID NO: 5757 - DNA, 19 bp, Homo sapiens
ggagaaaggtagaaccagc

SEQ ID NO: 5758 - DNA, 19 bp, Homo sapiens
agagaaaggggcggagagc

SEQ ID NO: 5759 - DNA, 21 bp, Homo sapiens
gagaagccacccgcggagagc

SEQ ID NO: 5760 - DNA, 19 bp, Homo sapiens
ggaaaaagtcaaggggagc

SEQ ID NO: 5761 - DNA, 19 bp, Homo sapiens
ggagaaagagtgcatgagc

SEQ ID NO: 5762 - DNA, 17 bp, Homo sapiens
gaggggtaacggagagc

SEQ ID NO: 5763 - DNA, 19 bp, Homo sapiens
gggaccgcagacggagagc

SEQ ID NO: 5764 - DNA, 20 bp, Homo sapiens
agagaggcggaacggagggc

SEQ ID NO: 5765 - DNA, 19 bp, Homo sapiens
ggagaaaatgtaatttgag

SEQ ID NO: 5766 - DNA, 60 bp, Chimpanzee cytomegalovirus
gcgcatgcgcctgggggctttctatgcgcgcatacgcgcgcagctcgcgggtgtatgcgt

SEQ ID NO: 5767 - DNA, 20 bp, Chimpanzee cytomegalovirus
cagctcgcgggtgtatgcgt

SEQ ID NO: 5768 - DNA, 17 bp, Homo sapiens
cagctcgcggctgacat

SEQ ID NO: 5769 - DNA, 19 bp, Homo sapiens
caggtcgcgggccgagcgt

SEQ ID NO: 5770 - DNA, 15 bp, Homo sapiens
caactcgtatatgcg

SEQ ID NO: 5771 - DNA, 18 bp, Homo sapiens
cagctcgctgcttcgcgt

SEQ ID NO: 5772 - DNA, 19 bp, Homo sapiens
gcgcggcgggtgtgtgcgt

SEQ ID NO: 5773 - DNA, 20 bp, Homo sapiens
agcacatggggtgtatgtgt

SEQ ID NO: 5774 - DNA, 18 bp, Homo sapiens
cagcacgtgggcatgcgt

SEQ ID NO: 5775 - DNA, 20 bp, Homo sapiens
cagctctgcggggtacacgt

SEQ ID NO: 5776 - DNA, 20 bp, Homo sapiens
gcccgcgggaagcgctgcgt

SEQ ID NO: 5777 - DNA, 17 bp, Homo sapiens
accagaggtgtatgtgt

SEQ ID NO: 5778 - DNA, 21 bp, Homo sapiens
cacctcgcggactccatgcgt

SEQ ID NO: 5779 - DNA, 16 bp, Homo sapiens
gctccgcggcacgcgt

SEQ ID NO: 5780 - DNA, 17 bp, Homo sapiens
cagacgggtgtatgtgt

SEQ ID NO: 5781 - DNA, 18 bp, Homo sapiens
cagcgtgcacgcatgcgt

SEQ ID NO: 5782 - DNA, 17 bp, Homo sapiens
accgcaggtgtgtgcgt

SEQ ID NO: 5783 - DNA, 17 bp, Homo sapiens
cagtgcgcggcacgcgt

SEQ ID NO: 5784 - DNA, 21 bp, Homo sapiens
cagctatgcatgcatatgtgt

SEQ ID NO: 5785 - DNA, 19 bp, Homo sapiens
cccggctgggtgtatgtgt

SEQ ID NO: 5786 - DNA, 17 bp, Homo sapiens
cagcccgcggccggcgt

SEQ ID NO: 5787 - DNA, 17 bp, Homo sapiens
gctcagagtgtgtgtgt

SEQ ID NO: 5788 - DNA, 17 bp, Homo sapiens
agcatccaagtatgcgt

SEQ ID NO: 5789 - DNA, 17 bp, Homo sapiens
cagctcgcggtgccagc

SEQ ID NO: 5790 - DNA, 19 bp, Homo sapiens
cagctcgcaggtcataggt

SEQ ID NO: 5791 - DNA, 20 bp, Homo sapiens
cagctgcacatgctgtgcgt

SEQ ID NO: 5792 - DNA, 15 bp, Homo sapiens
gctgcgggcgcgcgt

SEQ ID NO: 5793 - DNA, 21 bp, Homo sapiens
cacctcggaggaagtgtgtgt

SEQ ID NO: 5794 - DNA, 17 bp, Homo sapiens
cagacgtgtgtatgtgt

SEQ ID NO: 5795 - DNA, 18 bp, Homo sapiens
agctgccaatgtatgtgt

SEQ ID NO: 5796 - DNA, 18 bp, Homo sapiens
cagctcgctggtcagcgt

SEQ ID NO: 5797 - DNA, 17 bp, Homo sapiens
actcgcggactgcgcgt

SEQ ID NO: 5798 - DNA, 18 bp, Homo sapiens
cagctcgcggatgagcac

SEQ ID NO: 5799 - DNA, 130 bp, Chimpanzee cytomegalovirus
gggggtcggggggtgcgcagggcggtgccccgggtcggaacccccgggtgcggttcgggcggcggggcttcccggctccttccaccggctcgcccgggggtcggggcgatgccctggcctcccctccccc

SEQ ID NO: 5800 - DNA, 21 bp, Chimpanzee cytomegalovirus
tgccctggcctcccctccccc

SEQ ID NO: 5801 - DNA, 19 bp, Homo sapiens
tgctcctgatcctttcccc

SEQ ID NO: 5802 - DNA, 16 bp, Homo sapiens
ccctctcccctctccc

SEQ ID NO: 5803 - DNA, 17 bp, Homo sapiens
gctctgtctcccctccc

SEQ ID NO: 5804 - DNA, 21 bp, Homo sapiens
tgccctggccccagcaccccc

SEQ ID NO: 5805 - DNA, 18 bp, Homo sapiens
tgctactgacccctcccc

SEQ ID NO: 5806 - DNA, 15 bp, Homo sapiens
gccacctcccctccc

SEQ ID NO: 5807 - DNA, 19 bp, Homo sapiens
gccctccaggcccctcctc

SEQ ID NO: 5808 - DNA, 17 bp, Homo sapiens
ccctggcccctctcccc

SEQ ID NO: 5809 - DNA, 17 bp, Homo sapiens
gccccctgcccctcccc

SEQ ID NO: 5810 - DNA, 17 bp, Homo sapiens
tgccctggcccactccc

SEQ ID NO: 5811 - DNA, 29 bp, Homo sapiens
gccctggcactctgtaaagcttctccggg

SEQ ID NO: 5812 - DNA, 20 bp, Homo sapiens
cctcctccctcccctcctcc

SEQ ID NO: 5813 - DNA, 18 bp, Homo sapiens
ccccctccctctccttcc

SEQ ID NO: 5814 - DNA, 18 bp, Homo sapiens
gcctttagcctccctccc

SEQ ID NO: 5815 - DNA, 17 bp, Homo sapiens
gccctcccccctccccc

SEQ ID NO: 5816 - DNA, 20 bp, Homo sapiens
gccaaaacattcccctcccc

SEQ ID NO: 5817 - DNA, 19 bp, Homo sapiens
ctgttctcatccctccccc

SEQ ID NO: 5818 - DNA, 19 bp, Homo sapiens
gctctggccccaatcctcc

SEQ ID NO: 5819 - DNA, 19 bp, Homo sapiens
tggccttaccccctccccc

SEQ ID NO: 5820 - DNA, 19 bp, Homo sapiens
tgccccagagcctctctcc

SEQ ID NO: 5821 - DNA, 23 bp, Homo sapiens
ccctggctcagagcccttcctcc

SEQ ID NO: 5822 - DNA, 17 bp, Homo sapiens
cgctccctcccctcccc

SEQ ID NO: 5823 - DNA, 18 bp, Homo sapiens
gcccctcgctccctcccc

SEQ ID NO: 5824 - DNA, 22 bp, Homo sapiens
gccctggcctccaccgttttcc

SEQ ID NO: 5825 - DNA, 19 bp, Homo sapiens
gccctggctgaccctcccc

SEQ ID NO: 5826 - DNA, 20 bp, Homo sapiens
cccctccgtctcctctcccc

SEQ ID NO: 5827 - DNA, 18 bp, Homo sapiens
tgccctgggctccaacct

SEQ ID NO: 5828 - DNA, 19 bp, Homo sapiens
tgcccgggcctcccgcacc

SEQ ID NO: 5829 - DNA, 19 bp, Homo sapiens
ccctgagcccccctcctcc

SEQ ID NO: 5830 - DNA, 19 bp, Homo sapiens
ccctctatctccctccccc

SEQ ID NO: 5831 - DNA, 19 bp, Homo sapiens
cctcacactcccctccccc

SEQ ID NO: 5832 - DNA, 19 bp, Homo sapiens
tgcccctcactccctcccc

SEQ ID NO: 5833 - DNA, 15 bp, Homo sapiens
ccctcccccctcccc

SEQ ID NO: 5834 - DNA, 19 bp, Homo sapiens
gccctggcccagggctccc

SEQ ID NO: 5835 - DNA, 20 bp, Homo sapiens
tgctctacctccccttcccc

SEQ ID NO: 5836 - DNA, 17 bp, Homo sapiens
cccctcccccctccccc

SEQ ID NO: 5837 - DNA, 20 bp, Homo sapiens
actctggcttcccctccccc

SEQ ID NO: 5838 - DNA, 18 bp, Homo sapiens
gccctggccctgactccc

SEQ ID NO: 5839 - DNA, 20 bp, Homo sapiens
tgccttgctggccctccccc

SEQ ID NO: 5840 - DNA, 20 bp, Homo sapiens
tgccctggctgtccagtccc

SEQ ID NO: 5841 - DNA, 17 bp, Homo sapiens
gctcccctcccttcccc

SEQ ID NO: 5842 - DNA, 23 bp, Homo sapiens
taccctggccagttctctctccc

SEQ ID NO: 5843 - DNA, 20 bp, Homo sapiens
gcccagccctttccccttcc

SEQ ID NO: 5844 - DNA, 16 bp, Homo sapiens
ccctggctcctccccc

SEQ ID NO: 5845 - DNA, 17 bp, Homo sapiens
gcccacctccctccccc

SEQ ID NO: 5846 - DNA, 19 bp, Homo sapiens
ccctggccagtctccttcc

SEQ ID NO: 5847 - DNA, 20 bp, Homo sapiens
tgccctgagttctttctccc

SEQ ID NO: 5848 - DNA, 19 bp, Homo sapiens
gctctggctcccctctccc

SEQ ID NO: 5849 - DNA, 16 bp, Homo sapiens
gcccggctcctctccc

SEQ ID NO: 5850 - DNA, 24 bp, Homo sapiens
tgccctgggccttgtgggaccccc

SEQ ID NO: 5851 - DNA, 17 bp, Homo sapiens
gccccttcccctcctcc

SEQ ID NO: 5852 - DNA, 18 bp, Homo sapiens
cctccgccttcccctccc

SEQ ID NO: 5853 - DNA, 22 bp, Homo sapiens
gccctggccacttctctcctcc

SEQ ID NO: 5854 - DNA, 19 bp, Homo sapiens
tgccctgacctctctgccc

SEQ ID NO: 5855 - DNA, 19 bp, Homo sapiens
gctccttaccccctccccc

SEQ ID NO: 5856 - DNA, 19 bp, Homo sapiens
tggctcccttccctccccc

SEQ ID NO: 5857 - DNA, 17 bp, Homo sapiens
cccctcccctctcctcc

SEQ ID NO: 5858 - DNA, 17 bp, Homo sapiens
ccccctcccccctcccc

SEQ ID NO: 5859 - DNA, 18 bp, Homo sapiens
gccccctccccctctccc

SEQ ID NO: 5860 - DNA, 18 bp, Homo sapiens
tgcctggccctctctccc

SEQ ID NO: 5861 - DNA, 18 bp, Homo sapiens
cctggagtcccctcctcc

SEQ ID NO: 5862 - DNA, 22 bp, Homo sapiens
cccttcttgcttcccctccccc

SEQ ID NO: 5863 - DNA, 18 bp, Homo sapiens
tgccccctcccttccccc

SEQ ID NO: 5864 - DNA, 24 bp, Homo sapiens
gccttactggccttttccttctcc

SEQ ID NO: 5865 - DNA, 17 bp, Homo sapiens
gctctgctcccctctcc

SEQ ID NO: 5866 - DNA, 20 bp, Homo sapiens
gccggctgcctccccttccc

SEQ ID NO: 5867 - DNA, 17 bp, Homo sapiens
acccccgcccctccccc

SEQ ID NO: 5868 - DNA, 20 bp, Homo sapiens
ctgggagcttctcctccccc

SEQ ID NO: 5869 - DNA, 17 bp, Homo sapiens
tgccacccccctccccc

SEQ ID NO: 5870 - DNA, 15 bp, Homo sapiens
gccccctccctcccc

SEQ ID NO: 5871 - DNA, 16 bp, Homo sapiens
ccctaggcccctcccc

SEQ ID NO: 5872 - DNA, 19 bp, Homo sapiens
gcccagccttccctcctcc

SEQ ID NO: 5873 - DNA, 18 bp, Homo sapiens
tggctcccctcctctccc

SEQ ID NO: 5874 - DNA, 17 bp, Homo sapiens
cctggcctcggtccccc

SEQ ID NO: 5875 - DNA, 19 bp, Homo sapiens
gcccagcttcccctcctcc

SEQ ID NO: 5876 - DNA, 18 bp, Homo sapiens
tacccaggttccctcccc

SEQ ID NO: 5877 - DNA, 19 bp, Homo sapiens
gctcttacaccccctcccc

SEQ ID NO: 5878 - DNA, 22 bp, Homo sapiens
tggcctggcccttcccttcccc

SEQ ID NO: 5879 - DNA, 18 bp, Homo sapiens
tgctcagcccccttcccc

SEQ ID NO: 5880 - DNA, 18 bp, Homo sapiens
gcccactccccctccccc

SEQ ID NO: 5881 - DNA, 19 bp, Homo sapiens
tgcacctaagccctccccc

SEQ ID NO: 5882 - DNA, 15 bp, Homo sapiens
ccctcctccctcccc

SEQ ID NO: 5883 - DNA, 19 bp, Homo sapiens
tgccagtgtctcctccccc

SEQ ID NO: 5884 - DNA, 19 bp, Homo sapiens
cccctttgccccctccccc

SEQ ID NO: 5885 - DNA, 20 bp, Homo sapiens
tactactggtcccctcctcc

SEQ ID NO: 5886 - DNA, 20 bp, Homo sapiens
gctcctgtttcccctccccc

SEQ ID NO: 5887 - DNA, 21 bp, Homo sapiens
cccagggacttcccctccccc

SEQ ID NO: 5888 - DNA, 19 bp, Homo sapiens
taccttggcccccttcccc

SEQ ID NO: 5889 - DNA, 17 bp, Homo sapiens
cccccgcccccctcccc

SEQ ID NO: 5890 - DNA, 18 bp, Homo sapiens
tggcctccctcctcctcc

SEQ ID NO: 5891 - DNA, 18 bp, Homo sapiens
gccctccgctcctccccc

SEQ ID NO: 5892 - DNA, 16 bp, Homo sapiens
tgccagcccctcctcc

SEQ ID NO: 5893 - DNA, 19 bp, Homo sapiens
gccctgcttttcctccccc

SEQ ID NO: 5894 - DNA, 18 bp, Homo sapiens
gccctttgccccctcccc

SEQ ID NO: 5895 - DNA, 17 bp, Homo sapiens
tgcccggcccggctccc

SEQ ID NO: 5896 - DNA, 15 bp, Homo sapiens
cctgcctcctccccc

SEQ ID NO: 5897 - DNA, 18 bp, Homo sapiens
tgcgctgcctccttctcc

SEQ ID NO: 5898 - DNA, 18 bp, Homo sapiens
tggccggccccctccccc

SEQ ID NO: 5899 - DNA, 19 bp, Homo sapiens
tgcagcctccctctcctcc

SEQ ID NO: 5900 - DNA, 20 bp, Homo sapiens
tgctgcctccttccctcccc

SEQ ID NO: 5901 - DNA, 19 bp, Homo sapiens
ccctccacctccctccccc

SEQ ID NO: 5902 - DNA, 18 bp, Homo sapiens
tgcctgtgccatctcccc

SEQ ID NO: 5903 - DNA, 21 bp, Homo sapiens
gccctgggcgcgtcctctccc

SEQ ID NO: 5904 - DNA, 17 bp, Homo sapiens
tgccctggctctgtccc

SEQ ID NO: 5905 - DNA, 18 bp, Homo sapiens
tgcctgtctctcccctcc

SEQ ID NO: 5906 - DNA, 21 bp, Homo sapiens
tgccctaggcggggatccccc

SEQ ID NO: 5907 - DNA, 18 bp, Homo sapiens
gcccgccctccctccccc

SEQ ID NO: 5908 - DNA, 16 bp, Homo sapiens
gccctgccccttcccc

SEQ ID NO: 5909 - DNA, 19 bp, Homo sapiens
gcctacggcctccttcccc

SEQ ID NO: 5910 - DNA, 18 bp, Homo sapiens
ccctgcccaccctccccc

SEQ ID NO: 5911 - DNA, 20 bp, Homo sapiens
ccctgcacctcccctcctcc

SEQ ID NO: 5912 - DNA, 19 bp, Homo sapiens
gccttagcctccctcctcc

SEQ ID NO: 5913 - DNA, 17 bp, Homo sapiens
cccaccgcccctccccc

SEQ ID NO: 5914 - DNA, 23 bp, Homo sapiens
tgccctaggtagtagccttccct

SEQ ID NO: 5915 - DNA, 19 bp, Homo sapiens
tgcgcacggcccctccccc

SEQ ID NO: 5916 - DNA, 18 bp, Homo sapiens
gctcccggcccttccctc

SEQ ID NO: 5917 - DNA, 18 bp, Homo sapiens
tgcccccctccctttccc

SEQ ID NO: 5918 - DNA, 19 bp, Homo sapiens
tgcccggccttggtcctcc

SEQ ID NO: 5919 - DNA, 21 bp, Homo sapiens
tactccattctcccctctccc

SEQ ID NO: 5920 - DNA, 17 bp, Homo sapiens
cgccctcctccccttcc

SEQ ID NO: 5921 - DNA, 18 bp, Homo sapiens
ctgcgcggcccctccccc

SEQ ID NO: 5922 - DNA, 27 bp, Homo sapiens
tgcctctgaacaccctccccttccccg

SEQ ID NO: 5923 - DNA, 23 bp, Homo sapiens
tgccctgggcttgcccggctccc

SEQ ID NO: 5924 - DNA, 18 bp, Homo sapiens
gccccgatcccctccccc

SEQ ID NO: 5925 - DNA, 20 bp, Homo sapiens
ccggctccttcccctccccc

SEQ ID NO: 5926 - DNA, 16 bp, Homo sapiens
ccctgactcctccccc

SEQ ID NO: 5927 - DNA, 18 bp, Homo sapiens
tgcacgcccccctccccc

SEQ ID NO: 5928 - DNA, 18 bp, Homo sapiens
tggcttctcccctccccc

SEQ ID NO: 5929 - DNA, 18 bp, Homo sapiens
gcgtggttcctcccctcc

SEQ ID NO: 5930 - DNA, 23 bp, Homo sapiens
gccctggctggctggctctccct

SEQ ID NO: 5931 - DNA, 19 bp, Homo sapiens
tgtcccccacccctccctc

SEQ ID NO: 5932 - DNA, 16 bp, Homo sapiens
ccccggccccttcccc

SEQ ID NO: 5933 - DNA, 18 bp, Homo sapiens
gccccaaatcccctcccc

SEQ ID NO: 5934 - DNA, 17 bp, Homo sapiens
gccaggctctcctcccc

SEQ ID NO: 5935 - DNA, 19 bp, Homo sapiens
tgccctggcctctacctcc

SEQ ID NO: 5936 - DNA, 18 bp, Homo sapiens
tgcggcctcctctcctcc

SEQ ID NO: 5937 - DNA, 21 bp, Homo sapiens
tgcctgatacccccctctccc

SEQ ID NO: 5938 - DNA, 22 bp, Homo sapiens
tggcctggcctcctctcttccg

SEQ ID NO: 5939 - DNA, 16 bp, Homo sapiens
tgcaccccccccctcc

SEQ ID NO: 5940 - DNA, 20 bp, Homo sapiens
tgccctggctcccatttccc

SEQ ID NO: 5941 - DNA, 21 bp, Homo sapiens
gccgcgaccctcccctcctcc

SEQ ID NO: 5942 - DNA, 21 bp, Homo sapiens
tgcgccacccctcttctcccc

SEQ ID NO: 5943 - DNA, 18 bp, Homo sapiens
ggcctgaacccctccccc

SEQ ID NO: 5944 - DNA, 17 bp, Homo sapiens
tgcactgtcccctcccc

SEQ ID NO: 5945 - DNA, 18 bp, Homo sapiens
gcccgagcgctcccctcc

SEQ ID NO: 5946 - DNA, 18 bp, Homo sapiens
tgctctcctgcccctccc

SEQ ID NO: 5947 - DNA, 29 bp, Homo sapiens
tgccctgggcccggtgtctctcctccggg

SEQ ID NO: 5948 - DNA, 17 bp, Homo sapiens
ccccgagtcctctcccc

SEQ ID NO: 5949 - DNA, 18 bp, Homo sapiens
ccaaccttcccctccccc

SEQ ID NO: 5950 - DNA, 22 bp, Homo sapiens
tgccctggtctgccgcggaccc

SEQ ID NO: 5951 - DNA, 22 bp, Homo sapiens
tgccctgggtctgggagcctcc

SEQ ID NO: 5952 - DNA, 18 bp, Homo sapiens
cccttccagccctccccc

SEQ ID NO: 5953 - DNA, 18 bp, Homo sapiens
cccccgccttccctctcc

SEQ ID NO: 5954 - DNA, 20 bp, Homo sapiens
tgccccggccgtcgctcccc

SEQ ID NO: 5955 - DNA, 19 bp, Homo sapiens
gcacagccctccccttccc

SEQ ID NO: 5956 - DNA, 21 bp, Homo sapiens
tgccctgggttttccacttcc

SEQ ID NO: 5957 - DNA, 19 bp, Homo sapiens
ccctggccttccttttccc

SEQ ID NO: 5958 - DNA, 17 bp, Homo sapiens
tgccctccccctccccc

SEQ ID NO: 5959 - DNA, 18 bp, Homo sapiens
tgctccacctccttcctc

SEQ ID NO: 5960 - DNA, 18 bp, Homo sapiens
cctcttccaccccctccc

SEQ ID NO: 5961 - DNA, 19 bp, Homo sapiens
gctcctgtgtcctctcccc

SEQ ID NO: 5962 - DNA, 19 bp, Homo sapiens
tgtcccggcctctgacccc

SEQ ID NO: 5963 - DNA, 19 bp, Homo sapiens
tgcagcagcctccccttcc

SEQ ID NO: 5964 - DNA, 23 bp, Homo sapiens
tgccctgggctctgggatgcccc

SEQ ID NO: 5965 - DNA, 19 bp, Homo sapiens
cccctgcatcccttccccc

SEQ ID NO: 5966 - DNA, 16 bp, Homo sapiens
ccctgctcccctcccc

SEQ ID NO: 5967 - DNA, 20 bp, Homo sapiens
gccttggcctcccaaagtcc

SEQ ID NO: 5968 - DNA, 25 bp, Homo sapiens
tggcctggccccctgatccttcccc

SEQ ID NO: 5969 - DNA, 19 bp, Homo sapiens
ctgatccttcccctctccc

SEQ ID NO: 5970 - DNA, 17 bp, Homo sapiens
cctatcccccctccccc

SEQ ID NO: 5971 - DNA, 17 bp, Homo sapiens
gccctgtctcctccccc

SEQ ID NO: 5972 - DNA, 17 bp, Homo sapiens
tgcctaccctccttccc

SEQ ID NO: 5973 - DNA, 17 bp, Homo sapiens
ccctggcttccctcccc

SEQ ID NO: 5974 - DNA, 16 bp, Homo sapiens
tgccctgagcccctcc

SEQ ID NO: 5975 - DNA, 18 bp, Homo sapiens
tgccctggccgggctccc

SEQ ID NO: 5976 - DNA, 17 bp, Homo sapiens
gcccttacccctccccc

SEQ ID NO: 5977 - DNA, 16 bp, Homo sapiens
tgcccctggcccctcc

SEQ ID NO: 5978 - DNA, 20 bp, Homo sapiens
gccgctgcgctcccctcccc

SEQ ID NO: 5979 - DNA, 20 bp, Homo sapiens
gcccggccccttccttctcc

SEQ ID NO: 5980 - DNA, 19 bp, Homo sapiens
tgcccctcccctgcctccc

SEQ ID NO: 5981 - DNA, 17 bp, Homo sapiens
tgccaaactccctcccc

SEQ ID NO: 5982 - DNA, 17 bp, Homo sapiens
ccccatccccctccccc

SEQ ID NO: 5983 - DNA, 17 bp, Homo sapiens
cctacctcccctccccc

SEQ ID NO: 5984 - DNA, 20 bp, Homo sapiens
ccctcaacatctcctcctcc

SEQ ID NO: 5985 - DNA, 18 bp, Homo sapiens
tgtcccaccccctttccc

SEQ ID NO: 5986 - DNA, 19 bp, Homo sapiens
gctctggcctccgttcccc

SEQ ID NO: 5987 - DNA, 18 bp, Homo sapiens
tgcttggcctccttcccc

SEQ ID NO: 5988 - DNA, 19 bp, Homo sapiens
ctgtatcctcccctccccc

SEQ ID NO: 5989 - DNA, 26 bp, Homo sapiens
gccctggctcaaggatttctcccccg

SEQ ID NO: 5990 - DNA, 16 bp, Homo sapiens
gccctgacccttcccc

SEQ ID NO: 5991 - DNA, 19 bp, Homo sapiens
gctcctggcctccttctcc

SEQ ID NO: 5992 - DNA, 16 bp, Homo sapiens
cccactcccctccccc

SEQ ID NO: 5993 - DNA, 18 bp, Homo sapiens
ccctccctcccctttccc

SEQ ID NO: 5994 - DNA, 20 bp, Homo sapiens
gccctgaccgccccctctcc

SEQ ID NO: 5995 - DNA, 19 bp, Homo sapiens
gcctcacgacctctccctc

SEQ ID NO: 5996 - DNA, 16 bp, Homo sapiens
acccctcccctccccc

SEQ ID NO: 5997 - DNA, 23 bp, Homo sapiens
tgccctggaccttcaatttctcc

SEQ ID NO: 5998 - DNA, 20 bp, Homo sapiens
cccccccctttccctccccc

SEQ ID NO: 5999 - DNA, 20 bp, Homo sapiens
ccactaacctcttctccccc

SEQ ID NO: 6000 - DNA, 17 bp, Homo sapiens
tgccccccccctccccc

SEQ ID NO: 6001 - DNA, 19 bp, Homo sapiens
ccctccctttccctccccc

SEQ ID NO: 6002 - DNA, 20 bp, Homo sapiens
gccctggccgcgcctcctcc

SEQ ID NO: 6003 - DNA, 17 bp, Homo sapiens
ccccctccccctccccc

SEQ ID NO: 6004 - DNA, 16 bp, Homo sapiens
ccctcccccctccccc

SEQ ID NO: 6005 - DNA, 20 bp, Homo sapiens
ccctggcatcaccctccccc

SEQ ID NO: 6006 - DNA, 21 bp, Homo sapiens
taccctgagctcccctccccc

SEQ ID NO: 6007 - DNA, 17 bp, Homo sapiens
cgccctcgccctccccc

SEQ ID NO: 6008 - DNA, 21 bp, Homo sapiens
tgcccgccccctcccttcccc

SEQ ID NO: 6009 - DNA, 20 bp, Homo sapiens
tgctctgacctccacatccc

SEQ ID NO: 6010 - DNA, 19 bp, Homo sapiens
tgcaacactcccctccccc

SEQ ID NO: 6011 - DNA, 18 bp, Homo sapiens
tgccctgggccagcctcc

SEQ ID NO: 6012 - DNA, 18 bp, Homo sapiens
tgccccggacttctcccc

SEQ ID NO: 6013 - DNA, 16 bp, Homo sapiens
tgcagcctcctctccc

SEQ ID NO: 6014 - DNA, 19 bp, Homo sapiens
gcccctcttcccctccccc

SEQ ID NO: 6015 - DNA, 16 bp, Homo sapiens
tgccgggtcccctccc

SEQ ID NO: 6016 - DNA, 18 bp, Homo sapiens
tgcttctgctccctcccc

SEQ ID NO: 6017 - DNA, 17 bp, Homo sapiens
gccgagctcccctcccc

SEQ ID NO: 6018 - DNA, 24 bp, Homo sapiens
tgcctggcccatctctctttcccc

SEQ ID NO: 6019 - DNA, 20 bp, Homo sapiens
tgcctcggcgctcctccccc

SEQ ID NO: 6020 - DNA, 18 bp, Homo sapiens
cgctgctctcccctctcc

SEQ ID NO: 6021 - DNA, 20 bp, Homo sapiens
tgtccctgcatccctccccc

SEQ ID NO: 6022 - DNA, 18 bp, Homo sapiens
cccttggccccctctccc

SEQ ID NO: 6023 - DNA, 18 bp, Homo sapiens
ccctggcctctctcgccc

SEQ ID NO: 6024 - DNA, 18 bp, Homo sapiens
taccttggcccctccctc

SEQ ID NO: 6025 - DNA, 20 bp, Homo sapiens
tgccccaacacctcttcccc

SEQ ID NO: 6026 - DNA, 17 bp, Homo sapiens
gcccgcccccctccccc

SEQ ID NO: 6027 - DNA, 15 bp, Homo sapiens
gccccacccctcccc

SEQ ID NO: 6028 - DNA, 17 bp, Homo sapiens
tgcccggcctggcctcc

SEQ ID NO: 6029 - DNA, 21 bp, Homo sapiens
tgcctggcctcggaaaccccc

SEQ ID NO: 6030 - DNA, 18 bp, Homo sapiens
cctcgcctcccctccccc

SEQ ID NO: 6031 - DNA, 18 bp, Homo sapiens
tgtcctagcccctcctcc

SEQ ID NO: 6032 - DNA, 22 bp, Homo sapiens
gccccccaaccctcctcttccc

SEQ ID NO: 6033 - DNA, 19 bp, Homo sapiens
gccctggccttccctctcc

SEQ ID NO: 6034 - DNA, 19 bp, Homo sapiens
tacccctctcccctccccc

SEQ ID NO: 6035 - DNA, 19 bp, Homo sapiens
cctgcccctcccctccccc

SEQ ID NO: 6036 - DNA, 17 bp, Homo sapiens
tgccctggccgctgccc

SEQ ID NO: 6037 - DNA, 18 bp, Homo sapiens
ccccgggcccccttcccc

SEQ ID NO: 6038 - DNA, 18 bp, Homo sapiens
tgctccagcctctccccc

SEQ ID NO: 6039 - DNA, 18 bp, Homo sapiens
tagcctcacctcttcccc

SEQ ID NO: 6040 - DNA, 22 bp, Homo sapiens
tggcctggcctgagatgcctcc

SEQ ID NO: 6041 - DNA, 19 bp, Homo sapiens
tgtcctggggccctccccc

SEQ ID NO: 6042 - DNA, 18 bp, Homo sapiens
taccttaccccctcctcc

SEQ ID NO: 6043 - DNA, 18 bp, Homo sapiens
tgccccctcccctcctcc

SEQ ID NO: 6044 - DNA, 19 bp, Homo sapiens
tgcaggctctcccctcccc

SEQ ID NO: 6045 - DNA, 18 bp, Homo sapiens
gccctggccatctcctcc

SEQ ID NO: 6046 - DNA, 17 bp, Homo sapiens
tgcccagcccctctccc

SEQ ID NO: 6047 - DNA, 18 bp, Homo sapiens
gcccacaccccctccccc

SEQ ID NO: 6048 - DNA, 17 bp, Homo sapiens
tgctcctcccctccccc

SEQ ID NO: 6049 - DNA, 21 bp, Homo sapiens
gccctggcctcggcagcctcc

SEQ ID NO: 6050 - DNA, 18 bp, Homo sapiens
cgcctgctcccctccccc

SEQ ID NO: 6051 - DNA, 20 bp, Homo sapiens
tgccctggattccagtctcc

SEQ ID NO: 6052 - DNA, 21 bp, Homo sapiens
tgccctggtttcctcttgccc

SEQ ID NO: 6053 - DNA, 19 bp, Homo sapiens
tgccgcttttccctccccc

SEQ ID NO: 6054 - DNA, 21 bp, Homo sapiens
gccctggcctcagttttctcc

SEQ ID NO: 6055 - DNA, 19 bp, Homo sapiens
tgctcctaattccctcccc

SEQ ID NO: 6056 - DNA, 18 bp, Homo sapiens
gccccacccccctccccc

SEQ ID NO: 6057 - DNA, 18 bp, Homo sapiens
ctggcctcccatttcccc

SEQ ID NO: 6058 - DNA, 17 bp, Homo sapiens
gctcctgcccctccccc

SEQ ID NO: 6059 - DNA, 19 bp, Homo sapiens
tgcctccatctccctcccc

SEQ ID NO: 6060 - DNA, 20 bp, Homo sapiens
tgccctcacagcctcttcct

SEQ ID NO: 6061 - DNA, 21 bp, Homo sapiens
gccctcctgccctcccctccc

SEQ ID NO: 6062 - DNA, 16 bp, Homo sapiens
ccctcgcctcctcccc

SEQ ID NO: 6063 - DNA, 18 bp, Homo sapiens
ccttctacctccctcccc

SEQ ID NO: 6064 - DNA, 23 bp, Homo sapiens
tgccctgacacctgactcttccc

SEQ ID NO: 6065 - DNA, 20 bp, Homo sapiens
tgccccaacagctccttccc

SEQ ID NO: 6066 - DNA, 18 bp, Homo sapiens
tgctccggcctcccgccc

SEQ ID NO: 6067 - DNA, 19 bp, Homo sapiens
tgctccgtttccctccccc

SEQ ID NO: 6068 - DNA, 20 bp, Homo sapiens
tggcctggccttcgtgccct

SEQ ID NO: 6069 - DNA, 20 bp, Homo sapiens
taccctcactcccctcctcc

SEQ ID NO: 6070 - DNA, 21 bp, Homo sapiens
tgcttagatctcccctctccc

SEQ ID NO: 6071 - DNA, 19 bp, Homo sapiens
gcccgcaagctcccctccc

SEQ ID NO: 6072 - DNA, 18 bp, Homo sapiens
tgcctggcctgggctccc

SEQ ID NO: 6073 - DNA, 20 bp, Homo sapiens
tgccctggacccgtttcctc

SEQ ID NO: 6074 - DNA, 19 bp, Homo sapiens
gccgttgccttccctcccc

SEQ ID NO: 6075 - DNA, 19 bp, Homo sapiens
tgcctgattttcctccccc

SEQ ID NO: 6076 - DNA, 20 bp, Homo sapiens
gccctgagttttccttcccc

SEQ ID NO: 6077 - DNA, 21 bp, Homo sapiens
ccctggcctcacttctcctcc

SEQ ID NO: 6078 - DNA, 21 bp, Homo sapiens
tgccctggctcaactggctcc

SEQ ID NO: 6079 - DNA, 18 bp, Homo sapiens
tgccctggccctgccccc

SEQ ID NO: 6080 - DNA, 18 bp, Homo sapiens
gcccagcctttcctcccc

SEQ ID NO: 6081 - DNA, 19 bp, Homo sapiens
gccttggcttctcgctccc

SEQ ID NO: 6082 - DNA, 16 bp, Homo sapiens
tgctcagcctcctccc

SEQ ID NO: 6083 - DNA, 17 bp, Homo sapiens
tgctccctcccctcccc

SEQ ID NO: 6084 - DNA, 20 bp, Homo sapiens
tgccctgggcttgggcctcc

SEQ ID NO: 6085 - DNA, 19 bp, Homo sapiens
gcgctgcctcctctcctcc

SEQ ID NO: 6086 - DNA, 20 bp, Homo sapiens
gcctttggctcccttcctcc

SEQ ID NO: 6087 - DNA, 21 bp, Homo sapiens
gccctggctacccagcctccc

SEQ ID NO: 6088 - DNA, 25 bp, Homo sapiens
tgccctggcgcacggctccttctcc

SEQ ID NO: 6089 - DNA, 18 bp, Homo sapiens
cgccgcctcccctcctcc

SEQ ID NO: 6090 - DNA, 19 bp, Homo sapiens
cctggcctctgcttccccc

SEQ ID NO: 6091 - DNA, 19 bp, Homo sapiens
gctccgcccttcccttccc

SEQ ID NO: 6092 - DNA, 20 bp, Homo sapiens
gcctcgtccttccttcctcc

SEQ ID NO: 6093 - DNA, 16 bp, Homo sapiens
tgcacactccctcccc

SEQ ID NO: 6094 - DNA, 21 bp, Homo sapiens
gcggggcttctcccctcctcc

SEQ ID NO: 6095 - DNA, 18 bp, Homo sapiens
tgtcctggcctcctgctc

SEQ ID NO: 6096 - DNA, 15 bp, Homo sapiens
gcccacctcctcccc

SEQ ID NO: 6097 - DNA, 20 bp, Homo sapiens
cctcatccgtcccctcctcc

SEQ ID NO: 6098 - DNA, 19 bp, Homo sapiens
tgccgccaggcccctcccc

SEQ ID NO: 6099 - DNA, 23 bp, Homo sapiens
gctctgtccccctcctcttcccc

SEQ ID NO: 6100 - DNA, 18 bp, Homo sapiens
tgccctggcactgccctc

SEQ ID NO: 6101 - DNA, 24 bp, Homo sapiens
tgccctggtccagatgccctcccc

SEQ ID NO: 6102 - DNA, 18 bp, Homo sapiens
tgctctggccccggcccc

SEQ ID NO: 6103 - DNA, 19 bp, Homo sapiens
tgccctggtgccagcccct

SEQ ID NO: 6104 - DNA, 21 bp, Homo sapiens
gcccatggcctcctttcttcc

SEQ ID NO: 6105 - DNA, 20 bp, Homo sapiens
tgcttattgcctccctcccc

SEQ ID NO: 6106 - DNA, 19 bp, Homo sapiens
cccctccctccctttcccc

SEQ ID NO: 6107 - DNA, 20 bp, Homo sapiens
gccccatgcttccctttccc

SEQ ID NO: 6108 - DNA, 18 bp, Homo sapiens
gccctggacgcctccctc

SEQ ID NO: 6109 - DNA, 19 bp, Homo sapiens
ccctggcctcgcagccctc

SEQ ID NO: 6110 - DNA, 18 bp, Homo sapiens
ctagaaacctcccctccc

SEQ ID NO: 6111 - DNA, 21 bp, Homo sapiens
tgccctggtctcctccacccc

SEQ ID NO: 6112 - DNA, 18 bp, Homo sapiens
tgccctgaaccctccccc

SEQ ID NO: 6113 - DNA, 21 bp, Homo sapiens
tgcccctgcttcccctttccc

SEQ ID NO: 6114 - DNA, 18 bp, Homo sapiens
tgcccttgcaccctcccc

SEQ ID NO: 6115 - DNA, 17 bp, Homo sapiens
taccacatcccctcccc

SEQ ID NO: 6116 - DNA, 18 bp, Homo sapiens
tgccctggcctgggcctc

SEQ ID NO: 6117 - DNA, 18 bp, Homo sapiens
ccatgggtctcctccccc

SEQ ID NO: 6118 - DNA, 19 bp, Homo sapiens
ctagtccctcccctttccc

SEQ ID NO: 6119 - DNA, 20 bp, Homo sapiens
cctgcccattcccctccccc

SEQ ID NO: 6120 - DNA, 18 bp, Homo sapiens
tgccctggcttccatctc

SEQ ID NO: 6121 - DNA, 20 bp, Homo sapiens
tgtcctatatctcctccccc

SEQ ID NO: 6122 - DNA, 20 bp, Homo sapiens
tggcctggtgctccctcccc

SEQ ID NO: 6123 - DNA, 20 bp, Homo sapiens
cgccctgtcacccctccccc

SEQ ID NO: 6124 - DNA, 19 bp, Homo sapiens
cctctggcctctgtccctc

SEQ ID NO: 6125 - DNA, 18 bp, Homo sapiens
cctgcctcctcccctccc

SEQ ID NO: 6126 - DNA, 21 bp, Homo sapiens
tgccacaatgactcctccccc

SEQ ID NO: 6127 - DNA, 18 bp, Homo sapiens
tgccctgggcccattccc

SEQ ID NO: 6128 - DNA, 16 bp, Homo sapiens
tgccctggccgcctcc

SEQ ID NO: 6129 - DNA, 19 bp, Homo sapiens
tgctctggcctcagtctcc

SEQ ID NO: 6130 - DNA, 22 bp, Homo sapiens
ccctggccatcatctttccctc

SEQ ID NO: 6131 - DNA, 20 bp, Homo sapiens
gcccgcagctcccctctccc

SEQ ID NO: 6132 - DNA, 19 bp, Homo sapiens
tgcacgcgctccctccccc

SEQ ID NO: 6133 - DNA, 18 bp, Homo sapiens
tgccctgactcctccccc

SEQ ID NO: 6134 - DNA, 23 bp, Homo sapiens
tgccctgggcctggtccccctcc

SEQ ID NO: 6135 - DNA, 22 bp, Homo sapiens
cctggtccccctcctctttccc

SEQ ID NO: 6136 - DNA, 24 bp, Homo sapiens
tgtgctggcctctcagagctcccc

SEQ ID NO: 6137 - DNA, 20 bp, Homo sapiens
tgccctgggcctccagagcc

SEQ ID NO: 6138 - DNA, 20 bp, Homo sapiens
tggagtccttcccctcctcc

SEQ ID NO: 6139 - DNA, 16 bp, Homo sapiens
accccccccctccccc

SEQ ID NO: 6140 - DNA, 19 bp, Homo sapiens
tgccctgacttcatccctc

SEQ ID NO: 6141 - DNA, 15 bp, Homo sapiens
gccccccccctcccc

SEQ ID NO: 6142 - DNA, 18 bp, Homo sapiens
taccctggagcctccctc

SEQ ID NO: 6143 - DNA, 18 bp, Homo sapiens
tgccccccatccctcccc

SEQ ID NO: 6144 - DNA, 21 bp, Homo sapiens
gctggcggcctcctctccccc

SEQ ID NO: 6145 - DNA, 16 bp, Homo sapiens
tgccagcctcttcccc

SEQ ID NO: 6146 - DNA, 21 bp, Homo sapiens
gctctaaaagtcccctcctcc

SEQ ID NO: 6147 - DNA, 18 bp, Homo sapiens
cccccctttccctccccc

SEQ ID NO: 6148 - DNA, 19 bp, Homo sapiens
tgccctggccccagcttcc

SEQ ID NO: 6149 - DNA, 21 bp, Homo sapiens
tgccccaaactctcctctccc

SEQ ID NO: 6150 - DNA, 18 bp, Homo sapiens
gcctctgccccctccccc

SEQ ID NO: 6151 - DNA, 20 bp, Homo sapiens
tgctcccctccccctccccc

SEQ ID NO: 6152 - DNA, 21 bp, Homo sapiens
gccctcggccttctcttcctc

SEQ ID NO: 6153 - DNA, 18 bp, Homo sapiens
gccccatgctccctcccc

SEQ ID NO: 6154 - DNA, 18 bp, Homo sapiens
tgctctggcccctgcccc

SEQ ID NO: 6155 - DNA, 20 bp, Homo sapiens
tggcctggcctcggctaccc

SEQ ID NO: 6156 - DNA, 17 bp, Homo sapiens
gccctggcccatccccc

SEQ ID NO: 6157 - DNA, 22 bp, Homo sapiens
taccctggcctccccagctccc

SEQ ID NO: 6158 - DNA, 22 bp, Homo sapiens
tgacctggcccaccaactctcc

SEQ ID NO: 6159 - DNA, 19 bp, Homo sapiens
gctcagcctcccttccccc

SEQ ID NO: 6160 - DNA, 20 bp, Homo sapiens
ccctggccactacctcctcc

SEQ ID NO: 6161 - DNA, 17 bp, Homo sapiens
gccctggcccggtcccc

SEQ ID NO: 6162 - DNA, 17 bp, Homo sapiens
gcctcgctccctctccc

SEQ ID NO: 6163 - DNA, 21 bp, Homo sapiens
tgcaaccacctcccctcttcc

SEQ ID NO: 6164 - DNA, 18 bp, Homo sapiens
ccctgctgcctctccctc

SEQ ID NO: 6165 - DNA, 21 bp, Homo sapiens
cgcctgatccctcccctcccc

SEQ ID NO: 6166 - DNA, 18 bp, Homo sapiens
ccctcccctcccctcccc

SEQ ID NO: 6167 - DNA, 17 bp, Homo sapiens
tgcctgctcccctcccc

SEQ ID NO: 6168 - DNA, 18 bp, Homo sapiens
tgctcccctcccctcccc

SEQ ID NO: 6169 - DNA, 19 bp, Homo sapiens
acccatgaccccctttccc

SEQ ID NO: 6170 - DNA, 20 bp, Homo sapiens
tgcctcggcctcccaaagcc

SEQ ID NO: 6171 - DNA, 18 bp, Homo sapiens
tgcctccgccccctcctc

SEQ ID NO: 6172 - DNA, 20 bp, Homo sapiens
gccgcgcccctccccttccc

SEQ ID NO: 6173 - DNA, 18 bp, Homo sapiens
ccccgggtccccttctcc

SEQ ID NO: 6174 - DNA, 18 bp, Homo sapiens
tgctccggcctcggctcc

SEQ ID NO: 6175 - DNA, 19 bp, Homo sapiens
gccctggcctctgggtccc

SEQ ID NO: 6176 - DNA, 18 bp, Homo sapiens
gcccccaggcctctctcc

SEQ ID NO: 6177 - DNA, 23 bp, Homo sapiens
gccctgaggccctcccctctccc

SEQ ID NO: 6178 - DNA, 17 bp, Homo sapiens
gctcccgtccctccccc

SEQ ID NO: 6179 - DNA, 16 bp, Homo sapiens
accccctcccctcccc

SEQ ID NO: 6180 - DNA, 20 bp, Homo sapiens
tggcccactttccctccccc

SEQ ID NO: 6181 - DNA, 17 bp, Homo sapiens
tgccctgacctcttccc

SEQ ID NO: 6182 - DNA, 19 bp, Homo sapiens
tacccaagcttcctccccc

SEQ ID NO: 6183 - DNA, 17 bp, Homo sapiens
gcctggacccttccccc

SEQ ID NO: 6184 - DNA, 18 bp, Homo sapiens
gcctccatctcccctccc

SEQ ID NO: 6185 - DNA, 18 bp, Homo sapiens
tggcttccttcctccccc

SEQ ID NO: 6186 - DNA, 21 bp, Homo sapiens
tgccctggttctcaggcctcc

SEQ ID NO: 6187 - DNA, 21 bp, Homo sapiens
tgcccggcctcctgtatgcct

SEQ ID NO: 6188 - DNA, 18 bp, Homo sapiens
ctgccctctccctccccc

SEQ ID NO: 6189 - DNA, 22 bp, Homo sapiens
tgcttagcccctcttcttcccc

SEQ ID NO: 6190 - DNA, 18 bp, Homo sapiens
tggcctggcctggcccct

SEQ ID NO: 6191 - DNA, 21 bp, Homo sapiens
tgcctcggcctccgcggcctc

SEQ ID NO: 6192 - DNA, 19 bp, Homo sapiens
tgcttcccatcccctcccc

SEQ ID NO: 6193 - DNA, 19 bp, Homo sapiens
cctctgcctccccttcccc

SEQ ID NO: 6194 - DNA, 21 bp, Homo sapiens
tgcccactcctcccctctccc

SEQ ID NO: 6195 - DNA, 17 bp, Homo sapiens
gctgcggtcccctcccc

SEQ ID NO: 6196 - DNA, 18 bp, Homo sapiens
gccctggcttctctctcc

SEQ ID NO: 6197 - DNA, 21 bp, Homo sapiens
tgccctgagctcacctctccc

SEQ ID NO: 6198 - DNA, 22 bp, Homo sapiens
tgccctggcccagtcctttccc

SEQ ID NO: 6199 - DNA, 21 bp, Homo sapiens
tgccctgccctaccctccccc

SEQ ID NO: 6200 - DNA, 20 bp, Homo sapiens
cccctctcttcccctccccc

SEQ ID NO: 6201 - DNA, 18 bp, Homo sapiens
gccctggcttcccgcctc

SEQ ID NO: 6202 - DNA, 19 bp, Homo sapiens
tgcttccctccccttcccc

SEQ ID NO: 6203 - DNA, 17 bp, Homo sapiens
gcgctgcttccctcccc

SEQ ID NO: 6204 - DNA, 18 bp, Homo sapiens
tgcccatggccctcccct

SEQ ID NO: 6205 - DNA, 19 bp, Homo sapiens
tgccctggtcccctacgcc

SEQ ID NO: 6206 - DNA, 16 bp, Homo sapiens
ccccatctcctccccc

SEQ ID NO: 6207 - DNA, 21 bp, Homo sapiens
tgtcctttgggcccctccctc

SEQ ID NO: 6208 - DNA, 18 bp, Homo sapiens
tggcctgacctctctccc

SEQ ID NO: 6209 - DNA, 18 bp, Homo sapiens
tgccctggcccccatccc

SEQ ID NO: 6210 - DNA, 18 bp, Homo sapiens
gcctcagcccccttcccc

SEQ ID NO: 6211 - DNA, 18 bp, Homo sapiens
tgccctggccccatttcc

SEQ ID NO: 6212 - DNA, 16 bp, Homo sapiens
tgcctctctcccctcc

SEQ ID NO: 6213 - DNA, 16 bp, Homo sapiens
gcccagcctctctccc

SEQ ID NO: 6214 - DNA, 21 bp, Homo sapiens
tgcctcggcctcccaaagtcc

SEQ ID NO: 6215 - DNA, 18 bp, Homo sapiens
gccctggcctcagaccct

SEQ ID NO: 6216 - DNA, 20 bp, Homo sapiens
ctggactcctcccctccccc

SEQ ID NO: 6217 - DNA, 17 bp, Homo sapiens
tgcccgaccccttcccc

SEQ ID NO: 6218 - DNA, 17 bp, Homo sapiens
gccccctcccctcctcc

SEQ ID NO: 6219 - DNA, 19 bp, Homo sapiens
tgccctggccttcctgctc

SEQ ID NO: 6220 - DNA, 17 bp, Homo sapiens
cctcctccccctccccc

SEQ ID NO: 6221 - DNA, 19 bp, Homo sapiens
gccctggcctccggggctc

SEQ ID NO: 6222 - DNA, 18 bp, Homo sapiens
tgcctggcctcatatccc

SEQ ID NO: 6223 - DNA, 19 bp, Homo sapiens
gcccttccattcccctccc

SEQ ID NO: 6224 - DNA, 16 bp, Homo sapiens
gcatagctcccctccc

SEQ ID NO: 6225 - DNA, 23 bp, Homo sapiens
gccctgggagcatcccctcctcc

SEQ ID NO: 6226 - DNA, 21 bp, Homo sapiens
gccctcagcgtcccctccccc

SEQ ID NO: 6227 - DNA, 18 bp, Homo sapiens
ccctcctccccctcctcc

SEQ ID NO: 6228 - DNA, 18 bp, Homo sapiens
tgacctggccactccccc

SEQ ID NO: 6229 - DNA, 18 bp, Homo sapiens
cccctcctccccttcccc

SEQ ID NO: 6230 - DNA, 17 bp, Homo sapiens
tgccctgtccctccccc

SEQ ID NO: 6231 - DNA, 18 bp, Homo sapiens
ccccttctcccctcctcc

SEQ ID NO: 6232 - DNA, 17 bp, Homo sapiens
tgtcctggcctgcctcc

SEQ ID NO: 6233 - DNA, 18 bp, Homo sapiens
taccctgacccttccctc

SEQ ID NO: 6234 - DNA, 19 bp, Homo sapiens
ccctggccttctcctctcc

SEQ ID NO: 6235 - DNA, 17 bp, Homo sapiens
ccctcagccccttcccc

SEQ ID NO: 6236 - DNA, 20 bp, Homo sapiens
gccctcagtttccctccccc

SEQ ID NO: 6237 - DNA, 16 bp, Homo sapiens
taccctacccctcccc

SEQ ID NO: 6238 - DNA, 22 bp, Homo sapiens
acctctggcctcctcttccctg

SEQ ID NO: 6239 - DNA, 19 bp, Homo sapiens
gccgctcctccccttcccc

SEQ ID NO: 6240 - DNA, 19 bp, Homo sapiens
gccccttagccccctctcc

SEQ ID NO: 6241 - DNA, 19 bp, Homo sapiens
tgccctgggctcctccccc

SEQ ID NO: 6242 - DNA, 17 bp, Homo sapiens
tgcgcccgtcccctccc

SEQ ID NO: 6243 - DNA, 26 bp, Homo sapiens
tgccctggctcccatcttccctctcc

SEQ ID NO: 6244 - DNA, 20 bp, Homo sapiens
cctctttcctccccttcccc

SEQ ID NO: 6245 - DNA, 17 bp, Homo sapiens
gccctcctccctccccc

SEQ ID NO: 6246 - DNA, 19 bp, Homo sapiens
tgctttgacccccttctcc

SEQ ID NO: 6247 - DNA, 20 bp, Homo sapiens
gccctggccagctcctttcc

SEQ ID NO: 6248 - DNA, 20 bp, Homo sapiens
cttcctccttctcctccccc

SEQ ID NO: 6249 - DNA, 19 bp, Homo sapiens
tgcccttctctccttcccc

SEQ ID NO: 6250 - DNA, 20 bp, Homo sapiens
gcttagcaggtcccctcccc

SEQ ID NO: 6251 - DNA, 18 bp, Homo sapiens
ccctggccttccatctcc

SEQ ID NO: 6252 - DNA, 17 bp, Homo sapiens
tacccatgcccctcccc

SEQ ID NO: 6253 - DNA, 20 bp, Homo sapiens
ccgctaccctcccctttccc

SEQ ID NO: 6254 - DNA, 16 bp, Homo sapiens
gccccggcctcctccc

SEQ ID NO: 6255 - DNA, 22 bp, Homo sapiens
tgccttggcccccaggtgcccc

SEQ ID NO: 6256 - DNA, 18 bp, Homo sapiens
gccctgatctcctctccc

SEQ ID NO: 6257 - DNA, 18 bp, Homo sapiens
tgcctctgcacctccctc

SEQ ID NO: 6258 - DNA, 19 bp, Homo sapiens
tgtcctggccctcttcccc

SEQ ID NO: 6259 - DNA, 17 bp, Homo sapiens
gcccctgcccctccccc

SEQ ID NO: 6260 - DNA, 16 bp, Homo sapiens
tgccgacctccttccc

SEQ ID NO: 6261 - DNA, 19 bp, Homo sapiens
tgtcctgaacaccctcccc

SEQ ID NO: 6262 - DNA, 23 bp, Homo sapiens
gccctggcctctgcttttttccc

SEQ ID NO: 6263 - DNA, 18 bp, Homo sapiens
tgccctggctctggcccc

SEQ ID NO: 6264 - DNA, 18 bp, Homo sapiens
tgccctggctcaggctcc

SEQ ID NO: 6265 - DNA, 19 bp, Homo sapiens
tgccctgggccttccgtcc

SEQ ID NO: 6266 - DNA, 18 bp, Homo sapiens
gcctctggccccttcctc

SEQ ID NO: 6267 - DNA, 17 bp, Homo sapiens
tgctcggtccctccccc

SEQ ID NO: 6268 - DNA, 18 bp, Homo sapiens
tgccctggactctgcccc

SEQ ID NO: 6269 - DNA, 18 bp, Homo sapiens
gctccatctccctccccc

SEQ ID NO: 6270 - DNA, 19 bp, Homo sapiens
gcccgcccttccttcctcc

SEQ ID NO: 6271 - DNA, 16 bp, Homo sapiens
tgcccaccccctcccc

SEQ ID NO: 6272 - DNA, 19 bp, Homo sapiens
taccctggccttcaggcct

SEQ ID NO: 6273 - DNA, 21 bp, Homo sapiens
taccttcatgtcccctccccc

SEQ ID NO: 6274 - DNA, 18 bp, Homo sapiens
cgccggctcccctccccc

SEQ ID NO: 6275 - DNA, 17 bp, Homo sapiens
tgtcctgtcccctcccc

SEQ ID NO: 6276 - DNA, 20 bp, Homo sapiens
ccctccccctctcctccccc

SEQ ID NO: 6277 - DNA, 17 bp, Homo sapiens
gccctcgctccctcccc

SEQ ID NO: 6278 - DNA, 20 bp, Homo sapiens
ccctgcagcaaccctccccc

SEQ ID NO: 6279 - DNA, 18 bp, Homo sapiens
tgctttggcccctccccc

SEQ ID NO: 6280 - DNA, 19 bp, Homo sapiens
tgccatcccacccctcccc

SEQ ID NO: 6281 - DNA, 17 bp, Homo sapiens
cgccgcgctcccctccc

SEQ ID NO: 6282 - DNA, 17 bp, Homo sapiens
gctcccctccctccccc

SEQ ID NO: 6283 - DNA, 18 bp, Homo sapiens
ccctggttcacctccccc

SEQ ID NO: 6284 - DNA, 18 bp, Homo sapiens
cgccgcttcccctcctcc

SEQ ID NO: 6285 - DNA, 18 bp, Homo sapiens
tggccacccccctccccc

SEQ ID NO: 6286 - DNA, 19 bp, Homo sapiens
tgtcctaagctcctccccc

SEQ ID NO: 6287 - DNA, 22 bp, Homo sapiens
tgccctgggctccagggagccc

SEQ ID NO: 6288 - DNA, 19 bp, Homo sapiens
gctcatgacctccccttcc

SEQ ID NO: 6289 - DNA, 18 bp, Homo sapiens
tgtccacactccctcccc

SEQ ID NO: 6290 - DNA, 19 bp, Homo sapiens
gcactgcttctcctccccc

SEQ ID NO: 6291 - DNA, 20 bp, Homo sapiens
gccccacgctcccctccccc

SEQ ID NO: 6292 - DNA, 19 bp, Homo sapiens
cctacctctctcctccccc

SEQ ID NO: 6293 - DNA, 23 bp, Homo sapiens
tgccctgggaagggctctctccc

SEQ ID NO: 6294 - DNA, 17 bp, Homo sapiens
gctcagcccccttcccc

SEQ ID NO: 6295 - DNA, 18 bp, Homo sapiens
tgcccggcctcccttctc

SEQ ID NO: 6296 - DNA, 19 bp, Homo sapiens
gccctcgtccccctcctcc

SEQ ID NO: 6297 - DNA, 20 bp, Homo sapiens
gcttcacctccctcccctcc

SEQ ID NO: 6298 - DNA, 21 bp, Homo sapiens
tgcctggcctcgtgggaccct

SEQ ID NO: 6299 - DNA, 20 bp, Homo sapiens
gcggctctctcccctcttcc

SEQ ID NO: 6300 - DNA, 20 bp, Homo sapiens
tgcctcatggtcccctcccc

SEQ ID NO: 6301 - DNA, 18 bp, Homo sapiens
gccgccgtctcctcctcc

SEQ ID NO: 6302 - DNA, 18 bp, Homo sapiens
gccctgggctcctccccc

SEQ ID NO: 6303 - DNA, 17 bp, Homo sapiens
taccccgcctctcctcc

SEQ ID NO: 6304 - DNA, 21 bp, Homo sapiens
tgccgtggctgggcctccccc

SEQ ID NO: 6305 - DNA, 18 bp, Homo sapiens
gcctccgcctcctcctcc

SEQ ID NO: 6306 - DNA, 18 bp, Homo sapiens
cctggctaccccctcccc

SEQ ID NO: 6307 - DNA, 20 bp, Homo sapiens
acacctggcctctccttccc

SEQ ID NO: 6308 - DNA, 18 bp, Homo sapiens
tgcccccctccctcctcc

SEQ ID NO: 6309 - DNA, 20 bp, Homo sapiens
cccctcctttctccttcccc

SEQ ID NO: 6310 - DNA, 18 bp, Homo sapiens
gcccgctttctcccctcc

SEQ ID NO: 6311 - DNA, 21 bp, Homo sapiens
gcccagccccttccctctccc

SEQ ID NO: 6312 - DNA, 18 bp, Homo sapiens
gccgccatcttctccccc

SEQ ID NO: 6313 - DNA, 19 bp, Homo sapiens
tgaccccacgctcctctcc

SEQ ID NO: 6314 - DNA, 20 bp, Homo sapiens
tgccctggggagtcctcctc

SEQ ID NO: 6315 - DNA, 20 bp, Homo sapiens
tgcgtagattcccctcctcc

SEQ ID NO: 6316 - DNA, 18 bp, Homo sapiens
gccccaaacccctccccc

SEQ ID NO: 6317 - DNA, 18 bp, Homo sapiens
ctggcctcttcccctccc

SEQ ID NO: 6318 - DNA, 18 bp, Homo sapiens
tgtcctggcccctccctc

SEQ ID NO: 6319 - DNA, 21 bp, Homo sapiens
tgccctggcccctcctcctcc

SEQ ID NO: 6320 - DNA, 23 bp, Homo sapiens
ccttcctcccccttccctccccc

SEQ ID NO: 6321 - DNA, 16 bp, Homo sapiens
gcctctgtcccctccc

SEQ ID NO: 6322 - DNA, 19 bp, Homo sapiens
tgccctgcctctggcctcc

SEQ ID NO: 6323 - DNA, 18 bp, Homo sapiens
cctctggcctcctgctcc

SEQ ID NO: 6324 - DNA, 19 bp, Homo sapiens
ccctggcctctctggcccc

SEQ ID NO: 6325 - DNA, 16 bp, Homo sapiens
ccctctcccctccccc

SEQ ID NO: 6326 - DNA, 19 bp, Homo sapiens
gcttctggccctcccctcc

SEQ ID NO: 6327 - DNA, 19 bp, Homo sapiens
tgcgtggccttccctcccc

SEQ ID NO: 6328 - DNA, 19 bp, Homo sapiens
tgcccctcccttgcctccc

SEQ ID NO: 6329 - DNA, 19 bp, Homo sapiens
gccctctggatcctcctcc

SEQ ID NO: 6330 - DNA, 15 bp, Homo sapiens
gccccgcccctcccc

SEQ ID NO: 6331 - DNA, 16 bp, Homo sapiens
ccccgtcccctcctcc

SEQ ID NO: 6332 - DNA, 20 bp, Homo sapiens
cccttcccatctcctccccc

SEQ ID NO: 6333 - DNA, 20 bp, Homo sapiens
tgccttgacctcccaggctc

SEQ ID NO: 6334 - DNA, 21 bp, Homo sapiens
tgcccgctcctcccctctccc

SEQ ID NO: 6335 - DNA, 18 bp, Homo sapiens
ctaagcctcccctcttcc

SEQ ID NO: 6336 - DNA, 18 bp, Homo sapiens
tgactctccatcctcccc

SEQ ID NO: 6337 - DNA, 19 bp, Homo sapiens
tggtctccccccctctccc

SEQ ID NO: 6338 - DNA, 17 bp, Homo sapiens
ccccagcctcctccccc

SEQ ID NO: 6339 - DNA, 18 bp, Homo sapiens
tgccctggcccatgccct

SEQ ID NO: 6340 - DNA, 20 bp, Homo sapiens
accccaggtctcctctttcc

SEQ ID NO: 6341 - DNA, 18 bp, Homo sapiens
cccccccatccctctccc

SEQ ID NO: 6342 - DNA, 17 bp, Homo sapiens
tgcccttcctctcctcc

SEQ ID NO: 6343 - DNA, 18 bp, Homo sapiens
acctcccacctctctccc

SEQ ID NO: 6344 - DNA, 17 bp, Homo sapiens
cctctggcctccacccc

SEQ ID NO: 6345 - DNA, 18 bp, Homo sapiens
tgacctccacctcttccc

SEQ ID NO: 6346 - DNA, 18 bp, Homo sapiens
cccgtgactccctccccc

SEQ ID NO: 6347 - DNA, 23 bp, Homo sapiens
tgccctggcctgtaggtgcccct

SEQ ID NO: 6348 - DNA, 21 bp, Homo sapiens
gcctgggaactcctctcttcc

SEQ ID NO: 6349 - DNA, 20 bp, Homo sapiens
gcggggccttcccctcctcc

SEQ ID NO: 6350 - DNA, 15 bp, Homo sapiens
gccggcctccctccc

SEQ ID NO: 6351 - DNA, 19 bp, Homo sapiens
tgccctggccctgtccccc

SEQ ID NO: 6352 - DNA, 18 bp, Homo sapiens
gcttcctgcccctccccc

SEQ ID NO: 6353 - DNA, 20 bp, Homo sapiens
ctgacctccttccctcctcc

SEQ ID NO: 6354 - DNA, 17 bp, Homo sapiens
cctccacctcctccccc

SEQ ID NO: 6355 - DNA, 20 bp, Homo sapiens
gcctcctcctcctcttcccc

SEQ ID NO: 6356 - DNA, 19 bp, Homo sapiens
ccttctcctcccctcctcc

SEQ ID NO: 6357 - DNA, 18 bp, Homo sapiens
cccctcctcctctcctcc

SEQ ID NO: 6358 - DNA, 17 bp, Homo sapiens
gcccttggccccctccc

SEQ ID NO: 6359 - DNA, 18 bp, Homo sapiens
cccgcccctcccctcccc

SEQ ID NO: 6360 - DNA, 18 bp, Homo sapiens
tgaccaggcccctccccc

SEQ ID NO: 6361 - DNA, 24 bp, Homo sapiens
tgccctaggccagcccacctctcc

SEQ ID NO: 6362 - DNA, 18 bp, Homo sapiens
tagcccctttccctcccc

SEQ ID NO: 6363 - DNA, 18 bp, Homo sapiens
tgccctgacctcccactc

SEQ ID NO: 6364 - DNA, 18 bp, Homo sapiens
gcctctgacccctcctcc

SEQ ID NO: 6365 - DNA, 17 bp, Homo sapiens
tgccccgcccctccccc

SEQ ID NO: 6366 - DNA, 16 bp, Homo sapiens
cgcccacccccctccc

SEQ ID NO: 6367 - DNA, 18 bp, Homo sapiens
tgcccggcagcctcctcc

SEQ ID NO: 6368 - DNA, 22 bp, Homo sapiens
tgccccggcttctcaggagccc

SEQ ID NO: 6369 - DNA, 18 bp, Homo sapiens
ccccgcctcccctctccc

SEQ ID NO: 6370 - DNA, 20 bp, Homo sapiens
tgccctcccctctccttccc

SEQ ID NO: 6371 - DNA, 18 bp, Homo sapiens
ccctgccctcccctctcc

SEQ ID NO: 6372 - DNA, 20 bp, Homo sapiens
tgccctaagttctctcctcc

SEQ ID NO: 6373 - DNA, 16 bp, Homo sapiens
tgctgcccccctcccc

SEQ ID NO: 6374 - DNA, 16 bp, Homo sapiens
gcaccctcccctcccc

SEQ ID NO: 6375 - DNA, 23 bp, Homo sapiens
gcccctcgcggtcttcccttccc

SEQ ID NO: 6376 - DNA, 20 bp, Homo sapiens
cgcttcggctttctcctccc

SEQ ID NO: 6377 - DNA, 19 bp, Homo sapiens
tgccctggacttcgacctc

SEQ ID NO: 6378 - DNA, 17 bp, Homo sapiens
gctcccggcctcctccc

SEQ ID NO: 6379 - DNA, 17 bp, Homo sapiens
gctctgacctctctccc

SEQ ID NO: 6380 - DNA, 21 bp, Homo sapiens
tgcctgcagtaaccttcctcc

SEQ ID NO: 6381 - DNA, 18 bp, Homo sapiens
tgacctccacctttcccc

SEQ ID NO: 6382 - DNA, 18 bp, Homo sapiens
accctggtcctctctccc

SEQ ID NO: 6383 - DNA, 17 bp, Homo sapiens
tgcctggcccttccccc

SEQ ID NO: 6384 - DNA, 18 bp, Homo sapiens
gccctggccttccggcct

SEQ ID NO: 6385 - DNA, 19 bp, Homo sapiens
cgtccctctcccctcttcc

SEQ ID NO: 6386 - DNA, 18 bp, Homo sapiens
tgcctggcccaagcccct

SEQ ID NO: 6387 - DNA, 20 bp, Homo sapiens
gcttggccttttccctcccc

SEQ ID NO: 6388 - DNA, 17 bp, Homo sapiens
gccctgctccctctccc

SEQ ID NO: 6389 - DNA, 21 bp, Homo sapiens
gcctgtgggctcccctccccc

SEQ ID NO: 6390 - DNA, 27 bp, Homo sapiens
tgccctggtgtgtccagtctttccccg

SEQ ID NO: 6391 - DNA, 20 bp, Homo sapiens
tgccccccaaccccctcccc

SEQ ID NO: 6392 - DNA, 18 bp, Homo sapiens
tgcctggcgtaccctccc

SEQ ID NO: 6393 - DNA, 18 bp, Homo sapiens
cgccgggtcccctctccc

SEQ ID NO: 6394 - DNA, 21 bp, Homo sapiens
tgcctgcaccctcccctcccc

SEQ ID NO: 6395 - DNA, 20 bp, Homo sapiens
gccttctgcgccccctcccc

SEQ ID NO: 6396 - DNA, 20 bp, Homo sapiens
tgccctggtccgccaactcc

SEQ ID NO: 6397 - DNA, 18 bp, Homo sapiens
gcctcggcctcctcctcc

SEQ ID NO: 6398 - DNA, 20 bp, Homo sapiens
gccctgcacccccctctccc

SEQ ID NO: 6399 - DNA, 18 bp, Homo sapiens
ctgcgcctctcctccccc

SEQ ID NO: 6400 - DNA, 18 bp, Homo sapiens
tgccctggcccccaggcc

SEQ ID NO: 6401 - DNA, 19 bp, Homo sapiens
gcccagtgtcccttccccc

SEQ ID NO: 6402 - DNA, 23 bp, Homo sapiens
tgccctggggatgggcctctcct

SEQ ID NO: 6403 - DNA, 17 bp, Homo sapiens
taccctggctcggcccc

SEQ ID NO: 6404 - DNA, 19 bp, Homo sapiens
tgcttgagcaccctccccc

SEQ ID NO: 6405 - DNA, 18 bp, Homo sapiens
tgcttggcctccagcctc

SEQ ID NO: 6406 - DNA, 20 bp, Homo sapiens
tgcccggccctgcttccctc

SEQ ID NO: 6407 - DNA, 18 bp, Homo sapiens
tgcgtacccccctccccc

SEQ ID NO: 6408 - DNA, 19 bp, Homo sapiens
gcttaacgatccctccccc

SEQ ID NO: 6409 - DNA, 19 bp, Homo sapiens
accctccactccctctccc

SEQ ID NO: 6410 - DNA, 17 bp, Homo sapiens
gcagctctcccctcccc

SEQ ID NO: 6411 - DNA, 18 bp, Homo sapiens
tgcccccggcccctcccc

SEQ ID NO: 6412 - DNA, 19 bp, Homo sapiens
tgcctggcctcctggcccc

SEQ ID NO: 6413 - DNA, 17 bp, Homo sapiens
gccctggcagctccccc

SEQ ID NO: 6414 - DNA, 23 bp, Homo sapiens
gccctggctggtccccctcctcc

SEQ ID NO: 6415 - DNA, 18 bp, Homo sapiens
tggtccccctcctcctcc

SEQ ID NO: 6416 - DNA, 17 bp, Homo sapiens
tgccctggcccctttcc

SEQ ID NO: 6417 - DNA, 15 bp, Homo sapiens
gcccggcccctcccc

SEQ ID NO: 6418 - DNA, 17 bp, Homo sapiens
gctccttcccctcctcc

SEQ ID NO: 6419 - DNA, 20 bp, Homo sapiens
tgccctggtcctgtcacccc

SEQ ID NO: 6420 - DNA, 20 bp, Homo sapiens
tgccccggcgccccttcccc

SEQ ID NO: 6421 - DNA, 21 bp, Homo sapiens
tgccctggtctggactccccc

SEQ ID NO: 6422 - DNA, 20 bp, Homo sapiens
tgcgccttctcccctcctcc

SEQ ID NO: 6423 - DNA, 17 bp, Homo sapiens
tgccctgagccactccc

SEQ ID NO: 6424 - DNA, 23 bp, Homo sapiens
cccccgccttcctcctctcctcc

SEQ ID NO: 6425 - DNA, 20 bp, Homo sapiens
cctaacagatcccctccccc

SEQ ID NO: 6426 - DNA, 21 bp, Homo sapiens
tgccctggcctgaagtctccc

SEQ ID NO: 6427 - DNA, 17 bp, Homo sapiens
gccccggcccctccccc

SEQ ID NO: 6428 - DNA, 20 bp, Homo sapiens
ctctgccatccccctccccc

SEQ ID NO: 6429 - DNA, 19 bp, Homo sapiens
tgccctggacaccttcccc

SEQ ID NO: 6430 - DNA, 18 bp, Homo sapiens
gccccccttccctctccc

SEQ ID NO: 6431 - DNA, 19 bp, Homo sapiens
tgctctttccccctcctcc

SEQ ID NO: 6432 - DNA, 20 bp, Homo sapiens
ccccgcccctcccctccccc

SEQ ID NO: 6433 - DNA, 18 bp, Homo sapiens
gctcccggcccctctccc

SEQ ID NO: 6434 - DNA, 20 bp, Homo sapiens
tgctcggcctcctctccccc

SEQ ID NO: 6435 - DNA, 20 bp, Homo sapiens
cctttggcctccgatcctcc

SEQ ID NO: 6436 - DNA, 20 bp, Homo sapiens
tgccctggctcccaggtctc

SEQ ID NO: 6437 - DNA, 17 bp, Homo sapiens
tgcccgagcccctcccc

SEQ ID NO: 6438 - DNA, 18 bp, Homo sapiens
tgtcctggcctcctctcc

SEQ ID NO: 6439 - DNA, 19 bp, Homo sapiens
tgcactgacctccttctcc

SEQ ID NO: 6440 - DNA, 20 bp, Homo sapiens
tgctatccctcccctctccc

SEQ ID NO: 6441 - DNA, 23 bp, Homo sapiens
gcccaggcccgtctttcctctcc

SEQ ID NO: 6442 - DNA, 23 bp, Homo sapiens
tgccctggtgctggctgttcccc

SEQ ID NO: 6443 - DNA, 16 bp, Homo sapiens
gccccgccccctcccc

SEQ ID NO: 6444 - DNA, 19 bp, Homo sapiens
taccctgcccccctcttcc

SEQ ID NO: 6445 - DNA, 18 bp, Homo sapiens
ctttcctgcccctccccc

SEQ ID NO: 6446 - DNA, 18 bp, Homo sapiens
ccctggccttggctcccc

SEQ ID NO: 6447 - DNA, 20 bp, Homo sapiens
cctaatgctttccctccccc

SEQ ID NO: 6448 - DNA, 16 bp, Homo sapiens
ccctcccccctcctcc

SEQ ID NO: 6449 - DNA, 19 bp, Homo sapiens
tgcctctggtgcctctctc

SEQ ID NO: 6450 - DNA, 117 bp, Human herpesvirus 5
ctgacagtagcgggtaataaaaacaataggatttttatcgtttttttatgttacaaaacaacgtatcactttcacggtgatttattcttgctattccttttccccttgggctgtcag

SEQ ID NO: 6451 - DNA, 24 bp, Human herpesvirus 5
atcactttcacggtgatttattct

SEQ ID NO: 6452 - DNA, 20 bp, Homo sapiens
atctactttcacatttattt

SEQ ID NO: 6453 - DNA, 22 bp, Homo sapiens
acttccacggtggggggcctct

SEQ ID NO: 6454 - DNA, 23 bp, Homo sapiens
atcactttcctattatttattct

SEQ ID NO: 6455 - DNA, 20 bp, Homo sapiens
atcatgacaagtgatttatt

SEQ ID NO: 6456 - DNA, 20 bp, Homo sapiens
ctttcacaggcacgtttatt

SEQ ID NO: 6457 - DNA, 22 bp, Homo sapiens
atcactttcgtggagccaatct

SEQ ID NO: 6458 - DNA, 19 bp, Homo sapiens
tcacttagggtgatttatt

SEQ ID NO: 6459 - DNA, 18 bp, Homo sapiens
atcatttttgcagtgatc

SEQ ID NO: 6460 - DNA, 18 bp, Homo sapiens
atcactttcagaatgttc

SEQ ID NO: 6461 - DNA, 23 bp, Homo sapiens
tcactttcaattctttttattct

SEQ ID NO: 6462 - DNA, 16 bp, Homo sapiens
ctttcaatgtttattc

SEQ ID NO: 6463 - DNA, 18 bp, Homo sapiens
atcacttcactgttattt

SEQ ID NO: 6464 - DNA, 17 bp, Homo sapiens
cacttagtgatttattc

SEQ ID NO: 6465 - DNA, 18 bp, Homo sapiens
accacttttatggtgttt

SEQ ID NO: 6466 - DNA, 18 bp, Homo sapiens
tttacacaatgatttatt

SEQ ID NO: 6467 - DNA, 19 bp, Homo sapiens
atcacttttacagtgactt

SEQ ID NO: 6468 - DNA, 18 bp, Homo sapiens
atcactttggtgctgttc

SEQ ID NO: 6469 - DNA, 18 bp, Homo sapiens
cacttttacaacttattc

SEQ ID NO: 6470 - DNA, 21 bp, Homo sapiens
tccttcccagtggtttattct

SEQ ID NO: 6471 - DNA, 16 bp, Homo sapiens
cacttatgatttattc

SEQ ID NO: 6472 - DNA, 107 bp, Human herpesvirus 5
ctacgtggaaagcaagcccactaacgaactgtctcaacgactgcaacgtttcgtaaccaagcgaccgatgcccgttagcgacagcttcgtctgcctgcgacccgtag

SEQ ID NO: 6473 - DNA, 24 bp, Human herpesvirus 5
taacgaactgtctcaacgactgca

SEQ ID NO: 6474 - DNA, 16 bp, Homo sapiens
gaactgtcaacactgc

SEQ ID NO: 6475 - DNA, 19 bp, Homo sapiens
cgctgttttgacgactgca

SEQ ID NO: 6476 - DNA, 20 bp, Homo sapiens
taacaactgtcttggaactg

SEQ ID NO: 6477 - DNA, 18 bp, Homo sapiens
caaatctcaacggctgca

SEQ ID NO: 6478 - DNA, 16 bp, Homo sapiens
cgactgtctccgctgc

SEQ ID NO: 6479 - DNA, 16 bp, Homo sapiens
acaactgtctcgacta

SEQ ID NO: 6480 - DNA, 84 bp, Chimpanzee cytomegalovirus
tatgtgaaatctcctaggataggtaggtactgtataaatgatcattcaggatgcttaagtttcttttctagatgattttagata

SEQ ID NO: 6481 - DNA, 24 bp, Chimpanzee cytomegalovirus
aggatgcttaagtttcttttctag

SEQ ID NO: 6482 - DNA, 19 bp, Homo sapiens
tgtataagtttctttttta

SEQ ID NO: 6483 - DNA, 17 bp, Homo sapiens
gggtgctgagtttctct

SEQ ID NO: 6484 - DNA, 21 bp, Homo sapiens
aggatgctgggttttttttct

SEQ ID NO: 6485 - DNA, 18 bp, Homo sapiens
agatgcctgtttttttct

SEQ ID NO: 6486 - DNA, 15 bp, Homo sapiens
aggatcttcttttct

SEQ ID NO: 6487 - DNA, 19 bp, Homo sapiens
agtatgtttaagtttcttt

SEQ ID NO: 6488 - DNA, 20 bp, Homo sapiens
aagaagcaaaagtttctttt

SEQ ID NO: 6489 - DNA, 18 bp, Homo sapiens
agggtgcttaagtaacct

SEQ ID NO: 6490 - DNA, 20 bp, Homo sapiens
ggatgcttaagtcttcctct

SEQ ID NO: 6491 - DNA, 18 bp, Homo sapiens
aggatgttaggtttcttt

SEQ ID NO: 6492 - DNA, 23 bp, Homo sapiens
aggatgttggagaggttttctag

SEQ ID NO: 6493 - DNA, 18 bp, Homo sapiens
aggatgctgtacttttct

SEQ ID NO: 6494 - DNA, 21 bp, Homo sapiens
aggatgctgaggtgattctag

SEQ ID NO: 6495 - DNA, 23 bp, Homo sapiens
aggagcctactttttttttctag

SEQ ID NO: 6496 - DNA, 61 bp, Human herpesvirus 5
catgcgcaacaggtccagcttaaaggcgcacttgtcattaaacaggctggacatgcgcgtg

SEQ ID NO: 6497 - DNA, 24 bp, Human herpesvirus 5
cattaaacaggctggacatgcgcg

SEQ ID NO: 6498 - DNA, 20 bp, Homo sapiens
catagaacaggctgggcaca

SEQ ID NO: 6499 - DNA, 18 bp, Homo sapiens
cattaaatagctggaacg

SEQ ID NO: 6500 - DNA, 22 bp, Homo sapiens
cattagccacagcgcatgcgcg

SEQ ID NO: 6501 - DNA, 22 bp, Homo sapiens
cattaacaggctggggaaaccg

SEQ ID NO: 6502 - DNA, 61 bp, Transmissible gastroenteritis virus
atttgacccccagaactatgtatcagcctagagttgcaactagttctgactttgttcaaat

SEQ ID NO: 6503 - DNA, 24 bp, Transmissible gastroenteritis virus
cagaactatgtatcagcctagagt

SEQ ID NO: 6504 - DNA, 21 bp, Homo sapiens
cagaactgggtatcccagagt

SEQ ID NO: 6505 - DNA, 25 bp, Homo sapiens
cagaacttgccatgcagcttggagt

SEQ ID NO: 6506 - DNA, 22 bp, Homo sapiens
cagaagtgtggaagcctggagt

SEQ ID NO: 6507 - DNA, 22 bp, Homo sapiens
cagaatcatgaatccctagagt

SEQ ID NO: 6508 - DNA, 25 bp, Homo sapiens
caagactatgtttagtctttagagt

SEQ ID NO: 6509 - DNA, 22 bp, Homo sapiens
caggacggtggcctcctagagt

SEQ ID NO: 6510 - DNA, 17 bp, Homo sapiens
caggctatgtatcacct

SEQ ID NO: 6511 - DNA, 18 bp, Homo sapiens
cagactggaagcctagag

SEQ ID NO: 6512 - DNA, 17 bp, Homo sapiens
gaactcatggcctagag

SEQ ID NO: 6513 - DNA, 17 bp, Homo sapiens
cagaacttcagtttagg

SEQ ID NO: 6514 - DNA, 18 bp, Homo sapiens
caggactatatattgagc

SEQ ID NO: 6515 - DNA, 77 bp, Chimpanzee cytomegalovirus
gaaaacgatataaatttttacccgtacctttggatgtatatagatagatctagttttgtgtagaacaatgtgttttt

SEQ ID NO: 6516 - DNA, 24 bp, Chimpanzee cytomegalovirus
tacccgtacctttggatgtatata

SEQ ID NO: 6517 - DNA, 16 bp, Homo sapiens
gtaaccagatgtatat

SEQ ID NO: 6518 - DNA, 19 bp, Homo sapiens
ccatacatagatgtgtata

SEQ ID NO: 6519 - DNA, 19 bp, Homo sapiens
cccatcttgggtgtatata

SEQ ID NO: 6520 - DNA, 18 bp, Homo sapiens
gtagctaggatgtatata

SEQ ID NO: 6521 - DNA, 20 bp, Homo sapiens
cctgtgtctctggatccaca

SEQ ID NO: 6522 - DNA, 22 bp, Homo sapiens
tacttgtatgtttagatatata

SEQ ID NO: 6523 - DNA, 20 bp, Homo sapiens
cccagtatatagtgtatata

SEQ ID NO: 6524 - DNA, 15 bp, Homo sapiens
gtaccagtgtatata

SEQ ID NO: 6525 - DNA, 22 bp, Homo sapiens
gtacctttaggtcattcatata

SEQ ID NO: 6526 - DNA, 17 bp, Homo sapiens
taccctagatgtatata

SEQ ID NO: 6527 - DNA, 19 bp, Homo sapiens
gtatttctacatgtatata

SEQ ID NO: 6528 - DNA, 22 bp, Homo sapiens
tacctatatagagatgtatata

SEQ ID NO: 6529 - DNA, 67 bp, Transmissible gastroenteritis virus
ctgtagaacttgccattctcattgacaacattaacaatacattagtcaatcttgaatggctcaatag

SEQ ID NO: 6530 - DNA, 24 bp, Transmissible gastroenteritis virus
tagaacttgccattctcattgaca

SEQ ID NO: 6531 - DNA, 21 bp, Homo sapiens
gaaccccgcttttcattgaca

SEQ ID NO: 6532 - DNA, 24 bp, Homo sapiens
tagaactcaaggttttcattgaca

SEQ ID NO: 6533 - DNA, 21 bp, Homo sapiens
taaattatgctctcattgaca

SEQ ID NO: 6534 - DNA, 17 bp, Homo sapiens
ctgctgttctcactgca

SEQ ID NO: 6535 - DNA, 18 bp, Homo sapiens
tagaactgctattctgac

SEQ ID NO: 6536 - DNA, 22 bp, Homo sapiens
cagaacttgtggtttattgaca

SEQ ID NO: 6537 - DNA, 19 bp, Homo sapiens
tagaatttaccattcatca

SEQ ID NO: 6538 - DNA, 21 bp, Homo sapiens
tagaacttaccatttttcctg

SEQ ID NO: 6539 - DNA, 17 bp, Homo sapiens
gaactatattcattgac

SEQ ID NO: 6540 - DNA, 24 bp, Homo sapiens
cagaacttgcggaccttgttgaca

SEQ ID NO: 6541 - DNA, 21 bp, Homo sapiens
tagagtttgccattcattctg

SEQ ID NO: 6542 - DNA, 84 bp, Tupaia herpesvirus
gatcgtctgcccgcggccgctcacgttcacgccgtggaggatctggaagaattcgagcgtcagcggcgtggggaacagcacgtc

SEQ ID NO: 6543 - DNA, 24 bp, Tupaia herpesvirus
ttcgagcgtcagcggcgtggggaa

SEQ ID NO: 6544 - DNA, 21 bp, Homo sapiens
gagtagcaatggtgtggggaa

SEQ ID NO: 6545 - DNA, 24 bp, Homo sapiens
tctgggcgttagcggcgtttggga

SEQ ID NO: 6546 - DNA, 20 bp, Homo sapiens
ccaggcggcggtgtggggaa

SEQ ID NO: 6547 - DNA, 20 bp, Homo sapiens
ctcggggcgcggcgtgggga

SEQ ID NO: 6548 - DNA, 20 bp, Homo sapiens
ttcgggcgtggggggtgggg

SEQ ID NO: 6549 - DNA, 129 bp, Chimpanzee cytomegalovirus
gctgcgtggagagacggcggggaatgatcgtctccgatgcgggttgtggtttcccgagccggatcagagccctcacggatgcggttcggggacccgcggggagcgatctccgctgtcgtctcccgcggc

SEQ ID NO: 6550 - DNA, 24 bp, Chimpanzee cytomegalovirus
atgcggttcggggacccgcgggga

SEQ ID NO: 6551 - DNA, 19 bp, Homo sapiens
agctgcggggtccgcgggg

SEQ ID NO: 6552 - DNA, 18 bp, Homo sapiens
atgcagtttgggatgggg

SEQ ID NO: 6553 - DNA, 22 bp, Homo sapiens
cgcggtcccgggcctgcgggga

SEQ ID NO: 6554 - DNA, 20 bp, Homo sapiens
gtccggggaggcccgcgggg

SEQ ID NO: 6555 - DNA, 19 bp, Homo sapiens
gtccgggaggctcgcgggg

SEQ ID NO: 6556 - DNA, 21 bp, Homo sapiens
gcgggcgacgacccgcgggga

SEQ ID NO: 6557 - DNA, 20 bp, Homo sapiens
gcagctgggggtccgcgggg

SEQ ID NO: 6558 - DNA, 17 bp, Homo sapiens
ggttcgggggtcaggga

SEQ ID NO: 6559 - DNA, 18 bp, Homo sapiens
gcggcccggctcgcgggg

SEQ ID NO: 6560 - DNA, 17 bp, Homo sapiens
ggccacggcccgtgggg

SEQ ID NO: 6561 - DNA, 16 bp, Homo sapiens
atgcggctcccgtggg

SEQ ID NO: 6562 - DNA, 19 bp, Homo sapiens
cgcggcggatccgcgggga

SEQ ID NO: 6563 - DNA, 18 bp, Homo sapiens
tggggtccgcccgcgggg

SEQ ID NO: 6564 - DNA, 75 bp, Chimpanzee cytomegalovirus
ctcttaagaacacaaaagacatgatcgcacagtgtagaaacacgcaccgtgtatgtcaaccccaagcaaaaagag

SEQ ID NO: 6565 - DNA, 24 bp, Chimpanzee cytomegalovirus
tatgtcaaccccaagcaaaaagag

SEQ ID NO: 6566 - DNA, 18 bp, Homo sapiens
catgtcagacgcaaaaag

SEQ ID NO: 6567 - DNA, 19 bp, Homo sapiens
tatgtcaaccttagtcaga

SEQ ID NO: 6568 - DNA, 15 bp, Homo sapiens
tcaaccagaaaaaga

SEQ ID NO: 6569 - DNA, 19 bp, Homo sapiens
tatgtggccatcaaaaaga

SEQ ID NO: 6570 - DNA, 23 bp, Homo sapiens
tatgtcaacctgtaaggataaag

SEQ ID NO: 6571 - DNA, 21 bp, Homo sapiens
gctgactccaagcaaagggag

SEQ ID NO: 6572 - DNA, 22 bp, Homo sapiens
tatgtcaaagccaaggtaaaag

SEQ ID NO: 6573 - DNA, 17 bp, Homo sapiens
aacaaaagcaaaaagag

SEQ ID NO: 6574 - DNA, 22 bp, Homo sapiens
tgtttgaccccaagaaacccag

SEQ ID NO: 6575 - DNA, 17 bp, Homo sapiens
atgtcaaccccacaaga

SEQ ID NO: 6576 - DNA, 20 bp, Homo sapiens
tgttgtccccaagcatggag

SEQ ID NO: 6577 - DNA, 24 bp, Homo sapiens
tatttcaaccccaagcaatcagag

SEQ ID NO: 6578 - DNA, 75 bp, Transmissible gastroenteritis virus
gtaaaatggccttggtatgtgtggctactaataggcttagtagtaatattttgcataccattactgctattttgc

SEQ ID NO: 6579 - DNA, 24 bp, Transmissible gastroenteritis virus
tggtatgtgtggctactaataggc

SEQ ID NO: 6580 - DNA, 21 bp, Homo sapiens
tggtatgtatgtagggatagg

SEQ ID NO: 6581 - DNA, 23 bp, Homo sapiens
tggaatgtgtggtgcacataggc

SEQ ID NO: 6582 - DNA, 22 bp, Homo sapiens
tggaatgtgtggagctggtggg

SEQ ID NO: 6583 - DNA, 23 bp, Homo sapiens
tgggtgtgtggctgcaggaaggc

SEQ ID NO: 6584 - DNA, 24 bp, Homo sapiens
tggtatgtgtggtcaccagagggc

SEQ ID NO: 6585 - DNA, 21 bp, Homo sapiens
tggatgtgtgaggtagtaggc

SEQ ID NO: 6586 - DNA, 22 bp, Homo sapiens
tggtgtgtggcacacagtaggc

SEQ ID NO: 6587 - DNA, 17 bp, Homo sapiens
tgtgttttactaatagg

SEQ ID NO: 6588 - DNA, 62 bp, Transmissible gastroenteritis virus
attctatcatctgctataatagcagttgtttctgctagagaattttgttaaggatgatgaat

SEQ ID NO: 6589 - DNA, 24 bp, Transmissible gastroenteritis virus
tctatcatctgctataatagcagt

SEQ ID NO: 6590 - DNA, 19 bp, Homo sapiens
tatcatctggctaccatag

SEQ ID NO: 6591 - DNA, 20 bp, Homo sapiens
tctaccatctgctgatatag

SEQ ID NO: 6592 - DNA, 21 bp, Homo sapiens
ctattatctgttaataacagt

SEQ ID NO: 6593 - DNA, 19 bp, Homo sapiens
tctgttatctgccatctag

SEQ ID NO: 6594 - DNA, 21 bp, Homo sapiens
tctgtcatccgctgtgacagt

SEQ ID NO: 6595 - DNA, 18 bp, Homo sapiens
tctatcatctgccagcag

SEQ ID NO: 6596 - DNA, 20 bp, Homo sapiens
tctgtgatttgctataatag

SEQ ID NO: 6597 - DNA, 18 bp, Homo sapiens
tctctcatctgctcagcg

SEQ ID NO: 6598 - DNA, 18 bp, Homo sapiens
atcttacatgatagcagt

SEQ ID NO: 6599 - DNA, 19 bp, Homo sapiens
tctgccatctgctctgcag

SEQ ID NO: 6600 - DNA, 88 bp, Rana tigrina ranavirus
tagacaatggactgtctttgtcttgaaaaagtatcttacgatagtagtaaagatatcttaagatatttctttagtctataactgtttg

SEQ ID NO: 6601 - DNA, 24 bp, Rana tigrina ranavirus
tatcttaagatatttctttagtct

SEQ ID NO: 6602 - DNA, 20 bp, Homo sapiens
tcttatattttttctttagt

SEQ ID NO: 6603 - DNA, 20 bp, Homo sapiens
tctgtagaatattctttagt

SEQ ID NO: 6604 - DNA, 18 bp, Homo sapiens
atcttaagattcttggtc

SEQ ID NO: 6605 - DNA, 19 bp, Homo sapiens
tcttagttttttctttagt

SEQ ID NO: 6606 - DNA, 18 bp, Homo sapiens
taccttaattctttagtc

SEQ ID NO: 6607 - DNA, 17 bp, Homo sapiens
cttaaaacatctttagt

SEQ ID NO: 6608 - DNA, 17 bp, Homo sapiens
cttaagatgttttagtc

SEQ ID NO: 6609 - DNA, 18 bp, Homo sapiens
tcttagaaaatctttagt

SEQ ID NO: 6610 - DNA, 18 bp, Homo sapiens
tcttaaaattctttggtc

SEQ ID NO: 6611 - DNA, 63 bp, Rana tigrina ranavirus
gctaaaagagggttacgtgcccgggacggtgtcccacaaccacatgatgccctactttttagc

SEQ ID NO: 6612 - DNA, 24 bp, Rana tigrina ranavirus
aagagggttacgtgcccgggacgg

SEQ ID NO: 6613 - DNA, 24 bp, Homo sapiens
aggggtggtatgtgcccgggatgg

SEQ ID NO: 6614 - DNA, 22 bp, Homo sapiens
agagggctgcaaaaggggacgg

SEQ ID NO: 6615 - DNA, 18 bp, Homo sapiens
agggtgtgcccgggatgg

SEQ ID NO: 6616 - DNA, 21 bp, Homo sapiens
gaggggcagggcttggggcgg

SEQ ID NO: 6617 - DNA, 19 bp, Homo sapiens
gagggtgggtgtggggcgg

SEQ ID NO: 6618 - DNA, 23 bp, Homo sapiens
gagggcgcgcgggctcgggacgg

SEQ ID NO: 6619 - DNA, 18 bp, Homo sapiens
gggcggtgcccggggcgg

SEQ ID NO: 6620 - DNA, 18 bp, Homo sapiens
agagggttggtgggaacg

SEQ ID NO: 6621 - DNA, 22 bp, Homo sapiens
aagaaggttatgtgttgactgg

SEQ ID NO: 6622 - DNA, 23 bp, Homo sapiens
agaggggctgaggcccgggacgg

SEQ ID NO: 6623 - DNA, 22 bp, Homo sapiens
agagggtttacacttggggtgg

SEQ ID NO: 6624 - DNA, 16 bp, Homo sapiens
gagaggttacgtgagg

SEQ ID NO: 6625 - DNA, 18 bp, Homo sapiens
aacagggtgcctgggacg

SEQ ID NO: 6626 - DNA, 24 bp, Homo sapiens
agagggtcgcgtgggctgggatgg

SEQ ID NO: 6627 - DNA, 16 bp, Homo sapiens
gagggggtcaggacgg

SEQ ID NO: 6628 - DNA, 18 bp, Homo sapiens
agagggttgtgtagcgag

SEQ ID NO: 6629 - DNA, 18 bp, Homo sapiens
aggggcgtgctcggggcg

SEQ ID NO: 6630 - DNA, 67 bp, Rana tigrina ranavirus
ccgcgggactcagggggagccggggcaggggcatgatgagtccttggggccccaggggtcccgacgg

SEQ ID NO: 6631 - DNA, 19 bp, Rana tigrina ranavirus
gccccaggggtcccgacgg

SEQ ID NO: 6632 - DNA, 19 bp, Homo sapiens
ccctcaggggcaaggacgg

SEQ ID NO: 6633 - DNA, 17 bp, Homo sapiens
gcctccactcccgacgg

SEQ ID NO: 6634 - DNA, 17 bp, Homo sapiens
gccccaggtgggagcgg

SEQ ID NO: 6635 - DNA, 16 bp, Homo sapiens
gcccggcgcccgacgg

SEQ ID NO: 6636 - DNA, 19 bp, Homo sapiens
gccctgtggggtcacccgg

SEQ ID NO: 6637 - DNA, 18 bp, Homo sapiens
gccccagagagtcgatgg

SEQ ID NO: 6638 - DNA, 16 bp, Homo sapiens
gccccaaggtcgacgg

SEQ ID NO: 6639 - DNA, 20 bp, Homo sapiens
gccccgggcccagatgacgg

SEQ ID NO: 6640 - DNA, 19 bp, Homo sapiens
gccccgcaggtcccggtgg

SEQ ID NO: 6641 - DNA, 21 bp, Homo sapiens
gccccgagggggccacgacgg

SEQ ID NO: 6642 - DNA, 16 bp, Homo sapiens
gccccggagccgacgg

SEQ ID NO: 6643 - DNA, 17 bp, Homo sapiens
gccccgagccccggcgg

SEQ ID NO: 6644 - DNA, 16 bp, Homo sapiens
gccccagggttcacag

SEQ ID NO: 6645 - DNA, 19 bp, Homo sapiens
gccccagcgggagccgcgg

SEQ ID NO: 6646 - DNA, 19 bp, Homo sapiens
accccggccctcccggcgg

SEQ ID NO: 6647 - DNA, 17 bp, Homo sapiens
gctcaggggtcccaagg

SEQ ID NO: 6648 - DNA, 17 bp, Homo sapiens
gccatggagcccgacgg

SEQ ID NO: 6649 - DNA, 19 bp, Homo sapiens
gcccctgggtcaccggcgg

SEQ ID NO: 6650 - DNA, 18 bp, Homo sapiens
gccccgggcgggcaacgg

SEQ ID NO: 6651 - DNA, 19 bp, Homo sapiens
gccccaaggggctgcacgg

SEQ ID NO: 6652 - DNA, 20 bp, Homo sapiens
gctccagaagcgtccggtgg

SEQ ID NO: 6653 - DNA, 19 bp, Homo sapiens
gccccaggctgcccggtgg

SEQ ID NO: 6654 - DNA, 18 bp, Homo sapiens
gccccagagaccggacgg

SEQ ID NO: 6655 - DNA, 17 bp, Homo sapiens
gcccccggggctcgcgg

SEQ ID NO: 6656 - DNA, 22 bp, Homo sapiens
ccagaggcttccacctgatggc

SEQ ID NO: 6657 - DNA, 16 bp, Homo sapiens
gccgcaggggtcacgg

SEQ ID NO: 6658 - DNA, 18 bp, Homo sapiens
gccccaggcggcagatgg

SEQ ID NO: 6659 - DNA, 17 bp, Homo sapiens
gcctaggggtcctgagg

SEQ ID NO: 6660 - DNA, 23 bp, Homo sapiens
gccccagggggtcaggccgtcgg

SEQ ID NO: 6661 - DNA, 17 bp, Homo sapiens
gccccgggggcccgagg

SEQ ID NO: 6662 - DNA, 16 bp, Homo sapiens
ccccaggggtgcaagg

SEQ ID NO: 6663 - DNA, 16 bp, Homo sapiens
gcccgaatcccggcgg

SEQ ID NO: 6664 - DNA, 19 bp, Homo sapiens
gctccaggagtcgggatgg

SEQ ID NO: 6665 - DNA, 18 bp, Homo sapiens
gcccccgggggccgagcg

SEQ ID NO: 6666 - DNA, 20 bp, Homo sapiens
gccccaagggtcaggccgtg

SEQ ID NO: 6667 - DNA, 19 bp, Homo sapiens
accccagggccgggagcgg

SEQ ID NO: 6668 - DNA, 18 bp, Homo sapiens
cccggaggaacccgacgg

SEQ ID NO: 6669 - DNA, 19 bp, Homo sapiens
gccccggcggccgggatgg

SEQ ID NO: 6670 - DNA, 20 bp, Homo sapiens
gcccccggggtccccggcgg

SEQ ID NO: 6671 - DNA, 23 bp, Homo sapiens
gccccagggcgtcaggccgtcgg

SEQ ID NO: 6672 - DNA, 18 bp, Homo sapiens
gctccaggagctgcacgg

SEQ ID NO: 6673 - DNA, 18 bp, Homo sapiens
gccccaggagcccggcgg

SEQ ID NO: 6674 - DNA, 19 bp, Homo sapiens
ccccaggatgtggcgatgg

SEQ ID NO: 6675 - DNA, 19 bp, Homo sapiens
gccccgaggccccggccgg

SEQ ID NO: 6676 - DNA, 16 bp, Homo sapiens
gcctcagggatcacag

SEQ ID NO: 6677 - DNA, 16 bp, Homo sapiens
gctccagaggccgcgg

SEQ ID NO: 6678 - DNA, 18 bp, Homo sapiens
gcttcaagagtccgacgg

SEQ ID NO: 6679 - DNA, 22 bp, Homo sapiens
gccctaggagaaacctcggcgg

SEQ ID NO: 6680 - DNA, 16 bp, Homo sapiens
gctccgagccccgcgg

SEQ ID NO: 6681 - DNA, 17 bp, Homo sapiens
gccccgggcctcggcgg

SEQ ID NO: 6682 - DNA, 17 bp, Homo sapiens
gcccgggatcccggcgg

SEQ ID NO: 6683 - DNA, 19 bp, Homo sapiens
gccccgcggagctcggcgg

SEQ ID NO: 6684 - DNA, 19 bp, Homo sapiens
gccccgggggcgcgcgcgg

SEQ ID NO: 6685 - DNA, 17 bp, Homo sapiens
gcccccgggccgagcgg

SEQ ID NO: 6686 - DNA, 20 bp, Homo sapiens
gcctcaagggcccgcggcgg

SEQ ID NO: 6687 - DNA, 19 bp, Homo sapiens
gccccagaggccgcggcgg

SEQ ID NO: 6688 - DNA, 18 bp, Homo sapiens
gccccatgggtcagatgg

SEQ ID NO: 6689 - DNA, 19 bp, Homo sapiens
cctcctggggtcccggtgg

SEQ ID NO: 6690 - DNA, 18 bp, Homo sapiens
cctccaaagtcccgacgg

SEQ ID NO: 6691 - DNA, 17 bp, Homo sapiens
gcctcagaggtgagcag

SEQ ID NO: 6692 - DNA, 23 bp, Homo sapiens
gcctgggggggggtgcccggcgg

SEQ ID NO: 6693 - DNA, 21 bp, Homo sapiens
gccccagcacagccccgatgg

SEQ ID NO: 6694 - DNA, 16 bp, Homo sapiens
gccgccggggccgcgg

SEQ ID NO: 6695 - DNA, 19 bp, Homo sapiens
gccccgggcggcctgacgg

SEQ ID NO: 6696 - DNA, 19 bp, Homo sapiens
gctccggggatcccaccag

SEQ ID NO: 6697 - DNA, 17 bp, Homo sapiens
gccccaggggacaaagg

SEQ ID NO: 6698 - DNA, 22 bp, Homo sapiens
gctccaggagtgctgcagacgg

SEQ ID NO: 6699 - DNA, 18 bp, Homo sapiens
gccccagaggaaaactgg

SEQ ID NO: 6700 - DNA, 19 bp, Homo sapiens
gcccgtcgggtcccgatgg

SEQ ID NO: 6701 - DNA, 20 bp, Homo sapiens
actccaggggcgaaccgcgg

SEQ ID NO: 6702 - DNA, 18 bp, Homo sapiens
gccccaggcgcagcgcgg

SEQ ID NO: 6703 - DNA, 18 bp, Homo sapiens
gctcccggggtcccgcgg

SEQ ID NO: 6704 - DNA, 19 bp, Homo sapiens
gcccctgaagcctcggcgg

SEQ ID NO: 6705 - DNA, 15 bp, Homo sapiens
ccccagggcccacgg

SEQ ID NO: 6706 - DNA, 16 bp, Homo sapiens
gccccgaggtgcgcgg

SEQ ID NO: 6707 - DNA, 19 bp, Homo sapiens
gccccgggagtcgggatgg

SEQ ID NO: 6708 - DNA, 19 bp, Homo sapiens
cctcaaggggtcccggtgg

SEQ ID NO: 6709 - DNA, 15 bp, Homo sapiens
gccccagggacgcgg

SEQ ID NO: 6710 - DNA, 18 bp, Homo sapiens
actccaggggctgcaagg

SEQ ID NO: 6711 - DNA, 17 bp, Homo sapiens
gccccaggccccggcgg

SEQ ID NO: 6712 - DNA, 16 bp, Homo sapiens
gccccgggaccggcgg

SEQ ID NO: 6713 - DNA, 16 bp, Homo sapiens
gccccagggtcccacg

SEQ ID NO: 6714 - DNA, 18 bp, Homo sapiens
gcacccgggtcccggcgg

SEQ ID NO: 6715 - DNA, 18 bp, Homo sapiens
acctggaagccccggcgg

SEQ ID NO: 6716 - DNA, 18 bp, Homo sapiens
gccccaaaacgccgatgg

SEQ ID NO: 6717 - DNA, 19 bp, Homo sapiens
accccagggcttctgatgg

SEQ ID NO: 6718 - DNA, 24 bp, Homo sapiens
gcctcaggggccatcagccgtcgg

SEQ ID NO: 6719 - DNA, 20 bp, Homo sapiens
gccccagctcatcctgatgg

SEQ ID NO: 6720 - DNA, 19 bp, Homo sapiens
gccccagagggcaggacgg

SEQ ID NO: 6721 - DNA, 18 bp, Homo sapiens
gccccagggctcagatgg

SEQ ID NO: 6722 - DNA, 17 bp, Homo sapiens
gctcatgaagtccccgg

SEQ ID NO: 6723 - DNA, 22 bp, Homo sapiens
ccccaggggtcaaggccgtcgg

SEQ ID NO: 6724 - DNA, 16 bp, Homo sapiens
accccaggggacgcgg

SEQ ID NO: 6725 - DNA, 19 bp, Homo sapiens
ccctcaaagatcttgatgg

SEQ ID NO: 6726 - DNA, 15 bp, Homo sapiens
gccagggccccgcgg

SEQ ID NO: 6727 - DNA, 18 bp, Homo sapiens
gccccggggacgaggcgg

SEQ ID NO: 6728 - DNA, 17 bp, Homo sapiens
gccccggcccgaggcgg

SEQ ID NO: 6729 - DNA, 17 bp, Homo sapiens
gccccacgggtggacgg

SEQ ID NO: 6730 - DNA, 20 bp, Homo sapiens
gccccaggagtcaggccgtg

SEQ ID NO: 6731 - DNA, 22 bp, Homo sapiens
gccccgggggtcaagccgtcgg

SEQ ID NO: 6732 - DNA, 22 bp, Homo sapiens
gccccagggaggagtgcgatgg

SEQ ID NO: 6733 - DNA, 19 bp, Homo sapiens
accccaggggtcagccgtg

SEQ ID NO: 6734 - DNA, 20 bp, Homo sapiens
gccccagggatcaggccgtg

SEQ ID NO: 6735 - DNA, 18 bp, Homo sapiens
gccgcaggggtcctccgg

SEQ ID NO: 6736 - DNA, 16 bp, Homo sapiens
gccccgagcccggcgg

SEQ ID NO: 6737 - DNA, 19 bp, Homo sapiens
gccccaggtgggggactgg

SEQ ID NO: 6738 - DNA, 18 bp, Homo sapiens
gccccagcgggtgcacgg

SEQ ID NO: 6739 - DNA, 17 bp, Homo sapiens
ccccggctgcccgacgg

SEQ ID NO: 6740 - DNA, 19 bp, Homo sapiens
gcctcagccgccccgacgg

SEQ ID NO: 6741 - DNA, 21 bp, Homo sapiens
gccctggagaggcagcgacgg

SEQ ID NO: 6742 - DNA, 23 bp, Homo sapiens
gccccagggcttcaggccgtcgg

SEQ ID NO: 6743 - DNA, 18 bp, Homo sapiens
ccccaggctccccgacgg

SEQ ID NO: 6744 - DNA, 17 bp, Homo sapiens
gccccaggcgcgaacgg

SEQ ID NO: 6745 - DNA, 22 bp, Homo sapiens
accccggggccatggccgtcgg

SEQ ID NO: 6746 - DNA, 17 bp, Homo sapiens
gctccgggggccccacg

SEQ ID NO: 6747 - DNA, 16 bp, Homo sapiens
gcctcaggtcccacgg

SEQ ID NO: 6748 - DNA, 16 bp, Homo sapiens
gccggggtcccggcgg

SEQ ID NO: 6749 - DNA, 18 bp, Homo sapiens
gcccccgggccccgacgg

SEQ ID NO: 6750 - DNA, 16 bp, Homo sapiens
gccccaggagggacgg

SEQ ID NO: 6751 - DNA, 17 bp, Homo sapiens
gccccagggatccgcgg

SEQ ID NO: 6752 - DNA, 21 bp, Homo sapiens
gccccggcggtcgcagggcgg

SEQ ID NO: 6753 - DNA, 17 bp, Homo sapiens
gcctcaggggcccgcgg

SEQ ID NO: 6754 - DNA, 18 bp, Homo sapiens
gccctagggacccggtgg

SEQ ID NO: 6755 - DNA, 17 bp, Homo sapiens
accccagaggccggcgg

SEQ ID NO: 6756 - DNA, 20 bp, Homo sapiens
gcccccggcaggcgcggcgg

SEQ ID NO: 6757 - DNA, 19 bp, Homo sapiens
accccggggtaagcggcgg

SEQ ID NO: 6758 - DNA, 16 bp, Homo sapiens
gcccctggggtgacag

SEQ ID NO: 6759 - DNA, 24 bp, Homo sapiens
cccaggggagcacttcctgatggc

SEQ ID NO: 6760 - DNA, 19 bp, Homo sapiens
cctccaggggccaagatgg

SEQ ID NO: 6761 - DNA, 15 bp, Homo sapiens
gccccagggggacag

SEQ ID NO: 6762 - DNA, 21 bp, Homo sapiens
gctctggggtcccagtgacgg

SEQ ID NO: 6763 - DNA, 19 bp, Homo sapiens
gccccgggggtgcgcgcgg

SEQ ID NO: 6764 - DNA, 16 bp, Homo sapiens
gcccaaggggccgcgg

SEQ ID NO: 6765 - DNA, 16 bp, Homo sapiens
gccccaggcgagacgg

SEQ ID NO: 6766 - DNA, 19 bp, Homo sapiens
gccccaggaggcgacgcgg

SEQ ID NO: 6767 - DNA, 20 bp, Homo sapiens
gccccaggggccaagccgtg

SEQ ID NO: 6768 - DNA, 20 bp, Homo sapiens
cctccaacaaggttcggcgg

SEQ ID NO: 6769 - DNA, 16 bp, Homo sapiens
gccccagtggtcacag

SEQ ID NO: 6770 - DNA, 18 bp, Homo sapiens
gccccagggctccgccgg

SEQ ID NO: 6771 - DNA, 18 bp, Homo sapiens
gccccagggtcgagatgg

SEQ ID NO: 6772 - DNA, 20 bp, Homo sapiens
gccccgaggcctggaggcgg

SEQ ID NO: 6773 - DNA, 19 bp, Homo sapiens
gccccgggggcagccgcgg

SEQ ID NO: 6774 - DNA, 18 bp, Homo sapiens
gccccagggcgtccacag

SEQ ID NO: 6775 - DNA, 17 bp, Homo sapiens
gccccaggcgggcacgg

SEQ ID NO: 6776 - DNA, 19 bp, Homo sapiens
cctccaggggtttcctcgg

SEQ ID NO: 6777 - DNA, 19 bp, Homo sapiens
cccagcaggccctcggcgg

SEQ ID NO: 6778 - DNA, 16 bp, Homo sapiens
gccccaggggccgcgg

SEQ ID NO: 6779 - DNA, 17 bp, Homo sapiens
gctccagaagccgacgg

SEQ ID NO: 6780 - DNA, 18 bp, Homo sapiens
gctccaggggcccgaggg

SEQ ID NO: 6781 - DNA, 17 bp, Homo sapiens
accccaaggcccgatgg

SEQ ID NO: 6782 - DNA, 20 bp, Homo sapiens
accccaggggtgtcagacgg

SEQ ID NO: 6783 - DNA, 19 bp, Homo sapiens
gccccaaggggctggatgg

SEQ ID NO: 6784 - DNA, 18 bp, Homo sapiens
gccccaggggccctgcgg

SEQ ID NO: 6785 - DNA, 16 bp, Homo sapiens
gccccagaggtcgagg

SEQ ID NO: 6786 - DNA, 20 bp, Homo sapiens
ccccagggctctgtcgatgg

SEQ ID NO: 6787 - DNA, 21 bp, Homo sapiens
gcccaagggaggctctgatgg

SEQ ID NO: 6788 - DNA, 18 bp, Homo sapiens
gccccaggtggaggacgg

SEQ ID NO: 6789 - DNA, 19 bp, Homo sapiens
cccaggggaaacctgacgg

SEQ ID NO: 6790 - DNA, 18 bp, Homo sapiens
gccgctgggccccgacgg

SEQ ID NO: 6791 - DNA, 19 bp, Homo sapiens
gcccacagaggttcggtgg

SEQ ID NO: 6792 - DNA, 18 bp, Homo sapiens
gcccgggcagcctgacgg

SEQ ID NO: 6793 - DNA, 16 bp, Homo sapiens
accccagcggtgacgg

SEQ ID NO: 6794 - DNA, 19 bp, Homo sapiens
gccccaggggtcagccgtg

SEQ ID NO: 6795 - DNA, 18 bp, Homo sapiens
gccctgggggtcccccag

SEQ ID NO: 6796 - DNA, 17 bp, Homo sapiens
gccccagggggtcgagg

SEQ ID NO: 6797 - DNA, 23 bp, Homo sapiens
gccccagggtcagtggccgtcgg

SEQ ID NO: 6798 - DNA, 18 bp, Homo sapiens
cccaggggtaaaccacgg

SEQ ID NO: 6799 - DNA, 18 bp, Homo sapiens
ccccagggaccccggcgg

SEQ ID NO: 6800 - DNA, 18 bp, Homo sapiens
ccctcagaggcctgacgg

SEQ ID NO: 6801 - DNA, 21 bp, Homo sapiens
gccccagggaggttctgatgg

SEQ ID NO: 6802 - DNA, 19 bp, Homo sapiens
gccgcagatgccccgacgg

SEQ ID NO: 6803 - DNA, 21 bp, Homo sapiens
ccctcaggggcactgaggcgg

SEQ ID NO: 6804 - DNA, 19 bp, Homo sapiens
gccccaggtgcgccgatgg

SEQ ID NO: 6805 - DNA, 19 bp, Homo sapiens
gccccggcggcgcccgcgg

SEQ ID NO: 6806 - DNA, 17 bp, Homo sapiens
gcccgaggtcccgacgg

SEQ ID NO: 6807 - DNA, 17 bp, Homo sapiens
gccccaagcccaggcgg

SEQ ID NO: 6808 - DNA, 24 bp, Homo sapiens
gccccagcggtcaaaagccgtcgg

SEQ ID NO: 6809 - DNA, 15 bp, Homo sapiens
gcccgggatccccgg

SEQ ID NO: 6810 - DNA, 19 bp, Homo sapiens
gccccagggagtcttcacg

SEQ ID NO: 6811 - DNA, 23 bp, Homo sapiens
gccccatggggccgcactgacgg

SEQ ID NO: 6812 - DNA, 19 bp, Homo sapiens
gccccgggagccgcggcgg

SEQ ID NO: 6813 - DNA, 18 bp, Homo sapiens
cccctaaaaatccggcgg

SEQ ID NO: 6814 - DNA, 19 bp, Homo sapiens
gccccgagccgagagacgg

SEQ ID NO: 6815 - DNA, 18 bp, Homo sapiens
cccagagggttctcgcgg

SEQ ID NO: 6816 - DNA, 19 bp, Homo sapiens
gccccaagggccccgacgg

SEQ ID NO: 6817 - DNA, 20 bp, Homo sapiens
gccccagcggcgaccctcgg

SEQ ID NO: 6818 - DNA, 18 bp, Homo sapiens
gccacaggggcccggcgg

SEQ ID NO: 6819 - DNA, 23 bp, Homo sapiens
gccccagaggtcaaggccgtcgg

SEQ ID NO: 6820 - DNA, 21 bp, Homo sapiens
ccccagaacagatctcgatgg

SEQ ID NO: 6821 - DNA, 16 bp, Homo sapiens
gcccaggccccgacgg

SEQ ID NO: 6822 - DNA, 21 bp, Homo sapiens
gcccagggggctgcccggtgg

SEQ ID NO: 6823 - DNA, 19 bp, Homo sapiens
gccctcagccaggtgatgg

SEQ ID NO: 6824 - DNA, 19 bp, Homo sapiens
gcctgggcactcccgacgg

SEQ ID NO: 6825 - DNA, 21 bp, Homo sapiens
gccccaaggcggcagcggcgg

SEQ ID NO: 6826 - DNA, 19 bp, Homo sapiens
gccccaggagccggagcgg

SEQ ID NO: 6827 - DNA, 19 bp, Homo sapiens
cctccagaggccttgatgg

SEQ ID NO: 6828 - DNA, 63 bp, Bovine adenovirus D
gcatgggtctatctaccaaagaattaattaaaagttcccattctattgcaaaaaatcccatgc

SEQ ID NO: 6829 - DNA, 18 bp, Bovine adenovirus D
ttgcaaaaaatcccatgc

SEQ ID NO: 6830 - DNA, 19 bp, Homo sapiens
ttgcaaaacatccttatgc

SEQ ID NO: 6831 - DNA, 15 bp, Homo sapiens
ttacaaaacccatgc

SEQ ID NO: 6832 - DNA, 18 bp, Homo sapiens
ctgcaaaagctccccatg

SEQ ID NO: 6833 - DNA, 18 bp, Homo sapiens
acaattaaaatcccatgc

SEQ ID NO: 6834 - DNA, 19 bp, Homo sapiens
tgcaaaaaagccaccatgc

SEQ ID NO: 6835 - DNA, 24 bp, Homo sapiens
ctgcaaaagaacagagcccgtgcg

SEQ ID NO: 6836 - DNA, 18 bp, Homo sapiens
ttacccaaagtcccatgc

SEQ ID NO: 6837 - DNA, 15 bp, Homo sapiens
ttgcaaaaaccatgc

SEQ ID NO: 6838 - DNA, 17 bp, Homo sapiens
ttgcaaaagtctcacgc

SEQ ID NO: 6839 - DNA, 20 bp, Homo sapiens
tgcaaaaagctccttcatgc

SEQ ID NO: 6840 - DNA, 65 bp, Lumpy skin disease virus
gtatatacttagatgagtcatttaaaacttgtctattgagttttaattctttttccaacttatac

SEQ ID NO: 6841 - DNA, 22 bp, Lumpy skin disease virus
taattctttttccaacttatac

SEQ ID NO: 6842 - DNA, 20 bp, Homo sapiens
taactcttttacaaacttat

SEQ ID NO: 6843 - DNA, 19 bp, Homo sapiens
taattcccccaacttatac

SEQ ID NO: 6844 - DNA, 19 bp, Homo sapiens
ctctttccagatacttata

SEQ ID NO: 6845 - DNA, 18 bp, Homo sapiens
tcccccatccaatttata

SEQ ID NO: 6846 - DNA, 68 bp, Bovine adenovirus D
gttgcaacacaatatattgcatactgattagaatttaaatcagtaaagtaattaaccaattctgcagc

SEQ ID NO: 6847 - DNA, 24 bp, Bovine adenovirus D
tcagtaaagtaattaaccaattct

SEQ ID NO: 6848 - DNA, 22 bp, Homo sapiens
agtaaagtatctcaacaattct

SEQ ID NO: 6849 - DNA, 24 bp, Homo sapiens
tcactgaagtgaaacaccaattct

SEQ ID NO: 6850 - DNA, 22 bp, Homo sapiens
tcagatttttcattaaccaatt

SEQ ID NO: 6851 - DNA, 19 bp, Homo sapiens
cagtaaagcaatgtcaatt

SEQ ID NO: 6852 - DNA, 23 bp, Homo sapiens
tcagaaagtaattaaaatcaact

SEQ ID NO: 6853 - DNA, 17 bp, Homo sapiens
agtaaagataccaattc

SEQ ID NO: 6854 - DNA, 22 bp, Homo sapiens
tcattcaaataattagccaatt

SEQ ID NO: 6855 - DNA, 16 bp, Homo sapiens
gtaaagttaaccaatt

SEQ ID NO: 6856 - DNA, 24 bp, Homo sapiens
tcagtaaagaatctgcccaattct

SEQ ID NO: 6857 - DNA, 76 bp, Simian hemorrhagic fever virus
ctgtttctgattcagattccccttggctaaaagttgcatcaattaatagtggaggttgccctgtagtcacggacag

SEQ ID NO: 6858 - DNA, 24 bp, Simian hemorrhagic fever virus
ttaatagtggaggttgccctgtag

SEQ ID NO: 6859 - DNA, 21 bp, Homo sapiens
taagtggtttctgtcctgtag

SEQ ID NO: 6860 - DNA, 19 bp, Homo sapiens
ttaatggtagaagtcctgt

SEQ ID NO: 6861 - DNA, 18 bp, Homo sapiens
ggtggttcagccctgtag

SEQ ID NO: 6862 - DNA, 21 bp, Homo sapiens
cagaataaggttgctttgtag

SEQ ID NO: 6863 - DNA, 77 bp, Rana tigrina ranavirus
gtcctggaaacccatcctggtgggagcagttgtcgccgctagcggcggcgccgcctaccagtcttggtggcccaaac

SEQ ID NO: 6864 - DNA, 24 bp, Rana tigrina ranavirus
tggaaacccatcctggtgggagca

SEQ ID NO: 6865 - DNA, 21 bp, Homo sapiens
tggatgtgggctggtgggagc

SEQ ID NO: 6866 - DNA, 22 bp, Homo sapiens
cggaatttgagctggtgggggc

SEQ ID NO: 6867 - DNA, 19 bp, Homo sapiens
tggaaactcactccaggag

SEQ ID NO: 6868 - DNA, 21 bp, Homo sapiens
tgggaaccggtccccagcggg

SEQ ID NO: 6869 - DNA, 20 bp, Homo sapiens
gaaatcaaccatggtgggag

SEQ ID NO: 6870 - DNA, 22 bp, Homo sapiens
tggaaacctgtaccttacagca

SEQ ID NO: 6871 - DNA, 18 bp, Homo sapiens
tggaaactggtcctgcgg

SEQ ID NO: 6872 - DNA, 19 bp, Homo sapiens
tgggtccaccctgggagca

SEQ ID NO: 6873 - DNA, 20 bp, Homo sapiens
gaaatccatcccaccgagca

SEQ ID NO: 6874 - DNA, 21 bp, Homo sapiens
ggaacctgttctagaagagca

SEQ ID NO: 6875 - DNA, 19 bp, Homo sapiens
tgggtgcccatccaggagc

SEQ ID NO: 6876 - DNA, 18 bp, Homo sapiens
tggaaacttacctgggac

SEQ ID NO: 6877 - DNA, 23 bp, Homo sapiens
tgggacccacggctctgggagca

SEQ ID NO: 6878 - DNA, 20 bp, Homo sapiens
ggaaacctggggtgggggca

SEQ ID NO: 6879 - DNA, 21 bp, Homo sapiens
tgggggcccatcctgtggggc

SEQ ID NO: 6880 - DNA, 22 bp, Homo sapiens
tggaaacccgaccaacccgggg

SEQ ID NO: 6881 - DNA, 20 bp, Homo sapiens
tgaaaactcgtcctggggag

SEQ ID NO: 6882 - DNA, 23 bp, Homo sapiens
tgggggtccaccctgcccggagc

SEQ ID NO: 6883 - DNA, 17 bp, Homo sapiens
ggagccgtccggcgagc

SEQ ID NO: 6884 - DNA, 18 bp, Homo sapiens
tggaaacccatcttgatg

SEQ ID NO: 6885 - DNA, 21 bp, Homo sapiens
cggggcccatcccagggagca

SEQ ID NO: 6886 - DNA, 18 bp, Homo sapiens
tgggacctcatcctggtg

SEQ ID NO: 6887 - DNA, 22 bp, Homo sapiens
tggagggccatcctgtgcacgg

SEQ ID NO: 6888 - DNA, 21 bp, Homo sapiens
tggaaaaccattcttaaagca

SEQ ID NO: 6889 - DNA, 22 bp, Homo sapiens
tggaagcccagtacagtgggag

SEQ ID NO: 6890 - DNA, 21 bp, Homo sapiens
tggaagcccatcctacaatag

SEQ ID NO: 6891 - DNA, 20 bp, Homo sapiens
tggagaccctctggtaggag

SEQ ID NO: 6892 - DNA, 20 bp, Homo sapiens
gaaatccattttcctgggtg

SEQ ID NO: 6893 - DNA, 19 bp, Homo sapiens
gggggcctccgagtgggag

SEQ ID NO: 6894 - DNA, 23 bp, Homo sapiens
tggagccccatccctgcagggca

SEQ ID NO: 6895 - DNA, 18 bp, Homo sapiens
ggactccatcctgctggg

SEQ ID NO: 6896 - DNA, 24 bp, Homo sapiens
tggaaacatgtctcttaaagggca

SEQ ID NO: 6897 - DNA, 19 bp, Homo sapiens
tggaagtcatcctagaaag

SEQ ID NO: 6898 - DNA, 21 bp, Homo sapiens
tggggacccactatgggagca

SEQ ID NO: 6899 - DNA, 21 bp, Homo sapiens
tggaaaccttgtccttgtaag

SEQ ID NO: 6900 - DNA, 21 bp, Homo sapiens
tggaaatttatcccagaagag

SEQ ID NO: 6901 - DNA, 18 bp, Homo sapiens
ggaaacccattctgtgca

SEQ ID NO: 6902 - DNA, 20 bp, Homo sapiens
tggaaacattgtcctgagtg

SEQ ID NO: 6903 - DNA, 22 bp, Homo sapiens
tggtggctcacgaggtgggagc

SEQ ID NO: 6904 - DNA, 22 bp, Homo sapiens
tggaggtcctgtcctgtccggg

SEQ ID NO: 6905 - DNA, 16 bp, Homo sapiens
gaaacactggtgggag

SEQ ID NO: 6906 - DNA, 18 bp, Homo sapiens
tggagccctatcctagtg

SEQ ID NO: 6907 - DNA, 21 bp, Homo sapiens
tggaagcacatctcctttggg

SEQ ID NO: 6908 - DNA, 18 bp, Homo sapiens
tgggaacctgctgatggg

SEQ ID NO: 6909 - DNA, 21 bp, Homo sapiens
tggagaccatcctgaccagca

SEQ ID NO: 6910 - DNA, 21 bp, Homo sapiens
tggaagtcatcttcttgtggg

SEQ ID NO: 6911 - DNA, 21 bp, Homo sapiens
tggaagcctgcggttaaggag

SEQ ID NO: 6912 - DNA, 17 bp, Homo sapiens
tggagactatcctggcg

SEQ ID NO: 6913 - DNA, 20 bp, Homo sapiens
tggagaccatcctggctaac

SEQ ID NO: 6914 - DNA, 21 bp, Homo sapiens
tggagacccatccgctgagca

SEQ ID NO: 6915 - DNA, 23 bp, Homo sapiens
tggggcccatcctgtcacaggca

SEQ ID NO: 6916 - DNA, 19 bp, Homo sapiens
tggaaacctatcacacggg

SEQ ID NO: 6917 - DNA, 65 bp, Rana tigrina ranavirus
gtggtgggagtgaggatgtttatgtcgtctggaaactctagtgcgacttcgtccttttccaccgc

SEQ ID NO: 6918 - DNA, 18 bp, Rana tigrina ranavirus
ttcgtccttttccaccgc

SEQ ID NO: 6919 - DNA, 16 bp, Homo sapiens
ttcctcctttccccgc

SEQ ID NO: 6920 - DNA, 17 bp, Homo sapiens
ttcgttccctccaccgc

SEQ ID NO: 6921 - DNA, 17 bp, Homo sapiens
ttctccttccaggccgc

SEQ ID NO: 6922 - DNA, 19 bp, Homo sapiens
tccttcccactcccaccgc

SEQ ID NO: 6923 - DNA, 17 bp, Homo sapiens
ctcgtcctctccgccgc

SEQ ID NO: 6924 - DNA, 20 bp, Homo sapiens
tccgtcctctcgttcgccgc

SEQ ID NO: 6925 - DNA, 16 bp, Homo sapiens
ttcgtctctcccccgc

SEQ ID NO: 6926 - DNA, 16 bp, Homo sapiens
tccgtccttctgccgc

SEQ ID NO: 6927 - DNA, 18 bp, Homo sapiens
ctcgtcctcgcccgccgc

SEQ ID NO: 6928 - DNA, 16 bp, Homo sapiens
ttcctcccctccccgc

SEQ ID NO: 6929 - DNA, 17 bp, Homo sapiens
tccgtccctcccatcgc

SEQ ID NO: 6930 - DNA, 16 bp, Homo sapiens
ttcgcccctgcaccgc

SEQ ID NO: 6931 - DNA, 20 bp, Homo sapiens
ttcttcccctccttcgccgc

SEQ ID NO: 6932 - DNA, 17 bp, Homo sapiens
ctcgccgcttccgccgc

SEQ ID NO: 6933 - DNA, 17 bp, Homo sapiens
ctcgggccttccaccgc

SEQ ID NO: 6934 - DNA, 19 bp, Homo sapiens
ttcctctccattccactgc

SEQ ID NO: 6935 - DNA, 15 bp, Homo sapiens
ctcgcccttcaccgc

SEQ ID NO: 6936 - DNA, 16 bp, Homo sapiens
ctcgtcctcctgccgc

SEQ ID NO: 6937 - DNA, 21 bp, Homo sapiens
ttcctcctcacttccactgcg

SEQ ID NO: 6938 - DNA, 20 bp, Homo sapiens
ttcctccttgtacccactgc

SEQ ID NO: 6939 - DNA, 18 bp, Homo sapiens
ttcgcctccttccactgc

SEQ ID NO: 6940 - DNA, 17 bp, Homo sapiens
ttcatcttcccacctgc

SEQ ID NO: 6941 - DNA, 18 bp, Homo sapiens
ttcgtcccttccctccgc

SEQ ID NO: 6942 - DNA, 17 bp, Homo sapiens
ttcctccctttcactgc

SEQ ID NO: 6943 - DNA, 15 bp, Homo sapiens
ttcgcccttccccgc

SEQ ID NO: 6944 - DNA, 18 bp, Homo sapiens
ttcttcctcctccgtcgc

SEQ ID NO: 6945 - DNA, 16 bp, Homo sapiens
ttcgccctcctcccgc

SEQ ID NO: 6946 - DNA, 17 bp, Homo sapiens
ctcgtccaccccgccgc

SEQ ID NO: 6947 - DNA, 19 bp, Homo sapiens
tccgtccttgcctctgccg

SEQ ID NO: 6948 - DNA, 17 bp, Homo sapiens
ttctctctctccactgc

SEQ ID NO: 6949 - DNA, 17 bp, Homo sapiens
ttctcctttccaaccgc

SEQ ID NO: 6950 - DNA, 20 bp, Homo sapiens
tccgtccctttcttcactgc

SEQ ID NO: 6951 - DNA, 19 bp, Homo sapiens
ttcggcccttccccatcgc

SEQ ID NO: 6952 - DNA, 16 bp, Homo sapiens
tccgtccccccgccgc

SEQ ID NO: 6953 - DNA, 16 bp, Homo sapiens
tccgcccctttgccgc

SEQ ID NO: 6954 - DNA, 19 bp, Homo sapiens
ctcgtcccctagtcactgc

SEQ ID NO: 6955 - DNA, 16 bp, Homo sapiens
ttcgccttccctccgc

SEQ ID NO: 6956 - DNA, 17 bp, Homo sapiens
ttcgcccccttcatcgc

SEQ ID NO: 6957 - DNA, 18 bp, Homo sapiens
tccgtgaccttccactgc

SEQ ID NO: 6958 - DNA, 21 bp, Homo sapiens
tccgtcctccctagccaccgc

SEQ ID NO: 6959 - DNA, 17 bp, Homo sapiens
ttcgtccctacacacgc

SEQ ID NO: 6960 - DNA, 15 bp, Homo sapiens
ctcgtccttccccgc

SEQ ID NO: 6961 - DNA, 17 bp, Homo sapiens
ttctcctcctccactgc

SEQ ID NO: 6962 - DNA, 18 bp, Homo sapiens
tccgtccccttcctccac

SEQ ID NO: 6963 - DNA, 17 bp, Homo sapiens
ttcctctcctccatcgc

SEQ ID NO: 6964 - DNA, 16 bp, Homo sapiens
ttcttccttccaccgc

SEQ ID NO: 6965 - DNA, 18 bp, Homo sapiens
ctcgtcctgcatccccgc

SEQ ID NO: 6966 - DNA, 19 bp, Homo sapiens
ttcatccttttccacctgc

SEQ ID NO: 6967 - DNA, 16 bp, Homo sapiens
ttcggcctcccaccgc

SEQ ID NO: 6968 - DNA, 19 bp, Homo sapiens
ttcatccttctcatcccgc

SEQ ID NO: 6969 - DNA, 18 bp, Homo sapiens
ttctccaccttccactgc

SEQ ID NO: 6970 - DNA, 16 bp, Homo sapiens
ttctccttttccatgc

SEQ ID NO: 6971 - DNA, 17 bp, Homo sapiens
tccagcctttccaccgc

SEQ ID NO: 6972 - DNA, 17 bp, Homo sapiens
ttcttccctcccgccgc

SEQ ID NO: 6973 - DNA, 25 bp, Homo sapiens
ttcatcctttcacctctttaccgcg

SEQ ID NO: 6974 - DNA, 16 bp, Homo sapiens
ttctccttttccacgc

SEQ ID NO: 6975 - DNA, 16 bp, Homo sapiens
ctcctcccttcaccgc

SEQ ID NO: 6976 - DNA, 74 bp, Simian hemorrhagic fever virus
cggccgtgtgcgcaggttactacgtgggggactcactctttgttggtactccaaacgtgacctcgtactggttg

SEQ ID NO: 6977 - DNA, 24 bp, Simian hemorrhagic fever virus
gtactccaaacgtgacctcgtact

SEQ ID NO: 6978 - DNA, 15 bp, Homo sapiens
ctcctgacctcgtac

SEQ ID NO: 6979 - DNA, 18 bp, Homo sapiens
gtactccagagtgacact

SEQ ID NO: 6980 - DNA, 83 bp, Simian hemorrhagic fever virus
gggcgctaaacctctgagacccgttgatttggctatcaccccttgggatgaccccaaatgtgagtttctggtgacacacgcct

SEQ ID NO: 6981 - DNA, 24 bp, Simian hemorrhagic fever virus
tgatttggctatcaccccttggga

SEQ ID NO: 6982 - DNA, 24 bp, Homo sapiens
tgatttcaaccccattccttggga

SEQ ID NO: 6983 - DNA, 19 bp, Homo sapiens
tgatttggttatcagtggg

SEQ ID NO: 6984 - DNA, 25 bp, Homo sapiens
tgatttggctttgcttttcttggga

SEQ ID NO: 6985 - DNA, 22 bp, Homo sapiens
tgatttggcttcattttcttga

SEQ ID NO: 6986 - DNA, 24 bp, Homo sapiens
tgttttggaatatattccttggga

SEQ ID NO: 6987 - DNA, 27 bp, Homo sapiens
tgatttggttaattgcataaaatggga

SEQ ID NO: 6988 - DNA, 28 bp, Homo sapiens
tggtttggctatagtctcatcccaaggg

SEQ ID NO: 6989 - DNA, 19 bp, Homo sapiens
ttgcctattaccccttggg

SEQ ID NO: 6990 - DNA, 21 bp, Homo sapiens
tgatttgtttgctatttggga

SEQ ID NO: 6991 - DNA, 28 bp, Homo sapiens
tgatttggctgccactggatcccaaggg

SEQ ID NO: 6992 - DNA, 28 bp, Homo sapiens
tgatttggcatattacttatcccaaggg

SEQ ID NO: 6993 - DNA, 27 bp, Homo sapiens
tgatctggctgtcaccagatcccaagg

SEQ ID NO: 6994 - DNA, 16 bp, Homo sapiens
tgctttggctatttgg

SEQ ID NO: 6995 - DNA, 67 bp, Rana tigrina ranavirus
agatatcatgggaggcgctgggagaaagtctcccagaaagtctcccagaaagtctcccagaaagtct

SEQ ID NO: 6996 - DNA, 24 bp, Rana tigrina ranavirus
tcccagaaagtctcccagaaagtc

SEQ ID NO: 6997 - DNA, 18 bp, Homo sapiens
ccccagaaaacagaaagt

SEQ ID NO: 6998 - DNA, 24 bp, Homo sapiens
ccccagtattattcccagaaagtc

SEQ ID NO: 6999 - DNA, 19 bp, Homo sapiens
tcccagaaagctcccagaa

SEQ ID NO: 7000 - DNA, 22 bp, Homo sapiens
gaaggtctcccagcggagggtc

SEQ ID NO: 7001 - DNA, 22 bp, Homo sapiens
tcccagcaaagctcgcttccag

SEQ ID NO: 7002 - DNA, 18 bp, Homo sapiens
tcccagagtctggagggt

SEQ ID NO: 7003 - DNA, 18 bp, Homo sapiens
tcccaggaagttcccaga

SEQ ID NO: 7004 - DNA, 22 bp, Homo sapiens
tcccaggtagtttttcaacagt

SEQ ID NO: 7005 - DNA, 21 bp, Homo sapiens
tcccagggagtaacagaaggt

SEQ ID NO: 7006 - DNA, 22 bp, Homo sapiens
tccatagacaacccagaaagtc

SEQ ID NO: 7007 - DNA, 22 bp, Homo sapiens
tcccagtggtacacagaaagtc

SEQ ID NO: 7008 - DNA, 20 bp, Homo sapiens
aagccatttcccagaaggtc

SEQ ID NO: 7009 - DNA, 23 bp, Homo sapiens
tcctatggcccattccagaaagt

SEQ ID NO: 7010 - DNA, 19 bp, Homo sapiens
caagaggtccccagaaagt

SEQ ID NO: 7011 - DNA, 20 bp, Homo sapiens
tcctaggaaccccagaaggt

SEQ ID NO: 7012 - DNA, 18 bp, Homo sapiens
ccagaagccccagaaagt

SEQ ID NO: 7013 - DNA, 20 bp, Homo sapiens
tcctgaaagtcttgatggtc

SEQ ID NO: 7014 - DNA, 19 bp, Homo sapiens
tccttagaaagtcagaagt

SEQ ID NO: 7015 - DNA, 25 bp, Homo sapiens
tcccagaggctctctcccagcagtc

SEQ ID NO: 7016 - DNA, 18 bp, Homo sapiens
tccaagagtctcccagaa

SEQ ID NO: 7017 - DNA, 21 bp, Homo sapiens
tcccaggaagtctccaaaagc

SEQ ID NO: 7018 - DNA, 20 bp, Homo sapiens
ccacagcctcccaggaagtc

SEQ ID NO: 7019 - DNA, 21 bp, Homo sapiens
tcccagaaagtccttctccca

SEQ ID NO: 7020 - DNA, 20 bp, Homo sapiens
ccagaaaatctccctcagtc

SEQ ID NO: 7021 - DNA, 18 bp, Homo sapiens
tcccacaaaattccccag

SEQ ID NO: 7022 - DNA, 16 bp, Homo sapiens
cagaaagtttcaaagt

SEQ ID NO: 7023 - DNA, 20 bp, Homo sapiens
tcccaaaaagactagggagt

SEQ ID NO: 7024 - DNA, 18 bp, Homo sapiens
tccttgagtccagaaagt

SEQ ID NO: 7025 - DNA, 22 bp, Homo sapiens
ccccagagggccttggagagtc

SEQ ID NO: 7026 - DNA, 21 bp, Homo sapiens
tcccaaagggctacagggagt

SEQ ID NO: 7027 - DNA, 22 bp, Homo sapiens
tcccagaatggtttctggagtc

SEQ ID NO: 7028 - DNA, 20 bp, Homo sapiens
ccataaagtcccaggaggtc

SEQ ID NO: 7029 - DNA, 19 bp, Homo sapiens
tcccagaaggctccaaagt

SEQ ID NO: 7030 - DNA, 18 bp, Homo sapiens
tcccgggaagctcccaga

SEQ ID NO: 7031 - DNA, 21 bp, Homo sapiens
cccagaaagtttcttgtgagt

SEQ ID NO: 7032 - DNA, 24 bp, Homo sapiens
tcccagaagctttttcaaaaagtc

SEQ ID NO: 7033 - DNA, 17 bp, Homo sapiens
tcccaaaggtctcccag

SEQ ID NO: 7034 - DNA, 20 bp, Homo sapiens
tcctagaaagtctttctaga

SEQ ID NO: 7035 - DNA, 21 bp, Homo sapiens
tcccaggaggcctcaggggtc

SEQ ID NO: 7036 - DNA, 25 bp, Homo sapiens
tcccagaaggtttcagggcaaagtc

SEQ ID NO: 7037 - DNA, 17 bp, Homo sapiens
ccagaaagcctcaaagt

SEQ ID NO: 7038 - DNA, 18 bp, Homo sapiens
gaaagtctcaaggaaagt

SEQ ID NO: 7039 - DNA, 22 bp, Homo sapiens
tcctgagtctacttcagaaagt

SEQ ID NO: 7040 - DNA, 18 bp, Homo sapiens
tcccagagagtccttcag

SEQ ID NO: 7041 - DNA, 16 bp, Homo sapiens
ccagagcccagaaagt

SEQ ID NO: 7042 - DNA, 23 bp, Homo sapiens
tcccagaaatttccgactaagtc

SEQ ID NO: 7043 - DNA, 21 bp, Homo sapiens
ccagaaagctctccaagggtc

SEQ ID NO: 7044 - DNA, 23 bp, Homo sapiens
ccctaggccacacccagaaagtc

SEQ ID NO: 7045 - DNA, 21 bp, Homo sapiens
ccaaaaggtaatacagaaagt

SEQ ID NO: 7046 - DNA, 18 bp, Homo sapiens
tccaagagtacagaaagt

SEQ ID NO: 7047 - DNA, 19 bp, Homo sapiens
tcccgggaatctcccaaaa

SEQ ID NO: 7048 - DNA, 22 bp, Homo sapiens
ccccagcagcttccggaaagtc

SEQ ID NO: 7049 - DNA, 19 bp, Homo sapiens
tcccagctactcagaaagt

SEQ ID NO: 7050 - DNA, 18 bp, Homo sapiens
tcccagccctcagaaagt

SEQ ID NO: 7051 - DNA, 20 bp, Homo sapiens
ccatctgtttctcagaaagt

SEQ ID NO: 7052 - DNA, 24 bp, Homo sapiens
tcccagaagagttcccaggaagtc

SEQ ID NO: 7053 - DNA, 19 bp, Homo sapiens
tctcagggagcctcccaga

SEQ ID NO: 7054 - DNA, 114 bp, Simian hemorrhagic fever virus
atgtgctacctgccgacagtgttgtcaaggttggtgtcagcaagcctggggtcgctcacaaagcactctgtacggtaactgatatctacctcccgatgctgggcttgtacacat

SEQ ID NO: 7055 - DNA, 24 bp, Simian hemorrhagic fever virus
tctgtacggtaactgatatctacc

SEQ ID NO: 7056 - DNA, 20 bp, Homo sapiens
tctgtacagatagatatcta

SEQ ID NO: 7057 - DNA, 19 bp, Homo sapiens
tctgtacagtgacatttac

SEQ ID NO: 7058 - DNA, 21 bp, Homo sapiens
tctgtacaggttgtgtctgcc

SEQ ID NO: 7059 - DNA, 21 bp, Homo sapiens
tgcacggtgaagatttctacc

SEQ ID NO: 7060 - DNA, 19 bp, Homo sapiens
tgtggggtaactgggcacc

SEQ ID NO: 7061 - DNA, 16 bp, Homo sapiens
tctgtacagtacatct

SEQ ID NO: 7062 - DNA, 15 bp, Homo sapiens
tctgtcgtgatatct

SEQ ID NO: 7063 - DNA, 20 bp, Homo sapiens
tgcagaataactggtatcta

SEQ ID NO: 7064 - DNA, 63 bp, Equine herpesvirus 2
gcgggcgagcgaggtgagggaagggcagttatctgattgttgttttttttttgctggccgcgc

SEQ ID NO: 7065 - DNA, 23 bp, Equine herpesvirus 2
tgttttttttttgctggccgcgc

SEQ ID NO: 7066 - DNA, 18 bp, Homo sapiens
tttttttttttttaaccg

SEQ ID NO: 7067 - DNA, 19 bp, Homo sapiens
tgtttttttttttccacac

SEQ ID NO: 7068 - DNA, 17 bp, Homo sapiens
tgttttttttttctagc

SEQ ID NO: 7069 - DNA, 18 bp, Homo sapiens
ttttttttttgctggggc

SEQ ID NO: 7070 - DNA, 19 bp, Homo sapiens
ttttttttttgctgaagac

SEQ ID NO: 7071 - DNA, 17 bp, Homo sapiens
ttttttttttttggcgc

SEQ ID NO: 7072 - DNA, 18 bp, Homo sapiens
ttttttttttgccgatgc

SEQ ID NO: 7073 - DNA, 20 bp, Homo sapiens
tgtttttcccttggctgtgc

SEQ ID NO: 7074 - DNA, 19 bp, Homo sapiens
ttttttttttgtgttccgc

SEQ ID NO: 7075 - DNA, 22 bp, Homo sapiens
gttttttttttgctgaaagggc

SEQ ID NO: 7076 - DNA, 20 bp, Homo sapiens
ttttttttttgcttcaacgc

SEQ ID NO: 7077 - DNA, 16 bp, Homo sapiens
ttttttttttgctcca

SEQ ID NO: 7078 - DNA, 21 bp, Homo sapiens
ttttttttttgctttcattgc

SEQ ID NO: 7079 - DNA, 21 bp, Homo sapiens
ttttttttttcctttttgcgc

SEQ ID NO: 7080 - DNA, 22 bp, Homo sapiens
ttttttttttgacagtccgcgc

SEQ ID NO: 7081 - DNA, 19 bp, Homo sapiens
ttttttttttgctaattgc

SEQ ID NO: 7082 - DNA, 22 bp, Homo sapiens
ttttttttttgcttcacattgc

SEQ ID NO: 7083 - DNA, 18 bp, Homo sapiens
ttttttttttgcagctgc

SEQ ID NO: 7084 - DNA, 18 bp, Homo sapiens
ttttttttttttgccacg

SEQ ID NO: 7085 - DNA, 20 bp, Homo sapiens
ttttttttttgggactgcgc

SEQ ID NO: 7086 - DNA, 19 bp, Homo sapiens
ttttttttttgctggaaac

SEQ ID NO: 7087 - DNA, 18 bp, Homo sapiens
ttttttttttgcaggtgc

SEQ ID NO: 7088 - DNA, 24 bp, Homo sapiens
tgtttgttttttgctttgatttgc

SEQ ID NO: 7089 - DNA, 18 bp, Homo sapiens
ttttttttttgctccccg

SEQ ID NO: 7090 - DNA, 18 bp, Homo sapiens
ttttttttttgccagtgc

SEQ ID NO: 7091 - DNA, 19 bp, Homo sapiens
ttttttttttgcccattgc

SEQ ID NO: 7092 - DNA, 18 bp, Homo sapiens
ttttttttttgcatgtgc

SEQ ID NO: 7093 - DNA, 18 bp, Homo sapiens
ttttttttttgagatggc

SEQ ID NO: 7094 - DNA, 21 bp, Homo sapiens
tttttttttttccaaatgcgc

SEQ ID NO: 7095 - DNA, 18 bp, Homo sapiens
ttttttttttgtggctgc

SEQ ID NO: 7096 - DNA, 18 bp, Homo sapiens
ttttttttttgtgcacgc

SEQ ID NO: 7097 - DNA, 19 bp, Homo sapiens
ttttttttttggtgagcgc

SEQ ID NO: 7098 - DNA, 17 bp, Homo sapiens
ttttttttttttgccgc

SEQ ID NO: 7099 - DNA, 18 bp, Homo sapiens
ttttttttttgctggagc

SEQ ID NO: 7100 - DNA, 18 bp, Homo sapiens
ttttttttttgctagtgc

SEQ ID NO: 7101 - DNA, 19 bp, Homo sapiens
ttttttttttgctgggaac

SEQ ID NO: 7102 - DNA, 22 bp, Homo sapiens
tttttttttttcaaagccgcgc

SEQ ID NO: 7103 - DNA, 18 bp, Homo sapiens
tgtttttttcttgtgctg

SEQ ID NO: 7104 - DNA, 18 bp, Homo sapiens
ttttttttttgcctctgc

SEQ ID NO: 7105 - DNA, 19 bp, Homo sapiens
ttttttttttgtctcacgc

SEQ ID NO: 7106 - DNA, 22 bp, Homo sapiens
ttttttttttgtttggaagcgc

SEQ ID NO: 7107 - DNA, 20 bp, Homo sapiens
ttttttttttgttcagctgc

SEQ ID NO: 7108 - DNA, 16 bp, Homo sapiens
ttttttttttgcaccg

SEQ ID NO: 7109 - DNA, 18 bp, Homo sapiens
ttttttttttgctcatgc

SEQ ID NO: 7110 - DNA, 20 bp, Homo sapiens
tgttttttttttttctgtgc

SEQ ID NO: 7111 - DNA, 22 bp, Homo sapiens
tgtttttgttttgctaggaagc

SEQ ID NO: 7112 - DNA, 18 bp, Homo sapiens
ttttttttttgctctagc

SEQ ID NO: 7113 - DNA, 18 bp, Homo sapiens
tgtttgtttttgctgtgc

SEQ ID NO: 7114 - DNA, 20 bp, Homo sapiens
tgtttttttttgagacagcg

SEQ ID NO: 7115 - DNA, 21 bp, Homo sapiens
tttttttttttttaaccgtgc

SEQ ID NO: 7116 - DNA, 20 bp, Homo sapiens
ttttttttttgctttctcgc

SEQ ID NO: 7117 - DNA, 17 bp, Homo sapiens
tgttttttttttttagc

SEQ ID NO: 7118 - DNA, 19 bp, Homo sapiens
tgttttttttttttacagc

SEQ ID NO: 7119 - DNA, 19 bp, Homo sapiens
ttttttttttgccaattgc

SEQ ID NO: 7120 - DNA, 20 bp, Homo sapiens
tgtttttttctcttctgcgc

SEQ ID NO: 7121 - DNA, 18 bp, Homo sapiens
tgttttttctttgcttgc

SEQ ID NO: 7122 - DNA, 19 bp, Homo sapiens
tgttttttttttttttggc

SEQ ID NO: 7123 - DNA, 18 bp, Homo sapiens
tgtcttttttttgtgtgc

SEQ ID NO: 7124 - DNA, 20 bp, Homo sapiens
tgtttttttttttaaagctg

SEQ ID NO: 7125 - DNA, 17 bp, Homo sapiens
ttttctttgcagttgcg

SEQ ID NO: 7126 - DNA, 15 bp, Homo sapiens
tgttttttttttcac

SEQ ID NO: 7127 - DNA, 67 bp, Equine herpesvirus 2
tggaggtagcggtgctaaaaaaagttgttgagaatgtagaggaggaagtggagggccgtcaccgcca

SEQ ID NO: 7128 - DNA, 24 bp, Equine herpesvirus 2
gcggtgctaaaaaaagttgttgag

SEQ ID NO: 7129 - DNA, 19 bp, Homo sapiens
gcggtgctcgggaaagtgc

SEQ ID NO: 7130 - DNA, 21 bp, Homo sapiens
ggtgctaaggaaaaagctgag

SEQ ID NO: 7131 - DNA, 21 bp, Homo sapiens
gcggtgccagaaaaagccctg

SEQ ID NO: 7132 - DNA, 20 bp, Homo sapiens
ggtattaaaaaaaatcagag

SEQ ID NO: 7133 - DNA, 19 bp, Homo sapiens
gggcaaaaaagttgttgag

SEQ ID NO: 7134 - DNA, 20 bp, Homo sapiens
ggtgctggggagctgctgag

SEQ ID NO: 7135 - DNA, 19 bp, Homo sapiens
gcggtgctgaagcccttga

SEQ ID NO: 7136 - DNA, 19 bp, Homo sapiens
ggcacctaaagagttgttg

SEQ ID NO: 7137 - DNA, 20 bp, Homo sapiens
cagaaagaaaaaagttgttg

SEQ ID NO: 7138 - DNA, 24 bp, Homo sapiens
gctgtgctggaggtgtctgttgag

SEQ ID NO: 7139 - DNA, 24 bp, Homo sapiens
gcggtgctcggagccacccttgag

SEQ ID NO: 7140 - DNA, 22 bp, Homo sapiens
tgagtccaaagaggttgttgag

SEQ ID NO: 7141 - DNA, 19 bp, Homo sapiens
gcgctgctgaaggaagctg

SEQ ID NO: 7142 - DNA, 84 bp, Equine herpesvirus 2
tcaccctttcttgtttatccaatagagattcagtaccggtatcccagtatctgattatcagataaggaagtacagtaaagggga

SEQ ID NO: 7143 - DNA, 24 bp, Equine herpesvirus 2
atccaatagagattcagtaccggt

SEQ ID NO: 7144 - DNA, 23 bp, Homo sapiens
cagagagattctgtcttaccggt

SEQ ID NO: 7145 - DNA, 23 bp, Homo sapiens
atccagtagagactgaagctggt

SEQ ID NO: 7146 - DNA, 21 bp, Homo sapiens
tccaataggccaggtaccggt

SEQ ID NO: 7147 - DNA, 17 bp, Homo sapiens
tccgatctcagtactgg

SEQ ID NO: 7148 - DNA, 19 bp, Homo sapiens
caatagagattcagggccg

SEQ ID NO: 7149 - DNA, 24 bp, Homo sapiens
tccaatagggagatcagtgctggt

SEQ ID NO: 7150 - DNA, 16 bp, Homo sapiens
atccaatgagatgctg

SEQ ID NO: 7151 - DNA, 17 bp, Homo sapiens
atccgtagggattcagt

SEQ ID NO: 7152 - DNA, 131 bp, Equine herpesvirus 2
cctggatctggtcctggtcctggatctggtcctggtcctggatctggtcctggtcctggatctggtcctggtcctggatctggtcctggtcctggatctggtcctggtcctggatctggtcctggtcctgg

SEQ ID NO: 7153 - DNA, 24 bp, Equine herpesvirus 2
ctggatctggtcctggtcctggat

SEQ ID NO: 7154 - DNA, 17 bp, Homo sapiens
ctgtggcttggtcctgg

SEQ ID NO: 7155 - DNA, 21 bp, Homo sapiens
ctgaatttggttgatttggat

SEQ ID NO: 7156 - DNA, 22 bp, Homo sapiens
ctggatctggtccaggagccca

SEQ ID NO: 7157 - DNA, 16 bp, Homo sapiens
ggatctggtcccatgg

SEQ ID NO: 7158 - DNA, 19 bp, Homo sapiens
tgggtttggttctggtccc

SEQ ID NO: 7159 - DNA, 20 bp, Homo sapiens
tggatctggtttggagaagg

SEQ ID NO: 7160 - DNA, 23 bp, Homo sapiens
ctaggggagtcttggtcctggat

SEQ ID NO: 7161 - DNA, 20 bp, Homo sapiens
ctgggtttgggaagtcctgg

SEQ ID NO: 7162 - DNA, 18 bp, Homo sapiens
ctgagttcatggtcctgg

SEQ ID NO: 7163 - DNA, 20 bp, Homo sapiens
tggggtttggccagtcctgg

SEQ ID NO: 7164 - DNA, 17 bp, Homo sapiens
tgggtctggtcctgtgg

SEQ ID NO: 7165 - DNA, 18 bp, Homo sapiens
ctggatctggtgtctgga

SEQ ID NO: 7166 - DNA, 60 bp, Equine herpesvirus 2
tctctgacaatctgccaccgagaaccgaaaccgggatgacccgcggtggagtttcgggga

SEQ ID NO: 7167 - DNA, 24 bp, Equine herpesvirus 2
tctgccaccgagaaccgaaaccgg

SEQ ID NO: 7168 - DNA, 21 bp, Homo sapiens
tctgctggcgaacaaaaccgg

SEQ ID NO: 7169 - DNA, 18 bp, Homo sapiens
caccgagaaagagacagg

SEQ ID NO: 7170 - DNA, 29 bp, Homo sapiens
tctgccaccagggctagaggccggtttcg

SEQ ID NO: 7171 - DNA, 18 bp, Homo sapiens
tctgccaccgagaaagaa

SEQ ID NO: 7172 - DNA, 25 bp, Homo sapiens
tctgccacctgggaactgaacacgg

SEQ ID NO: 7173 - DNA, 23 bp, Homo sapiens
tctgccaccaagaggaacaccgg

SEQ ID NO: 7174 - DNA, 25 bp, Homo sapiens
tctgccactgaaactaggccggttc

SEQ ID NO: 7175 - DNA, 21 bp, Homo sapiens
tctgccacttggaatctccgg

SEQ ID NO: 7176 - DNA, 29 bp, Homo sapiens
tctgccacagagggcgatggccggtttcg

SEQ ID NO: 7177 - DNA, 22 bp, Homo sapiens
tctgccactgacagccagtgcc

SEQ ID NO: 7178 - DNA, 28 bp, Homo sapiens
tctgccactggagatctggccggtttcg

SEQ ID NO: 7179 - DNA, 25 bp, Homo sapiens
tctccaccgaggcactggccggttc

SEQ ID NO: 7180 - DNA, 25 bp, Homo sapiens
tctgccacgagagctaggccggttc

SEQ ID NO: 7181 - DNA, 126 bp, Vaccinia virus
cttttttacgactccatcagaaagaggtttaatatttttgtgagaccatcgaagagagaaagataaaacttttttacgactccatcagaaagaggtttaatatttttgtgagaccatcgaagagag

SEQ ID NO: 7182 - DNA, 126 bp, Vaccinia virus; identical to SEQ ID NO: 7181

SEQ ID NO: 7183 - DNA, 22 bp, Homo sapiens
tcagaaaataagctagtatttt

SEQ ID NO: 7184 - DNA, 19 bp, Homo sapiens
agaaagcattcaatatttt

SEQ ID NO: 7185 - DNA, 20 bp, Homo sapiens
ccagaaagatgtagtatttt

SEQ ID NO: 7186 - DNA, 19 bp, Homo sapiens
gaaagaggttttcaatttt

SEQ ID NO: 7187 - DNA, 21 bp, Homo sapiens
atcagaagaatgcaatatttt

SEQ ID NO: 7188 - DNA, 18 bp, Homo sapiens
agaaagaggaaacatttt

SEQ ID NO: 7189 - DNA, 22 bp, Homo sapiens
atcaggcagagtaaaatatttt

SEQ ID NO: 7190 - DNA, 17 bp, Homo sapiens
gaaagaggtaccatttt

SEQ ID NO: 7191 - DNA, 20 bp, Homo sapiens
tcaggaagaagctgtatttt

SEQ ID NO: 7192 - DNA, 22 bp, Homo sapiens
cagaaagttatcttaatatttt

SEQ ID NO: 7193 - DNA, 23 bp, Homo sapiens
atcaggtccaggtttaatatttt

SEQ ID NO: 7194 - DNA, 98 bp, Vaccinia virus
taaaattaaattaattataaaattatgtatatgatttactaactttagttagataagttagtaatacataaattttagtatattaatattatatttta

SEQ ID NO: 7195 - DNA, 24 bp, Vaccinia virus
taagttagtaatacataaatttta

SEQ ID NO: 7196 - DNA, 24 bp, Homo sapiens
taagtctaaaacacatagatttta

SEQ ID NO: 7197 - DNA, 21 bp, Homo sapiens
taagttagtacatgtaaactt

SEQ ID NO: 7198 - DNA, 71 bp, Gallid herpesvirus 3
tctaagattttaggaaaaattatggggtttgatgtatttaaagcggcaactgatttccgattggtctttga

SEQ ID NO: 7199 - DNA, 24 bp, Gallid herpesvirus 3
taagattttaggaaaaattatggg

SEQ ID NO: 7200 - DNA, 18 bp, Homo sapiens
taagactttggggaaaaa

SEQ ID NO: 7201 - DNA, 18 bp, Homo sapiens
taagttttaggaagaacc

SEQ ID NO: 7202 - DNA, 21 bp, Homo sapiens
taagatttaggaaaagaaatg

SEQ ID NO: 7203 - DNA, 22 bp, Homo sapiens
tagaattttaggaggctctggg

SEQ ID NO: 7204 - DNA, 19 bp, Homo sapiens
ctctgggagaaattatggg

SEQ ID NO: 7205 - DNA, 22 bp, Homo sapiens
aatcccaaggaaaggttatggg

SEQ ID NO: 7206 - DNA, 20 bp, Homo sapiens
aagttttaggagaaaatggg

SEQ ID NO: 7207 - DNA, 23 bp, Homo sapiens
gaatgcccaagaaagattatggg

SEQ ID NO: 7208 - DNA, 24 bp, Homo sapiens
taaggctttagggggtttcgtggg

SEQ ID NO: 7209 - DNA, 22 bp, Homo sapiens
taagactttagggaagataagg

SEQ ID NO: 7210 - DNA, 21 bp, Homo sapiens
gattgcgggagaaattatggg

SEQ ID NO: 7211 - DNA, 21 bp, Homo sapiens
taagattcttaggagggatgg

SEQ ID NO: 7212 - DNA, 22 bp, Homo sapiens
gattttaggagaaaagaatggg

SEQ ID NO: 7213 - DNA, 18 bp, Homo sapiens
agattctaggagaaaacc

SEQ ID NO: 7214 - DNA, 23 bp, Homo sapiens
agattttagtcctctgttatggg

SEQ ID NO: 7215 - DNA, 17 bp, Homo sapiens
aaatttaagaattatgg

SEQ ID NO: 7216 - DNA, 19 bp, Homo sapiens
gagcaggaaaagttgtggg

SEQ ID NO: 7217 - DNA, 21 bp, Homo sapiens
agattttaggaagacacgtgg

SEQ ID NO: 7218 - DNA, 18 bp, Homo sapiens
taagattttagaggaaaa

SEQ ID NO: 7219 - DNA, 73 bp, Equine herpesvirus 2
ttacctgcagcctaaccctagccctaaccctagctcatgcttggagtgtgttggtgacagtccttgcaggtga

SEQ ID NO: 7220 - DNA, 24 bp, Equine herpesvirus 2
tgtgttggtgacagtccttgcagg

SEQ ID NO: 7221 - DNA, 27 bp, Homo sapiens
tgagttggtgatcttttatcttgtagg

SEQ ID NO: 7222 - DNA, 21 bp, Homo sapiens
gcgagtggtagtccttgcggg

SEQ ID NO: 7223 - DNA, 22 bp, Homo sapiens
tgtgttaggtccattttgcagg

SEQ ID NO: 7224 - DNA, 26 bp, Homo sapiens
tgtgttggagacagtttagcctgcag

SEQ ID NO: 7225 - DNA, 30 bp, Homo sapiens
tgttttggtgacagttttctgcctgcaagg

SEQ ID NO: 7226 - DNA, 16 bp, Homo sapiens
tgggttggtgactcct

SEQ ID NO: 7227 - DNA, 18 bp, Homo sapiens
tgtcttaagtttttgcag

SEQ ID NO: 7228 - DNA, 19 bp, Homo sapiens
tgtgtggtgacagttgaag

SEQ ID NO: 7229 - DNA, 68 bp, Equine herpesvirus 2
ggaaatagcctttggattatgcctttgatagtgcctcaggctacaagatcaatccaacggttgtttcc

SEQ ID NO: 7230 - DNA, 24 bp, Equine herpesvirus 2
caagatcaatccaacggttgtttc

SEQ ID NO: 7231 - DNA, 23 bp, Homo sapiens
caagattaagtctgggttatttc

SEQ ID NO: 7232 - DNA, 21 bp, Homo sapiens
caaggtcaatctgatcatttc

SEQ ID NO: 7233 - DNA, 17 bp, Homo sapiens
gatcagtacagctgttc

SEQ ID NO: 7234 - DNA, 20 bp, Homo sapiens
agggtcaatccaatgaaagt

SEQ ID NO: 7235 - DNA, 23 bp, Homo sapiens
caagatcagtcctcatttgtttc

SEQ ID NO: 7236 - DNA, 18 bp, Homo sapiens
aagatcaatatactggtt

SEQ ID NO: 7237 - DNA, 25 bp, Homo sapiens
caggattatccaactcctctgtttc

SEQ ID NO: 7238 - DNA, 19 bp, Homo sapiens
caagagtagtccaacgatt

SEQ ID NO: 7239 - DNA, 21 bp, Homo sapiens
caagatcagtttcaatgggct

SEQ ID NO: 7240 - DNA, 19 bp, Homo sapiens
tgagatcattccagcctgc

SEQ ID NO: 7241 - DNA, 22 bp, Homo sapiens
caagatcacgttgctgttgttt

SEQ ID NO: 7242 - DNA, 20 bp, Homo sapiens
tgagatgaatctggttgctt

SEQ ID NO: 7243 - DNA, 19 bp, Homo sapiens
aagatcaaatcaattatct

SEQ ID NO: 7244 - DNA, 18 bp, Homo sapiens
aaggccaatccaatggtc

SEQ ID NO: 7245 - DNA, 17 bp, Homo sapiens
gatgtccgcggttgttt

SEQ ID NO: 7246 - DNA, 21 bp, Homo sapiens
tgagatcagtcaaagttgctt

SEQ ID NO: 7247 - DNA, 61 bp, Cowpox virus
atggattttactagatcatttatataccaaaaaatattatacgatctacgttttattatat

SEQ ID NO: 7248 - DNA, 24 bp, Cowpox virus
tactagatcatttatataccaaaa

SEQ ID NO: 7249 - DNA, 21 bp, Homo sapiens
tagcattgccacataccaaaa

SEQ ID NO: 7250 - DNA, 15 bp, Homo sapiens
agactatataccaaa

SEQ ID NO: 7251 - DNA, 17 bp, Homo sapiens
ctagtcatttacttcca

SEQ ID NO: 7252 - DNA, 20 bp, Homo sapiens
taaatcattttcacagacca

SEQ ID NO: 7253 - DNA, 21 bp, Homo sapiens
gaaaaccatttatatatcaaa

SEQ ID NO: 7254 - DNA, 20 bp, Homo sapiens
tagacacatttatatgtcaa

SEQ ID NO: 7255 - DNA, 18 bp, Homo sapiens
tactaaatcatcaaccaa

SEQ ID NO: 7256 - DNA, 17 bp, Homo sapiens
tagatcatttcatacca

SEQ ID NO: 7257 - DNA, 22 bp, Homo sapiens
ctggaatggatatataccaaaa

SEQ ID NO: 7258 - DNA, 19 bp, Homo sapiens
tacagatcatttgtaccaa

SEQ ID NO: 7259 - DNA, 22 bp, Homo sapiens
ctggatcatccccataccaaaa

SEQ ID NO: 7260 - DNA, 22 bp, Homo sapiens
tacctggttatatataccaaaa

SEQ ID NO: 7261 - DNA, 18 bp, Homo sapiens
tactgatcatctttgcca

SEQ ID NO: 7262 - DNA, 25 bp, Homo sapiens
tactggatcacttccatgatcaaaa

SEQ ID NO: 7263 - DNA, 21 bp, Homo sapiens
cactagatcatttttgttcca

SEQ ID NO: 7264 - DNA, 22 bp, Homo sapiens
ctagagtacctatatactaaaa

SEQ ID NO: 7265 - DNA, 89 bp, Equine herpesvirus 2
ggttcaggttcaggctcaggttcaagctctggttcaggttcaggctctggttcaggttttggtttaggttttgggtctggatctgggtc

SEQ ID NO: 7266 - DNA, 24 bp, Equine herpesvirus 2
tggttcaggttttggtttaggttt

SEQ ID NO: 7267 - DNA, 21 bp, Homo sapiens
tggtttgggttctgtttgttt

SEQ ID NO: 7268 - DNA, 18 bp, Homo sapiens
tggttcaggttttgcctt

SEQ ID NO: 7269 - DNA, 19 bp, Homo sapiens
tggtttaggttcttggttt

SEQ ID NO: 7270 - DNA, 17 bp, Homo sapiens
agttcagggtttaggtt

SEQ ID NO: 7271 - DNA, 22 bp, Homo sapiens
tggttcaggtttgtcccggttt

SEQ ID NO: 7272 - DNA, 18 bp, Homo sapiens
tggtttagttttggctta

SEQ ID NO: 7273 - DNA, 21 bp, Homo sapiens
tgcttcagtatgtttgggttt

SEQ ID NO: 7274 - DNA, 85 bp, Equine herpesvirus 2
ttcttgccaaagactgtgacggctggaaccaagttgactctcgctcacaccattggtcccatccttcacaggatttgaacaagag

SEQ ID NO: 7275 - DNA, 24 bp, Equine herpesvirus 2
ttggtcccatccttcacaggattt

SEQ ID NO: 7276 - DNA, 18 bp, Homo sapiens
ttggtcctacctttagaa

SEQ ID NO: 7277 - DNA, 20 bp, Homo sapiens
ttgattccatcctttccaga

SEQ ID NO: 7278 - DNA, 20 bp, Homo sapiens
ttgctcctatttttcacaga

SEQ ID NO: 7279 - DNA, 24 bp, Homo sapiens
ctggtcaagccctttacaggattt

SEQ ID NO: 7280 - DNA, 130 bp, Equine herpesvirus 2
ggcttgggctttggctcaggttgaggcggaggcttgggctttggctcaggttgaggcggaggcttgggctttggctcaggttgaggcggaggcttgggctttggctcaggttgaggcggaggcttgggtt

SEQ ID NO: 7281 - DNA, 24 bp, Equine herpesvirus 2
tcaggttgaggcggaggcttgggc

SEQ ID NO: 7282 - DNA, 19 bp, Homo sapiens
tcagttgaggctagttggg

SEQ ID NO: 7283 - DNA, 18 bp, Homo sapiens
ggcagtggaggcttgggc

SEQ ID NO: 7284 - DNA, 19 bp, Homo sapiens
tccggtgcggaggcttggg

SEQ ID NO: 7285 - DNA, 20 bp, Homo sapiens
ccaggttgggattgcttggg

SEQ ID NO: 7286 - DNA, 22 bp, Homo sapiens
tcaggtggaggcgggtgggggg

SEQ ID NO: 7287 - DNA, 24 bp, Homo sapiens
tcaggttgggccgggaaggagggc

SEQ ID NO: 7288 - DNA, 21 bp, Homo sapiens
aggttggggggacacctgggc

SEQ ID NO: 7289 - DNA, 21 bp, Homo sapiens
tcaggtgtggggtggagggga

SEQ ID NO: 7290 - DNA, 21 bp, Homo sapiens
tcaggtggggtgggatgacgg

SEQ ID NO: 7291 - DNA, 20 bp, Homo sapiens
tcaggctggggcggggagag

SEQ ID NO: 7292 - DNA, 22 bp, Homo sapiens
aggttaggtggatcgcctgggc

SEQ ID NO: 7293 - DNA, 21 bp, Homo sapiens
agctcagcctggaggcttggg

SEQ ID NO: 7294 - DNA, 19 bp, Homo sapiens
ggttgaggcgggcccaggc

SEQ ID NO: 7295 - DNA, 18 bp, Homo sapiens
ccaggttggggtgggggc

SEQ ID NO: 7296 - DNA, 19 bp, Homo sapiens
ccaggttggggtgggcggc

SEQ ID NO: 7297 - DNA, 128 bp, Vaccinia virus
cttttttacgactccatcagaaagaggtttaatatttttgtgagaccatcgaagagagaaagagataaaacttttttacgactccatcagaaagaggtttaatatttttgtgagaccatcgaagagag

SEQ ID NO: 7298 - DNA, 77 bp, Equine herpesvirus 2
agctgccattttgaaagagctaattcacagtttgattaaaaaagacttttcatcagtagcttattcttagtgttgct

SEQ ID NO: 7299 - DNA, 24 bp, Equine herpesvirus 2
tgaaagagctaattcacagtttga

SEQ ID NO: 7300 - DNA, 22 bp, Homo sapiens
tgaaaagctaagactggtttga

SEQ ID NO: 7301 - DNA, 17 bp, Homo sapiens
taaaagagctagttcca

SEQ ID NO: 7302 - DNA, 20 bp, Homo sapiens
tgaaggcagggcacagtttg

SEQ ID NO: 7303 - DNA, 20 bp, Homo sapiens
tggcagagctaattcaacag

SEQ ID NO: 7304 - DNA, 22 bp, Homo sapiens
tgaaaaagctggtgccatttga

SEQ ID NO: 7305 - DNA, 23 bp, Homo sapiens
tgaagagggctgagacagtttga

SEQ ID NO: 7306 - DNA, 21 bp, Homo sapiens
tgggagagtctgtacagtttg

SEQ ID NO: 7307 - DNA, 16 bp, Homo sapiens
tgaaaaagcacagttt

SEQ ID NO: 7308 - DNA, 25 bp, Homo sapiens
tgaaagagctaattttactgcttga

SEQ ID NO: 7309 - DNA, 24 bp, Homo sapiens
tgaagcagtcttcaaacagtttga

SEQ ID NO: 7310 - DNA, 24 bp, Homo sapiens
tgggaggctgaggcagcagtttga

SEQ ID NO: 7311 - DNA, 21 bp, Homo sapiens
tggcagaggccacacagtttg

SEQ ID NO: 7312 - DNA, 22 bp, Homo sapiens
tgaaagagctaatgtattccag

SEQ ID NO: 7313 - DNA, 77 bp, Equine herpesvirus 2
ccacctgcccgcccgcccgcccacctgacccgcgcagaggtaagggagcgagctgttgagttggattggcagagtgg

SEQ ID NO: 7314 - DNA, 24 bp, Equine herpesvirus 2
agggagcgagctgttgagttggat

SEQ ID NO: 7315 - DNA, 20 bp, Homo sapiens
gggtgcgagctggtatggat

SEQ ID NO: 7316 - DNA, 21 bp, Homo sapiens
aggaggtgagctaggggttgg

SEQ ID NO: 7317 - DNA, 19 bp, Homo sapiens
gggggctgagctgaggtgg

SEQ ID NO: 7318 - DNA, 22 bp, Homo sapiens
agggagcagggctgtccgggat

SEQ ID NO: 7319 - DNA, 20 bp, Homo sapiens
aaggagcggggggcggttgg

SEQ ID NO: 7320 - DNA, 20 bp, Homo sapiens
gggagggagggtcgagttgg

SEQ ID NO: 7321 - DNA, 22 bp, Homo sapiens
gggagcgagctgtagctgtgat

SEQ ID NO: 7322 - DNA, 18 bp, Homo sapiens
ggagcgagctggctttgg

SEQ ID NO: 7323 - DNA, 19 bp, Homo sapiens
aggagtgagctggttgtgg

SEQ ID NO: 7324 - DNA, 20 bp, Homo sapiens
agggagtggagttgagttgg

SEQ ID NO: 7325 - DNA, 16 bp, Homo sapiens
agggagcgagcttcgg

SEQ ID NO: 7326 - DNA, 19 bp, Homo sapiens
agggagtggctgccaatgg

SEQ ID NO: 7327 - DNA, 19 bp, Homo sapiens
ggggtgagctgatctggat

SEQ ID NO: 7328 - DNA, 17 bp, Homo sapiens
gggggcctttgagttgg

SEQ ID NO: 7329 - DNA, 15 bp, Homo sapiens
agggagcagttgtgg

SEQ ID NO: 7330 - DNA, 22 bp, Homo sapiens
agggagcaggcctcgaggttgg

SEQ ID NO: 7331 - DNA, 17 bp, Homo sapiens
gggagccagaaagttgg

SEQ ID NO: 7332 - DNA, 22 bp, Homo sapiens
aaggagtgagctgagtcactgg

SEQ ID NO: 7333 - DNA, 70 bp, Vaccinia virus
ataaaaatatttttgtaaaactttttttatgagaccatcaaagagagaaagagaataaaaatatttttgt

SEQ ID NO: 7334 - DNA, 70 bp, Vaccinia virus; identical to SEQ ID NO: 7333

SEQ ID NO: 7335 - DNA, 19 bp, Homo sapiens
tatttctgtaacttttttt

SEQ ID NO: 7336 - DNA, 20 bp, Homo sapiens
aatatttctgtgtacttttt

SEQ ID NO: 7337 - DNA, 24 bp, Homo sapiens
aatatttttataaatcccatttta

SEQ ID NO: 7338 - DNA, 24 bp, Homo sapiens
aatatggcagtaaaacttttttta

SEQ ID NO: 7339 - DNA, 21 bp, Homo sapiens
atacttttgctccttttttta

SEQ ID NO: 7340 - DNA, 19 bp, Homo sapiens
tatttttgtcaaactttct

SEQ ID NO: 7341 - DNA, 20 bp, Homo sapiens
aatatttttgcagcactttt

SEQ ID NO: 7342 - DNA, 72 bp, Equine herpesvirus 2
gtggaggagagagagaaataagcacctttaccttttttggggataaaggtgaatctctactctcgctctcac

SEQ ID NO: 7343 - DNA, 24 bp, Equine herpesvirus 2
gaggagagagagaaataagcacct

SEQ ID NO: 7344 - DNA, 18 bp, Homo sapiens
gaggagagaggggcagcc

SEQ ID NO: 7345 - DNA, 25 bp, Homo sapiens
agagagagagaagcagacagtacct

SEQ ID NO: 7346 - DNA, 18 bp, Homo sapiens
agggagagagctaagcac

SEQ ID NO: 7347 - DNA, 21 bp, Homo sapiens
ggagaaagaggaacaggacct

SEQ ID NO: 7348 - DNA, 23 bp, Homo sapiens
gagagagagagagaaataaaggc

SEQ ID NO: 7349 - DNA, 18 bp, Homo sapiens
gagaagagggaaagtacc

SEQ ID NO: 7350 - DNA, 19 bp, Homo sapiens
gagaagagagagtggtaag

SEQ ID NO: 7351 - DNA, 16 bp, Homo sapiens
gaggagagggaggcac

SEQ ID NO: 7352 - DNA, 23 bp, Homo sapiens
gaggtgggagagaaatcacacac

SEQ ID NO: 7353 - DNA, 19 bp, Homo sapiens
gaggagaaggaggaataag

SEQ ID NO: 7354 - DNA, 17 bp, Homo sapiens
ggagagagagagagacc

SEQ ID NO: 7355 - DNA, 24 bp, Homo sapiens
gagcgagagagagaggcaacatct

SEQ ID NO: 7356 - DNA, 18 bp, Homo sapiens
gaggagagagagagaggc

SEQ ID NO: 7357 - DNA, 18 bp, Homo sapiens
gaggagagaagagaagca

SEQ ID NO: 7358 - DNA, 21 bp, Homo sapiens
gaggagagcagaggaatgccc

SEQ ID NO: 7359 - DNA, 21 bp, Homo sapiens
gaggagagtgaaattaaggca

SEQ ID NO: 7360 - DNA, 20 bp, Homo sapiens
gaggagagaggaggtggcac

SEQ ID NO: 7361 - DNA, 17 bp, Homo sapiens
gaggagagaggagccct

SEQ ID NO: 7362 - DNA, 24 bp, Homo sapiens
gaagagagaaagtagtgagcatct

SEQ ID NO: 7363 - DNA, 26 bp, Homo sapiens
gaggagaagggaggaatggttcacct

SEQ ID NO: 7364 - DNA, 20 bp, Homo sapiens
aaggagagagggggatgagc

SEQ ID NO: 7365 - DNA, 21 bp, Homo sapiens
gaggggatggagaaataatac

SEQ ID NO: 7366 - DNA, 18 bp, Homo sapiens
gaggagagaggaagtaaa

SEQ ID NO: 7367 - DNA, 18 bp, Homo sapiens
gaggaagagagagactgc

SEQ ID NO: 7368 - DNA, 19 bp, Homo sapiens
gagagagggagagaacagc

SEQ ID NO: 7369 - DNA, 20 bp, Homo sapiens
aaggagagagggaaggttgc

SEQ ID NO: 7370 - DNA, 19 bp, Homo sapiens
gaggtgagagagaaatggc

SEQ ID NO: 7371 - DNA, 24 bp, Homo sapiens
ggagagagaggaggggagatacct

SEQ ID NO: 7372 - DNA, 19 bp, Homo sapiens
ggagagggaggaacaagca

SEQ ID NO: 7373 - DNA, 21 bp, Homo sapiens
gaggagagacagaaatagagc

SEQ ID NO: 7374 - DNA, 17 bp, Homo sapiens
gaggacagaggaggcac

SEQ ID NO: 7375 - DNA, 18 bp, Homo sapiens
agggaggaagaataagca

SEQ ID NO: 7376 - DNA, 23 bp, Homo sapiens
gaggggagggagaggtgagctcc

SEQ ID NO: 7377 - DNA, 23 bp, Homo sapiens
aaggagagggaggagggcggcct

SEQ ID NO: 7378 - DNA, 20 bp, Homo sapiens
ggagagagggcttagcacct

SEQ ID NO: 7379 - DNA, 17 bp, Homo sapiens
gaggagaagagggccct

SEQ ID NO: 7380 - DNA, 19 bp, Homo sapiens
gagagagagagagaaataa

SEQ ID NO: 7381 - DNA, 19 bp, Homo sapiens
ggagagaggagggtaatgc

SEQ ID NO: 7382 - DNA, 22 bp, Homo sapiens
gaggaaagaggggagagaacct

SEQ ID NO: 7383 - DNA, 21 bp, Homo sapiens
gaggagaagagcggggcgcct

SEQ ID NO: 7384 - DNA, 16 bp, Homo sapiens
ggagagaaagaaatgc

SEQ ID NO: 7385 - DNA, 19 bp, Homo sapiens
ggagagagggagggctcct

SEQ ID NO: 7386 - DNA, 23 bp, Homo sapiens
aggagagagagaatgacccacct

SEQ ID NO: 7387 - DNA, 20 bp, Homo sapiens
gaggggaggaagaaagtgca

SEQ ID NO: 7388 - DNA, 19 bp, Homo sapiens
gaggagagagagaaaaggc

SEQ ID NO: 7389 - DNA, 18 bp, Homo sapiens
gagagagagagagagaca

SEQ ID NO: 7390 - DNA, 18 bp, Homo sapiens
gaggagagaagaatttgc

SEQ ID NO: 7391 - DNA, 25 bp, Homo sapiens
gaggagagagagagatagagcccct

SEQ ID NO: 7392 - DNA, 26 bp, Homo sapiens
gagagagagagagaatgtgtgtacct

SEQ ID NO: 7393 - DNA, 18 bp, Homo sapiens
gaggagagggaggaaaac

SEQ ID NO: 7394 - DNA, 19 bp, Homo sapiens
gaggggaagagagaaatgc

SEQ ID NO: 7395 - DNA, 16 bp, Homo sapiens
ggagagaggagaagca

SEQ ID NO: 7396 - DNA, 18 bp, Homo sapiens
gaggagagagaggtcacc

SEQ ID NO: 7397 - DNA, 19 bp, Homo sapiens
aaggggagagagaaaaggc

SEQ ID NO: 7398 - DNA, 16 bp, Homo sapiens
gaggagaaagggacac

SEQ ID NO: 7399 - DNA, 23 bp, Homo sapiens
gaggagggagtgaagttgcaccc

SEQ ID NO: 7400 - DNA, 18 bp, Homo sapiens
gagtgaggaataagcacc

SEQ ID NO: 7401 - DNA, 23 bp, Homo sapiens
gaggagagaggggaaatagcacc

SEQ ID NO: 7402 - DNA, 23 bp, Homo sapiens
gagagagagagagaggcagacct

SEQ ID NO: 7403 - DNA, 18 bp, Homo sapiens
gaggaaagagaggacacc

SEQ ID NO: 7404 - DNA, 20 bp, Homo sapiens
ggagggagagaaatacaccc

SEQ ID NO: 7405 - DNA, 16 bp, Homo sapiens
agagagagagaacagc

SEQ ID NO: 7406 - DNA, 20 bp, Homo sapiens
gaggagaagagaggttaagc

SEQ ID NO: 7407 - DNA, 20 bp, Homo sapiens
ggaggattctaaaataagca

SEQ ID NO: 7408 - DNA, 22 bp, Homo sapiens
ggtgagggtgcaataagcatct

SEQ ID NO: 7409 - DNA, 19 bp, Homo sapiens
ggagagagagatggtagca

SEQ ID NO: 7410 - DNA, 19 bp, Homo sapiens
gaggacagagagatccaca

SEQ ID NO: 7411 - DNA, 18 bp, Homo sapiens
ggagagagagagggagca

SEQ ID NO: 7412 - DNA, 22 bp, Homo sapiens
gaggagagagtacatggcatct

SEQ ID NO: 7413 - DNA, 19 bp, Homo sapiens
gaggagaggggaaaatgca

SEQ ID NO: 7414 - DNA, 20 bp, Homo sapiens
ggcagagagagaaggcaact

SEQ ID NO: 7415 - DNA, 18 bp, Homo sapiens
aggagagaggcaagtgcc

SEQ ID NO: 7416 - DNA, 19 bp, Homo sapiens
gagtagagagaggagggcc

SEQ ID NO: 7417 - DNA, 18 bp, Homo sapiens
gagggagggaggaataag

SEQ ID NO: 7418 - DNA, 22 bp, Homo sapiens
aaggagagactcgtgagcgcct

SEQ ID NO: 7419 - DNA, 22 bp, Homo sapiens
gagagagagagagaacactgca

SEQ ID NO: 7420 - DNA, 22 bp, Homo sapiens
gagagagagagagacaccaaac

SEQ ID NO: 7421 - DNA, 22 bp, Homo sapiens
aagggagagacaataagcatct

SEQ ID NO: 7422 - DNA, 18 bp, Homo sapiens
gaggagagatggagtaag

SEQ ID NO: 7423 - DNA, 15 bp, Homo sapiens
gaggagaggaggcac

SEQ ID NO: 7424 - DNA, 23 bp, Homo sapiens
gaggagaggaagggacaaaacct

SEQ ID NO: 7425 - DNA, 18 bp, Homo sapiens
gagagagagagagaaata

SEQ ID NO: 7426 - DNA, 21 bp, Homo sapiens
gagagagagagagacctgtgc

SEQ ID NO: 7427 - DNA, 21 bp, Homo sapiens
gagagagagagagagagacct

SEQ ID NO: 7428 - DNA, 19 bp, Homo sapiens
gaggagagggaggtgcacc

SEQ ID NO: 7429 - DNA, 21 bp, Homo sapiens
gaggagagagagagagagagc

SEQ ID NO: 7430 - DNA, 18 bp, Homo sapiens
gagagagagagagataca

SEQ ID NO: 7431 - DNA, 22 bp, Homo sapiens
gaggagagaagagaggcagagc

SEQ ID NO: 7432 - DNA, 18 bp, Homo sapiens
gagaagaagaaataagca

SEQ ID NO: 7433 - DNA, 22 bp, Homo sapiens
ggtgagagagaccagagcacct

SEQ ID NO: 7434 - DNA, 18 bp, Homo sapiens
gggagagagccaagcacc

SEQ ID NO: 7435 - DNA, 19 bp, Homo sapiens
gagggagagagaatcaacc

SEQ ID NO: 7436 - DNA, 17 bp, Homo sapiens
gaggaaagggaggctcc

SEQ ID NO: 7437 - DNA, 21 bp, Homo sapiens
gaggtgagggagaagttccct

SEQ ID NO: 7438 - DNA, 19 bp, Homo sapiens
agaagagggaagtgagcac

SEQ ID NO: 7439 - DNA, 23 bp, Homo sapiens
gaggagaaagggtgggagcatct

SEQ ID NO: 7440 - DNA, 20 bp, Homo sapiens
gaggaagagagaagcagagc

SEQ ID NO: 7441 - DNA, 18 bp, Homo sapiens
gagagagagaatagcacc

SEQ ID NO: 7442 - DNA, 21 bp, Homo sapiens
gggagagagctgagagcgcct

SEQ ID NO: 7443 - DNA, 23 bp, Homo sapiens
gaggagaggagacaggggtacct

SEQ ID NO: 7444 - DNA, 24 bp, Homo sapiens
aagggagagagagatagacatcct

SEQ ID NO: 7445 - DNA, 19 bp, Homo sapiens
gaggagagacagcagcacc

SEQ ID NO: 7446 - DNA, 20 bp, Homo sapiens
gaggagggagggagagacct

SEQ ID NO: 7447 - DNA, 22 bp, Homo sapiens
gaggagagagggatataaggac

SEQ ID NO: 7448 - DNA, 21 bp, Homo sapiens
gagggcagagaaaaggcatct

SEQ ID NO: 7449 - DNA, 18 bp, Homo sapiens
gaggagagggaaggaaat

SEQ ID NO: 7450 - DNA, 16 bp, Homo sapiens
gaggagagagaaaagc

SEQ ID NO: 7451 - DNA, 88 bp, Equine herpesvirus 2
acacctccccggggggcgtgtctacatggatgttgggcaagggtcaaaatgcattatgggtaaagtgtgactctctaggggcgggggt

SEQ ID NO: 7452 - DNA, 24 bp, Equine herpesvirus 2
tgcattatgggtaaagtgtgactc

SEQ ID NO: 7453 - DNA, 19 bp, Homo sapiens
tgcatgtgtgcgtgtgact

SEQ ID NO: 7454 - DNA, 20 bp, Homo sapiens
attaccttcaaagtgtggct

SEQ ID NO: 7455 - DNA, 20 bp, Homo sapiens
tgcatcatgggtggagcagt

SEQ ID NO: 7456 - DNA, 21 bp, Homo sapiens
tgcagtatgggtacacagact

SEQ ID NO: 7457 - DNA, 23 bp, Homo sapiens
tgtgttatgggtcataggtactc

SEQ ID NO: 7458 - DNA, 18 bp, Homo sapiens
tcattgcaaagtgtggct

SEQ ID NO: 7459 - DNA, 18 bp, Homo sapiens
ttatgggtaggtgcgact

SEQ ID NO: 7460 - DNA, 15 bp, Homo sapiens
tgcatgtagtgtgac

SEQ ID NO: 7461 - DNA, 17 bp, Homo sapiens
tgattatgggtgggcat

SEQ ID NO: 7462 - DNA, 17 bp, Homo sapiens
tgcattatgggatggga

SEQ ID NO: 7463 - DNA, 19 bp, Homo sapiens
tgtattgtgaggtatgact

SEQ ID NO: 7464 - DNA, 16 bp, Homo sapiens
tgcttatgggtaatga

SEQ ID NO: 7465 - DNA, 20 bp, Homo sapiens
attgtgggtagctatgactc

SEQ ID NO: 7466 - DNA, 101 bp, Vaccinia virus
gatggagtcgtaaaaaagttttatctctttctctcttcgatggtctcacaaaaatattaaacctctttctgatggagtcgtaaaaaagttttatctctttc

SEQ ID NO: 7467 - DNA, 24 bp, Vaccinia virus
tgatggagtcgtaaaaaagtttta

SEQ ID NO: 7468 - DNA, 21 bp, Homo sapiens
tggtgaagttcataaagtttt

SEQ ID NO: 7469 - DNA, 23 bp, Homo sapiens
tgatggagttttagaaaaatttt

SEQ ID NO: 7470 - DNA, 23 bp, Homo sapiens
taatggaagtgtaggagagtttt

SEQ ID NO: 7471 - DNA, 19 bp, Homo sapiens
tgatggaatgcaaggtttt

SEQ ID NO: 7472 - DNA, 18 bp, Homo sapiens
tggcggagtcgtagaagc

SEQ ID NO: 7473 - DNA, 22 bp, Homo sapiens
tggtggagtcagtgaagaaatt

SEQ ID NO: 7474 - DNA, 131 bp, Equine herpesvirus 2
cccccgactccaacctcattcaaaatcccgcttgagttccgtaggggaagtgagtctggcgatttgagagacccctcgcttctcccagaactctagaccggtgttttgaagaatcttcgagagtctggggg

SEQ ID NO: 7475 - DNA, 24 bp, Equine herpesvirus 2
tcccagaactctagaccggtgttt

SEQ ID NO: 7476 - DNA, 17 bp, Homo sapiens
ccccagggaccggtgtt

SEQ ID NO: 7477 - DNA, 18 bp, Homo sapiens
tcccagaatctggattcc

SEQ ID NO: 7478 - DNA, 22 bp, Homo sapiens
tcccagaacttcagaccaggtt

SEQ ID NO: 7479 - DNA, 21 bp, Homo sapiens
cccggagctctagactccggc

SEQ ID NO: 7480 - DNA, 15 bp, Homo sapiens
agaactaccggtgtt

SEQ ID NO: 7481 - DNA, 20 bp, Homo sapiens
cagcaattctgacagtgttt

SEQ ID NO: 7482 - DNA, 21 bp, Homo sapiens
tcccagcgctctggatccggc

SEQ ID NO: 7483 - DNA, 21 bp, Homo sapiens
agatgctctagactggtgttt

SEQ ID NO: 7484 - DNA, 18 bp, Homo sapiens
tctcagaactctaatgct

SEQ ID NO: 7485 - DNA, 19 bp, Homo sapiens
tcccggggctctcggcgtt

SEQ ID NO: 7486 - DNA, 17 bp, Homo sapiens
gaactctagggctgttt

SEQ ID NO: 7487 - DNA, 124 bp, Vaccinia virus
acctctttctgatggagtcgtaaaaaagttttatctctttctctcttcgatggtctcacaaaaatattaaacctctttctgatggagtcgtaaaaaagttttatctctttctctcttcgatggt

SEQ ID NO: 7488 - DNA, 115 bp, Vaccinia virus
gatggtctcataaaaaaagttttacaaaaatatttttattctctttctctctttgatggtctcataaaaaaagttttacaaaaatatttttattctctttctctctttgatggtc

SEQ ID NO: 7489 - DNA, 24 bp, Vaccinia virus
ataaaaaaagttttacaaaaatat

SEQ ID NO: 7490 - DNA, 21 bp, Homo sapiens
aaaaagcagccacaaaaatat

SEQ ID NO: 7491 - DNA, 21 bp, Homo sapiens
aaaaaagccttataaaaatat

SEQ ID NO: 7492 - DNA, 24 bp, Homo sapiens
taaaaaaagctactacaaagatat

SEQ ID NO: 7493 - DNA, 23 bp, Homo sapiens
acaaatacattttacaaaaatat

SEQ ID NO: 7494 - DNA, 25 bp, Homo sapiens
aaaaaagcaattgttacaaaaatat

SEQ ID NO: 7495 - DNA, 20 bp, Homo sapiens
gaaaaaaaagttttacaaaa

SEQ ID NO: 7496 - DNA, 22 bp, Homo sapiens
aaaaaaagtaagacaaaaatat

SEQ ID NO: 7497 - DNA, 22 bp, Homo sapiens
acaaaaaaagcctcagaaatat

SEQ ID NO: 7498 - DNA, 67 bp, Variola virus
tgtgggaaacgggcatggaggatgaattatcgttattattatttaaagcctcccattcggattcaca

SEQ ID NO: 7499 - DNA, 22 bp, Variola virus
aagcctcccattcggattcaca

SEQ ID NO: 7500 - DNA, 17 bp, Homo sapiens
aagcctccttgactcac

SEQ ID NO: 7501 - DNA, 16 bp, Homo sapiens
agtcctcccatttcac

SEQ ID NO: 7502 - DNA, 19 bp, Homo sapiens
agccttacattcaaatgca

SEQ ID NO: 7503 - DNA, 15 bp, Homo sapiens
ctctccaaattcaca

SEQ ID NO: 7504 - DNA, 16 bp, Homo sapiens
agcctcccgttggccc

SEQ ID NO: 7505 - DNA, 16 bp, Homo sapiens
aagcctccaggttcac

SEQ ID NO: 7506 - DNA, 17 bp, Homo sapiens
agcttccctagttcaca

SEQ ID NO: 7507 - DNA, 20 bp, Homo sapiens
aagcctccagttcactcaca

SEQ ID NO: 7508 - DNA, 19 bp, Homo sapiens
aagccccccaatctgattc

SEQ ID NO: 7509 - DNA, 18 bp, Homo sapiens
gcttcccactcagtccac

SEQ ID NO: 7510 - DNA, 18 bp, Homo sapiens
aagcctcccgggcttcac

SEQ ID NO: 7511 - DNA, 16 bp, Homo sapiens
aactctcccattccac

SEQ ID NO: 7512 - DNA, 20 bp, Homo sapiens
aagcctcctctttggcccca

SEQ ID NO: 7513 - DNA, 21 bp, Homo sapiens
aagtttcccttccaaatcaca

SEQ ID NO: 7514 - DNA, 18 bp, Homo sapiens
ggacctctccgattcaca

SEQ ID NO: 7515 - DNA, 20 bp, Homo sapiens
aaccctcccattccgttcac

SEQ ID NO: 7516 - DNA, 15 bp, Homo sapiens
aaacctcccagaatt

SEQ ID NO: 7517 - DNA, 23 bp, Homo sapiens
agtctcccattagcccaggttca

SEQ ID NO: 7518 - DNA, 19 bp, Homo sapiens
ctcccactagaaattcaca

SEQ ID NO: 7519 - DNA, 18 bp, Homo sapiens
aagccccctattcgctcc

SEQ ID NO: 7520 - DNA, 18 bp, Homo sapiens
aagcccccgttcggctcc

SEQ ID NO: 7521 - DNA, 18 bp, Homo sapiens
agctctcccattgcccac

SEQ ID NO: 7522 - DNA, 18 bp, Homo sapiens
aaacctcttccccagatt

SEQ ID NO: 7523 - DNA, 25 bp, Homo sapiens
agcctcccaagtagttgggtttaca

SEQ ID NO: 7524 - DNA, 17 bp, Homo sapiens
aagcctcctatgctcac

SEQ ID NO: 7525 - DNA, 17 bp, Homo sapiens
agcctcccttttggttc

SEQ ID NO: 7526 - DNA, 19 bp, Homo sapiens
gcctcccattcctaacaca

SEQ ID NO: 7527 - DNA, 16 bp, Homo sapiens
aagccacccaggttca

SEQ ID NO: 7528 - DNA, 19 bp, Homo sapiens
gcctcccgcagctttcgca

SEQ ID NO: 7529 - DNA, 16 bp, Homo sapiens
aagactcccatttcac

SEQ ID NO: 7530 - DNA, 20 bp, Homo sapiens
aagctgcccattcggacaca

SEQ ID NO: 7531 - DNA, 17 bp, Homo sapiens
aagcctccatttgccac

SEQ ID NO: 7532 - DNA, 20 bp, Homo sapiens
gcttcctatttccatccaca

SEQ ID NO: 7533 - DNA, 19 bp, Homo sapiens
agcccccattcccctccac

SEQ ID NO: 7534 - DNA, 20 bp, Homo sapiens
agcttacatccagatttaca

SEQ ID NO: 7535 - DNA, 20 bp, Homo sapiens
gccttccacacacattcaca

SEQ ID NO: 7536 - DNA, 17 bp, Homo sapiens
aagcctcccgctgaact

SEQ ID NO: 7537 - DNA, 17 bp, Homo sapiens
aagcctttattcaaacc

SEQ ID NO: 7538 - DNA, 19 bp, Homo sapiens
aagcctcccaatcccaaac

SEQ ID NO: 7539 - DNA, 23 bp, Homo sapiens
agcctcccgttctacccctcaca

SEQ ID NO: 7540 - DNA, 25 bp, Homo sapiens
agcctcccaaagtgctgggtttaca

SEQ ID NO: 7541 - DNA, 16 bp, Homo sapiens
gcctttccaaattcac

SEQ ID NO: 7542 - DNA, 20 bp, Homo sapiens
agactcctctgggattcaca

SEQ ID NO: 7543 - DNA, 16 bp, Homo sapiens
agctcccattttccac

SEQ ID NO: 7544 - DNA, 21 bp, Homo sapiens
aagcttcatcaaagattcaca

SEQ ID NO: 7545 - DNA, 18 bp, Homo sapiens
ctcccatttggcctccca

SEQ ID NO: 7546 - DNA, 22 bp, Homo sapiens
aagtcccccagacttttggatt

SEQ ID NO: 7547 - DNA, 20 bp, Homo sapiens
agcctcccataaagatttac

SEQ ID NO: 7548 - DNA, 24 bp, Homo sapiens
gcctcccaaagtgctggatttaca

SEQ ID NO: 7549 - DNA, 19 bp, Homo sapiens
aagccccccattcaccaca

SEQ ID NO: 7550 - DNA, 21 bp, Homo sapiens
gccttccatccatgattcaca

SEQ ID NO: 7551 - DNA, 19 bp, Homo sapiens
agctcttctccagattcac

SEQ ID NO: 7552 - DNA, 17 bp, Homo sapiens
aagtctcccacttttca

SEQ ID NO: 7553 - DNA, 21 bp, Homo sapiens
agcctcccatgtggccctcca

SEQ ID NO: 7554 - DNA, 20 bp, Homo sapiens
aagccccctgtgaggttcac

SEQ ID NO: 7555 - DNA, 21 bp, Homo sapiens
aagcctcctcacattggttca

SEQ ID NO: 7556 - DNA, 18 bp, Homo sapiens
aagcctcccttccaccca

SEQ ID NO: 7557 - DNA, 19 bp, Homo sapiens
agcttttcctggattcaca

SEQ ID NO: 7558 - DNA, 15 bp, Homo sapiens
cccccattggccaca

SEQ ID NO: 7559 - DNA, 16 bp, Homo sapiens
gcctcccatccatcac

SEQ ID NO: 7560 - DNA, 16 bp, Homo sapiens
agcccccatttcccac

SEQ ID NO: 7561 - DNA, 20 bp, Homo sapiens
cccccatcatggtatttaca

SEQ ID NO: 7562 - DNA, 19 bp, Homo sapiens
acctcccatgggtgttcac

SEQ ID NO: 7563 - DNA, 16 bp, Homo sapiens
gcccccattcattcac

SEQ ID NO: 7564 - DNA, 18 bp, Homo sapiens
ctcccttcccgattcaca

SEQ ID NO: 7565 - DNA, 21 bp, Homo sapiens
aagcctactgtccaattcaca

SEQ ID NO: 7566 - DNA, 18 bp, Homo sapiens
acctcccatgggtgttca

SEQ ID NO: 7567 - DNA, 22 bp, Homo sapiens
agtctctcttcctggattcaca

SEQ ID NO: 7568 - DNA, 18 bp, Homo sapiens
aagcctcccatacttcag

SEQ ID NO: 7569 - DNA, 21 bp, Homo sapiens
aactctcccattaaaaacaca

SEQ ID NO: 7570 - DNA, 18 bp, Homo sapiens
aagcctcccatcctccca

SEQ ID NO: 7571 - DNA, 19 bp, Homo sapiens
aacctcccccacatttaca

SEQ ID NO: 7572 - DNA, 24 bp, Homo sapiens
agctccccattcgaggccttcaca

SEQ ID NO: 7573 - DNA, 17 bp, Homo sapiens
gcctccattcaaacaca

SEQ ID NO: 7574 - DNA, 17 bp, Homo sapiens
aacttcctcaaattcac

SEQ ID NO: 7575 - DNA, 19 bp, Homo sapiens
agctctcctaagattcaca

SEQ ID NO: 7576 - DNA, 19 bp, Homo sapiens
aagccctttaagattcaca

SEQ ID NO: 7577 - DNA, 19 bp, Homo sapiens
aagcctccaatggctcgca

SEQ ID NO: 7578 - DNA, 20 bp, Homo sapiens
aagcctcctctcggaattca

SEQ ID NO: 7579 - DNA, 18 bp, Homo sapiens
gcatcccattcaatcaca

SEQ ID NO: 7580 - DNA, 20 bp, Homo sapiens
agtctcttgtccagtccaca

SEQ ID NO: 7581 - DNA, 16 bp, Homo sapiens
gcctctcccgttcaca

SEQ ID NO: 7582 - DNA, 21 bp, Homo sapiens
aagcctccccacacctgttca

SEQ ID NO: 7583 - DNA, 19 bp, Homo sapiens
ctcccattgcatattcaca

SEQ ID NO: 7584 - DNA, 71 bp, Equine herpesvirus 2
cgcgttagtggtccgtgggaagctaagttggccattggagacacctagcttgcacagaccactaccacgcg

SEQ ID NO: 7585 - DNA, 24 bp, Equine herpesvirus 2
ttagtggtccgtgggaagctaagt

SEQ ID NO: 7586 - DNA, 24 bp, Homo sapiens
tagtggtcagtccaggagctaggt

SEQ ID NO: 7587 - DNA, 18 bp, Homo sapiens
ttagggacgggagctaag

SEQ ID NO: 7588 - DNA, 19 bp, Homo sapiens
gtggtgtgggaagttgagt

SEQ ID NO: 7589 - DNA, 21 bp, Homo sapiens
tggcaacgtgggaagctgagt

SEQ ID NO: 7590 - DNA, 130 bp, Vaccinia virus
ttaaacctctttctgatggagtcgtaaaaaagttttatctctttctccttcgatggtctcacaaaaatattaaacctctttctgatggagtcgtaaaaaagttttatctctttctcctttctcacaaaaa

SEQ ID NO: 7591 - DNA, 24 bp, Vaccinia virus
cgtaaaaaagttttatctctttct

SEQ ID NO: 7592 - DNA, 21 bp, Homo sapiens
taaaaaaacacttctctttct

SEQ ID NO: 7593 - DNA, 20 bp, Homo sapiens
gtcgaaagtgctctctttct

SEQ ID NO: 7594 - DNA, 23 bp, Homo sapiens
gtaggcaaagttttcctctttct

SEQ ID NO: 7595 - DNA, 23 bp, Homo sapiens
gtaaaatggtttgagctctttct

SEQ ID NO: 7596 - DNA, 21 bp, Homo sapiens
gcaaggagaatgtctctttct

SEQ ID NO: 7597 - DNA, 22 bp, Homo sapiens
gtaaaaaagtcatattttttct

SEQ ID NO: 7598 - DNA, 18 bp, Homo sapiens
ataaaaaagtattctttc

SEQ ID NO: 7599 - DNA, 22 bp, Homo sapiens
taaaaaagaaagatctctttct

SEQ ID NO: 7600 - DNA, 17 bp, Homo sapiens
gtaaaatttatctcttt

SEQ ID NO: 7601 - DNA, 23 bp, Homo sapiens
gtcgaaaagctcattttctttct

SEQ ID NO: 7602 - DNA, 17 bp, Homo sapiens
gtaagaaagctctcctt

SEQ ID NO: 7603 - DNA, 23 bp, Homo sapiens
gtgaaaaccaggcatctctttct

SEQ ID NO: 7604 - DNA, 21 bp, Homo sapiens
atagaaaagaattctctttct

SEQ ID NO: 7605 - DNA, 76 bp, Equine herpesvirus 2
gataccgcgtaagatagaaagggttggctatgtgtctctggtaaacatagttacactttcctatcttcgcggtgtt

SEQ ID NO: 7606 - DNA, 24 bp, Equine herpesvirus 2
tacactttcctatcttcgcggtgt

SEQ ID NO: 7607 - DNA, 16 bp, Homo sapiens
tttcccatcttagtgt

SEQ ID NO: 7608 - DNA, 21 bp, Homo sapiens
taactttcctattttgcttgt

SEQ ID NO: 7609 - DNA, 20 bp, Homo sapiens
cactttcctgtcttcaaaat

SEQ ID NO: 7610 - DNA, 23 bp, Homo sapiens
cttttctatctccaatctggtgt

SEQ ID NO: 7611 - DNA, 18 bp, Homo sapiens
taactttcctatcttcca

SEQ ID NO: 7612 - DNA, 33 bp, Homo sapiens
tacactttttttgctgttgtttttgcggtgtac

SEQ ID NO: 7613 - DNA, 22 bp, Homo sapiens
tacattttcttattttcacagt

SEQ ID NO: 7614 - DNA, 25 bp, Homo sapiens
tacacttttcaattttgagccatgt

SEQ ID NO: 7615 - DNA, 21 bp, Homo sapiens
tacactttttttctttccagt

SEQ ID NO: 7616 - DNA, 20 bp, Homo sapiens
tacattcctatcagtggtgt

SEQ ID NO: 7617 - DNA, 96 bp, Vaccinia virus
ggagtcataaaatatttttattctctttctctcttcgatggtctcacaaaaatattaaacctctttctgatggagtcgtaaaaaagttttatctct

SEQ ID NO: 7618 - DNA, 24 bp, Vaccinia virus
taaaatatttttattctctttctc

SEQ ID NO: 7619 - DNA, 18 bp, Homo sapiens
aaatattgttctctttct

SEQ ID NO: 7620 - DNA, 21 bp, Homo sapiens
taaaatactttaaatctttct

SEQ ID NO: 7621 - DNA, 17 bp, Homo sapiens
aaaacacttctctttct

SEQ ID NO: 7622 - DNA, 22 bp, Homo sapiens
aaaatatttcatttctctttct

SEQ ID NO: 7623 - DNA, 21 bp, Homo sapiens
taaaataatttgccctttctc

SEQ ID NO: 7624 - DNA, 18 bp, Homo sapiens
taaaatattttaattctc

SEQ ID NO: 7625 - DNA, 16 bp, Homo sapiens
tatctctctctttctc

SEQ ID NO: 7626 - DNA, 18 bp, Homo sapiens
taaaatatttttctcttt

SEQ ID NO: 7627 - DNA, 22 bp, Homo sapiens
taaaatatttttattgcttttc

SEQ ID NO: 7628 - DNA, 22 bp, Homo sapiens
tgacatagaccttctctttctc

SEQ ID NO: 7629 - DNA, 18 bp, Homo sapiens
taaaatatcttctttctc

SEQ ID NO: 7630 - DNA, 18 bp, Homo sapiens
taaaatctttttattctc

SEQ ID NO: 7631 - DNA, 18 bp, Homo sapiens
taaaatagttttattctc

SEQ ID NO: 7632 - DNA, 20 bp, Homo sapiens
atatttttgttcccaatctc

SEQ ID NO: 7633 - DNA, 18 bp, Homo sapiens
atatttctttctctttct

SEQ ID NO: 7634 - DNA, 24 bp, Homo sapiens
aaaatatttcacctgctctttctc

SEQ ID NO: 7635 - DNA, 18 bp, Homo sapiens
taaattatttttattctc

SEQ ID NO: 7636 - DNA, 81 bp, Molluscum contagiosum virus
tctcggtccacgagggaagcgtcaccctgacactggtctcagggcttgtctcgtcggtgaatccctttgtcccttccgaga

SEQ ID NO: 7637 - DNA, 20 bp, Molluscum contagiosum virus
tccctttgtcccttccgaga

SEQ ID NO: 7638 - DNA, 18 bp, Homo sapiens
tcccttcgtttcattaga

SEQ ID NO: 7639 - DNA, 17 bp, Homo sapiens
cctctttgccctctgag

SEQ ID NO: 7640 - DNA, 18 bp, Homo sapiens
tccttctgtcccttctga

SEQ ID NO: 7641 - DNA, 16 bp, Homo sapiens
cctttctcccccaaga

SEQ ID NO: 7642 - DNA, 20 bp, Homo sapiens
tccctttgctcttcaaaaga

SEQ ID NO: 7643 - DNA, 18 bp, Homo sapiens
tccctttgcctttaaaga

SEQ ID NO: 7644 - DNA, 18 bp, Homo sapiens
tccccttagcattccgag

SEQ ID NO: 7645 - DNA, 17 bp, Homo sapiens
cccctgccattccgaga

SEQ ID NO: 7646 - DNA, 20 bp, Homo sapiens
cccctttgttctaagccaga

SEQ ID NO: 7647 - DNA, 17 bp, Homo sapiens
tccctctgtctcgcgga

SEQ ID NO: 7648 - DNA, 19 bp, Homo sapiens
tcccttcgtcttccccaag

SEQ ID NO: 7649 - DNA, 22 bp, Homo sapiens
ccccctccccttttttttgaga

SEQ ID NO: 7650 - DNA, 18 bp, Homo sapiens
tctctctgtccttctcag

SEQ ID NO: 7651 - DNA, 17 bp, Homo sapiens
tccctttggttctcgga

SEQ ID NO: 7652 - DNA, 19 bp, Homo sapiens
tccctttgttccttttaga

SEQ ID NO: 7653 - DNA, 19 bp, Homo sapiens
tccctttgtatatcagaga

SEQ ID NO: 7654 - DNA, 15 bp, Homo sapiens
cctctgtcccccaga

SEQ ID NO: 7655 - DNA, 18 bp, Homo sapiens
tctccttaacttccgaga

SEQ ID NO: 7656 - DNA, 21 bp, Homo sapiens
tccctccatatcctttctgag

SEQ ID NO: 7657 - DNA, 17 bp, Homo sapiens
tccacccccttctgaga

SEQ ID NO: 7658 - DNA, 17 bp, Homo sapiens
tctctttgtcctcaaag

SEQ ID NO: 7659 - DNA, 20 bp, Homo sapiens
cccctgcctactttctgaga

SEQ ID NO: 7660 - DNA, 18 bp, Homo sapiens
tccctgacaccttccgag

SEQ ID NO: 7661 - DNA, 17 bp, Homo sapiens
ccgccgcccttccgaga

SEQ ID NO: 7662 - DNA, 19 bp, Homo sapiens
cccagccagccttccgaga

SEQ ID NO: 7663 - DNA, 19 bp, Homo sapiens
cccctttgttccccaaaga

SEQ ID NO: 7664 - DNA, 20 bp, Homo sapiens
tccctttgtacttaccatag

SEQ ID NO: 7665 - DNA, 18 bp, Homo sapiens
tctctttattcttccgag

SEQ ID NO: 7666 - DNA, 19 bp, Homo sapiens
tccttttgcttctccaaga

SEQ ID NO: 7667 - DNA, 19 bp, Homo sapiens
ccctccggtctttccgaga

SEQ ID NO: 7668 - DNA, 18 bp, Homo sapiens
tctcctcgggttccgaga

SEQ ID NO: 7669 - DNA, 18 bp, Homo sapiens
tccctttgccccccgaga

SEQ ID NO: 7670 - DNA, 18 bp, Homo sapiens
cctctttgtcttcaaaga

SEQ ID NO: 7671 - DNA, 17 bp, Homo sapiens
tcgtttcgtttccgaga

SEQ ID NO: 7672 - DNA, 18 bp, Homo sapiens
cctctgtcctccctgaga

SEQ ID NO: 7673 - DNA, 18 bp, Homo sapiens
tctctttcttcccccgag

SEQ ID NO: 7674 - DNA, 16 bp, Homo sapiens
tccctttggcctgaga

SEQ ID NO: 7675 - DNA, 17 bp, Homo sapiens
tcccattgtgttcgaga

SEQ ID NO: 7676 - DNA, 18 bp, Homo sapiens
tcccttgtctctttgaga

SEQ ID NO: 7677 - DNA, 19 bp, Homo sapiens
tccctttgtgccatccgag

SEQ ID NO: 7678 - DNA, 18 bp, Homo sapiens
tccctttgccacccagag

SEQ ID NO: 7679 - DNA, 19 bp, Homo sapiens
tccctttggccccccgaga

SEQ ID NO: 7680 - DNA, 18 bp, Homo sapiens
cctttgtaccccaaaaga

SEQ ID NO: 7681 - DNA, 16 bp, Homo sapiens
tcctgtccctttgaga

SEQ ID NO: 7682 - DNA, 23 bp, Homo sapiens
tccccctcccagtttcttctgag

SEQ ID NO: 7683 - DNA, 16 bp, Homo sapiens
cccttccccttccgag

SEQ ID NO: 7684 - DNA, 16 bp, Homo sapiens
cctttgtcctcccgga

SEQ ID NO: 7685 - DNA, 18 bp, Homo sapiens
ctttttcagccttccgag

SEQ ID NO: 7686 - DNA, 18 bp, Homo sapiens
tctctttgtccctttaga

SEQ ID NO: 7687 - DNA, 17 bp, Homo sapiens
ccctacgacttccgaga

SEQ ID NO: 7688 - DNA, 18 bp, Homo sapiens
cctttatctctccagaga

SEQ ID NO: 7689 - DNA, 19 bp, Homo sapiens
ctttctcgcctttccgaga

SEQ ID NO: 7690 - DNA, 17 bp, Homo sapiens
tccctctgtccctaaga

SEQ ID NO: 7691 - DNA, 16 bp, Homo sapiens
tccctctgtttctcga

SEQ ID NO: 7692 - DNA, 22 bp, Homo sapiens
tccctctcatttctttttgaga

SEQ ID NO: 7693 - DNA, 20 bp, Homo sapiens
tccctttgcattttccggga

SEQ ID NO: 7694 - DNA, 17 bp, Homo sapiens
ccccttttattccgaga

SEQ ID NO: 7695 - DNA, 18 bp, Homo sapiens
tcctttctgtcccccaag

SEQ ID NO: 7696 - DNA, 21 bp, Homo sapiens
tccctttgcttctttccttga

SEQ ID NO: 7697 - DNA, 19 bp, Homo sapiens
tccctattgtggcccggga

SEQ ID NO: 7698 - DNA, 17 bp, Homo sapiens
tcccttttctgccaaaa

SEQ ID NO: 7699 - DNA, 22 bp, Homo sapiens
ccctttgctctgcccttctgag

SEQ ID NO: 7700 - DNA, 22 bp, Homo sapiens
tccccacaccctccttccggga

SEQ ID NO: 7701 - DNA, 19 bp, Homo sapiens
tcccttctctcttccgaga

SEQ ID NO: 7702 - DNA, 18 bp, Homo sapiens
tctttctgtcccacaaga

SEQ ID NO: 7703 - DNA, 18 bp, Homo sapiens
tcccttttcctctccgga

SEQ ID NO: 7704 - DNA, 17 bp, Homo sapiens
tccctttggctccaaga

SEQ ID NO: 7705 - DNA, 20 bp, Homo sapiens
tccctttgtgcttcctgaga

SEQ ID NO: 7706 - DNA, 19 bp, Homo sapiens
tcccttttccccttctgag

SEQ ID NO: 7707 - DNA, 20 bp, Homo sapiens
tcccctcgccgcttccggga

SEQ ID NO: 7708 - DNA, 18 bp, Homo sapiens
tctctttgtccattctga

SEQ ID NO: 7709 - DNA, 20 bp, Homo sapiens
tccctttatttcttaataga

SEQ ID NO: 7710 - DNA, 20 bp, Homo sapiens
tcctcttggtccttttgaga

SEQ ID NO: 7711 - DNA, 16 bp, Homo sapiens
tccctttgctttccga

SEQ ID NO: 7712 - DNA, 18 bp, Homo sapiens
cctttggtcccctctgag

SEQ ID NO: 7713 - DNA, 22 bp, Homo sapiens
tccctttgtttctactaagaga

SEQ ID NO: 7714 - DNA, 19 bp, Homo sapiens
cctctgtccctaacacaga

SEQ ID NO: 7715 - DNA, 18 bp, Homo sapiens
tccctttgcccacgtaga

SEQ ID NO: 7716 - DNA, 20 bp, Homo sapiens
cccctcacaggcttccgaga

SEQ ID NO: 7717 - DNA, 20 bp, Homo sapiens
tccagcacatctttccgaga

SEQ ID NO: 7718 - DNA, 17 bp, Homo sapiens
tccctttgcctcacaga

SEQ ID NO: 7719 - DNA, 16 bp, Homo sapiens
ccttttgtcccttaag

SEQ ID NO: 7720 - DNA, 17 bp, Homo sapiens
tccctatgtcccccaga

SEQ ID NO: 7721 - DNA, 19 bp, Homo sapiens
tccctctgtctcctccaga

SEQ ID NO: 7722 - DNA, 19 bp, Homo sapiens
cctagtgtcccttccggga

SEQ ID NO: 7723 - DNA, 17 bp, Homo sapiens
tccatttgcccctgaga

SEQ ID NO: 7724 - DNA, 18 bp, Homo sapiens
tctctctgtccctcctca

SEQ ID NO: 7725 - DNA, 20 bp, Homo sapiens
ctttatccattcatctgaga

SEQ ID NO: 7726 - DNA, 20 bp, Homo sapiens
tctccttgtcctcctctgag

SEQ ID NO: 7727 - DNA, 17 bp, Homo sapiens
tccctttttcttccaag

SEQ ID NO: 7728 - DNA, 21 bp, Homo sapiens
tcactttgcgtgtcttctgag

SEQ ID NO: 7729 - DNA, 19 bp, Homo sapiens
tccctttgtcattcttaga

SEQ ID NO: 7730 - DNA, 21 bp, Homo sapiens
tccctctgtctctgtaaaaga

SEQ ID NO: 7731 - DNA, 15 bp, Homo sapiens
tccctctgtctccag

SEQ ID NO: 7732 - DNA, 16 bp, Homo sapiens
ccctttgttctccaga

SEQ ID NO: 7733 - DNA, 20 bp, Homo sapiens
tccccttgaaatactccgag

SEQ ID NO: 7734 - DNA, 18 bp, Homo sapiens
cctctgtctctttctgag

SEQ ID NO: 7735 - DNA, 18 bp, Homo sapiens
tccctctgtgacccggga

SEQ ID NO: 7736 - DNA, 21 bp, Homo sapiens
cctttgtcccctccactgaga

SEQ ID NO: 7737 - DNA, 17 bp, Homo sapiens
cctttgtccatcagaga

SEQ ID NO: 7738 - DNA, 18 bp, Homo sapiens
cccttgtctacccctgag

SEQ ID NO: 7739 - DNA, 20 bp, Homo sapiens
tcccttctgaatctccgaga

SEQ ID NO: 7740 - DNA, 18 bp, Homo sapiens
cctctgccgcttttgaga

SEQ ID NO: 7741 - DNA, 16 bp, Homo sapiens
tcccctcccttctgag

SEQ ID NO: 7742 - DNA, 21 bp, Homo sapiens
cctctgtccaattccctgaga

SEQ ID NO: 7743 - DNA, 20 bp, Homo sapiens
tctccttgggctttccgaga

SEQ ID NO: 7744 - DNA, 17 bp, Homo sapiens
tcccttcgttttctaga

SEQ ID NO: 7745 - DNA, 19 bp, Homo sapiens
tccctttgccagccagaga

SEQ ID NO: 7746 - DNA, 16 bp, Homo sapiens
tcctcttgcccctgag

SEQ ID NO: 7747 - DNA, 17 bp, Homo sapiens
cctttgtcccctgcaga

SEQ ID NO: 7748 - DNA, 23 bp, Homo sapiens
tctttttgtccccaagttccgag

SEQ ID NO: 7749 - DNA, 84 bp, Equine herpesvirus 2
gaaatgccgcgtgatatccctatggttcagttggttgttatgtaaaagagaccagctttccaggggatacacacacggcgtttt

SEQ ID NO: 7750 - DNA, 24 bp, Equine herpesvirus 2
tatccctatggttcagttggttgt

SEQ ID NO: 7751 - DNA, 19 bp, Homo sapiens
tgtgtctttagttggttgt

SEQ ID NO: 7752 - DNA, 18 bp, Homo sapiens
ctcgagctggttggttgt

SEQ ID NO: 7753 - DNA, 18 bp, Homo sapiens
catctctatggtttattg

SEQ ID NO: 7754 - DNA, 17 bp, Homo sapiens
ccatgtaaattggttgt

SEQ ID NO: 7755 - DNA, 18 bp, Homo sapiens
tcccatggctctggttgt

SEQ ID NO: 7756 - DNA, 122 bp, Vaccinia virus
acctctttctgatggagtcgtaaaaaagttttatctttctctcttcgatggtctcacaaaaatattaaacctctttctgatggagtcgtaaaaaagttttatctctttctctcttcgatggt

SEQ ID NO: 7757 - DNA, 24 bp, Vaccinia virus
cgtaaaaaagttttatctttctct

SEQ ID NO: 7758 - DNA, 23 bp, Homo sapiens
gtggggcaagtcagactttctct

SEQ ID NO: 7759 - DNA, 22 bp, Homo sapiens
cgcagaacagttgtctttctct

SEQ ID NO: 7760 - DNA, 18 bp, Homo sapiens
tgaaaaaagacctttctc

SEQ ID NO: 7761 - DNA, 20 bp, Homo sapiens
aaaagctaaaatctttctct

SEQ ID NO: 7762 - DNA, 18 bp, Homo sapiens
aaacccttgtctttctct

SEQ ID NO: 7763 - DNA, 20 bp, Homo sapiens
tagaaaagcctgctttctct

SEQ ID NO: 7764 - DNA, 20 bp, Homo sapiens
gtaaaaagatttacctttct

SEQ ID NO: 7765 - DNA, 25 bp, Homo sapiens
gtaaggaattttacaaactttctct

SEQ ID NO: 7766 - DNA, 19 bp, Homo sapiens
ataaaaaagtattctttct

SEQ ID NO: 7767 - DNA, 18 bp, Homo sapiens
gtaggaagtttctttctc

SEQ ID NO: 7768 - DNA, 19 bp, Homo sapiens
aaaaagcaagactttctct

SEQ ID NO: 7769 - DNA, 96 bp, Equine herpesvirus 2
ggtggggggttcagagtgaacgaggagaggtattgcagtgattctctgtgagatatttcaacaccacccctcgttcagtccgagttcccaaacacc

SEQ ID NO: 7770 - DNA, 24 bp, Equine herpesvirus 2
aggtattgcagtgattctctgtga

SEQ ID NO: 7771 - DNA, 20 bp, Homo sapiens
ctgttgtaatggctctgtga

SEQ ID NO: 7772 - DNA, 18 bp, Homo sapiens
ggtttgcagtggcctgtg

SEQ ID NO: 7773 - DNA, 22 bp, Homo sapiens
ggtatgtcacttttctctgtga

SEQ ID NO: 7774 - DNA, 22 bp, Homo sapiens
agttattgcaggttatttgtga

SEQ ID NO: 7775 - DNA, 17 bp, Homo sapiens
ggtttacattctctgtg

SEQ ID NO: 7776 - DNA, 19 bp, Homo sapiens
ggaggcatgattctctgtg

SEQ ID NO: 7777 - DNA, 20 bp, Homo sapiens
aggtattgctgtgacaggtg

SEQ ID NO: 7778 - DNA, 18 bp, Homo sapiens
ggtgttgcagtggtttcc

SEQ ID NO: 7779 - DNA, 19 bp, Homo sapiens
aggtattctgtgctctgtg

SEQ ID NO: 7780 - DNA, 18 bp, Homo sapiens
aggtactgcttttctgtg

SEQ ID NO: 7781 - DNA, 122 bp, Vaccinia virus
acctctttctgatggagtcgtaaaaaagttttatctctttctctcttcgatggtctcacaaaaatattaaacctctttctgatggagtcgtaaaaaagttttatctttctctcttcgatggt

SEQ ID NO: 7782 - DNA, 85 bp, Equine herpesvirus 2
cgcgaaacactgaatcaagatctcacctcactgtagttgtgcctgtgacaatccagtgctgtgagatcttgtgcagtgttttgtg

SEQ ID NO: 7783 - DNA, 24 bp, Equine herpesvirus 2
tccagtgctgtgagatcttgtgca

SEQ ID NO: 7784 - DNA, 18 bp, Homo sapiens
cagtgctgtgcagatgcc

SEQ ID NO: 7785 - DNA, 22 bp, Homo sapiens
cagtttagtttcatcttgtgca

SEQ ID NO: 7786 - DNA, 18 bp, Homo sapiens
gtgctgtggtgctgtgca

SEQ ID NO: 7787 - DNA, 21 bp, Homo sapiens
cagttctgtctgacttgtgca

SEQ ID NO: 7788 - DNA, 20 bp, Homo sapiens
tccggcgctgtgggcctgcg

SEQ ID NO: 7789 - DNA, 25 bp, Homo sapiens
tctggtgctatggccagaatgtgtg

SEQ ID NO: 7790 - DNA, 21 bp, Homo sapiens
tccagggttgtgagtcctgta

SEQ ID NO: 7791 - DNA, 22 bp, Homo sapiens
tccagtgctggaatccagtgca

SEQ ID NO: 7792 - DNA, 19 bp, Homo sapiens
cctggtgctgtgagatggc

SEQ ID NO: 7793 - DNA, 19 bp, Homo sapiens
tccagtctgtgggaagtgc

SEQ ID NO: 7794 - DNA, 19 bp, Homo sapiens
aggctgcttgtcttgtgca

SEQ ID NO: 7795 - DNA, 23 bp, Homo sapiens
cccagtgctgtgggggccaagca

SEQ ID NO: 7796 - DNA, 21 bp, Homo sapiens
gtgctgtggggccacactgtg

SEQ ID NO: 7797 - DNA, 22 bp, Homo sapiens
tccagtgcatgtgactggtgca

SEQ ID NO: 7798 - DNA, 19 bp, Homo sapiens
tccatgctgtgagattgta

SEQ ID NO: 7799 - DNA, 17 bp, Homo sapiens
tccagtcttatcttgtg

SEQ ID NO: 7800 - DNA, 21 bp, Homo sapiens
cagtgctgggtgtcttgtgca

SEQ ID NO: 7801 - DNA, 83 bp, Equine herpesvirus 2
gatgctgtgggacagcgcatagagtgtctgagttctggtaatggagggatctccaggcactctatgcactgcttcgcagcgtc

SEQ ID NO: 7802 - DNA, 24 bp, Equine herpesvirus 2
cactctatgcactgcttcgcagcg

SEQ ID NO: 7803 - DNA, 20 bp, Homo sapiens
ctctgtgtcctgcctcggcg

SEQ ID NO: 7804 - DNA, 18 bp, Homo sapiens
tatgcgcggatcgcagcg

SEQ ID NO: 7805 - DNA, 18 bp, Homo sapiens
actctatgctgctgtggc

SEQ ID NO: 7806 - DNA, 21 bp, Homo sapiens
cccagtggctgcttcgtggcg

SEQ ID NO: 7807 - DNA, 18 bp, Homo sapiens
cactctggcatcacagca

SEQ ID NO: 7808 - DNA, 20 bp, Homo sapiens
cactctgtgtctgctttcag

SEQ ID NO: 7809 - DNA, 85 bp, Equine herpesvirus 2
gcaagatcccgcatgagtccctctgagccgttagttgtgatatacttatcactaactagcttagagagtctctcacggtgtctgc

SEQ ID NO: 7810 - DNA, 24 bp, Equine herpesvirus 2
tagcttagagagtctctcacggtg

SEQ ID NO: 7811 - DNA, 19 bp, Homo sapiens
gcctgggtcgctcacggtg

SEQ ID NO: 7812 - DNA, 19 bp, Homo sapiens
gcctggagagtctttacag

SEQ ID NO: 7813 - DNA, 23 bp, Homo sapiens
taacttaggggccgggcgcggtg

SEQ ID NO: 7814 - DNA, 20 bp, Homo sapiens
gctgagaaaatctcacggtg

SEQ ID NO: 7815 - DNA, 120 bp, Equine herpesvirus 2
ccccatcgtcctccagcagaggcgccgcgtgctgttctgtagtgaaattatgctggttatgtaatgcaaaatttcactacagcagcgcatcggcgccttatgaacacttggaagatgggg

SEQ ID NO: 7816 - DNA, 24 bp, Equine herpesvirus 2
cagcagcgcatcggcgccttatga

SEQ ID NO: 7817 - DNA, 21 bp, Homo sapiens
cagcagctccctggccttatg

SEQ ID NO: 7818 - DNA, 24 bp, Homo sapiens
cagcagccatcggcgccagcatga

SEQ ID NO: 7819 - DNA, 19 bp, Homo sapiens
aacggcgtgctaccttatg

SEQ ID NO: 7820 - DNA, 19 bp, Homo sapiens
cagcagcgtggcggcgacg

SEQ ID NO: 7821 - DNA, 21 bp, Homo sapiens
cagcagcgtagtgccttgtga

SEQ ID NO: 7822 - DNA, 65 bp, Equine herpesvirus 2
tgaatcgtccgagtggagtcagttgtgtgtaagccatactcacctggatcaaccctgacgatgca

SEQ ID NO: 7823 - DNA, 24 bp, Equine herpesvirus 2
tcacctggatcaaccctgacgatg

SEQ ID NO: 7824 - DNA, 23 bp, Homo sapiens
tccctgacttagttctgacgatg

SEQ ID NO: 7825 - DNA, 19 bp, Homo sapiens
tcacccggattgactaaca

SEQ ID NO: 7826 - DNA, 18 bp, Homo sapiens
tcacctggtcagctgtca

SEQ ID NO: 7827 - DNA, 20 bp, Homo sapiens
tcacctgggcagcccttcac

SEQ ID NO: 7828 - DNA, 21 bp, Homo sapiens
ccatctggatcagtccatcac

SEQ ID NO: 7829 - DNA, 19 bp, Homo sapiens
cctggatcgacctgtgatg

SEQ ID NO: 7830 - DNA, 21 bp, Homo sapiens
tcacctggtcagccctatcca

SEQ ID NO: 7831 - DNA, 19 bp, Homo sapiens
tcacttgaatcaatttaca

SEQ ID NO: 7832 - DNA, 17 bp, Homo sapiens
tcacctggtcaaactga

SEQ ID NO: 7833 - DNA, 17 bp, Homo sapiens
ccgcctggatcctagcg

SEQ ID NO: 7834 - DNA, 83 bp, Equine herpesvirus 2
ctagcccctgctcaggtttagaatcctggattttgtagggttaatgatcccagatttttaatccaggattttgtaggggttag

SEQ ID NO: 7835 - DNA, 24 bp, Equine herpesvirus 2
tagaatcctggattttgtagggtt

SEQ ID NO: 7836 - DNA, 18 bp, Homo sapiens
cagaatcttggattttgt

SEQ ID NO: 7837 - DNA, 19 bp, Homo sapiens
gaatcttagatttttggtt

SEQ ID NO: 7838 - DNA, 21 bp, Homo sapiens
tagaatcttggataaatggtt

SEQ ID NO: 7839 - DNA, 19 bp, Homo sapiens
aattttggattttgtgggt

SEQ ID NO: 7840 - DNA, 17 bp, Homo sapiens
tagaatcctggttcggt

SEQ ID NO: 7841 - DNA, 19 bp, Homo sapiens
tagaattatggattttcta

SEQ ID NO: 7842 - DNA, 17 bp, Homo sapiens
gaatttggatgcagggt

SEQ ID NO: 7843 - DNA, 20 bp, Homo sapiens
aaattttggtaaatagggtt

SEQ ID NO: 7844 - DNA, 20 bp, Homo sapiens
tagaattctgtggttttgca

SEQ ID NO: 7845 - DNA, 123 bp, Vaccinia virus
acctctttctgatggagtcgtaaaaaagttttatctctttctctcttcgatggtctcacaaaaatattaaacctctttctgatggagtcgtaaaaaagttttatctctttctccttcgatggt

SEQ ID NO: 7846 - DNA, 88 bp, Molluscum contagiosum virus
tcgcgttcttgctagctcgccgcgggtatgcagccaagtgcatgggaaagtactcgccgctgaaggcgcagcaaaagcaagtgcgcga

SEQ ID NO: 7847 - DNA, 24 bp, Molluscum contagiosum virus
ggaaagtactcgccgctgaaggcg

SEQ ID NO: 7848 - DNA, 19 bp, Homo sapiens
ggagatactcacctggagg

SEQ ID NO: 7849 - DNA, 21 bp, Homo sapiens
ggaggactcgccgacaccgcg

SEQ ID NO: 7850 - DNA, 19 bp, Homo sapiens
ggaaggactcgccaggagg

SEQ ID NO: 7851 - DNA, 24 bp, Homo sapiens
ggaagggagcaagagctgaaggcg

SEQ ID NO: 7852 - DNA, 19 bp, Homo sapiens
gaagtacttgccgaaggcg

SEQ ID NO: 7853 - DNA, 17 bp, Homo sapiens
ggaagtgttcgccgcta

SEQ ID NO: 7854 - DNA, 26 bp, Homo sapiens
ggaaagtatcatctgggctgaaggcg

SEQ ID NO: 7855 - DNA, 88 bp, Equine herpesvirus 2
cctaggccccgagtggggtggttgggaaggcagttttgtatctctggcaaaaaagctggcttcccaaacactctgtttggtgtcttgg

SEQ ID NO: 7856 - DNA, 24 bp, Equine herpesvirus 2
cttcccaaacactctgtttggtgt

SEQ ID NO: 7857 - DNA, 18 bp, Homo sapiens
cttcccaagtcttaagtg

SEQ ID NO: 7858 - DNA, 22 bp, Homo sapiens
cttcccaaaggcttctgagtgt

SEQ ID NO: 7859 - DNA, 22 bp, Homo sapiens
ttcctcatgctctgtttggtgt

SEQ ID NO: 7860 - DNA, 19 bp, Homo sapiens
cttcttgaacactctctcc

SEQ ID NO: 7861 - DNA, 22 bp, Homo sapiens
ttcacagatacactcttggtgt

SEQ ID NO: 7862 - DNA, 22 bp, Homo sapiens
ttcccgacacagacggtggtgt

SEQ ID NO: 7863 - DNA, 20 bp, Homo sapiens
cttcccaagcatcctatttg

SEQ ID NO: 7864 - DNA, 21 bp, Homo sapiens
ttcccaaaccacttggggtgt

SEQ ID NO: 7865 - DNA, 19 bp, Homo sapiens
ttcccaaacttctcccttg

SEQ ID NO: 7866 - DNA, 21 bp, Homo sapiens
cttccaagcaccacctggtgt

SEQ ID NO: 7867 - DNA, 24 bp, Homo sapiens
cttcccaagagttatgcatggtgt

SEQ ID NO: 7868 - DNA, 19 bp, Homo sapiens
cttctccagtactttggcg

SEQ ID NO: 7869 - DNA, 19 bp, Homo sapiens
ttcccaaacatactcattg

SEQ ID NO: 7870 - DNA, 17 bp, Homo sapiens
ttctcaaacactttggt

SEQ ID NO: 7871 - DNA, 16 bp, Homo sapiens
ttccaacactttgtct

SEQ ID NO: 7872 - DNA, 18 bp, Homo sapiens
cctcctaaatatctggtg

SEQ ID NO: 7873 - DNA, 24 bp, Homo sapiens
ttctggaacactctgccatactgt

SEQ ID NO: 7874 - DNA, 24 bp, Homo sapiens
tccccaacgttttgattagggtgt

SEQ ID NO: 7875 - DNA, 21 bp, Homo sapiens
cttccaggactgttttggtgt

SEQ ID NO: 7876 - DNA, 19 bp, Homo sapiens
cttcccaggacgtttagtg

SEQ ID NO: 7877 - DNA, 21 bp, Homo sapiens
ttcccaactgtttttcagtgt

SEQ ID NO: 7878 - DNA, 19 bp, Homo sapiens
cttcccgggtgtcctggcg

SEQ ID NO: 7879 - DNA, 18 bp, Homo sapiens
ttcctgaaacttttggtg

SEQ ID NO: 7880 - DNA, 22 bp, Homo sapiens
cttcccggggacccagtggtgt

SEQ ID NO: 7881 - DNA, 19 bp, Homo sapiens
ttcccaggagctctgcttg

SEQ ID NO: 7882 - DNA, 19 bp, Homo sapiens
ttcccagacattctaatgt

SEQ ID NO: 7883 - DNA, 17 bp, Homo sapiens
ttccaacactgttggtg

SEQ ID NO: 7884 - DNA, 20 bp, Homo sapiens
ttcatgaacactctgaaagt

SEQ ID NO: 7885 - DNA, 21 bp, Homo sapiens
cttttcaaactctcttggtgt

SEQ ID NO: 7886 - DNA, 20 bp, Homo sapiens
cttctgggacactctggctg

SEQ ID NO: 7887 - DNA, 25 bp, Homo sapiens
ttctctggcactcctgccctggtgt

SEQ ID NO: 7888 - DNA, 20 bp, Homo sapiens
cttcccaggcagtttaatgc

SEQ ID NO: 7889 - DNA, 24 bp, Homo sapiens
ctttccaaacactcagggctcagt

SEQ ID NO: 7890 - DNA, 17 bp, Homo sapiens
cttctcaaacttctgtt

SEQ ID NO: 7891 - DNA, 23 bp, Homo sapiens
cttctcaagcactccgtaactgt

SEQ ID NO: 7892 - DNA, 21 bp, Homo sapiens
cttcctggcactcttagtttg

SEQ ID NO: 7893 - DNA, 18 bp, Homo sapiens
ctgcccaaacattctgtt

SEQ ID NO: 7894 - DNA, 18 bp, Homo sapiens
cttcccaaacacacagtg

SEQ ID NO: 7895 - DNA, 21 bp, Homo sapiens
cttcccaagcttgagcggtgt

SEQ ID NO: 7896 - DNA, 17 bp, Homo sapiens
cttcccaaacctctgct

SEQ ID NO: 7897 - DNA, 23 bp, Homo sapiens
cttcctgatgctctccacagtgt

SEQ ID NO: 7898 - DNA, 23 bp, Homo sapiens
cttttcaaacacttctgtatagt

SEQ ID NO: 7899 - DNA, 18 bp, Homo sapiens
cttcccaggttcctggtg

SEQ ID NO: 7900 - DNA, 19 bp, Homo sapiens
cttccccagccgtttggtg

SEQ ID NO: 7901 - DNA, 18 bp, Homo sapiens
ttcccaaacactttggtg

SEQ ID NO: 7902 - DNA, 16 bp, Homo sapiens
ttcctaaacacttggt

SEQ ID NO: 7903 - DNA, 18 bp, Homo sapiens
cttcccaagtctctgcct

SEQ ID NO: 7904 - DNA, 22 bp, Homo sapiens
ttctcaatattctctgctgtgt

SEQ ID NO: 7905 - DNA, 21 bp, Homo sapiens
ttcccaatgcttccatggtgt

SEQ ID NO: 7906 - DNA, 24 bp, Homo sapiens
ttctggaacactctgccatattgt

SEQ ID NO: 7907 - DNA, 21 bp, Homo sapiens
cttcccaagcatgtttactgt

SEQ ID NO: 7908 - DNA, 23 bp, Homo sapiens
cttcccagggactctgtcctggt

SEQ ID NO: 7909 - DNA, 24 bp, Homo sapiens
ttcccaatattccttccttggtgt

SEQ ID NO: 7910 - DNA, 17 bp, Homo sapiens
ttcccaactgctttggt

SEQ ID NO: 7911 - DNA, 17 bp, Homo sapiens
cttcccagacgtctggt

SEQ ID NO: 7912 - DNA, 20 bp, Homo sapiens
ttctcaaatactctgttggt

SEQ ID NO: 7913 - DNA, 22 bp, Homo sapiens
ttcccaaacgtttcccaaatgt

SEQ ID NO: 7914 - DNA, 22 bp, Homo sapiens
ttctgaaccatccacctggtgt

SEQ ID NO: 7915 - DNA, 15 bp, Homo sapiens
ctcccaaatgtttgt

SEQ ID NO: 7916 - DNA, 21 bp, Homo sapiens
ttcccaagtcctctgttctgt

SEQ ID NO: 7917 - DNA, 21 bp, Homo sapiens
ttccggaactctgaggctggt

SEQ ID NO: 7918 - DNA, 19 bp, Homo sapiens
aaacactgaactctggtgt

SEQ ID NO: 7919 - DNA, 100 bp, Vaccinia virus
gatggagtcgtaaaaaagttttatctctttctccttcgatggtctcacaaaaatattaaacctctttctgatggagtcgtaaaaaagttttatctctttc

SEQ ID NO: 7920 - DNA, 24 bp, Vaccinia virus
agttttatctctttctccttcgat

SEQ ID NO: 7921 - DNA, 22 bp, Homo sapiens
gctttaaaaattctcctttgat

SEQ ID NO: 7922 - DNA, 23 bp, Homo sapiens
gttttctgggactctcctttgat

SEQ ID NO: 7923 - DNA, 25 bp, Homo sapiens
agttttatttctataacctttcgat

SEQ ID NO: 7924 - DNA, 19 bp, Homo sapiens
agtggtactttttctcctt

SEQ ID NO: 7925 - DNA, 23 bp, Homo sapiens
agttttatctctttattaccaac

SEQ ID NO: 7926 - DNA, 21 bp, Homo sapiens
gtttccgttctttctctttcg

SEQ ID NO: 7927 - DNA, 60 bp, Equine herpesvirus 2
tagagacatctgttcagaactccgttcgatctgcttcgagtggagcgcggattgtctctg

SEQ ID NO: 7928 - DNA, 18 bp, Equine herpesvirus 2
gagcgcggattgtctctg

SEQ ID NO: 7929 - DNA, 16 bp, Homo sapiens
gatcacagtgtctctg

SEQ ID NO: 7930 - DNA, 18 bp, Homo sapiens
gaacgcgggactcctctg

SEQ ID NO: 7931 - DNA, 17 bp, Homo sapiens
aagctgccttgtctctg

SEQ ID NO: 7932 - DNA, 18 bp, Homo sapiens
gagcccgccctgtctctg

SEQ ID NO: 7933 - DNA, 20 bp, Homo sapiens
gagcgcggggcgcgggtctg

SEQ ID NO: 7934 - DNA, 18 bp, Homo sapiens
gagcgcggtgcagacctg

SEQ ID NO: 7935 - DNA, 15 bp, Homo sapiens
gagcgcggagccctg

SEQ ID NO: 7936 - DNA, 17 bp, Homo sapiens
gaacgcggacctctctg

SEQ ID NO: 7937 - DNA, 16 bp, Homo sapiens
gaggcatctgtctctg

SEQ ID NO: 7938 - DNA, 19 bp, Homo sapiens
gagcacgggtctcactctg

SEQ ID NO: 7939 - DNA, 19 bp, Homo sapiens
gagcgcagcacgacctctg

SEQ ID NO: 7940 - DNA, 18 bp, Homo sapiens
gaacagaatatgtctctg

SEQ ID NO: 7941 - DNA, 18 bp, Homo sapiens
gagcgcgggatggctctg

SEQ ID NO: 7942 - DNA, 18 bp, Homo sapiens
gaggcggcacttactctg

SEQ ID NO: 7943 - DNA, 15 bp, Homo sapiens
aagcgagtgtctctg

SEQ ID NO: 7944 - DNA, 20 bp, Homo sapiens
gcacatactgattgtctctg

SEQ ID NO: 7945 - DNA, 18 bp, Homo sapiens
gagcgcggccggcctctg

SEQ ID NO: 7946 - DNA, 18 bp, Homo sapiens
gagatgctgacgtctctg

SEQ ID NO: 7947 - DNA, 15 bp, Homo sapiens
gagccgccgcctctg

SEQ ID NO: 7948 - DNA, 17 bp, Homo sapiens
aagcgcggagtgttctg

SEQ ID NO: 7949 - DNA, 18 bp, Homo sapiens
gaggtgcaggtgtctctg

SEQ ID NO: 7950 - DNA, 19 bp, Homo sapiens
gagcgcggctgcgtctctg

SEQ ID NO: 7951 - DNA, 15 bp, Homo sapiens
gagcacacatctctg

SEQ ID NO: 7952 - DNA, 18 bp, Homo sapiens
aagtaacatttgtctctg

SEQ ID NO: 7953 - DNA, 18 bp, Homo sapiens
gagcacggatggtgtctg

SEQ ID NO: 7954 - DNA, 15 bp, Homo sapiens
gaacgcgagtctctg

SEQ ID NO: 7955 - DNA, 16 bp, Homo sapiens
gagacgcgcgtctctg

SEQ ID NO: 7956 - DNA, 16 bp, Homo sapiens
gaacggattgtttctg

SEQ ID NO: 7957 - DNA, 19 bp, Homo sapiens
gagcagcggctcgtctctg

SEQ ID NO: 7958 - DNA, 16 bp, Homo sapiens
gagctgcatgtctctg

SEQ ID NO: 7959 - DNA, 17 bp, Homo sapiens
gaggcagagtgtctctg

SEQ ID NO: 7960 - DNA, 17 bp, Homo sapiens
gagcgcaggcccttctg

SEQ ID NO: 7961 - DNA, 19 bp, Homo sapiens
gagcacgggctcacctctg

SEQ ID NO: 7962 - DNA, 18 bp, Homo sapiens
aagtcaaacttgtctctg

SEQ ID NO: 7963 - DNA, 18 bp, Homo sapiens
gagggaaccctgtctctg

SEQ ID NO: 7964 - DNA, 18 bp, Homo sapiens
gagcgcaggatgactctg

SEQ ID NO: 7965 - DNA, 17 bp, Homo sapiens
gagcacaaagttctctg

SEQ ID NO: 7966 - DNA, 15 bp, Homo sapiens
gaggcgccgtctctg

SEQ ID NO: 7967 - DNA, 17 bp, Homo sapiens
gagcggggacatccctg

SEQ ID NO: 7968 - DNA, 18 bp, Homo sapiens
gaggcagcactgtctctg

SEQ ID NO: 7969 - DNA, 15 bp, Homo sapiens
gaggaattgtctctg

SEQ ID NO: 7970 - DNA, 17 bp, Homo sapiens
gagggaaactgtctctg

SEQ ID NO: 7971 - DNA, 15 bp, Homo sapiens
gagcgcggcgtcctg

SEQ ID NO: 7972 - DNA, 20 bp, Homo sapiens
gagcgcgagcgtgtgctctg

SEQ ID NO: 7973 - DNA, 15 bp, Homo sapiens
gagcgcgggcctctg

SEQ ID NO: 7974 - DNA, 18 bp, Homo sapiens
gaacgcggagcccacctg

SEQ ID NO: 7975 - DNA, 17 bp, Homo sapiens
aagtgcaggtgtctctg

SEQ ID NO: 7976 - DNA, 18 bp, Homo sapiens
gagctggagctccctctg

SEQ ID NO: 7977 - DNA, 18 bp, Homo sapiens
agcgggatcctgtctctg

SEQ ID NO: 7978 - DNA, 16 bp, Homo sapiens
gagcgcagctgttctg

SEQ ID NO: 7979 - DNA, 18 bp, Homo sapiens
gaagtcaaactgtctctg

SEQ ID NO: 7980 - DNA, 17 bp, Homo sapiens
gagcacttttgtctctg

SEQ ID NO: 7981 - DNA, 16 bp, Homo sapiens
gagctggatgtctctg

SEQ ID NO: 7982 - DNA, 17 bp, Homo sapiens
gagtcgggacgcctctg

SEQ ID NO: 7983 - DNA, 16 bp, Homo sapiens
gaacgggctgtctctg

SEQ ID NO: 7984 - DNA, 16 bp, Homo sapiens
gagcgcagcgcctctg

SEQ ID NO: 7985 - DNA, 15 bp, Homo sapiens
gagcgcagcgttctg

SEQ ID NO: 7986 - DNA, 16 bp, Homo sapiens
aagcccattgtctctg

SEQ ID NO: 7987 - DNA, 15 bp, Homo sapiens
gagcgcgatgccctg

SEQ ID NO: 7988 - DNA, 20 bp, Homo sapiens
gagcgcgaggccggcctctg

SEQ ID NO: 7989 - DNA, 18 bp, Homo sapiens
gaggcggcgctgtctctg

SEQ ID NO: 7990 - DNA, 16 bp, Homo sapiens
gaccacaatgtctctg

SEQ ID NO: 7991 - DNA, 17 bp, Homo sapiens
gagcgcaggtggctctg

SEQ ID NO: 7992 - DNA, 16 bp, Homo sapiens
gagctgcccgcctctg

SEQ ID NO: 7993 - DNA, 78 bp, Vaccinia virus
attaattataaaattatgtatatgatttactaactttagttagataagttagtaatacataaattttagtatattaat

SEQ ID NO: 7994 - DNA, 71 bp, Rana tigrina ranavirus
ccacgccgaaaagatgtccaggctcgtcaagatgggacccttttccgccggatctctcacaatctgcgtgg

SEQ ID NO: 7995 - DNA, 19 bp, Rana tigrina ranavirus
tctctcacaatctgcgtgg

SEQ ID NO: 7996 - DNA, 16 bp, Homo sapiens
tctctcacagtcctgg

SEQ ID NO: 7997 - DNA, 18 bp, Homo sapiens
tctcccacagtctcacag

SEQ ID NO: 7998 - DNA, 15 bp, Homo sapiens
tcttcacctgcgtgg

SEQ ID NO: 7999 - DNA, 20 bp, Homo sapiens
tctctcacagaggctgttgg

SEQ ID NO: 8000 - DNA, 20 bp, Homo sapiens
tctctcacactatccactgg

SEQ ID NO: 8001 - DNA, 19 bp, Homo sapiens
ctctcacagttctagctgg

SEQ ID NO: 8002 - DNA, 16 bp, Homo sapiens
tctcccacctccgtgg

SEQ ID NO: 8003 - DNA, 20 bp, Homo sapiens
tctctcacaattaaaaatgg

SEQ ID NO: 8004 - DNA, 17 bp, Homo sapiens
tctcccacagcccatgg

SEQ ID NO: 8005 - DNA, 18 bp, Homo sapiens
tctctcacagcctccagg

SEQ ID NO: 8006 - DNA, 15 bp, Homo sapiens
tctctcacaaacata

SEQ ID NO: 8007 - DNA, 19 bp, Homo sapiens
tcttgccagttctgcgtgg

SEQ ID NO: 8008 - DNA, 17 bp, Homo sapiens
tctctaacaatctgtgg

SEQ ID NO: 8009 - DNA, 15 bp, Homo sapiens
cccctctctgcgtgg

SEQ ID NO: 8010 - DNA, 16 bp, Homo sapiens
tcttcacaatcacatg

SEQ ID NO: 8011 - DNA, 16 bp, Homo sapiens
tccctcacatgggtgg

SEQ ID NO: 8012 - DNA, 18 bp, Homo sapiens
tctcccactccattgtgg

SEQ ID NO: 8013 - DNA, 18 bp, Homo sapiens
tctctgccagctgcgtgg

SEQ ID NO: 8014 - DNA, 17 bp, Homo sapiens
tccctcacaattgctgg

SEQ ID NO: 8015 - DNA, 16 bp, Homo sapiens
cctctcacagtgctgg

SEQ ID NO: 8016 - DNA, 15 bp, Homo sapiens
tccccctctgcgtgg

SEQ ID NO: 8017 - DNA, 17 bp, Homo sapiens
tctctcacatgcagtgg

SEQ ID NO: 8018 - DNA, 17 bp, Homo sapiens
tcttctcaaccgcgtgg

SEQ ID NO: 8019 - DNA, 18 bp, Homo sapiens
cctcagacacctgcgtgg

SEQ ID NO: 8020 - DNA, 19 bp, Homo sapiens
cctctcacacagcacgtgg

SEQ ID NO: 8021 - DNA, 17 bp, Homo sapiens
ctctcacaattagctgg

SEQ ID NO: 8022 - DNA, 19 bp, Homo sapiens
ctactcacagtctgcgtgg

SEQ ID NO: 8023 - DNA, 16 bp, Homo sapiens
tccctcacaacgttgg

SEQ ID NO: 8024 - DNA, 17 bp, Homo sapiens
ctctcacaggaccctgg

SEQ ID NO: 8025 - DNA, 21 bp, Homo sapiens
tctctcacaacaccccagtgg

SEQ ID NO: 8026 - DNA, 16 bp, Homo sapiens
tcttcacaaccgatgg

SEQ ID NO: 8027 - DNA, 17 bp, Homo sapiens
tctcccacaatgtcagg

SEQ ID NO: 8028 - DNA, 16 bp, Homo sapiens
tctctcacatcacatg

SEQ ID NO: 8029 - DNA, 16 bp, Homo sapiens
tcactcacaatgctgg

SEQ ID NO: 8030 - DNA, 17 bp, Homo sapiens
tctgtcgacccgcgtgg

SEQ ID NO: 8031 - DNA, 18 bp, Homo sapiens
tctctcacagacccactg

SEQ ID NO: 8032 - DNA, 18 bp, Homo sapiens
cctctcacactcctgtgg

SEQ ID NO: 8033 - DNA, 16 bp, Homo sapiens
cctctcacgctggtgg

SEQ ID NO: 8034 - DNA, 18 bp, Homo sapiens
cctctcacagcagattgg

SEQ ID NO: 8035 - DNA, 16 bp, Homo sapiens
tctttcacaatcctgg

SEQ ID NO: 8036 - DNA, 16 bp, Homo sapiens
cctctcacaaacttgg

SEQ ID NO: 8037 - DNA, 18 bp, Homo sapiens
tctctcacagccagcagg

SEQ ID NO: 8038 - DNA, 20 bp, Homo sapiens
tctcccacagactgtcgtgg

SEQ ID NO: 8039 - DNA, 18 bp, Homo sapiens
tctctacacaacaaatgg

SEQ ID NO: 8040 - DNA, 17 bp, Homo sapiens
tccctcacaagcactgg

SEQ ID NO: 8041 - DNA, 19 bp, Homo sapiens
tctctcaccccgctcgtgg

SEQ ID NO: 8042 - DNA, 19 bp, Homo sapiens
tcttccacaatccatttgg

SEQ ID NO: 8043 - DNA, 17 bp, Homo sapiens
tctcccacaattacatg

SEQ ID NO: 8044 - DNA, 18 bp, Homo sapiens
cctctcacagtctcatag

SEQ ID NO: 8045 - DNA, 22 bp, Homo sapiens
tctctcacagtccctgctgtgg

SEQ ID NO: 8046 - DNA, 15 bp, Homo sapiens
tctctcacaaacatg

SEQ ID NO: 8047 - DNA, 16 bp, Homo sapiens
tctcccacactggtgg

SEQ ID NO: 8048 - DNA, 18 bp, Homo sapiens
cctttcacaatccaatgg

SEQ ID NO: 8049 - DNA, 18 bp, Homo sapiens
tctcccacaaaagcgtgg

SEQ ID NO: 8050 - DNA, 18 bp, Homo sapiens
tctctcacaggatgctgg

SEQ ID NO: 8051 - DNA, 17 bp, Homo sapiens
tccctcacaatctcagg

SEQ ID NO: 8052 - DNA, 17 bp, Homo sapiens
cctctcacacactgtgg

SEQ ID NO: 8053 - DNA, 19 bp, Homo sapiens
tctctcacactttgcttgg

SEQ ID NO: 8054 - DNA, 20 bp, Homo sapiens
tctctacacaaaggcaatgg

SEQ ID NO: 8055 - DNA, 16 bp, Homo sapiens
tctcccacagtgctgg

SEQ ID NO: 8056 - DNA, 20 bp, Homo sapiens
tctcacacaacccagtgtgg

SEQ ID NO: 8057 - DNA, 19 bp, Homo sapiens
tctctcacatgtccaaagg

SEQ ID NO: 8058 - DNA, 20 bp, Homo sapiens
tctctacatactcctcgtgg

SEQ ID NO: 8059 - DNA, 18 bp, Homo sapiens
tctcccggctctgcgtgg

SEQ ID NO: 8060 - DNA, 21 bp, Homo sapiens
tctcccacattctctgtgtgg

SEQ ID NO: 8061 - DNA, 25 bp, Homo sapiens
tctctcaccgagcgctatgcgtggc

SEQ ID NO: 8062 - DNA, 16 bp, Homo sapiens
tccctcacagtgatgg

SEQ ID NO: 8063 - DNA, 16 bp, Homo sapiens
tccctcagctgcgtgg

SEQ ID NO: 8064 - DNA, 17 bp, Homo sapiens
tctcccacgctctggtg

SEQ ID NO: 8065 - DNA, 21 bp, Homo sapiens
tctctcactgtccttacttgg

SEQ ID NO: 8066 - DNA, 17 bp, Homo sapiens
cctctcacaatctttgg

SEQ ID NO: 8067 - DNA, 16 bp, Homo sapiens
tctctcacagacataa

SEQ ID NO: 8068 - DNA, 16 bp, Homo sapiens
tctcccacagtcactg

SEQ ID NO: 8069 - DNA, 66 bp, Rana tigrina ranavirus
gtcgcaaaggagctgtctgagaccatgagcgggaaactgaggtggctctctgactctgcatgcgac

SEQ ID NO: 8070 - DNA, 24 bp, Rana tigrina ranavirus
aaggagctgtctgagaccatgagc

SEQ ID NO: 8071 - DNA, 19 bp, Homo sapiens
aaggggcttctgagacgag

SEQ ID NO: 8072 - DNA, 18 bp, Homo sapiens
aaggggttgggccatgag

SEQ ID NO: 8073 - DNA, 22 bp, Homo sapiens
ggagagctgtagctctgtgagc

SEQ ID NO: 8074 - DNA, 21 bp, Homo sapiens
aagaagcaggaggccatgagc

SEQ ID NO: 8075 - DNA, 20 bp, Homo sapiens
aagtggttagagaccatgag

SEQ ID NO: 8076 - DNA, 21 bp, Homo sapiens
aagggctgtctggcatggggc

SEQ ID NO: 8077 - DNA, 20 bp, Homo sapiens
ggagctgcacagccatgggc

SEQ ID NO: 8078 - DNA, 19 bp, Homo sapiens
ggagctgtctggacaaaag

SEQ ID NO: 8079 - DNA, 23 bp, Homo sapiens
aaggaactgaataggctgtgggc

SEQ ID NO: 8080 - DNA, 19 bp, Homo sapiens
aaggggctgcctaagtgag

SEQ ID NO: 8081 - DNA, 22 bp, Homo sapiens
aaggagctttgctgtcatgagc

SEQ ID NO: 8082 - DNA, 19 bp, Homo sapiens
aggagctgggactctgggc

SEQ ID NO: 8083 - DNA, 21 bp, Homo sapiens
aaagagctcagggctgtgagc

SEQ ID NO: 8084 - DNA, 17 bp, Homo sapiens
ggggctgtccgagcctg

SEQ ID NO: 8085 - DNA, 23 bp, Homo sapiens
aaagagctgtttgactatagagc

SEQ ID NO: 8086 - DNA, 22 bp, Homo sapiens
agggactgtctgaggcagtgag

SEQ ID NO: 8087 - DNA, 21 bp, Homo sapiens
aaggatttgacagccatgagc

SEQ ID NO: 8088 - DNA, 20 bp, Homo sapiens
aaggagctagtatctgtgag

SEQ ID NO: 8089 - DNA, 21 bp, Homo sapiens
aggggctgtggcaccatgagc

SEQ ID NO: 8090 - DNA, 19 bp, Homo sapiens
aaggagttgtttgagaacc

SEQ ID NO: 8091 - DNA, 22 bp, Homo sapiens
aaggagcttctcatttgtgagc

SEQ ID NO: 8092 - DNA, 23 bp, Homo sapiens
agagctgtctgctgtgaatgagc

SEQ ID NO: 8093 - DNA, 19 bp, Homo sapiens
ggagctgtctgggaaaagc

SEQ ID NO: 8094 - DNA, 23 bp, Homo sapiens
ggagctgtagttcgactgtgagc

SEQ ID NO: 8095 - DNA, 22 bp, Homo sapiens
aggagccgtctctctgatgggc

SEQ ID NO: 8096 - DNA, 18 bp, Homo sapiens
cgagagcgaggccgtgag

SEQ ID NO: 8097 - DNA, 19 bp, Homo sapiens
ggaggtgcgggccatgagc

SEQ ID NO: 8098 - DNA, 22 bp, Homo sapiens
aaggagctgtcagggattggag

SEQ ID NO: 8099 - DNA, 17 bp, Homo sapiens
aggggctgtctgtgcag

SEQ ID NO: 8100 - DNA, 21 bp, Homo sapiens
aggagctatttgggacaggag

SEQ ID NO: 8101 - DNA, 23 bp, Homo sapiens
ggagttctctgagacctaggagc

SEQ ID NO: 8102 - DNA, 24 bp, Homo sapiens
aggcggccaggaagggccatgagc

SEQ ID NO: 8103 - DNA, 18 bp, Homo sapiens
aagcagtccagactgtgg

SEQ ID NO: 8104 - DNA, 19 bp, Homo sapiens
aaggagctatttgggaaag

SEQ ID NO: 8105 - DNA, 22 bp, Homo sapiens
aaggagttgcctggggttcgag

SEQ ID NO: 8106 - DNA, 19 bp, Homo sapiens
aaggagcttttggccaatg

SEQ ID NO: 8107 - DNA, 23 bp, Homo sapiens
aagagctgactgtgactatgggc

SEQ ID NO: 8108 - DNA, 17 bp, Homo sapiens
aggggctgtctatcata

SEQ ID NO: 8109 - DNA, 22 bp, Homo sapiens
aaggagctgtcagaatgagagc

SEQ ID NO: 8110 - DNA, 21 bp, Homo sapiens
ggcggctgtggggccatgagc

SEQ ID NO: 8111 - DNA, 131 bp, Lactate dehydrogenase-elevating virus
ggtgccacaaagagatcgtatcttagccgcactggcgtaccatatgaaggctagttgtgttagtgattacttcgctagtgctgcggccattctaatggatgcatgtgcgtgctgtgattatgatgaggact

SEQ ID NO: 8112 - DNA, 24 bp, Lactate dehydrogenase-elevating virus
ctagtgctgcggccattctaatgg

SEQ ID NO: 8113 - DNA, 19 bp, Homo sapiens
ctggtgctgcagctggatg

SEQ ID NO: 8114 - DNA, 27 bp, Homo sapiens
tagtgctgtagtctgagattctgatgg

SEQ ID NO: 8115 - DNA, 22 bp, Homo sapiens
gtgctgcaccaagttctgatgg

SEQ ID NO: 8116 - DNA, 18 bp, Homo sapiens
ctaatgctgcttttaatg

SEQ ID NO: 8117 - DNA, 18 bp, Homo sapiens
tagtgctgctgctgttcc

SEQ ID NO: 8118 - DNA, 20 bp, Homo sapiens
gtttacagtcattctaatgg

SEQ ID NO: 8119 - DNA, 20 bp, Homo sapiens
gtgctgcggttattatctgg

SEQ ID NO: 8120 - DNA, 24 bp, Homo sapiens
ctggtgtctgcctcattctaatgg

SEQ ID NO: 8121 - DNA, 75 bp, Rana tigrina ranavirus
ctgcccgacctaaagtccttcaaggccaagtgcaatgtgacgctgaggctcatgggggacccagagtgcgggcag

SEQ ID NO: 8122 - DNA, 24 bp, Rana tigrina ranavirus
tcatgggggacccagagtgcgggc

SEQ ID NO: 8123 - DNA, 19 bp, Homo sapiens
tcatgggggctccaggggg

SEQ ID NO: 8124 - DNA, 22 bp, Homo sapiens
tgggggaccaaggagccctggg

SEQ ID NO: 8125 - DNA, 19 bp, Homo sapiens
tcagggggacccagagggg

SEQ ID NO: 8126 - DNA, 20 bp, Homo sapiens
ccacaggcccagagtgtggg

SEQ ID NO: 8127 - DNA, 20 bp, Homo sapiens
tcaggggggaccccactggg

SEQ ID NO: 8128 - DNA, 19 bp, Homo sapiens
tctgggggacccagggagc

SEQ ID NO: 8129 - DNA, 19 bp, Homo sapiens
tcatgggagacctgcaggg

SEQ ID NO: 8130 - DNA, 19 bp, Homo sapiens
gacctcattggagtgcggg

SEQ ID NO: 8131 - DNA, 24 bp, Homo sapiens
tctgggggacttggctgagtgggc

SEQ ID NO: 8132 - DNA, 18 bp, Homo sapiens
tcatgggggatcctgcgg

SEQ ID NO: 8133 - DNA, 21 bp, Homo sapiens
tcatgggggacacagacgggg

SEQ ID NO: 8134 - DNA, 19 bp, Homo sapiens
tgtggtgccagagtgtggg

SEQ ID NO: 8135 - DNA, 18 bp, Homo sapiens
gggggacccaatatgggc

SEQ ID NO: 8136 - DNA, 21 bp, Homo sapiens
tctggggggctcagagcgcgg

SEQ ID NO: 8137 - DNA, 22 bp, Homo sapiens
ccgtgggggacctggatgtggc

SEQ ID NO: 8138 - DNA, 17 bp, Homo sapiens
tcatgggggacacggac

SEQ ID NO: 8139 - DNA, 23 bp, Homo sapiens
tcatggtggacacgggtgtgggc

SEQ ID NO: 8140 - DNA, 19 bp, Homo sapiens
tgggggaccctgctccggc

SEQ ID NO: 8141 - DNA, 18 bp, Homo sapiens
tcgtgggagactcagggg

SEQ ID NO: 8142 - DNA, 131 bp, Rana tigrina ranavirus
gttggaggcgactatgaccgcgacgaagaggactcttttcaggatcctctggcggttggggacgaagacgtctttgaggagcctgagagggtccacattcccatcgtggacatttgcaaggtggccaggat

SEQ ID NO: 8143 - DNA, 24 bp, Rana tigrina ranavirus
tttgaggagcctgagagggtccac

SEQ ID NO: 8144 - DNA, 26 bp, Homo sapiens
tttaaggagcctgagaagaatttcac

SEQ ID NO: 8145 - DNA, 20 bp, Homo sapiens
tttgaggattctgaggcagc

SEQ ID NO: 8146 - DNA, 17 bp, Homo sapiens
tttgaggagtttggggt

SEQ ID NO: 8147 - DNA, 16 bp, Homo sapiens
cttggggagcctgggc

SEQ ID NO: 8148 - DNA, 19 bp, Homo sapiens
tttgggaagcctgggacca

SEQ ID NO: 8149 - DNA, 21 bp, Homo sapiens
tttgaagagcctgctaacgtc

SEQ ID NO: 8150 - DNA, 15 bp, Homo sapiens
tttgagaaagagggt

SEQ ID NO: 8151 - DNA, 19 bp, Homo sapiens
cttggggagggagggtcca

SEQ ID NO: 8152 - DNA, 25 bp, Homo sapiens
tttgagaagcttgggaagaaatcac

SEQ ID NO: 8153 - DNA, 17 bp, Homo sapiens
tttggggagctgagagg

SEQ ID NO: 8154 - DNA, 20 bp, Homo sapiens
tttgggaagcctggtctccc

SEQ ID NO: 8155 - DNA, 16 bp, Homo sapiens
tttgaggaccttggtc

SEQ ID NO: 8156 - DNA, 17 bp, Homo sapiens
tttgagggccctggggt

SEQ ID NO: 8157 - DNA, 19 bp, Homo sapiens
cttgaggaggggaagggtc

SEQ ID NO: 8158 - DNA, 22 bp, Homo sapiens
tttggtgagtttgaggccaggt

SEQ ID NO: 8159 - DNA, 17 bp, Homo sapiens
tctggggagcctgaggg

SEQ ID NO: 8160 - DNA, 18 bp, Homo sapiens
aggggtctgagggtccac

SEQ ID NO: 8161 - DNA, 16 bp, Homo sapiens
tttgaggaccttgggc

SEQ ID NO: 8162 - DNA, 17 bp, Homo sapiens
tctggggagcctgagga

SEQ ID NO: 8163 - DNA, 17 bp, Homo sapiens
tttgatgagcctgatcc

SEQ ID NO: 8164 - DNA, 18 bp, Homo sapiens
tttgggggcttgagagga

SEQ ID NO: 8165 - DNA, 127 bp, Lactate dehydrogenase-elevating virus
tttgtcttgcctggtgtgctttacatggttcgcaggtatttgtgtcgactggttggaataaggcgacgcctcttcttgccgtccacttatcctgcgaagaattccatggctggcataaatggcaata

SEQ ID NO: 8166 - DNA, 24 bp, Lactate dehydrogenase-elevating virus
aggtatttgtgtcgactggttgga

SEQ ID NO: 8167 - DNA, 18 bp, Homo sapiens
aggggtgtgattggttgg

SEQ ID NO: 8168 - DNA, 18 bp, Homo sapiens
ggtgttggtgttggtcgg

SEQ ID NO: 8169 - DNA, 21 bp, Homo sapiens
agtatttatcagctggttgga

SEQ ID NO: 8170 - DNA, 20 bp, Homo sapiens
agctatttgtgttgatctga

SEQ ID NO: 8171 - DNA, 22 bp, Homo sapiens
ggtgtttgtgtctgctacctgg

SEQ ID NO: 8172 - DNA, 61 bp, Rana tigrina ranavirus
gtgtgtgctggatttctgcaatgtggccatggaacaggggcagatcctccccgccgaacac

SEQ ID NO: 8173 - DNA, 24 bp, Rana tigrina ranavirus
aggggcagatcctccccgccgaac

SEQ ID NO: 8174 - DNA, 20 bp, Homo sapiens
ggtggcgagggccccgccga

SEQ ID NO: 8175 - DNA, 18 bp, Homo sapiens
aggggcaggtcctccagc

SEQ ID NO: 8176 - DNA, 20 bp, Homo sapiens
agggcagagcgccctgctga

SEQ ID NO: 8177 - DNA, 20 bp, Homo sapiens
agggcagagtcccctgctga

SEQ ID NO: 8178 - DNA, 20 bp, Homo sapiens
agggcagagccccttgctga

SEQ ID NO: 8179 - DNA, 22 bp, Homo sapiens
aggggcaggttgtccttgctca

SEQ ID NO: 8180 - DNA, 19 bp, Homo sapiens
aagggcagatgcctcttgc

SEQ ID NO: 8181 - DNA, 20 bp, Homo sapiens
agggtcaggtcctccccagc

SEQ ID NO: 8182 - DNA, 22 bp, Homo sapiens
aggagcagtcagtttccgccga

SEQ ID NO: 8183 - DNA, 18 bp, Homo sapiens
aggagctgtccccgctga

SEQ ID NO: 8184 - DNA, 21 bp, Homo sapiens
aggggacgcaacccccgccga

SEQ ID NO: 8185 - DNA, 18 bp, Homo sapiens
gggcagcctcctccccgc

SEQ ID NO: 8186 - DNA, 25 bp, Homo sapiens
ggggcagaggaggcatctgctgaac

SEQ ID NO: 8187 - DNA, 18 bp, Homo sapiens
ggggcagaacctgcctga

SEQ ID NO: 8188 - DNA, 20 bp, Homo sapiens
ggccagtctcctcgccgaac

SEQ ID NO: 8189 - DNA, 18 bp, Homo sapiens
aggggcagagcctccagc

SEQ ID NO: 8190 - DNA, 18 bp, Homo sapiens
aggggcaggccctactga

SEQ ID NO: 8191 - DNA, 19 bp, Homo sapiens
aggggcagaacctcctcca

SEQ ID NO: 8192 - DNA, 18 bp, Homo sapiens
gaggcagatcttcctagc

SEQ ID NO: 8193 - DNA, 20 bp, Homo sapiens
gaggcagatcctcctggggc

SEQ ID NO: 8194 - DNA, 19 bp, Homo sapiens
aggggcagatcccccgagc

SEQ ID NO: 8195 - DNA, 19 bp, Homo sapiens
aggggcaggtcatccaccg

SEQ ID NO: 8196 - DNA, 18 bp, Homo sapiens
aggggcaatcctctgtgc

SEQ ID NO: 8197 - DNA, 18 bp, Homo sapiens
ggggcagactctcacaga

SEQ ID NO: 8198 - DNA, 16 bp, Homo sapiens
gggcagaccctgctga

SEQ ID NO: 8199 - DNA, 21 bp, Homo sapiens
ggggcagatccctccggctga

SEQ ID NO: 8200 - DNA, 21 bp, Homo sapiens
agggacaggtccctgagacgc

SEQ ID NO: 8201 - DNA, 21 bp, Homo sapiens
aggggcagagctgacctgaac

SEQ ID NO: 8202 - DNA, 20 bp, Homo sapiens
aggggcaggctcctccctcc

SEQ ID NO: 8203 - DNA, 17 bp, Homo sapiens
gaggcagacctccttgc

SEQ ID NO: 8204 - DNA, 19 bp, Homo sapiens
gaggcagattctccctagc

SEQ ID NO: 8205 - DNA, 20 bp, Homo sapiens
aggggcagacccttccctgc

SEQ ID NO: 8206 - DNA, 20 bp, Homo sapiens
aggggcagtattttccagac

SEQ ID NO: 8207 - DNA, 19 bp, Homo sapiens
agacatcctccctgttgaa

SEQ ID NO: 8208 - DNA, 22 bp, Homo sapiens
aggggtatggtcctctcatgaa

SEQ ID NO: 8209 - DNA, 21 bp, Homo sapiens
aggggcatgtctttcccccgc

SEQ ID NO: 8210 - DNA, 19 bp, Homo sapiens
gaggcagatccttcaccaa

SEQ ID NO: 8211 - DNA, 23 bp, Homo sapiens
aggagcagagggccctgttgaac

SEQ ID NO: 8212 - DNA, 21 bp, Homo sapiens
ggggcggtcctccccctggaa

SEQ ID NO: 8213 - DNA, 19 bp, Homo sapiens
ggggctgcccccctgctga

SEQ ID NO: 8214 - DNA, 18 bp, Homo sapiens
agaggcaggtcgccgccg

SEQ ID NO: 8215 - DNA, 98 bp, Rana tigrina ranavirus
gcaacgccctgctcagcagcctccgcaacgccctgctcagcagcctccgcaacgccctgctcagcagcctccgcaacgccctgctcagcagcctccgc

SEQ ID NO: 8216 - DNA, 24 bp, Rana tigrina ranavirus
cagcagcctccgcaacgccctgct

SEQ ID NO: 8217 - DNA, 17 bp, Homo sapiens
cagcagcctccgcgggc

SEQ ID NO: 8218 - DNA, 21 bp, Homo sapiens
gcagcctcctccccgcctgct

SEQ ID NO: 8219 - DNA, 21 bp, Homo sapiens
caggagtctcaaagccctgct

SEQ ID NO: 8220 - DNA, 24 bp, Homo sapiens
caggtggcctttcccgaccctgct

SEQ ID NO: 8221 - DNA, 23 bp, Homo sapiens
cagggccgtctcggcgccctgct

SEQ ID NO: 8222 - DNA, 23 bp, Homo sapiens
cagcagcctcttagccgtgggct

SEQ ID NO: 8223 - DNA, 22 bp, Homo sapiens
gctgcctccgcggcgcgacgct

SEQ ID NO: 8224 - DNA, 21 bp, Homo sapiens
cagcagccctgtgggcaaggc

SEQ ID NO: 8225 - DNA, 20 bp, Homo sapiens
gccggacacagtgccctgct

SEQ ID NO: 8226 - DNA, 19 bp, Homo sapiens
gcggcctccgcgccgggct

SEQ ID NO: 8227 - DNA, 22 bp, Homo sapiens
cagcggcccccgccactctgct

SEQ ID NO: 8228 - DNA, 19 bp, Homo sapiens
cagcagccctagctcctgc

SEQ ID NO: 8229 - DNA, 21 bp, Homo sapiens
cagcagccatcgtggcaggct

SEQ ID NO: 8230 - DNA, 18 bp, Homo sapiens
cagcacctccactgccct

SEQ ID NO: 8231 - DNA, 23 bp, Homo sapiens
gccccgggtcgcggcgccctgct

SEQ ID NO: 8232 - DNA, 19 bp, Homo sapiens
caccagcctccgcgtctgc

SEQ ID NO: 8233 - DNA, 16 bp, Homo sapiens
gcagcttccaccctgc

SEQ ID NO: 8234 - DNA, 21 bp, Homo sapiens
cagcagtccagctgccctgct

SEQ ID NO: 8235 - DNA, 17 bp, Homo sapiens
gcggcctccgcggccct

SEQ ID NO: 8236 - DNA, 18 bp, Homo sapiens
gcttccactgaccctgct

SEQ ID NO: 8237 - DNA, 21 bp, Homo sapiens
caggagcctccacaccttgct

SEQ ID NO: 8238 - DNA, 15 bp, Homo sapiens
cagcagcctcccatg

SEQ ID NO: 8239 - DNA, 23 bp, Homo sapiens
gcggcctccgctgctgagaggct

SEQ ID NO: 8240 - DNA, 18 bp, Homo sapiens
cagcagccttcccggcgc

SEQ ID NO: 8241 - DNA, 20 bp, Homo sapiens
acaccgggcagcgccctgct

SEQ ID NO: 8242 - DNA, 23 bp, Homo sapiens
ggacagctggacagtgccctgct

SEQ ID NO: 8243 - DNA, 19 bp, Homo sapiens
gcagcctctgcagcagtct

SEQ ID NO: 8244 - DNA, 22 bp, Homo sapiens
gcaatcttgcgtttgccctgct

SEQ ID NO: 8245 - DNA, 16 bp, Homo sapiens
gcagccccctccctgc

SEQ ID NO: 8246 - DNA, 21 bp, Homo sapiens
cagcagcctccgttccctgct

SEQ ID NO: 8247 - DNA, 21 bp, Homo sapiens
cagcagcctctgtgtgacaac

SEQ ID NO: 8248 - DNA, 24 bp, Homo sapiens
cagcagcctctgctaacagctgct

SEQ ID NO: 8249 - DNA, 18 bp, Homo sapiens
caacctcaatgccctgct

SEQ ID NO: 8250 - DNA, 18 bp, Homo sapiens
cagcagcccctgcaacac

SEQ ID NO: 8251 - DNA, 19 bp, Homo sapiens
cagcagcctctgaacccct

SEQ ID NO: 8252 - DNA, 20 bp, Homo sapiens
gccagcctcctcattctgct

SEQ ID NO: 8253 - DNA, 17 bp, Homo sapiens
acagcctctcatcctgc

SEQ ID NO: 8254 - DNA, 23 bp, Homo sapiens
cagcagcagcacagtgccctgct

SEQ ID NO: 8255 - DNA, 22 bp, Homo sapiens
cagcagcccccatgtccttgct

SEQ ID NO: 8256 - DNA, 21 bp, Homo sapiens
caacagcctctgtgatgcaac

SEQ ID NO: 8257 - DNA, 17 bp, Homo sapiens
cagtttccagccctgct

SEQ ID NO: 8258 - DNA, 21 bp, Homo sapiens
gcggccgctgcagaccctgct

SEQ ID NO: 8259 - DNA, 17 bp, Homo sapiens
cagcagccactgcctct

SEQ ID NO: 8260 - DNA, 18 bp, Homo sapiens
cagcagcctccacggcgc

SEQ ID NO: 8261 - DNA, 22 bp, Homo sapiens
gcagcctctgtcaactgatgct

SEQ ID NO: 8262 - DNA, 22 bp, Homo sapiens
acctccactgcagtgccctgct

SEQ ID NO: 8263 - DNA, 19 bp, Homo sapiens
cagcacctccgcaggcggc

SEQ ID NO: 8264 - DNA, 20 bp, Homo sapiens
gctccacctggtgccctgct

SEQ ID NO: 8265 - DNA, 20 bp, Homo sapiens
acaggctgcggcgccctgct

SEQ ID NO: 8266 - DNA, 16 bp, Homo sapiens
gccagcccacgccctg

SEQ ID NO: 8267 - DNA, 19 bp, Homo sapiens
cagcagcctccttggctgc

SEQ ID NO: 8268 - DNA, 19 bp, Homo sapiens
cagcgggctctgcaaccct

SEQ ID NO: 8269 - DNA, 22 bp, Homo sapiens
cagcagcctctttccagccctg

SEQ ID NO: 8270 - DNA, 19 bp, Homo sapiens
cagcagccctgcagtgtgc

SEQ ID NO: 8271 - DNA, 18 bp, Homo sapiens
cagcagcctttcagccct

SEQ ID NO: 8272 - DNA, 20 bp, Homo sapiens
gcagcctccctgtccttgct

SEQ ID NO: 8273 - DNA, 18 bp, Homo sapiens
gcagtctcaggccctgct

SEQ ID NO: 8274 - DNA, 26 bp, Homo sapiens
gcagcctctgggcgaggggctctgct

SEQ ID NO: 8275 - DNA, 26 bp, Homo sapiens
cagcagcctcctaaccgatctctgct

SEQ ID NO: 8276 - DNA, 18 bp, Homo sapiens
cagcagcctccttgacac

SEQ ID NO: 8277 - DNA, 20 bp, Homo sapiens
gctgtcttcgaaaccctgct

SEQ ID NO: 8278 - DNA, 23 bp, Homo sapiens
cagcgcttttcccctgccctgct

SEQ ID NO: 8279 - DNA, 22 bp, Homo sapiens
cagcagcccaggtcgccttgct

SEQ ID NO: 8280 - DNA, 19 bp, Homo sapiens
cagcagcctctttggctgc

SEQ ID NO: 8281 - DNA, 22 bp, Homo sapiens
cagaggcctctgaggccttgct

SEQ ID NO: 8282 - DNA, 17 bp, Homo sapiens
agcagcctctggccctg

SEQ ID NO: 8283 - DNA, 19 bp, Homo sapiens
gcagtctccgcaagcggct

SEQ ID NO: 8284 - DNA, 19 bp, Homo sapiens
cagcagccctgcttccttg

SEQ ID NO: 8285 - DNA, 23 bp, Homo sapiens
caggagccggtaggcgccctgct

SEQ ID NO: 8286 - DNA, 18 bp, Homo sapiens
cagcagcctcccagcagc

SEQ ID NO: 8287 - DNA, 24 bp, Homo sapiens
cagcagccaccgaccacttttgct

SEQ ID NO: 8288 - DNA, 24 bp, Homo sapiens
cagcagccttctaaccctattgct

SEQ ID NO: 8289 - DNA, 19 bp, Homo sapiens
cagcagccgccacccctgc

SEQ ID NO: 8290 - DNA, 20 bp, Homo sapiens
gcagcctccctagcaatggc

SEQ ID NO: 8291 - DNA, 21 bp, Homo sapiens
gcagcttgcatgggccctgct

SEQ ID NO: 8292 - DNA, 90 bp, Rana tigrina ranavirus
cgtgcggtaaatatcgtcgcgtcttgtgttgtctattctcgcctaaaaagagaatagagaatatagcgacagatgtagaaatgccgtgtg

SEQ ID NO: 8293 - DNA, 24 bp, Rana tigrina ranavirus
gagaatatagcgacagatgtagaa

SEQ ID NO: 8294 - DNA, 23 bp, Homo sapiens
gaggactagacacaggtgtagaa

SEQ ID NO: 8295 - DNA, 20 bp, Homo sapiens
gagaaattgctagatgtaga

SEQ ID NO: 8296 - DNA, 20 bp, Homo sapiens
gaatatagcggggagacaga

SEQ ID NO: 8297 - DNA, 17 bp, Homo sapiens
gagaatatggatgtaga

SEQ ID NO: 8298 - DNA, 26 bp, Homo sapiens
gaggatatagagggggagatgtggaa

SEQ ID NO: 8299 - DNA, 27 bp, Homo sapiens
gagagtatgttgacagtctgtctagaa

SEQ ID NO: 8300 - DNA, 23 bp, Homo sapiens
agagtaagatggcagatgtagaa

SEQ ID NO: 8301 - DNA, 20 bp, Homo sapiens
gagatataaagtagatgtag

SEQ ID NO: 8302 - DNA, 21 bp, Homo sapiens
gagatatcccacagatgtgga

SEQ ID NO: 8303 - DNA, 19 bp, Homo sapiens
gaaacctgcatagatgtag

SEQ ID NO: 8304 - DNA, 63 bp, Rana tigrina ranavirus
aagaagttgcgagatagtaatcttaagatagtagcctgagagaatatagacttgcaatatctt

SEQ ID NO: 8305 - DNA, 24 bp, Rana tigrina ranavirus
gagaatatagacttgcaatatctt

SEQ ID NO: 8306 - DNA, 19 bp, Homo sapiens
gagaatgataacaatatct

SEQ ID NO: 8307 - DNA, 23 bp, Homo sapiens
gagagttagacttgctgtatctc

SEQ ID NO: 8308 - DNA, 24 bp, Homo sapiens
aagaatatgaaaatgcaatatctt

SEQ ID NO: 8309 - DNA, 18 bp, Homo sapiens
gataatatagactcatca

SEQ ID NO: 8310 - DNA, 18 bp, Homo sapiens
gagaatataggcttttgc

SEQ ID NO: 8311 - DNA, 16 bp, Homo sapiens
gaaaatatacaatatc

SEQ ID NO: 8312 - DNA, 20 bp, Homo sapiens
gagtgtaaacttgcacaacc

SEQ ID NO: 8313 - DNA, 78 bp, Rana tigrina ranavirus
ggtatgttcagcctggggttgcggacgctgggggcgagtcctggtttagcgtctgggatcctgaagggtggtttgacc

SEQ ID NO: 8314 - DNA, 24 bp, Rana tigrina ranavirus
tttagcgtctgggatcctgaaggg

SEQ ID NO: 8315 - DNA, 15 bp, Homo sapiens
gctctgaactgaagg

SEQ ID NO: 8316 - DNA, 19 bp, Homo sapiens
gctctgggatccgccaggg

SEQ ID NO: 8317 - DNA, 17 bp, Homo sapiens
tagtgtctggaagaggg

SEQ ID NO: 8318 - DNA, 21 bp, Homo sapiens
ttcagtgtctgggatcgtggg

SEQ ID NO: 8319 - DNA, 68 bp, Rana tigrina ranavirus
ggacgcgtctagtatctacgtctcacctctgaatagtctagagacgccaaatactttaagacggatcc

SEQ ID NO: 8320 - DNA, 24 bp, Rana tigrina ranavirus
tctagtatctacgtctcacctctg

SEQ ID NO: 8321 - DNA, 19 bp, Homo sapiens
tccagtatttcttacctct

SEQ ID NO: 8322 - DNA, 19 bp, Homo sapiens
tctagcatttattccctct

SEQ ID NO: 8323 - DNA, 23 bp, Homo sapiens
tctggttctataccacacctctg

SEQ ID NO: 8324 - DNA, 19 bp, Homo sapiens
tctattatctccttctcac

SEQ ID NO: 8325 - DNA, 19 bp, Homo sapiens
tccagtgtctatatatctc

SEQ ID NO: 8326 - DNA, 19 bp, Homo sapiens
tctatatctaccagtgtct

SEQ ID NO: 8327 - DNA, 22 bp, Homo sapiens
ctagtatctgcacaattttctg

SEQ ID NO: 8328 - DNA, 15 bp, Homo sapiens
tctagtactccacct

SEQ ID NO: 8329 - DNA, 18 bp, Homo sapiens
tctagcatctgcccttcc

SEQ ID NO: 8330 - DNA, 23 bp, Homo sapiens
tccagtatttagcccagtctctg

SEQ ID NO: 8331 - DNA, 65 bp, Rana tigrina ranavirus
gcgggagctgggatcctggaggacagagccaggtcaggcgtcctcttggcggtcaggtctcccgt

SEQ ID NO: 8332 - DNA, 24 bp, Rana tigrina ranavirus
tgggatcctggaggacagagccag

SEQ ID NO: 8333 - DNA, 22 bp, Homo sapiens
ggggccagaggaggacggagcc

SEQ ID NO: 8334 - DNA, 20 bp, Homo sapiens
tgggggaggggcagagccag

SEQ ID NO: 8335 - DNA, 18 bp, Homo sapiens
tggggggaaggacagagc

SEQ ID NO: 8336 - DNA, 18 bp, Homo sapiens
ggatcctggagagagcca

SEQ ID NO: 8337 - DNA, 18 bp, Homo sapiens
tggtattctggaggacag

SEQ ID NO: 8338 - DNA, 22 bp, Homo sapiens
gggacagacagggtagagccag

SEQ ID NO: 8339 - DNA, 20 bp, Homo sapiens
ggcctggaggacagagtcag

SEQ ID NO: 8340 - DNA, 23 bp, Homo sapiens
tgggaaccgactggcagagccag

SEQ ID NO: 8341 - DNA, 18 bp, Homo sapiens
tgggatcctgggggacag

SEQ ID NO: 8342 - DNA, 23 bp, Homo sapiens
tggagatcctgggacagagccag

SEQ ID NO: 8343 - DNA, 16 bp, Homo sapiens
gggataccggacagag

SEQ ID NO: 8344 - DNA, 15 bp, Homo sapiens
gggaagggcagagcc

SEQ ID NO: 8345 - DNA, 18 bp, Homo sapiens
tgggatcctgaggcccag

SEQ ID NO: 8346 - DNA, 20 bp, Homo sapiens
tggggttgaggcagagccag

SEQ ID NO: 8347 - DNA, 18 bp, Homo sapiens
aggaatggaggacagggc

SEQ ID NO: 8348 - DNA, 18 bp, Homo sapiens
tggggcctggagacggag

SEQ ID NO: 8349 - DNA, 16 bp, Homo sapiens
tgggacctggaaagag

SEQ ID NO: 8350 - DNA, 21 bp, Homo sapiens
tggggtcctcgtcagagccag

SEQ ID NO: 8351 - DNA, 23 bp, Homo sapiens
tggggccctggaggagacacagc

SEQ ID NO: 8352 - DNA, 18 bp, Homo sapiens
gggatcctgcaagggcca

SEQ ID NO: 8353 - DNA, 21 bp, Homo sapiens
gggaactgaggacagggccag

SEQ ID NO: 8354 - DNA, 18 bp, Homo sapiens
aggaagagaggacagagc

SEQ ID NO: 8355 - DNA, 21 bp, Homo sapiens
ggggtcagacggcagagccag

SEQ ID NO: 8356 - DNA, 18 bp, Homo sapiens
tggggtcctgaagggcaa

SEQ ID NO: 8357 - DNA, 20 bp, Homo sapiens
tgggggtttggaggaccaag

SEQ ID NO: 8358 - DNA, 24 bp, Homo sapiens
tgaggtcctgggacatggagtcag

SEQ ID NO: 8359 - DNA, 23 bp, Homo sapiens
tgggtagcaaaggacagggccag

SEQ ID NO: 8360 - DNA, 20 bp, Homo sapiens
tgggatcctggagtgctgag

SEQ ID NO: 8361 - DNA, 17 bp, Homo sapiens
tgggatcctgaagccag

SEQ ID NO: 8362 - DNA, 20 bp, Homo sapiens
taggctctggaggacagagc

SEQ ID NO: 8363 - DNA, 20 bp, Homo sapiens
taggagagccagggcagagc

SEQ ID NO: 8364 - DNA, 20 bp, Homo sapiens
ggggtatggggcagagccag

SEQ ID NO: 8365 - DNA, 19 bp, Homo sapiens
gggatcctgggacctgggc

SEQ ID NO: 8366 - DNA, 18 bp, Homo sapiens
tggggcctggagggacag

SEQ ID NO: 8367 - DNA, 18 bp, Homo sapiens
tgggatcctgtgggtacc

SEQ ID NO: 8368 - DNA, 19 bp, Homo sapiens
aggtgggggacagagccag

SEQ ID NO: 8369 - DNA, 17 bp, Homo sapiens
tgggatcctgagggcag

SEQ ID NO: 8370 - DNA, 18 bp, Homo sapiens
ggacccagagggcagagc

SEQ ID NO: 8371 - DNA, 23 bp, Homo sapiens
tgggatcctgggaggtctgtgcc

SEQ ID NO: 8372 - DNA, 19 bp, Homo sapiens
tggggacctgggacagtca

SEQ ID NO: 8373 - DNA, 24 bp, Homo sapiens
tgggtatcttcccaccagagccag

SEQ ID NO: 8374 - DNA, 22 bp, Homo sapiens
tgggggtttgggggaaagccag

SEQ ID NO: 8375 - DNA, 21 bp, Homo sapiens
tgggaccctcaatggagccag

SEQ ID NO: 8376 - DNA, 26 bp, Homo sapiens
tgggaccctggaacctcgggggccag

SEQ ID NO: 8377 - DNA, 18 bp, Homo sapiens
tgggattactgagagcca

SEQ ID NO: 8378 - DNA, 19 bp, Homo sapiens
tgggaccctgggaggccag

SEQ ID NO: 8379 - DNA, 70 bp, Lactate dehydrogenase-elevating virus
accctgcaagtactcggtgagtgcgaatcagtttttaactgatgtcgtgttgtccatgactcacccaagt

SEQ ID NO: 8380 - DNA, 24 bp, Lactate dehydrogenase-elevating virus
tgcaagtactcggtgagtgcgaat

SEQ ID NO: 8381 - DNA, 20 bp, Homo sapiens
tgcaagtgcttgtgtgtgtg

SEQ ID NO: 8382 - DNA, 18 bp, Homo sapiens
gtactcgggtgggcgaat

SEQ ID NO: 8383 - DNA, 21 bp, Homo sapiens
tgcatagtgcttggtgaggca

SEQ ID NO: 8384 - DNA, 19 bp, Homo sapiens
tgcaagtagtcgtgtgagt

SEQ ID NO: 8385 - DNA, 16 bp, Homo sapiens
aagtagtgagtgtgaa

SEQ ID NO: 8386 - DNA, 19 bp, Homo sapiens
gtataaaatgggtgcgaat

SEQ ID NO: 8387 - DNA, 20 bp, Homo sapiens
tgcaaggctttcatgtgagt

SEQ ID NO: 8388 - DNA, 18 bp, Homo sapiens
tgcaagacttctgtgaat

SEQ ID NO: 8389 - DNA, 17 bp, Homo sapiens
tgtgagtactctgatgc

SEQ ID NO: 8390 - DNA, 18 bp, Homo sapiens
gtactcggtgctataaat

SEQ ID NO: 8391 - DNA, 83 bp, Rana tigrina ranavirus
gctgtaactattttcagaagatatatgtctgatgactgagtgccgtctgtagacgatgtcttgtctgaaagaaagtctatagc

SEQ ID NO: 8392 - DNA, 24 bp, Rana tigrina ranavirus
tgtcttgtctgaaagaaagtctat

SEQ ID NO: 8393 - DNA, 23 bp, Homo sapiens
tgtcttgtcttggggaaaaaagt

SEQ ID NO: 8394 - DNA, 20 bp, Homo sapiens
tgtttgtctgaaagagcagt

SEQ ID NO: 8395 - DNA, 23 bp, Homo sapiens
tcttgtttcggtggaaagtctat

SEQ ID NO: 8396 - DNA, 21 bp, Homo sapiens
gtcttgtctggaggagaacct

SEQ ID NO: 8397 - DNA, 19 bp, Homo sapiens
tgtcctgtttgggagaaaa

SEQ ID NO: 8398 - DNA, 21 bp, Homo sapiens
tgtgcttggagtggaaagtct

SEQ ID NO: 8399 - DNA, 15 bp, Homo sapiens
ttgtctgaaaggtcc

SEQ ID NO: 8400 - DNA, 19 bp, Homo sapiens
tgttttctagagaaagtct

SEQ ID NO: 8401 - DNA, 20 bp, Homo sapiens
tgcttgtctgctaagagtct

SEQ ID NO: 8402 - DNA, 21 bp, Homo sapiens
tgtctgtctgaagatgtctat

SEQ ID NO: 8403 - DNA, 76 bp, Monkeypox virus
gcaatgttaaagtgactcctccagattactcacctataattgcgagtattaaaggtaagagttatgacgcattagc

SEQ ID NO: 8404 - DNA, 76 bp, Monkeypox virus; identical to SEQ ID NO: 8403

SEQ ID NO: 8405 - DNA, 22 bp, Homo sapiens
tcaaaggtgagagttcaagcat

SEQ ID NO: 8406 - DNA, 18 bp, Homo sapiens
taaaggtaaggaacaatg

SEQ ID NO: 8407 - DNA, 20 bp, Homo sapiens
ggggagggtttatgacgcat

SEQ ID NO: 8408 - DNA, 20 bp, Homo sapiens
aggtggggaatgtgacgcat

SEQ ID NO: 8409 - DNA, 20 bp, Homo sapiens
ttaaaggtgaaagaaatatg

SEQ ID NO: 8410 - DNA, 114 bp, Ectromelia virus
ctggactatcaacgtactatccacacctgatggtctggagataccattgactaatataactattggtcacggtttccaactataggtcgtgcattgttcaaatcagagtccgag

SEQ ID NO: 8411 - DNA, 24 bp, Ectromelia virus
ttggtcacggtttccaactatagg

SEQ ID NO: 8412 - DNA, 22 bp, Homo sapiens
ttggcatctcaccaactatggg

SEQ ID NO: 8413 - DNA, 21 bp, Homo sapiens
ttggttacgatttcctctagg

SEQ ID NO: 8414 - DNA, 20 bp, Homo sapiens
ggttgttttccaactatggg

SEQ ID NO: 8415 - DNA, 81 bp, Chimpanzee cytomegalovirus
tttttgaacaatacgcactggtaatatccgtgatcccgtgtggaagagagaggatataataaatcgtgtgtatctcaaaaa

SEQ ID NO: 8416 - DNA, 24 bp, Chimpanzee cytomegalovirus
tataataaatcgtgtgtatctcaa

SEQ ID NO: 8417 - DNA, 18 bp, Homo sapiens
tataataagtcctgtgta

SEQ ID NO: 8418 - DNA, 23 bp, Homo sapiens
tataataaaatctacacatctca

SEQ ID NO: 8419 - DNA, 25 bp, Homo sapiens
tataacaaattaggccctatctcaa

SEQ ID NO: 8420 - DNA, 18 bp, Homo sapiens
taaaaaatcgtggctctc

SEQ ID NO: 8421 - DNA, 18 bp, Homo sapiens
tataataaatcatgatct

SEQ ID NO: 8422 - DNA, 62 bp, Chimpanzee cytomegalovirus
ggctctctgcggctcgcgttcgcgttccccggtgacgaaacccgcgcacaccgcagaacgcc

SEQ ID NO: 8423 - DNA, 24 bp, Chimpanzee cytomegalovirus
tctctgcggctcgcgttcgcgttc

SEQ ID NO: 8424 - DNA, 19 bp, Homo sapiens
tctctgcgcctgcgtgttc

SEQ ID NO: 8425 - DNA, 21 bp, Homo sapiens
tctgcagctcgttcgcagttc

SEQ ID NO: 8426 - DNA, 72 bp, Equine herpesvirus 2
ggcccctcctcctcccgggcgagcgaggcccgcacctgcggctgcctctgaaaactgggagcggggggcgcc

SEQ ID NO: 8427 - DNA, 24 bp, Equine herpesvirus 2
tgaaaactgggagcggggggcgcc

SEQ ID NO: 8428 - DNA, 21 bp, Homo sapiens
tgaaaactggggggtgggagg

SEQ ID NO: 8429 - DNA, 18 bp, Homo sapiens
gaggactgggagtggggc

SEQ ID NO: 8430 - DNA, 20 bp, Homo sapiens
tggaaactggaagtggtcgg

SEQ ID NO: 8431 - DNA, 19 bp, Homo sapiens
tgaagatgggggcgagggg

SEQ ID NO: 8432 - DNA, 20 bp, Homo sapiens
tgaggactgggagagggcgc

SEQ ID NO: 8433 - DNA, 18 bp, Homo sapiens
tgaaaacttgggaggcgc

SEQ ID NO: 8434 - DNA, 18 bp, Homo sapiens
tgaaaacagggggtgggg

SEQ ID NO: 8435 - DNA, 22 bp, Homo sapiens
gagagctgggagtggggaggcc

SEQ ID NO: 8436 - DNA, 18 bp, Homo sapiens
tgaggaactggggggcgc

SEQ ID NO: 8437 - DNA, 18 bp, Homo sapiens
tgaagactgggagggaac

SEQ ID NO: 8438 - DNA, 23 bp, Homo sapiens
tgaggggtgggggcgggagggcc

SEQ ID NO: 8439 - DNA, 18 bp, Homo sapiens
tggaaactggagagctcc

SEQ ID NO: 8440 - DNA, 18 bp, Homo sapiens
tggaagctggtgggcacc

SEQ ID NO: 8441 - DNA, 18 bp, Homo sapiens
tgagactgggtggggcgc

SEQ ID NO: 8442 - DNA, 21 bp, Homo sapiens
tgagggcctgggaggggcgcc

SEQ ID NO: 8443 - DNA, 20 bp, Homo sapiens
tgagaactgggagtggccgg

SEQ ID NO: 8444 - DNA, 18 bp, Homo sapiens
actatggagtggggggcg

SEQ ID NO: 8445 - DNA, 22 bp, Homo sapiens
tgaaggctgggagcagaacggc

SEQ ID NO: 8446 - DNA, 20 bp, Homo sapiens
tgatgactgggaggcgtcgg

SEQ ID NO: 8447 - DNA, 20 bp, Homo sapiens
gaaggttggggcggggcgcc

SEQ ID NO: 8448 - DNA, 25 bp, Homo sapiens
tggaaactgaggagtggtcggcgcc

SEQ ID NO: 8449 - DNA, 17 bp, Homo sapiens
tgaaagctgggatggga

SEQ ID NO: 8450 - DNA, 21 bp, Homo sapiens
tgaaggttggggacgggggac

SEQ ID NO: 8451 - DNA, 21 bp, Homo sapiens
gaagctgggatcacaggtgcc

SEQ ID NO: 8452 - DNA, 19 bp, Homo sapiens
tgaagacagatgggggcgc

SEQ ID NO: 8453 - DNA, 18 bp, Homo sapiens
tgggagcagggagtgagc

SEQ ID NO: 8454 - DNA, 21 bp, Homo sapiens
tggggactggggagggggcgc

SEQ ID NO: 8455 - DNA, 18 bp, Homo sapiens
tgaagctgggggcggggg

SEQ ID NO: 8456 - DNA, 20 bp, Homo sapiens
tgaaagctggggctggcgag

SEQ ID NO: 8457 - DNA, 23 bp, Homo sapiens
tgggaactgggactcagagtgcc

SEQ ID NO: 8458 - DNA, 19 bp, Homo sapiens
actgggagatgggacagcc

SEQ ID NO: 8459 - DNA, 17 bp, Homo sapiens
actgggagggcaggtgc

SEQ ID NO: 8460 - DNA, 23 bp, Homo sapiens
cgaggctgggagcgcggagcgcc

SEQ ID NO: 8461 - DNA, 18 bp, Homo sapiens
tgggggctgggaggcagc

SEQ ID NO: 8462 - DNA, 19 bp, Homo sapiens
tgaaaactggtagtgtagg

SEQ ID NO: 8463 - DNA, 18 bp, Homo sapiens
tgaaaactgggattggca

SEQ ID NO: 8464 - DNA, 15 bp, Homo sapiens
tgaaactgggagccg

SEQ ID NO: 8465 - DNA, 17 bp, Homo sapiens
tggaaactgggatgggg

SEQ ID NO: 8466 - DNA, 79 bp, Rana tigrina ranavirus
aagaatatatcttaagatagtagcttttctgaaagagatatatatattaagagtactactatcttgcgatattagtctt

SEQ ID NO: 8467 - DNA, 24 bp, Rana tigrina ranavirus
tatcttaagatagtagcttttctg

SEQ ID NO: 8468 - DNA, 22 bp, Homo sapiens
cttgagataatatatttttctg

SEQ ID NO: 8469 - DNA, 16 bp, Homo sapiens
tatcttaagatatact

SEQ ID NO: 8470 - DNA, 21 bp, Homo sapiens
tatcttaagacttcttttctg

SEQ ID NO: 8471 - DNA, 19 bp, Homo sapiens
tattttaagatagtcttct

SEQ ID NO: 8472 - DNA, 21 bp, Homo sapiens
tatctgagaagcccttttctg

SEQ ID NO: 8473 - DNA, 24 bp, Homo sapiens
atcttaggatgtgcttcttttctg

SEQ ID NO: 8474 - DNA, 19 bp, Homo sapiens
tatctctagaggcttttct

SEQ ID NO: 8475 - DNA, 72 bp, Rana tigrina ranavirus
cagctcatcttacccacgacgtggtccacggccgtgatgatctgggctgaacagtgggggcaggtgatgctg

SEQ ID NO: 8476 - DNA, 24 bp, Rana tigrina ranavirus
tgggctgaacagtgggggcaggtg

SEQ ID NO: 8477 - DNA, 26 bp, Homo sapiens
tgggctgaggtggggctgggcaggtg

SEQ ID NO: 8478 - DNA, 24 bp, Homo sapiens
taggctggggccactgggcaggtg

SEQ ID NO: 8479 - DNA, 17 bp, Homo sapiens
tgggctggaagtgggga

SEQ ID NO: 8480 - DNA, 19 bp, Homo sapiens
tgggctgggaagagcaggt

SEQ ID NO: 8481 - DNA, 20 bp, Homo sapiens
ggctgaagcgagggtgggtg

SEQ ID NO: 8482 - DNA, 21 bp, Homo sapiens
gggctgagcatgaagcaggtg

SEQ ID NO: 8483 - DNA, 22 bp, Homo sapiens
tgggctgagtgagtggccagtg

SEQ ID NO: 8484 - DNA, 18 bp, Homo sapiens
tgggctgaatggaggtgt

SEQ ID NO: 8485 - DNA, 18 bp, Homo sapiens
tgggtgagaagggcaggt

SEQ ID NO: 8486 - DNA, 18 bp, Homo sapiens
tgagctgggtgagcaggt

SEQ ID NO: 8487 - DNA, 23 bp, Homo sapiens
tgggccgggccgtggggcaggtg

SEQ ID NO: 8488 - DNA, 19 bp, Homo sapiens
tgggctgagctagtagggg

SEQ ID NO: 8489 - DNA, 19 bp, Homo sapiens
gagcaggtgggggcaggtg

SEQ ID NO: 8490 - DNA, 16 bp, Homo sapiens
tgagctggggggcagg

SEQ ID NO: 8491 - DNA, 23 bp, Homo sapiens
tgggctggcagtgaggccaggtg

SEQ ID NO: 8492 - DNA, 25 bp, Homo sapiens
tgggattgaaagaaaggggcaggtg

SEQ ID NO: 8493 - DNA, 18 bp, Homo sapiens
tgggcaggtggggcaggt

SEQ ID NO: 8494 - DNA, 21 bp, Homo sapiens
tgggttgggaagtggagggtg

SEQ ID NO: 8495 - DNA, 23 bp, Homo sapiens
tgggctggcgcggggggcaggtg

SEQ ID NO: 8496 - DNA, 17 bp, Homo sapiens
ggctggggagggcaggt

SEQ ID NO: 8497 - DNA, 21 bp, Homo sapiens
tgggctgagcagtgggaagtg

SEQ ID NO: 8498 - DNA, 21 bp, Homo sapiens
tgggctggggagtaaagggtg

SEQ ID NO: 8499 - DNA, 24 bp, Homo sapiens
gggctgagtttggttgggcaggtg

SEQ ID NO: 8500 - DNA, 23 bp, Homo sapiens
tggtctgggcactggggcaggtg

SEQ ID NO: 8501 - DNA, 22 bp, Homo sapiens
tgggctgcaaggagggcaggtg

SEQ ID NO: 8502 - DNA, 19 bp, Homo sapiens
tgggcgagtggtggggcag

SEQ ID NO: 8503 - DNA, 17 bp, Homo sapiens
tgggctgaggggttagg

SEQ ID NO: 8504 - DNA, 26 bp, Homo sapiens
tgggctgaatgctgagaaaacgggtg

SEQ ID NO: 8505 - DNA, 24 bp, Homo sapiens
tgggctgagaagtagatttgggtg

SEQ ID NO: 8506 - DNA, 19 bp, Homo sapiens
tgggctgagtggggggcgt

SEQ ID NO: 8507 - DNA, 21 bp, Homo sapiens
tgggttgggtgctggggacag

SEQ ID NO: 8508 - DNA, 20 bp, Homo sapiens
tgggctgggctgggcaggtg

SEQ ID NO: 8509 - DNA, 18 bp, Homo sapiens
tgggttggaggcacaggt

SEQ ID NO: 8510 - DNA, 22 bp, Homo sapiens
ggacgcatggtgggggcgggtg

SEQ ID NO: 8511 - DNA, 16 bp, Homo sapiens
ggctgggagggcaggt

SEQ ID NO: 8512 - DNA, 19 bp, Homo sapiens
tggcctgagcagtgggagc

SEQ ID NO: 8513 - DNA, 19 bp, Homo sapiens
tgagctgggcagtggggac

SEQ ID NO: 8514 - DNA, 23 bp, Homo sapiens
tgggctgagtgggtggccatgtg

SEQ ID NO: 8515 - DNA, 19 bp, Homo sapiens
gctgagctgggggcaggtg

SEQ ID NO: 8516 - DNA, 15 bp, Homo sapiens
tgggctgaatggggg

SEQ ID NO: 8517 - DNA, 23 bp, Homo sapiens
tgggctgagatggtgattatgtg

SEQ ID NO: 8518 - DNA, 23 bp, Homo sapiens
gggctgggtctcgggggcaggtg

SEQ ID NO: 8519 - DNA, 18 bp, Homo sapiens
tgggctggaaaagcaggt

SEQ ID NO: 8520 - DNA, 21 bp, Homo sapiens
tgggctgaataggttctggtg

SEQ ID NO: 8521 - DNA, 80 bp, Rana tigrina ranavirus
tgtcctctatgggtctcagatgcctggcggccctgccgtacacgtggaggttgcccggggttatctgcgacccgtggaca

SEQ ID NO: 8522 - DNA, 24 bp, Rana tigrina ranavirus
tatgggtctcagatgcctggcggc

SEQ ID NO: 8523 - DNA, 18 bp, Homo sapiens
gggccggatgcctggtgg

SEQ ID NO: 8524 - DNA, 17 bp, Homo sapiens
gggtctcagatgctggc

SEQ ID NO: 8525 - DNA, 24 bp, Homo sapiens
tacgggtctcggaatgagtgtggc

SEQ ID NO: 8526 - DNA, 18 bp, Homo sapiens
catgggtcttggacgtgg

SEQ ID NO: 8527 - DNA, 21 bp, Homo sapiens
cggaacccggtgcctggcggc

SEQ ID NO: 8528 - DNA, 20 bp, Homo sapiens
tatgggtctcgggctgtagc

SEQ ID NO: 8529 - DNA, 108 bp, Macaca mulatta rhadinovirus
taacggcgactttgggcagcgaatcagtgtctgtcgcaaaccctgttaaatttaaacacaacagggagcgcgactaaacacggactaactgctcatcgggccctgttg

SEQ ID NO: 8530 - DNA, 24 bp, Macaca mulatta rhadinovirus
aatcagtgtctgtcgcaaaccctg

SEQ ID NO: 8531 - DNA, 23 bp, Homo sapiens
cagtgtcctggctgcaagccctg

SEQ ID NO: 8532 - DNA, 20 bp, Homo sapiens
tcagtgccccacagaccctg

SEQ ID NO: 8533 - DNA, 16 bp, Homo sapiens
agtgtttaaaaccctg

SEQ ID NO: 8534 - DNA, 21 bp, Homo sapiens
atcatgtccctacaaaccctg

SEQ ID NO: 8535 - DNA, 16 bp, Homo sapiens
cagtgtctgttgcccc

SEQ ID NO: 8536 - DNA, 17 bp, Homo sapiens
gtgtctgtcccatcctg

SEQ ID NO: 8537 - DNA, 21 bp, Homo sapiens
aatcagtattcacaaaccctg

SEQ ID NO: 8538 - DNA, 19 bp, Homo sapiens
gcgtcagtgggcaaaccct

SEQ ID NO: 8539 - DNA, 21 bp, Homo sapiens
agcatccagtcgcaaaccctg

SEQ ID NO: 8540 - DNA, 17 bp, Homo sapiens
gtgtccaacaaaccctg

SEQ ID NO: 8541 - DNA, 23 bp, Homo sapiens
atcagtgtatgtagtttatcctg

SEQ ID NO: 8542 - DNA, 21 bp, Homo sapiens
aaccagtgtctgtaactcctg

SEQ ID NO: 8543 - DNA, 18 bp, Homo sapiens
atcagtgtctcaggtcct

SEQ ID NO: 8544 - DNA, 18 bp, Homo sapiens
agtgtctgtaaaaccctg

SEQ ID NO: 8545 - DNA, 23 bp, Homo sapiens
tcagtgtcttcctttgaaccctg

SEQ ID NO: 8546 - DNA, 20 bp, Homo sapiens
cagtgtctaagctgactctg

SEQ ID NO: 8547 - DNA, 18 bp, Homo sapiens
cagtgtctcggctaaacc

SEQ ID NO: 8548 - DNA, 19 bp, Homo sapiens
aatcagtgtcagtccccct

SEQ ID NO: 8549 - DNA, 16 bp, Homo sapiens
cagtgtctgccatcct

SEQ ID NO: 8550 - DNA, 84 bp, Equine herpesvirus 2
gcggtcgcctctagaggccgcccctgggaccgcggcgcccagagtacagctgggggcgccccccagaccccggcaggcggccgc

SEQ ID NO: 8551 - DNA, 24 bp, Equine herpesvirus 2
ccccccagaccccggcaggcggcc

SEQ ID NO: 8552 - DNA, 25 bp, Homo sapiens
cccaccagaccctggactttgggcc

SEQ ID NO: 8553 - DNA, 16 bp, Homo sapiens
cccccagacgctgcgg

SEQ ID NO: 8554 - DNA, 19 bp, Homo sapiens
ccgtccagaccccagcggc

SEQ ID NO: 8555 - DNA, 20 bp, Homo sapiens
ccccagacctcgccctgggg

SEQ ID NO: 8556 - DNA, 21 bp, Homo sapiens
cccccagctgctccaggcggc

SEQ ID NO: 8557 - DNA, 19 bp, Homo sapiens
cctccaggcccctgcagac

SEQ ID NO: 8558 - DNA, 19 bp, Homo sapiens
cccagaccctgcgcccggc

SEQ ID NO: 8559 - DNA, 20 bp, Homo sapiens
ccccctgcagtccaggcggc

SEQ ID NO: 8560 - DNA, 18 bp, Homo sapiens
ccccccaagctccggggc

SEQ ID NO: 8561 - DNA, 19 bp, Homo sapiens
ccccccaggcccacctggc

SEQ ID NO: 8562 - DNA, 21 bp, Homo sapiens
cctcagaccccggcgcctggc

SEQ ID NO: 8563 - DNA, 23 bp, Homo sapiens
ccccagcggtatggcaggcggcc

SEQ ID NO: 8564 - DNA, 20 bp, Homo sapiens
ccccagacttgggaactgcc

SEQ ID NO: 8565 - DNA, 18 bp, Homo sapiens
ccccccggaccccgacag

SEQ ID NO: 8566 - DNA, 18 bp, Homo sapiens
cccccagataccagtggc

SEQ ID NO: 8567 - DNA, 16 bp, Homo sapiens
ccccaaaccccgcggc

SEQ ID NO: 8568 - DNA, 21 bp, Homo sapiens
ccccccaggccgcacctggcc

SEQ ID NO: 8569 - DNA, 19 bp, Homo sapiens
ccccccaaattttagcggc

SEQ ID NO: 8570 - DNA, 20 bp, Homo sapiens
cctccaggccctggcaaacg

SEQ ID NO: 8571 - DNA, 20 bp, Homo sapiens
cccctgcaccccggctcagc

SEQ ID NO: 8572 - DNA, 17 bp, Homo sapiens
ccccccagcctcggcgc

SEQ ID NO: 8573 - DNA, 23 bp, Homo sapiens
cccccgaccccgggcgcgcggcc

SEQ ID NO: 8574 - DNA, 21 bp, Homo sapiens
cccccagaccctacctcggcc

SEQ ID NO: 8575 - DNA, 21 bp, Homo sapiens
cctccaggccttggttacacc

SEQ ID NO: 8576 - DNA, 23 bp, Homo sapiens
ccccattgctaaggcaggcggcc

SEQ ID NO: 8577 - DNA, 17 bp, Homo sapiens
ccccccaaccctggggc

SEQ ID NO: 8578 - DNA, 23 bp, Homo sapiens
cctctgagaccccagagtggtgg

SEQ ID NO: 8579 - DNA, 18 bp, Homo sapiens
ccccagactccgggggcg

SEQ ID NO: 8580 - DNA, 20 bp, Homo sapiens
ccccccaggccgttgggcag

SEQ ID NO: 8581 - DNA, 26 bp, Homo sapiens
ccccccaaccctgacagtgggcggcc

SEQ ID NO: 8582 - DNA, 18 bp, Homo sapiens
cccagaccctggtgggag

SEQ ID NO: 8583 - DNA, 18 bp, Homo sapiens
ccccccagaacctcgggg

SEQ ID NO: 8584 - DNA, 21 bp, Homo sapiens
cctccccgaccccggccgacc

SEQ ID NO: 8585 - DNA, 22 bp, Homo sapiens
ccccccaacccctactctggcc

SEQ ID NO: 8586 - DNA, 22 bp, Homo sapiens
ccctcagagggggcaggcggcc

SEQ ID NO: 8587 - DNA, 18 bp, Homo sapiens
ccccccagaccccgaggc

SEQ ID NO: 8588 - DNA, 20 bp, Homo sapiens
cctctcacaccccaaccggc

SEQ ID NO: 8589 - DNA, 22 bp, Homo sapiens
ccccccggaccccgaccatggc

SEQ ID NO: 8590 - DNA, 22 bp, Homo sapiens
ccccccagcaccctgctcaggc

SEQ ID NO: 8591 - DNA, 17 bp, Homo sapiens
ccccaaaccctggtggc

SEQ ID NO: 8592 - DNA, 23 bp, Homo sapiens
ccccccaggccctagcttctgcc

SEQ ID NO: 8593 - DNA, 21 bp, Homo sapiens
cccctccaggcggcgggcggc

SEQ ID NO: 8594 - DNA, 24 bp, Homo sapiens
cccccagacccaggcggggcagcc

SEQ ID NO: 8595 - DNA, 21 bp, Homo sapiens
ccgcccgctacggcaggcggc

SEQ ID NO: 8596 - DNA, 17 bp, Homo sapiens
ccctgacggcaggcggc

SEQ ID NO: 8597 - DNA, 17 bp, Homo sapiens
cccctgaccccgggcgc

SEQ ID NO: 8598 - DNA, 23 bp, Homo sapiens
cccctgtgtggcggcaggcggcc

SEQ ID NO: 8599 - DNA, 19 bp, Homo sapiens
ccacccagaccctgcaggc

SEQ ID NO: 8600 - DNA, 19 bp, Homo sapiens
cccttcagaccccgcaggc

SEQ ID NO: 8601 - DNA, 22 bp, Homo sapiens
cctccaggctgcggaagcggcc

SEQ ID NO: 8602 - DNA, 19 bp, Homo sapiens
ccctcccggcggaggcggc

SEQ ID NO: 8603 - DNA, 20 bp, Homo sapiens
cctcaggcccggcaggcagc

SEQ ID NO: 8604 - DNA, 20 bp, Homo sapiens
ccctgcagaccccggcccag

SEQ ID NO: 8605 - DNA, 20 bp, Homo sapiens
ccagaccctggtcacaaacc

SEQ ID NO: 8606 - DNA, 20 bp, Homo sapiens
cccccagaatcaaagtggcc

SEQ ID NO: 8607 - DNA, 23 bp, Homo sapiens
ccttgggccccggcacccgggcc

SEQ ID NO: 8608 - DNA, 20 bp, Homo sapiens
cctcagactccggcaggaac

SEQ ID NO: 8609 - DNA, 19 bp, Homo sapiens
ccccccagcccccgggcgc

SEQ ID NO: 8610 - DNA, 16 bp, Homo sapiens
ccccccagccccgggg

SEQ ID NO: 8611 - DNA, 19 bp, Homo sapiens
cctcagcagccaggcggcc

SEQ ID NO: 8612 - DNA, 18 bp, Homo sapiens
ccgcccagaccccggggc

SEQ ID NO: 8613 - DNA, 23 bp, Homo sapiens
cctcccagaccccaagatgtggc

SEQ ID NO: 8614 - DNA, 24 bp, Homo sapiens
cccttcagcccagcgcaggcggcc

SEQ ID NO: 8615 - DNA, 21 bp, Homo sapiens
ccccaaaccctggccctaggc

SEQ ID NO: 8616 - DNA, 22 bp, Homo sapiens
ccccccaaggcagggggtggcc

SEQ ID NO: 8617 - DNA, 22 bp, Homo sapiens
cctcccatggccgcaggcggcc

SEQ ID NO: 8618 - DNA, 25 bp, Homo sapiens
ccccccagggtcctggttgaggggc

SEQ ID NO: 8619 - DNA, 23 bp, Homo sapiens
ccctctaggccccagcaggcacc

SEQ ID NO: 8620 - DNA, 20 bp, Homo sapiens
cccccagaccccagagagcc

SEQ ID NO: 8621 - DNA, 17 bp, Homo sapiens
ccccagacttggccagc

SEQ ID NO: 8622 - DNA, 25 bp, Homo sapiens
cccccagatccctgttcggccgccg

SEQ ID NO: 8623 - DNA, 19 bp, Homo sapiens
cccaggccaggcggcggcc

SEQ ID NO: 8624 - DNA, 19 bp, Homo sapiens
cctcccccggcaggtggcc

SEQ ID NO: 8625 - DNA, 16 bp, Homo sapiens
cccagacccctgcggc

SEQ ID NO: 8626 - DNA, 24 bp, Homo sapiens
cccccaggccccgttcggccgccg

SEQ ID NO: 8627 - DNA, 19 bp, Homo sapiens
ccttccagaccccagctgc

SEQ ID NO: 8628 - DNA, 19 bp, Homo sapiens
ccctccagacccggttgcg

SEQ ID NO: 8629 - DNA, 19 bp, Homo sapiens
cccctcagcaggcaggtgg

SEQ ID NO: 8630 - DNA, 18 bp, Homo sapiens
cccctgagaccccacggc

SEQ ID NO: 8631 - DNA, 18 bp, Homo sapiens
cccagaccctaggcagcc

SEQ ID NO: 8632 - DNA, 20 bp, Homo sapiens
ccccccagatgcctggcgac

SEQ ID NO: 8633 - DNA, 17 bp, Homo sapiens
cccccagaccccgaggc

SEQ ID NO: 8634 - DNA, 20 bp, Homo sapiens
ccttcggatcccagcaaagg

SEQ ID NO: 8635 - DNA, 23 bp, Homo sapiens
cccgccagaccctcggcgcggcc

SEQ ID NO: 8636 - DNA, 21 bp, Homo sapiens
cctcctaaccccgggagagcc

SEQ ID NO: 8637 - DNA, 19 bp, Homo sapiens
ccctagactttagacagcc

SEQ ID NO: 8638 - DNA, 19 bp, Homo sapiens
ccaggaccccagcacggcc

SEQ ID NO: 8639 - DNA, 20 bp, Homo sapiens
ccccccaacccaggtggtgg

SEQ ID NO: 8640 - DNA, 21 bp, Homo sapiens
cccccagatccttccgggcgg

SEQ ID NO: 8641 - DNA, 18 bp, Homo sapiens
ccccagcatcccggcggc

SEQ ID NO: 8642 - DNA, 19 bp, Homo sapiens
ccccccaggacggggcggc

SEQ ID NO: 8643 - DNA, 19 bp, Homo sapiens
ccaggccaaggcaggcggc

SEQ ID NO: 8644 - DNA, 19 bp, Homo sapiens
ccccagactcccagcttgg

SEQ ID NO: 8645 - DNA, 16 bp, Homo sapiens
ccccccagccctgcgg

SEQ ID NO: 8646 - DNA, 19 bp, Homo sapiens
cccccgaccccggccgacc

SEQ ID NO: 8647 - DNA, 17 bp, Homo sapiens
ccacccggaccccgggg

SEQ ID NO: 8648 - DNA, 18 bp, Homo sapiens
cctcctagaccccgaggc

SEQ ID NO: 8649 - DNA, 18 bp, Homo sapiens
cctccggaccccggccag

SEQ ID NO: 8650 - DNA, 20 bp, Homo sapiens
ccttgcagagggcaggcggc

SEQ ID NO: 8651 - DNA, 17 bp, Homo sapiens
cccctagcggaggcggc

SEQ ID NO: 8652 - DNA, 22 bp, Homo sapiens
cctcccagacctcccaggtggc

SEQ ID NO: 8653 - DNA, 18 bp, Homo sapiens
ccctccagaccctcgcgg

SEQ ID NO: 8654 - DNA, 18 bp, Homo sapiens
cctcccagacctccggca

SEQ ID NO: 8655 - DNA, 20 bp, Homo sapiens
cctccaggttccagacagcc

SEQ ID NO: 8656 - DNA, 20 bp, Homo sapiens
cccccagccaggcggcggcc

SEQ ID NO: 8657 - DNA, 21 bp, Homo sapiens
ccccccaaccctggcgggacc

SEQ ID NO: 8658 - DNA, 21 bp, Homo sapiens
ccctgcagaccccgcagggcc

SEQ ID NO: 8659 - DNA, 20 bp, Homo sapiens
ccctccagacccggcgaggc

SEQ ID NO: 8660 - DNA, 21 bp, Homo sapiens
ccagaccctgagcagggtacc

SEQ ID NO: 8661 - DNA, 23 bp, Homo sapiens
ccagacccgccgaactggcggcc

SEQ ID NO: 8662 - DNA, 26 bp, Homo sapiens
ccccccagatccccgttcggccgccg

SEQ ID NO: 8663 - DNA, 17 bp, Homo sapiens
ccaggtcccaggcaacc

SEQ ID NO: 8664 - DNA, 19 bp, Homo sapiens
cccgccagacccgcgcggc

SEQ ID NO: 8665 - DNA, 20 bp, Homo sapiens
cctccaagaccccagctcgg

SEQ ID NO: 8666 - DNA, 16 bp, Homo sapiens
ccccagacccaccggc

SEQ ID NO: 8667 - DNA, 15 bp, Homo sapiens
ccagacccgcgcggc

SEQ ID NO: 8668 - DNA, 84 bp, Macaca mulatta rhadinovirus
ccgtttatcaaaatggaaaaattaaggctttgcgttaaaatctgctaacgcaaagggcacttaatttttccagtttggactcgg

SEQ ID NO: 8669 - DNA, 24 bp, Macaca mulatta rhadinovirus
tggaaaaattaaggctttgcgtta

SEQ ID NO: 8670 - DNA, 20 bp, Homo sapiens
tggaaaaaataaggtttcat

SEQ ID NO: 8671 - DNA, 18 bp, Homo sapiens
tggaaagagtaaggctct

SEQ ID NO: 8672 - DNA, 20 bp, Homo sapiens
tggaaaaatgaaggtggggc

SEQ ID NO: 8673 - DNA, 19 bp, Homo sapiens
ggaaagttaaggcctgcat

SEQ ID NO: 8674 - DNA, 19 bp, Homo sapiens
tggaacaattaaggcttta

SEQ ID NO: 8675 - DNA, 85 bp, Rana tigrina ranavirus
aaattttaaactgcaatgtctcctctgaaaactctgatagattatctctaagagttttatctaaagattttttttcctaagattt

SEQ ID NO: 8676 - DNA, 24 bp, Rana tigrina ranavirus
taagagttttatctaaagattttt

SEQ ID NO: 8677 - DNA, 16 bp, Homo sapiens
aagagttcaaagattt

SEQ ID NO: 8678 - DNA, 19 bp, Homo sapiens
gagttatatcaagattttt

SEQ ID NO: 8679 - DNA, 16 bp, Homo sapiens
agagttcaaagatttt

SEQ ID NO: 8680 - DNA, 65 bp, Rana tigrina ranavirus
gatgcgggagataagccaaactttataaagaccatggtcgtcaagtacctggacgtctttctgtc

SEQ ID NO: 8681 - DNA, 24 bp, Rana tigrina ranavirus
gtcaagtacctggacgtctttctg

SEQ ID NO: 8682 - DNA, 20 bp, Homo sapiens
caagtgcttccacctttctg

SEQ ID NO: 8683 - DNA, 19 bp, Homo sapiens
gtgccttgacttctttctg

SEQ ID NO: 8684 - DNA, 19 bp, Homo sapiens
gtcagattagtgtctttct

SEQ ID NO: 8685 - DNA, 23 bp, Homo sapiens
gttaagtgcctgcatctcttctg

SEQ ID NO: 8686 - DNA, 21 bp, Homo sapiens
gtccagttgagtgtctttctg

SEQ ID NO: 8687 - DNA, 26 bp, Homo sapiens
gtcaagtatctgattcttcttttctg

SEQ ID NO: 8688 - DNA, 20 bp, Homo sapiens
caagtgcttggtcccttctg

SEQ ID NO: 8689 - DNA, 24 bp, Homo sapiens
gtcatggtataaactgtctttctg

SEQ ID NO: 8690 - DNA, 18 bp, Homo sapiens
gctgagtacctgggcgtc

SEQ ID NO: 8691 - DNA, 98 bp, Macaca mulatta rhadinovirus
tggtgttgcaatgcattagggaatctaaaaacgaaatcctgctcggtaacacggaaattgtctttagttccctacagcatcacaacaattgtaaacca

SEQ ID NO: 8692 - DNA, 24 bp, Macaca mulatta rhadinovirus
tctttagttccctacagcatcaca

SEQ ID NO: 8693 - DNA, 17 bp, Homo sapiens
tcttcagttttagcatc

SEQ ID NO: 8694 - DNA, 18 bp, Homo sapiens
tcttcagttttctagctc

SEQ ID NO: 8695 - DNA, 16 bp, Homo sapiens
ttcagtgcagcatcac

SEQ ID NO: 8696 - DNA, 18 bp, Homo sapiens
tcttcagttccctttgca

SEQ ID NO: 8697 - DNA, 19 bp, Homo sapiens
tctttgttaaaagcatcac

SEQ ID NO: 8698 - DNA, 19 bp, Homo sapiens
tctttagttgccttatcat

SEQ ID NO: 8699 - DNA, 22 bp, Homo sapiens
tctgtagttctctaacatcaca

SEQ ID NO: 8700 - DNA, 22 bp, Homo sapiens
tctgtagttgcccagcatcaca

SEQ ID NO: 8701 - DNA, 19 bp, Homo sapiens
tccatttcctgcagcatca

SEQ ID NO: 8702 - DNA, 19 bp, Homo sapiens
tctttagttccttccaagc

SEQ ID NO: 8703 - DNA, 22 bp, Homo sapiens
tcttcagttctgacatatcaca

SEQ ID NO: 8704 - DNA, 19 bp, Homo sapiens
cctttagttctttgctaca

SEQ ID NO: 8705 - DNA, 19 bp, Homo sapiens
tttagttcttctactcaca

SEQ ID NO: 8706 - DNA, 22 bp, Homo sapiens
tcttcagttccaaattatcaca

SEQ ID NO: 8707 - DNA, 22 bp, Homo sapiens
tctgtagttctccaacatcaca

SEQ ID NO: 8708 - DNA, 20 bp, Homo sapiens
tccttggttctaagcatcac

SEQ ID NO: 8709 - DNA, 22 bp, Homo sapiens
tctgtagttctctcacatcaca

SEQ ID NO: 8710 - DNA, 16 bp, Homo sapiens
tttagtctagcatcac

SEQ ID NO: 8711 - DNA, 16 bp, Homo sapiens
tctttagttctcatca

SEQ ID NO: 8712 - DNA, 22 bp, Homo sapiens
tctttagctctttgtcagacat

SEQ ID NO: 8713 - DNA, 23 bp, Homo sapiens
tcagcttctccctgtggcgtcac

SEQ ID NO: 8714 - DNA, 19 bp, Homo sapiens
tctttagtttctgcagcat

SEQ ID NO: 8715 - DNA, 18 bp, Homo sapiens
tctttaattctctggcat

SEQ ID NO: 8716 - DNA, 20 bp, Homo sapiens
tctttatttttcccaccatc

SEQ ID NO: 8717 - DNA, 19 bp, Homo sapiens
tctttagtttctgtagcat

SEQ ID NO: 8718 - DNA, 24 bp, Homo sapiens
tctctatatgattatagcatcaca

SEQ ID NO: 8719 - DNA, 25 bp, Homo sapiens
tctttagtttcctctgcttgtcaca

SEQ ID NO: 8720 - DNA, 23 bp, Homo sapiens
tctttagttttctttttttcaca

SEQ ID NO: 8721 - DNA, 19 bp, Homo sapiens
tctcttaggaacagcatca

SEQ ID NO: 8722 - DNA, 20 bp, Homo sapiens
cctttagttccctatttaca

SEQ ID NO: 8723 - DNA, 18 bp, Homo sapiens
tcttagttaaggcatcac

SEQ ID NO: 8724 - DNA, 130 bp, Macaca mulatta rhadinovirus
ggggtgcaagtcccccggtggggtgcaagtcccccggtggggtgcaagtcccccggtggggtgcaagtcccccggtggggtgcaagtcccccggtggggtgcaagtcccccggtggggtgcaagtccccc

SEQ ID NO: 8725 - DNA, 24 bp, Macaca mulatta rhadinovirus
ccccggtggggtgcaagtcccccg

SEQ ID NO: 8726 - DNA, 20 bp, Homo sapiens
ccctggtggggtgacacgcc

SEQ ID NO: 8727 - DNA, 21 bp, Homo sapiens
cccctgtgaagaagtcccccg

SEQ ID NO: 8728 - DNA, 21 bp, Homo sapiens
ccacggtgggggcttcctccg

SEQ ID NO: 8729 - DNA, 22 bp, Homo sapiens
cctctgtggggtggcttcatcc

SEQ ID NO: 8730 - DNA, 20 bp, Homo sapiens
ccttgggtgccaaagtcccc

SEQ ID NO: 8731 - DNA, 22 bp, Homo sapiens
ccggtgggggctcagtcctccg

SEQ ID NO: 8732 - DNA, 17 bp, Homo sapiens
ccagtggggtcccttcc

SEQ ID NO: 8733 - DNA, 18 bp, Homo sapiens
cccaggtgggggagtccc

SEQ ID NO: 8734 - DNA, 22 bp, Homo sapiens
ccttgggggacagggtcccccg

SEQ ID NO: 8735 - DNA, 17 bp, Homo sapiens
ccctggtgggggccgcc

SEQ ID NO: 8736 - DNA, 19 bp, Homo sapiens
ccctggtggggtgcagagt

SEQ ID NO: 8737 - DNA, 19 bp, Homo sapiens
ccggcttctaagtcccccg

SEQ ID NO: 8738 - DNA, 15 bp, Homo sapiens
ccagtgggagtcccc

SEQ ID NO: 8739 - DNA, 18 bp, Homo sapiens
gggggccgcagtcccccg

SEQ ID NO: 8740 - DNA, 19 bp, Homo sapiens
cccagtgggtcctgtcccc

SEQ ID NO: 8741 - DNA, 17 bp, Homo sapiens
cccaggtgagggtcccc

SEQ ID NO: 8742 - DNA, 17 bp, Homo sapiens
ccccggcggggtctccc

SEQ ID NO: 8743 - DNA, 19 bp, Homo sapiens
cctcggtggggcgcgggcc

SEQ ID NO: 8744 - DNA, 19 bp, Homo sapiens
ccccggggcccagtccccc

SEQ ID NO: 8745 - DNA, 22 bp, Homo sapiens
cctgggtggggtgcggcgggtc

SEQ ID NO: 8746 - DNA, 21 bp, Homo sapiens
ccccactgtgtgggtccctcg

SEQ ID NO: 8747 - DNA, 17 bp, Homo sapiens
cccgtggggtggagacc

SEQ ID NO: 8748 - DNA, 17 bp, Homo sapiens
cccggtagggctccccc

SEQ ID NO: 8749 - DNA, 18 bp, Homo sapiens
gatggtagtggtcccccg

SEQ ID NO: 8750 - DNA, 22 bp, Homo sapiens
ccccggtgtgtggaggcgggtc

SEQ ID NO: 8751 - DNA, 21 bp, Homo sapiens
ggtggggtgtgagcaccaccg

SEQ ID NO: 8752 - DNA, 74 bp, Macaca mulatta rhadinovirus
gtcccccggtggggtgcaagtcccccggtggggttcaagtcccccggtggggtgcaagtcccccggtggggtgc

SEQ ID NO: 8753 - DNA, 63 bp, Rana tigrina ranavirus
ccgagtaggccttgacgcacctgacgtggcagaaccaccccaccaccgtcagggtctttttgg

SEQ ID NO: 8754 - DNA, 24 bp, Rana tigrina ranavirus
aggccttgacgcacctgacgtggc

SEQ ID NO: 8755 - DNA, 19 bp, Homo sapiens
agtccttcctctgacgtgg

SEQ ID NO: 8756 - DNA, 21 bp, Homo sapiens
aggccttggcctgcctgaagc

SEQ ID NO: 8757 - DNA, 18 bp, Homo sapiens
aggccttggcgagcctga

SEQ ID NO: 8758 - DNA, 19 bp, Homo sapiens
aggccttattctgatgtgg

SEQ ID NO: 8759 - DNA, 17 bp, Homo sapiens
gccaccacctgacgtgg

SEQ ID NO: 8760 - DNA, 24 bp, Homo sapiens
aggccttggtctgcttgaacatgg

SEQ ID NO: 8761 - DNA, 19 bp, Homo sapiens
aggccttgggcactggagg

SEQ ID NO: 8762 - DNA, 18 bp, Homo sapiens
aggcctcggtgcacttgg

SEQ ID NO: 8763 - DNA, 18 bp, Homo sapiens
aggccttcgcggacgtgg

SEQ ID NO: 8764 - DNA, 25 bp, Homo sapiens
aggccttggagcagcagcttgtggc

SEQ ID NO: 8765 - DNA, 22 bp, Homo sapiens
ggccggctgcgcctgacgtggc

SEQ ID NO: 8766 - DNA, 24 bp, Homo sapiens
aggccttgatgtggcctctgatgt

SEQ ID NO: 8767 - DNA, 21 bp, Homo sapiens
aggccttggcgtcttcatagc

SEQ ID NO: 8768 - DNA, 23 bp, Homo sapiens
gaccttgatgcatttcacagggc

SEQ ID NO: 8769 - DNA, 24 bp, Homo sapiens
aggccttggcccgccctcaccggc

SEQ ID NO: 8770 - DNA, 20 bp, Homo sapiens
ggtcttgacgcagtcgatgg

SEQ ID NO: 8771 - DNA, 25 bp, Homo sapiens
ggccttgatggacttgatggatggc

SEQ ID NO: 8772 - DNA, 19 bp, Homo sapiens
agcttttggcgcacctggg

SEQ ID NO: 8773 - DNA, 23 bp, Homo sapiens
aggccttgggtggtccgtgtggc

SEQ ID NO: 8774 - DNA, 18 bp, Homo sapiens
aggccctgtctggcgtgg

SEQ ID NO: 8775 - DNA, 22 bp, Homo sapiens
ggctctgggggacttgacgtgg

SEQ ID NO: 8776 - DNA, 16 bp, Homo sapiens
aggccttgatgacttg

SEQ ID NO: 8777 - DNA, 20 bp, Homo sapiens
aggccttggcacatggatgg

SEQ ID NO: 8778 - DNA, 20 bp, Homo sapiens
ggccttgattcactgcatgg

SEQ ID NO: 8779 - DNA, 19 bp, Homo sapiens
ggcctgacgtccctcgtgg

SEQ ID NO: 8780 - DNA, 23 bp, Homo sapiens
aggtcctgacgtgcccagctggc

SEQ ID NO: 8781 - DNA, 21 bp, Homo sapiens
aggccttgggtgaagagtggc

SEQ ID NO: 8782 - DNA, 16 bp, Homo sapiens
aggccttggcgcactg

SEQ ID NO: 8783 - DNA, 21 bp, Homo sapiens
aggccttgccgcactcggggc

SEQ ID NO: 8784 - DNA, 67 bp, Rana tigrina ranavirus
gtctctcaagactattactatcgtaagatatctctcacaaagtatctcacaataatagtttcaggac

SEQ ID NO: 8785 - DNA, 21 bp, Rana tigrina ranavirus
tcacaataatagtttcaggac

SEQ ID NO: 8786 - DNA, 20 bp, Homo sapiens
aataatgtagaattcaggac

SEQ ID NO: 8787 - DNA, 17 bp, Homo sapiens
tcacaacaatggccagg

SEQ ID NO: 8788 - DNA, 20 bp, Homo sapiens
tcacaatataaaatgaggac

SEQ ID NO: 8789 - DNA, 22 bp, Homo sapiens
tcataataacagcctgatggga

SEQ ID NO: 8790 - DNA, 15 bp, Homo sapiens
tcacaatatagcgga

SEQ ID NO: 8791 - DNA, 17 bp, Homo sapiens
tccaaagagtttcagga

SEQ ID NO: 8792 - DNA, 20 bp, Homo sapiens
tcacaaaaattatttcagga

SEQ ID NO: 8793 - DNA, 18 bp, Homo sapiens
acatacatcagtttcagg

SEQ ID NO: 8794 - DNA, 19 bp, Homo sapiens
tcacaatatgcattaggac

SEQ ID NO: 8795 - DNA, 21 bp, Homo sapiens
cacaataatagaaagctggac

SEQ ID NO: 8796 - DNA, 21 bp, Homo sapiens
tcaagatgaaaatttcaggac

SEQ ID NO: 8797 - DNA, 19 bp, Homo sapiens
tcacaataactagtaaaga

SEQ ID NO: 8798 - DNA, 18 bp, Homo sapiens
ataatagcatcataggac

SEQ ID NO: 8799 - DNA, 18 bp, Homo sapiens
tcataacacttttcagga

SEQ ID NO: 8800 - DNA, 18 bp, Homo sapiens
tcacaacaacgttttagg

SEQ ID NO: 8801 - DNA, 18 bp, Homo sapiens
tccaataattttcaggac

SEQ ID NO: 8802 - DNA, 15 bp, Homo sapiens
acataatagtcagga

SEQ ID NO: 8803 - DNA, 18 bp, Homo sapiens
tcacaataaggttccaaa

SEQ ID NO: 8804 - DNA, 19 bp, Homo sapiens
ccacaatcatgttcaggac

SEQ ID NO: 8805 - DNA, 21 bp, Homo sapiens
tcaaataataatgttttcagg

SEQ ID NO: 8806 - DNA, 18 bp, Homo sapiens
acaataacaaggcaggac

SEQ ID NO: 8807 - DNA, 16 bp, Homo sapiens
cacaatagtagtcaga

SEQ ID NO: 8808 - DNA, 17 bp, Homo sapiens
tcacaattaaaatcagg

SEQ ID NO: 8809 - DNA, 18 bp, Homo sapiens
tccaatccatttcaggac

SEQ ID NO: 8810 - DNA, 15 bp, Homo sapiens
tcacaatattccagg

SEQ ID NO: 8811 - DNA, 20 bp, Homo sapiens
cacaataagccagctcagga

SEQ ID NO: 8812 - DNA, 20 bp, Homo sapiens
taatagttgaacatcaggac

SEQ ID NO: 8813 - DNA, 16 bp, Homo sapiens
acaataacaaacagga

SEQ ID NO: 8814 - DNA, 16 bp, Homo sapiens
tcacaatatcacagga

SEQ ID NO: 8815 - DNA, 19 bp, Homo sapiens
ccacagccactttcaggac

SEQ ID NO: 8816 - DNA, 19 bp, Homo sapiens
tcacagaaagacttcagga

SEQ ID NO: 8817 - DNA, 19 bp, Homo sapiens
caaaatagtgtattcagga

SEQ ID NO: 8818 - DNA, 21 bp, Homo sapiens
tcacaaaaatcagttcaggac

SEQ ID NO: 8819 - DNA, 15 bp, Homo sapiens
tcacaatatccagga

SEQ ID NO: 8820 - DNA, 18 bp, Homo sapiens
cagataatagttttagga

SEQ ID NO: 8821 - DNA, 19 bp, Homo sapiens
tcagaataatagtctttgg

SEQ ID NO: 8822 - DNA, 19 bp, Homo sapiens
tcacaattaagacctcagg

SEQ ID NO: 8823 - DNA, 15 bp, Homo sapiens
ccacaataatcagga

SEQ ID NO: 8824 - DNA, 19 bp, Homo sapiens
tcaagataactgccaggac

SEQ ID NO: 8825 - DNA, 20 bp, Homo sapiens
cacaataacattgtttagga

SEQ ID NO: 8826 - DNA, 17 bp, Homo sapiens
tcacaatatggcccagg

SEQ ID NO: 8827 - DNA, 20 bp, Homo sapiens
tcacaatactggcccacagg

SEQ ID NO: 8828 - DNA, 16 bp, Homo sapiens
cacaaagtttcaggac

SEQ ID NO: 8829 - DNA, 19 bp, Homo sapiens
tcacagggaggctcaggac

SEQ ID NO: 8830 - DNA, 18 bp, Homo sapiens
acaatccaacttcaggac

SEQ ID NO: 8831 - DNA, 23 bp, Homo sapiens
tcacaacagtaggaacctaggac

SEQ ID NO: 8832 - DNA, 16 bp, Homo sapiens
ccacaataatacagga

SEQ ID NO: 8833 - DNA, 21 bp, Homo sapiens
tcacaacaatacagaaaggac

SEQ ID NO: 8834 - DNA, 17 bp, Homo sapiens
tcacagaatgttccaag

SEQ ID NO: 8835 - DNA, 18 bp, Homo sapiens
acaataaaggtctcaaga

SEQ ID NO: 8836 - DNA, 15 bp, Homo sapiens
acataattttcagga

SEQ ID NO: 8837 - DNA, 67 bp, Rana tigrina ranavirus
ggagcagggtcccggcgctctcgtgcgtactgctgtacggcaagagggtcgacgacaacgacgctcc

SEQ ID NO: 8838 - DNA, 24 bp, Rana tigrina ranavirus
cggcaagagggtcgacgacaacga

SEQ ID NO: 8839 - DNA, 21 bp, Homo sapiens
gccgagggccgagcggcagcg

SEQ ID NO: 8840 - DNA, 22 bp, Homo sapiens
cggcaaaatggcgcgacagcga

SEQ ID NO: 8841 - DNA, 21 bp, Homo sapiens
cgacgactccgacgacaacga

SEQ ID NO: 8842 - DNA, 18 bp, Homo sapiens
ggcaagagggtcttcgca

SEQ ID NO: 8843 - DNA, 18 bp, Homo sapiens
cggaagaggatggcggcg

SEQ ID NO: 8844 - DNA, 20 bp, Homo sapiens
ggcgcggaatcgacacgacg

SEQ ID NO: 8845 - DNA, 22 bp, Homo sapiens
cgacgggaaccaagcgacggcg

SEQ ID NO: 8846 - DNA, 19 bp, Homo sapiens
cagcaagaaaatggcggcg

SEQ ID NO: 8847 - DNA, 18 bp, Homo sapiens
cggcaagagggcgagaac

SEQ ID NO: 8848 - DNA, 20 bp, Homo sapiens
ggcaagagggttggacacga

SEQ ID NO: 8849 - DNA, 23 bp, Homo sapiens
cgggggcgccgcgacgacagcga

SEQ ID NO: 8850 - DNA, 18 bp, Homo sapiens
cgggagccgacggcagcg

SEQ ID NO: 8851 - DNA, 22 bp, Homo sapiens
cggccagagccgagtggcaacg

SEQ ID NO: 8852 - DNA, 21 bp, Homo sapiens
ggcaagagggtatggcaacga

SEQ ID NO: 8853 - DNA, 25 bp, Homo sapiens
cggtaggaggttcggtagataaacg

SEQ ID NO: 8854 - DNA, 19 bp, Homo sapiens
cggcgaggccaacgcggcg

SEQ ID NO: 8855 - DNA, 23 bp, Homo sapiens
cgacgaggagggggcgacaacga

SEQ ID NO: 8856 - DNA, 21 bp, Homo sapiens
cgggaggagggtcggcgcccg

SEQ ID NO: 8857 - DNA, 21 bp, Homo sapiens
gcaagaggaagtgccggcgac

SEQ ID NO: 8858 - DNA, 16 bp, Homo sapiens
cagcgacggcgacaac

SEQ ID NO: 8859 - DNA, 22 bp, Homo sapiens
cgggaagagagcctggcagcga

SEQ ID NO: 8860 - DNA, 20 bp, Homo sapiens
cgggagagggccgggcaacg

SEQ ID NO: 8861 - DNA, 105 bp, Rana tigrina ranavirus
gtcagactcccagtcgtcccgcctgactaccgcaaacaccctgtccttgaccaaactcgcaggtctgattgcgaggtcagcaaaggagactgtcacgagtcccgc

SEQ ID NO: 8862 - DNA, 24 bp, Rana tigrina ranavirus
tgattgcgaggtcagcaaaggaga

SEQ ID NO: 8863 - DNA, 22 bp, Homo sapiens
tggttgccaggtcagctgcagg

SEQ ID NO: 8864 - DNA, 22 bp, Homo sapiens
tgattgcaaggtctgaagggga

SEQ ID NO: 8865 - DNA, 17 bp, Homo sapiens
tgattgtgggtcagcaa

SEQ ID NO: 8866 - DNA, 18 bp, Homo sapiens
tgattgcaggtcagaagg

SEQ ID NO: 8867 - DNA, 22 bp, Homo sapiens
tgtttgcgagaggggaagggga

SEQ ID NO: 8868 - DNA, 20 bp, Homo sapiens
tggctgcgaggtcctaggag

SEQ ID NO: 8869 - DNA, 20 bp, Homo sapiens
tgatgcgttctgcagaggag

SEQ ID NO: 8870 - DNA, 19 bp, Homo sapiens
tgatgtgaggtcagaaaga

SEQ ID NO: 8871 - DNA, 21 bp, Homo sapiens
attgcgaggtcgcaagggaga

SEQ ID NO: 8872 - DNA, 20 bp, Homo sapiens
taattgcgcttgcaaaggag

SEQ ID NO: 8873 - DNA, 19 bp, Homo sapiens
gattgcaagggcgagggag

SEQ ID NO: 8874 - DNA, 21 bp, Homo sapiens
tgactgcgggggcagggggag

SEQ ID NO: 8875 - DNA, 20 bp, Homo sapiens
gattgtggagaacaaaggag

SEQ ID NO: 8876 - DNA, 21 bp, Homo sapiens
tgcattgcttagcaaagggga

SEQ ID NO: 8877 - DNA, 17 bp, Homo sapiens
gcaggtcagcaagggag

SEQ ID NO: 8878 - DNA, 19 bp, Homo sapiens
taattgcgggcagggggag

SEQ ID NO: 8879 - DNA, 123 bp, Macaca mulatta rhadinovirus
gaatacggccaacgcgccagcgtccaaccgccctccaaccgtgcagcgccgtatattcgaattgccttccgcacgaatacggggcgcagcatggtcgcgggaggctggcattgcgcaatattc

SEQ ID NO: 8880 - DNA, 24 bp, Macaca mulatta rhadinovirus
cagcatggtcgcgggaggctggca

SEQ ID NO: 8881 - DNA, 18 bp, Homo sapiens
tggcctggcgaggctggc

SEQ ID NO: 8882 - DNA, 16 bp, Homo sapiens
gcaggtgggggctggc

SEQ ID NO: 8883 - DNA, 18 bp, Homo sapiens
ggcgcgggcgaggctggc

SEQ ID NO: 8884 - DNA, 18 bp, Homo sapiens
ggtggcggggaggctggc

SEQ ID NO: 8885 - DNA, 17 bp, Homo sapiens
tggcgccggggctggca

SEQ ID NO: 8886 - DNA, 20 bp, Homo sapiens
cagcacgtccggaggctggc

SEQ ID NO: 8887 - DNA, 18 bp, Homo sapiens
catggcatggggctggca

SEQ ID NO: 8888 - DNA, 20 bp, Homo sapiens
ggcggggctcggggctggca

SEQ ID NO: 8889 - DNA, 16 bp, Homo sapiens
agccggggggctggca

SEQ ID NO: 8890 - DNA, 20 bp, Homo sapiens
gcaggcatcaggggctggca

SEQ ID NO: 8891 - DNA, 19 bp, Homo sapiens
tggtcaagaggggctggca

SEQ ID NO: 8892 - DNA, 19 bp, Homo sapiens
actcgggcgggaggctggc

SEQ ID NO: 8893 - DNA, 17 bp, Homo sapiens
agcatggcaggggctgg

SEQ ID NO: 8894 - DNA, 22 bp, Homo sapiens
cagcatgctcctgaggctggca

SEQ ID NO: 8895 - DNA, 17 bp, Homo sapiens
agcgtggcggggctggc

SEQ ID NO: 8896 - DNA, 25 bp, Homo sapiens
cagcatggctcgcggtcccggctgg

SEQ ID NO: 8897 - DNA, 18 bp, Homo sapiens
tagtcagtgggaggctgg

SEQ ID NO: 8898 - DNA, 17 bp, Homo sapiens
cagcatggtgtgggacc

SEQ ID NO: 8899 - DNA, 23 bp, Homo sapiens
cagcacgggcaggggggctggca

SEQ ID NO: 8900 - DNA, 19 bp, Homo sapiens
acatggtgcgagaggctgg

SEQ ID NO: 8901 - DNA, 22 bp, Homo sapiens
cagtctgaaatacggaggctgg

SEQ ID NO: 8902 - DNA, 18 bp, Homo sapiens
gcatggtcgcaggggagc

SEQ ID NO: 8903 - DNA, 19 bp, Homo sapiens
gcggggtggggggctggca

SEQ ID NO: 8904 - DNA, 21 bp, Homo sapiens
tggtatgttaaaaggctggca

SEQ ID NO: 8905 - DNA, 19 bp, Homo sapiens
caccacagtgggaggctgg

SEQ ID NO: 8906 - DNA, 19 bp, Homo sapiens
agcaggtgggaggctggca

SEQ ID NO: 8907 - DNA, 19 bp, Homo sapiens
cagcaggtgtcgggctggc

SEQ ID NO: 8908 - DNA, 17 bp, Homo sapiens
acatggtcgcggggctg

SEQ ID NO: 8909 - DNA, 20 bp, Homo sapiens
gcgtggggcttggaggctgg

SEQ ID NO: 8910 - DNA, 22 bp, Homo sapiens
gccatatgtggggaggctggca

SEQ ID NO: 8911 - DNA, 22 bp, Homo sapiens
gcatgggcctgggaggctggca

SEQ ID NO: 8912 - DNA, 21 bp, Homo sapiens
cagcactgtgggaggctggca

SEQ ID NO: 8913 - DNA, 22 bp, Homo sapiens
cagcatggttacgggagaaaca

SEQ ID NO: 8914 - DNA, 23 bp, Homo sapiens
caggtggttgggggaggctggca

SEQ ID NO: 8915 - DNA, 21 bp, Homo sapiens
tggtgctgggggaggctggca

SEQ ID NO: 8916 - DNA, 21 bp, Homo sapiens
cagcctgggaaggggctggca

SEQ ID NO: 8917 - DNA, 21 bp, Homo sapiens
acatgggggaggaggctggca

SEQ ID NO: 8918 - DNA, 21 bp, Homo sapiens
actgtggtaccggaggctggc

SEQ ID NO: 8919 - DNA, 18 bp, Homo sapiens
gcagggtcgtgggtgatg

SEQ ID NO: 8920 - DNA, 18 bp, Homo sapiens
cagcaggtcgcggccggc

SEQ ID NO: 8921 - DNA, 17 bp, Homo sapiens
cagtgtggtcacactgg

SEQ ID NO: 8922 - DNA, 24 bp, Homo sapiens
cagtgggagagatggaggctggca

SEQ ID NO: 8923 - DNA, 15 bp, Homo sapiens
gcagtgggaggctgg

SEQ ID NO: 8924 - DNA, 20 bp, Homo sapiens
gcactgggcctggaggctgg

SEQ ID NO: 8925 - DNA, 17 bp, Homo sapiens
acaggtgggaggctggc

SEQ ID NO: 8926 - DNA, 23 bp, Homo sapiens
cagctgtggggagggaggctggc

SEQ ID NO: 8927 - DNA, 16 bp, Homo sapiens
agctcagggaggctgg

SEQ ID NO: 8928 - DNA, 19 bp, Homo sapiens
cagcactggtcgcggcggc

SEQ ID NO: 8929 - DNA, 16 bp, Homo sapiens
cagatgtgggggctgg

SEQ ID NO: 8930 - DNA, 73 bp, Rana tigrina ranavirus
acgtccagcctctcggccgaggacgccgtggtagacgagtggtgcacagtctcgggcctgaagggaaggacgt

SEQ ID NO: 8931 - DNA, 24 bp, Rana tigrina ranavirus
tgcacagtctcgggcctgaaggga

SEQ ID NO: 8932 - DNA, 22 bp, Homo sapiens
tacacagtcttaagtgggggga

SEQ ID NO: 8933 - DNA, 19 bp, Homo sapiens
cagtgctgggcctgaaggg

SEQ ID NO: 8934 - DNA, 21 bp, Homo sapiens
gcacaatctgggcttgaaggg

SEQ ID NO: 8935 - DNA, 16 bp, Homo sapiens
cagcgggcctgaaggg

SEQ ID NO: 8936 - DNA, 21 bp, Homo sapiens
cacagacataggcctgagggg

SEQ ID NO: 8937 - DNA, 25 bp, Homo sapiens
tgcctaaagctttgggtctgaaggg

SEQ ID NO: 8938 - DNA, 21 bp, Homo sapiens
tgcccagactggcctggaggg

SEQ ID NO: 8939 - DNA, 22 bp, Homo sapiens
gcacagcaggaagtctggaggg

SEQ ID NO: 8940 - DNA, 21 bp, Homo sapiens
tgcacagtctcaggctggggg

SEQ ID NO: 8941 - DNA, 18 bp, Homo sapiens
gtccgggggcctgaaggg

SEQ ID NO: 8942 - DNA, 23 bp, Homo sapiens
tgcgcagtcccgggctgcttcgg

SEQ ID NO: 8943 - DNA, 22 bp, Homo sapiens
agcgctcaagggtctgggggga

SEQ ID NO: 8944 - DNA, 20 bp, Homo sapiens
tgcatgtgagcctgaaggga

SEQ ID NO: 8945 - DNA, 25 bp, Homo sapiens
tgcccggtctcgggccgcaccaggg

SEQ ID NO: 8946 - DNA, 21 bp, Homo sapiens
tgcactgtcagatctgaaggg

SEQ ID NO: 8947 - DNA, 26 bp, Homo sapiens
tgcatggcctgggaggcttgaaggga

SEQ ID NO: 8948 - DNA, 23 bp, Homo sapiens
gcagcaggacgggcctgagggga

SEQ ID NO: 8949 - DNA, 17 bp, Homo sapiens
gcacagtctccgggggg

SEQ ID NO: 8950 - DNA, 22 bp, Homo sapiens
tgacggtctcgggtccctggga

SEQ ID NO: 8951 - DNA, 20 bp, Homo sapiens
tgccggtctcgggcgccggg

SEQ ID NO: 8952 - DNA, 18 bp, Homo sapiens
gtcagaagcctgaaggga

SEQ ID NO: 8953 - DNA, 21 bp, Homo sapiens
tgcaggtgcgccctggaggga

SEQ ID NO: 8954 - DNA, 19 bp, Homo sapiens
cagccccgggcctggaggg

SEQ ID NO: 8955 - DNA, 21 bp, Homo sapiens
tgcgcagctcgggccgcccgg

SEQ ID NO: 8956 - DNA, 16 bp, Homo sapiens
agctgggcctgagggg

SEQ ID NO: 8957 - DNA, 25 bp, Homo sapiens
gcacagtcttgggtgtgtacaggga

SEQ ID NO: 8958 - DNA, 130 bp, Macaca mulatta rhadinovirus
cggctcggctccggggtggctccgggtgggggcggctcggctccggggtggctccgggtgggggcggctcggctccggggtggctccgggtgggggcggctcggctccggggtggctccgggtgggggcg

SEQ ID NO: 8959 - DNA, 24 bp, Macaca mulatta rhadinovirus
ctccgggtgggggcggctcggctc

SEQ ID NO: 8960 - DNA, 20 bp, Homo sapiens
cctgggtgggggctttgctc

SEQ ID NO: 8961 - DNA, 21 bp, Homo sapiens
tccggtgggggccccgggctc

SEQ ID NO: 8962 - DNA, 21 bp, Homo sapiens
ctccaggtgggggcgcggctc

SEQ ID NO: 8963 - DNA, 21 bp, Homo sapiens
gggtgggggcttcgatggctc

SEQ ID NO: 8964 - DNA, 20 bp, Homo sapiens
ccgggtggcccacttggctc

SEQ ID NO: 8965 - DNA, 19 bp, Homo sapiens
ctccgggtggcctcggttc

SEQ ID NO: 8966 - DNA, 18 bp, Homo sapiens
cccgggtgggggctgctc

SEQ ID NO: 8967 - DNA, 17 bp, Homo sapiens
cgggctccggctcggct

SEQ ID NO: 8968 - DNA, 18 bp, Homo sapiens
ctacgggtgggttggctc

SEQ ID NO: 8969 - DNA, 18 bp, Homo sapiens
ctccggcccggctcggct

SEQ ID NO: 8970 - DNA, 18 bp, Homo sapiens
ctccggctcggctcggct

SEQ ID NO: 8971 - DNA, 19 bp, Homo sapiens
ctctggctgggggcggagg

SEQ ID NO: 8972 - DNA, 17 bp, Homo sapiens
ctccgggtgggcggctc

SEQ ID NO: 8973 - DNA, 21 bp, Homo sapiens
ctctggtggggcactcggctc

SEQ ID NO: 8974 - DNA, 19 bp, Homo sapiens
ctctgggtgggagtggtct

SEQ ID NO: 8975 - DNA, 20 bp, Homo sapiens
ctccgggtggagcagtggct

SEQ ID NO: 8976 - DNA, 20 bp, Homo sapiens
ctccggctgggtctcggctc

SEQ ID NO: 8977 - DNA, 19 bp, Homo sapiens
ctctggtgggggcggagtc

SEQ ID NO: 8978 - DNA, 19 bp, Homo sapiens
ctccgggatgggggcgctc

SEQ ID NO: 8979 - DNA, 20 bp, Homo sapiens
ctccgggtgggggggtaggc

SEQ ID NO: 8980 - DNA, 20 bp, Homo sapiens
ctctgggtgggggaaggggg

SEQ ID NO: 8981 - DNA, 21 bp, Homo sapiens
ctctgggtgggggcggtgagg

SEQ ID NO: 8982 - DNA, 19 bp, Homo sapiens
ctccaggtgggggtgattc

SEQ ID NO: 8983 - DNA, 20 bp, Homo sapiens
gggtgggggtgtagggggct

SEQ ID NO: 8984 - DNA, 21 bp, Homo sapiens
ctcgggtggccccctcggctc

SEQ ID NO: 8985 - DNA, 21 bp, Homo sapiens
ctcagggtgggggcggtgaac

SEQ ID NO: 8986 - DNA, 20 bp, Homo sapiens
ctctggcatgtggcttggct

SEQ ID NO: 8987 - DNA, 15 bp, Homo sapiens
gggtggggctcggct

SEQ ID NO: 8988 - DNA, 20 bp, Homo sapiens
tctgggtgggggcaggcggc

SEQ ID NO: 8989 - DNA, 121 bp, Macaca mulatta rhadinovirus
atgggattaaataccagggatacaggctgtaggttcggtaatgggtaccaggctggagtgactcataccatgggattaaataccagggatacaggctgtaggttcggtaatttaaacctat

SEQ ID NO: 8990 - DNA, 24 bp, Macaca mulatta rhadinovirus
ataccatgggattaaataccaggg

SEQ ID NO: 8991 - DNA, 23 bp, Homo sapiens
ataccaagggaaaattgccaggg

SEQ ID NO: 8992 - DNA, 22 bp, Homo sapiens
atactgtgggataggagcaggg

SEQ ID NO: 8993 - DNA, 16 bp, Homo sapiens
cctcggaataccaggg

SEQ ID NO: 8994 - DNA, 17 bp, Homo sapiens
ccatgggattaagaagg

SEQ ID NO: 8995 - DNA, 18 bp, Homo sapiens
ccatgggaaagaccaggg

SEQ ID NO: 8996 - DNA, 24 bp, Homo sapiens
caccaaaaaaattagatactaggg

SEQ ID NO: 8997 - DNA, 20 bp, Homo sapiens
taccagggattgagttaggg

SEQ ID NO: 8998 - DNA, 25 bp, Homo sapiens
caccatggagccacggatatcaggg

SEQ ID NO: 8999 - DNA, 22 bp, Homo sapiens
ataccatgagacagtgccaggg

SEQ ID NO: 9000 - DNA, 18 bp, Homo sapiens
atacagtgggattagata

SEQ ID NO: 9001 - DNA, 17 bp, Homo sapiens
ataccagggatacctgg

SEQ ID NO: 9002 - DNA, 20 bp, Homo sapiens
cactgtgggagacaccaggg

SEQ ID NO: 9003 - DNA, 18 bp, Homo sapiens
catgggattcttccaggg

SEQ ID NO: 9004 - DNA, 17 bp, Homo sapiens
tgaggcaaataccaggg

SEQ ID NO: 9005 - DNA, 21 bp, Homo sapiens
catagttattaaatgccaggg

SEQ ID NO: 9006 - DNA, 68 bp, Macaca mulatta rhadinovirus
ggggaaccccctaacgggatgtaattaattcaaacctatataaattccaccctgttagggggatcccc

SEQ ID NO: 9007 - DNA, 24 bp, Macaca mulatta rhadinovirus
taacgggatgtaattaattcaaac

SEQ ID NO: 9008 - DNA, 19 bp, Homo sapiens
gatgtgtggattaattcaa

SEQ ID NO: 9009 - DNA, 16 bp, Homo sapiens
cggggtccaattcaaa

SEQ ID NO: 9010 - DNA, 19 bp, Homo sapiens
gaatgataattaattcaaa

SEQ ID NO: 9011 - DNA, 16 bp, Homo sapiens
ggatgtaatgttcaaa

SEQ ID NO: 9012 - DNA, 21 bp, Homo sapiens
caggatgtatcagaattcaaa

SEQ ID NO: 9013 - DNA, 91 bp, Rana tigrina ranavirus
gatgcctgaccgcctcactgctgtcctaaacaggtacaagatgtactttctcaaggaccaaaagtttagcctgagcgggacaatcaggatc

SEQ ID NO: 9014 - DNA, 24 bp, Rana tigrina ranavirus
aaggaccaaaagtttagcctgagc

SEQ ID NO: 9015 - DNA, 21 bp, Homo sapiens
aggttcgagatcagcctgggc

SEQ ID NO: 9016 - DNA, 21 bp, Homo sapiens
aaggagtaaaagtttcttgag

SEQ ID NO: 9017 - DNA, 19 bp, Homo sapiens
aggattgcttgagcctgag

SEQ ID NO: 9018 - DNA, 23 bp, Homo sapiens
aacgatcaaaacttggcctgagc

SEQ ID NO: 9019 - DNA, 23 bp, Homo sapiens
aggggttcaagaccagcctgggc

SEQ ID NO: 9020 - DNA, 20 bp, Homo sapiens
gactaaaagagtacctgagc

SEQ ID NO: 9021 - DNA, 22 bp, Homo sapiens
aaggccaggaggccacctgagc

SEQ ID NO: 9022 - DNA, 23 bp, Homo sapiens
aggagcaagatccaggcctgagc

SEQ ID NO: 9023 - DNA, 20 bp, Homo sapiens
aggatcaaaagttgagaagc

SEQ ID NO: 9024 - DNA, 24 bp, Homo sapiens
aaggggcagctaggcggcctgagc

SEQ ID NO: 9025 - DNA, 23 bp, Homo sapiens
aggtggctgggctcagcctgagc

SEQ ID NO: 9026 - DNA, 19 bp, Homo sapiens
aaggaccagggctttggag

SEQ ID NO: 9027 - DNA, 20 bp, Homo sapiens
aaggaccagaatgtttatgc

SEQ ID NO: 9028 - DNA, 18 bp, Homo sapiens
aagaccagaccagcctgg

SEQ ID NO: 9029 - DNA, 18 bp, Homo sapiens
aagaccaataggtctgag

SEQ ID NO: 9030 - DNA, 22 bp, Homo sapiens
aggctgaagcccaggcctgggc

SEQ ID NO: 9031 - DNA, 18 bp, Homo sapiens
aagaatcaaaagtttagc

SEQ ID NO: 9032 - DNA, 24 bp, Homo sapiens
ggagaccaaaagctgctcctgggc

SEQ ID NO: 9033 - DNA, 20 bp, Homo sapiens
agggcaggggtctcctgagc

SEQ ID NO: 9034 - DNA, 19 bp, Homo sapiens
ggccagctccagcctgggc

SEQ ID NO: 9035 - DNA, 22 bp, Homo sapiens
aggaccaaggaaccctcctgag

SEQ ID NO: 9036 - DNA, 21 bp, Homo sapiens
aagggcagctggagcctgagc

SEQ ID NO: 9037 - DNA, 24 bp, Homo sapiens
aggagttaagagaccagcctgggc

SEQ ID NO: 9038 - DNA, 16 bp, Homo sapiens
aagaccgaaagtctga

SEQ ID NO: 9039 - DNA, 19 bp, Homo sapiens
aagcgacccttagcctgag

SEQ ID NO: 9040 - DNA, 18 bp, Homo sapiens
agggtaaaaagtcctgag

SEQ ID NO: 9041 - DNA, 23 bp, Homo sapiens
aggaggttgagaccagcctgggc

SEQ ID NO: 9042 - DNA, 22 bp, Homo sapiens
ggaggtcaagaccagcctgggc

SEQ ID NO: 9043 - DNA, 18 bp, Homo sapiens
aaggaccaaggctatgag

SEQ ID NO: 9044 - DNA, 25 bp, Homo sapiens
aaggaccaagaagcagtgctttgag

SEQ ID NO: 9045 - DNA, 17 bp, Homo sapiens
aggcccagatcagcctg

SEQ ID NO: 9046 - DNA, 25 bp, Homo sapiens
aaggaccaagagttttgaaaaaagc

SEQ ID NO: 9047 - DNA, 20 bp, Homo sapiens
ggagactgaagtccagtctg

SEQ ID NO: 9048 - DNA, 20 bp, Homo sapiens
ggccgactccaggcctgagc

SEQ ID NO: 9049 - DNA, 21 bp, Homo sapiens
ggatgaaggcctggcctgagc

SEQ ID NO: 9050 - DNA, 20 bp, Homo sapiens
agaccagcctgggcctgggc

SEQ ID NO: 9051 - DNA, 19 bp, Homo sapiens
ggccaaaagttcaaggagc

SEQ ID NO: 9052 - DNA, 20 bp, Homo sapiens
aggcctgaggcaccagcctg

SEQ ID NO: 9053 - DNA, 21 bp, Homo sapiens
agggttgaaaagcccctgagc

SEQ ID NO: 9054 - DNA, 23 bp, Homo sapiens
aggagattgagaccagcctgggc

SEQ ID NO: 9055 - DNA, 20 bp, Homo sapiens
ggagtcaaaagtttatcctg

SEQ ID NO: 9056 - DNA, 17 bp, Homo sapiens
aaggatcaaaatttagc

SEQ ID NO: 9057 - DNA, 21 bp, Homo sapiens
aagggctaaagttacccgagc

SEQ ID NO: 9058 - DNA, 24 bp, Homo sapiens
aagaccaaaaagctcaggcttgag

SEQ ID NO: 9059 - DNA, 18 bp, Homo sapiens
aggagtcaaatgcctgag

SEQ ID NO: 9060 - DNA, 20 bp, Homo sapiens
aggataaaatccacctgagc

SEQ ID NO: 9061 - DNA, 20 bp, Homo sapiens
aggaccaagagttcactggc

SEQ ID NO: 9062 - DNA, 23 bp, Homo sapiens
aggagttggaggtcagcctgggc

SEQ ID NO: 9063 - DNA, 22 bp, Homo sapiens
aaggaccaataaaatacctgag

SEQ ID NO: 9064 - DNA, 22 bp, Homo sapiens
agaccagagcacctgcctgagc

SEQ ID NO: 9065 - DNA, 17 bp, Homo sapiens
ggaccaaaggcagcctg

SEQ ID NO: 9066 - DNA, 22 bp, Homo sapiens
aaggggcaagcagggcctgagc

SEQ ID NO: 9067 - DNA, 23 bp, Homo sapiens
aggagttggagaccagcctgggc

SEQ ID NO: 9068 - DNA, 24 bp, Homo sapiens
aggagccaggcaggtggcctgagc

SEQ ID NO: 9069 - DNA, 18 bp, Homo sapiens
aggaaccaagagtttagc

SEQ ID NO: 9070 - DNA, 19 bp, Homo sapiens
aaggaccagtagtggtgag

SEQ ID NO: 9071 - DNA, 23 bp, Homo sapiens
aggagttggagttcagcctgggc

SEQ ID NO: 9072 - DNA, 21 bp, Homo sapiens
aagaccaagaaggccttgggc

SEQ ID NO: 9073 - DNA, 18 bp, Homo sapiens
agagccaggcagcctgag

SEQ ID NO: 9074 - DNA, 62 bp, Rana tigrina ranavirus
gagattcttgcagcggatatttatacgggattagtttgagtagagtacacatgcggagcatc

SEQ ID NO: 9075 - DNA, 24 bp, Rana tigrina ranavirus
tgagtagagtacacatgcggagca

SEQ ID NO: 9076 - DNA, 20 bp, Homo sapiens
tgagaagagtgtatacaaag

SEQ ID NO: 9077 - DNA, 19 bp, Homo sapiens
tgagcagagtagccattgg

SEQ ID NO: 9078 - DNA, 23 bp, Homo sapiens
gagtagagtgcacagtgtgctcg

SEQ ID NO: 9079 - DNA, 18 bp, Homo sapiens
tgagtagagttattgagc

SEQ ID NO: 9080 - DNA, 21 bp, Homo sapiens
tgagtagagtaagggagagca

SEQ ID NO: 9081 - DNA, 19 bp, Homo sapiens
tgagcggggtacacatgga

SEQ ID NO: 9082 - DNA, 21 bp, Homo sapiens
tgggcagagtagggtggggca

SEQ ID NO: 9083 - DNA, 19 bp, Homo sapiens
tggtggggtacacaaaagc

SEQ ID NO: 9084 - DNA, 17 bp, Homo sapiens
tgggtggagtgcagagc

SEQ ID NO: 9085 - DNA, 20 bp, Homo sapiens
gtagagtatgtgagaaggca

SEQ ID NO: 9086 - DNA, 18 bp, Homo sapiens
tgggtagggtcacataca

SEQ ID NO: 9087 - DNA, 23 bp, Homo sapiens
tgagtagagtgtgaatgccagca

SEQ ID NO: 9088 - DNA, 20 bp, Homo sapiens
gagtagggtgggatggggca

SEQ ID NO: 9089 - DNA, 17 bp, Homo sapiens
tgagtagagacgtatgc

SEQ ID NO: 9090 - DNA, 18 bp, Homo sapiens
tgagtagaggcaccagag

SEQ ID NO: 9091 - DNA, 17 bp, Homo sapiens
gaggagcgcatgcggag

SEQ ID NO: 9092 - DNA, 18 bp, Homo sapiens
tgggtagggatacagagc

SEQ ID NO: 9093 - DNA, 18 bp, Homo sapiens
tgagtagagacacataca

SEQ ID NO: 9094 - DNA, 67 bp, Swinepox virus
aggggaacttatgactgttataaaaaataagaataagattccatttttattattatctggttctcct

SEQ ID NO: 9095 - DNA, 24 bp, Swinepox virus
tgttataaaaaataagaataagat

SEQ ID NO: 9096 - DNA, 19 bp, Homo sapiens
tgttataaaaataagaaca

SEQ ID NO: 9097 - DNA, 19 bp, Homo sapiens
tgttaggaaaaataagaat

SEQ ID NO: 9098 - DNA, 20 bp, Homo sapiens
tgttataaagaataatgaac

SEQ ID NO: 9099 - DNA, 21 bp, Homo sapiens
ttataaaaaataagaaaaaat

SEQ ID NO: 9100 - DNA, 24 bp, Homo sapiens
tgttataaaaatatataataagat

SEQ ID NO: 9101 - DNA, 18 bp, Homo sapiens
tattataagaaataagaa

SEQ ID NO: 9102 - DNA, 63 bp, Rana tigrina ranavirus
acatgtcctccctgctcaccatgaagaacctcatgcacgtggttgtcgcggaggagggcctgt

SEQ ID NO: 9103 - DNA, 18 bp, Rana tigrina ranavirus
tcgcggaggagggcctgt

SEQ ID NO: 9104 - DNA, 21 bp, Homo sapiens
cgtggaggaggcaaatcctgt

SEQ ID NO: 9105 - DNA, 18 bp, Homo sapiens
tcgtggaggagaacttgt

SEQ ID NO: 9106 - DNA, 18 bp, Homo sapiens
ccgccagacagggcctgt

SEQ ID NO: 9107 - DNA, 18 bp, Homo sapiens
tccagacagggggcctgt

SEQ ID NO: 9108 - DNA, 16 bp, Homo sapiens
ccgcggagcggcctgt

SEQ ID NO: 9109 - DNA, 18 bp, Homo sapiens
cgtggtggcagggcctgt

SEQ ID NO: 9110 - DNA, 17 bp, Homo sapiens
tcgaggtgggggcctgt

SEQ ID NO: 9111 - DNA, 18 bp, Homo sapiens
tcgcggagcagccagcct

SEQ ID NO: 9112 - DNA, 16 bp, Homo sapiens
tcgggaggagaacagt

SEQ ID NO: 9113 - DNA, 20 bp, Homo sapiens
ccgcggagctgcgagcctgt

SEQ ID NO: 9114 - DNA, 19 bp, Homo sapiens
ccgcggagctgaggtctgt

SEQ ID NO: 9115 - DNA, 17 bp, Homo sapiens
tcccagtaagggcctgt

SEQ ID NO: 9116 - DNA, 17 bp, Homo sapiens
tcactcagagggcctgt

SEQ ID NO: 9117 - DNA, 19 bp, Homo sapiens
tcccggagaagctgcttgt

SEQ ID NO: 9118 - DNA, 18 bp, Homo sapiens
gcggaagaaccgctctgt

SEQ ID NO: 9119 - DNA, 20 bp, Homo sapiens
ccgtggaggaggcaacctgt

SEQ ID NO: 9120 - DNA, 16 bp, Homo sapiens
tcccagaggggcctgt

SEQ ID NO: 9121 - DNA, 20 bp, Homo sapiens
cgcggagggagggcgcctgt

SEQ ID NO: 9122 - DNA, 15 bp, Homo sapiens
tccagaggggcctgt

SEQ ID NO: 9123 - DNA, 15 bp, Homo sapiens
tccggaggaagctgt

SEQ ID NO: 9124 - DNA, 24 bp, Homo sapiens
tcggggaggaggcctgggcctgta

SEQ ID NO: 9125 - DNA, 15 bp, Homo sapiens
ccgcggaggggctgc

SEQ ID NO: 9126 - DNA, 19 bp, Homo sapiens
tcgcggaagaacttgctgt

SEQ ID NO: 9127 - DNA, 18 bp, Homo sapiens
tctggaggaaaatcctgt

SEQ ID NO: 9128 - DNA, 19 bp, Homo sapiens
gcagaggagcaagccctgt

SEQ ID NO: 9129 - DNA, 16 bp, Homo sapiens
ccgcggaggggccagt

SEQ ID NO: 9130 - DNA, 18 bp, Homo sapiens
tcgcggggaaggccatgt

SEQ ID NO: 9131 - DNA, 16 bp, Homo sapiens
tcgggagcagacctgt

SEQ ID NO: 9132 - DNA, 17 bp, Homo sapiens
tcgggaggaaaccctgt

SEQ ID NO: 9133 - DNA, 18 bp, Homo sapiens
tcgcggagcagctcctgt

SEQ ID NO: 9134 - DNA, 18 bp, Homo sapiens
cgcggggcacaggcctgt

SEQ ID NO: 9135 - DNA, 18 bp, Homo sapiens
gcaggcaggagggcctgt

SEQ ID NO: 9136 - DNA, 18 bp, Homo sapiens
tcactcaaaggggcctgt

SEQ ID NO: 9137 - DNA, 18 bp, Homo sapiens
tcccaactaggggcctgt

SEQ ID NO: 9138 - DNA, 17 bp, Homo sapiens
tctggggacagacctgt

SEQ ID NO: 9139 - DNA, 20 bp, Homo sapiens
tcccggagaaactggtctgt

SEQ ID NO: 9140 - DNA, 16 bp, Homo sapiens
ccgcggaggtagctgt

SEQ ID NO: 9141 - DNA, 16 bp, Homo sapiens
ccgcggtaaggcctgt

SEQ ID NO: 9142 - DNA, 16 bp, Homo sapiens
ccgggagggggcctgt

SEQ ID NO: 9143 - DNA, 75 bp, Equine herpesvirus 2
cacctgctgaacgcgggcttcgcctgccacggccccccgggcctcagccacggccagctcgccacctgcgaggtg

SEQ ID NO: 9144 - DNA, 24 bp, Equine herpesvirus 2
cagccacggccagctcgccacctg

SEQ ID NO: 9145 - DNA, 19 bp, Homo sapiens
ggccatggcccaccacctg

SEQ ID NO: 9146 - DNA, 22 bp, Homo sapiens
gctgtgggacaggtgccacctg

SEQ ID NO: 9147 - DNA, 20 bp, Homo sapiens
gcggcggcagcagccacctg

SEQ ID NO: 9148 - DNA, 19 bp, Homo sapiens
gcttggccagcctcatctg

SEQ ID NO: 9149 - DNA, 16 bp, Homo sapiens
gccacggccggcccct

SEQ ID NO: 9150 - DNA, 23 bp, Homo sapiens
gccgcggccagcctgcccttctg

SEQ ID NO: 9151 - DNA, 20 bp, Homo sapiens
agtcctggtcctgccacctg

SEQ ID NO: 9152 - DNA, 19 bp, Homo sapiens
cagcgtggccagccaggcc

SEQ ID NO: 9153 - DNA, 17 bp, Homo sapiens
cagccacggcctcttgc

SEQ ID NO: 9154 - DNA, 21 bp, Homo sapiens
gctcacgcagcttgccacctg

SEQ ID NO: 9155 - DNA, 23 bp, Homo sapiens
cagcctggtacagctgccacctg

SEQ ID NO: 9156 - DNA, 23 bp, Homo sapiens
gcggcggccagccgggctgcctg

SEQ ID NO: 9157 - DNA, 22 bp, Homo sapiens
cagccatggtggcatgcacctg

SEQ ID NO: 9158 - DNA, 22 bp, Homo sapiens
cagctgtggtggctcacgtctg

SEQ ID NO: 9159 - DNA, 21 bp, Homo sapiens
gccacggctgcctggcctctg

SEQ ID NO: 9160 - DNA, 20 bp, Homo sapiens
gccacagcctcgctcatctg

SEQ ID NO: 9161 - DNA, 22 bp, Homo sapiens
cagccgctgcaggtgccacctg

SEQ ID NO: 9162 - DNA, 22 bp, Homo sapiens
accacggcggcgacgctgcctg

SEQ ID NO: 9163 - DNA, 18 bp, Homo sapiens
cagcctggccaaatgcca

SEQ ID NO: 9164 - DNA, 23 bp, Homo sapiens
cagcctggctggcgcgtggcctg

SEQ ID NO: 9165 - DNA, 19 bp, Homo sapiens
ggccatggcctaccacctg

SEQ ID NO: 9166 - DNA, 20 bp, Homo sapiens
gccgtggccagcccctactg

SEQ ID NO: 9167 - DNA, 19 bp, Homo sapiens
cacggccacacagcacctg

SEQ ID NO: 9168 - DNA, 18 bp, Homo sapiens
cagccatggaccacacct

SEQ ID NO: 9169 - DNA, 22 bp, Homo sapiens
cagctgtggtggctcatgcctg

SEQ ID NO: 9170 - DNA, 28 bp, Homo sapiens
cagcccacggccagctccgcactgcctg

SEQ ID NO: 9171 - DNA, 22 bp, Homo sapiens
cagccaatggcccagcactgcc

SEQ ID NO: 9172 - DNA, 19 bp, Homo sapiens
agccacaggcttctctgcc

SEQ ID NO: 9173 - DNA, 22 bp, Homo sapiens
cagcctgcggccagccagagcc

SEQ ID NO: 9174 - DNA, 23 bp, Homo sapiens
cagccacgctccctcgttgcctg

SEQ ID NO: 9175 - DNA, 18 bp, Homo sapiens
gcctggccagctgcccct

SEQ ID NO: 9176 - DNA, 17 bp, Homo sapiens
agccagggctaccacct

SEQ ID NO: 9177 - DNA, 17 bp, Homo sapiens
agccacaggtcacacac

SEQ ID NO: 9178 - DNA, 21 bp, Homo sapiens
gccctggccagctcagctctg

SEQ ID NO: 9179 - DNA, 22 bp, Homo sapiens
cagccctggctggccagacctg

SEQ ID NO: 9180 - DNA, 18 bp, Homo sapiens
cagccactgcctccatct

SEQ ID NO: 9181 - DNA, 23 bp, Homo sapiens
acctgtggctcaccagccacctg

SEQ ID NO: 9182 - DNA, 19 bp, Homo sapiens
cagtcatcgccagctctcc

SEQ ID NO: 9183 - DNA, 24 bp, Homo sapiens
agcccagaactggtttgccacctg

SEQ ID NO: 9184 - DNA, 22 bp, Homo sapiens
cagtccatacacttgccacctg

SEQ ID NO: 9185 - DNA, 20 bp, Homo sapiens
cagccacggcgggctgagcc

SEQ ID NO: 9186 - DNA, 17 bp, Homo sapiens
gcttggccccaccacct

SEQ ID NO: 9187 - DNA, 22 bp, Homo sapiens
gccctggccagctcctttcctg

SEQ ID NO: 9188 - DNA, 24 bp, Homo sapiens
cagcccgcggccggcgtccgcctg

SEQ ID NO: 9189 - DNA, 20 bp, Homo sapiens
cagccacggccggctcagcc

SEQ ID NO: 9190 - DNA, 22 bp, Homo sapiens
gccgcggtgcggtcgtcacctg

SEQ ID NO: 9191 - DNA, 21 bp, Homo sapiens
cagcccgcggccagctcgcca

SEQ ID NO: 9192 - DNA, 18 bp, Homo sapiens
agcctggcccaaccacct

SEQ ID NO: 9193 - DNA, 22 bp, Homo sapiens
agcagtggccgcaggccacctg

SEQ ID NO: 9194 - DNA, 19 bp, Homo sapiens
cacggccaactgctgcctg

SEQ ID NO: 9195 - DNA, 16 bp, Homo sapiens
gccccggccgccacct

SEQ ID NO: 9196 - DNA, 26 bp, Homo sapiens
gccacagctggctggctggccgtctg

SEQ ID NO: 9197 - DNA, 17 bp, Homo sapiens
cagccatggaccctgcc

SEQ ID NO: 9198 - DNA, 24 bp, Homo sapiens
cagcacgaaccagctcgccacctg

SEQ ID NO: 9199 - DNA, 16 bp, Homo sapiens
gccgcagcgccacctg

SEQ ID NO: 9200 - DNA, 16 bp, Homo sapiens
gccgcggccaacacct

SEQ ID NO: 9201 - DNA, 16 bp, Homo sapiens
cagcgcggccagcgcc

SEQ ID NO: 9202 - DNA, 17 bp, Homo sapiens
agccacggacgcccgcc

SEQ ID NO: 9203 - DNA, 23 bp, Homo sapiens
cagccacggctagccccgcgcac

SEQ ID NO: 9204 - DNA, 19 bp, Homo sapiens
cagctgctgctctccacct

SEQ ID NO: 9205 - DNA, 19 bp, Homo sapiens
cagcccggcctctccacct

SEQ ID NO: 9206 - DNA, 17 bp, Homo sapiens
gccaccggcggccacct

SEQ ID NO: 9207 - DNA, 16 bp, Homo sapiens
cagtcacagccacacc

SEQ ID NO: 9208 - DNA, 20 bp, Homo sapiens
gctatggcgacggccacctg

SEQ ID NO: 9209 - DNA, 19 bp, Homo sapiens
cagccctggccagctggcc

SEQ ID NO: 9210 - DNA, 23 bp, Homo sapiens
cagcctgtggttcctgccacctg

SEQ ID NO: 9211 - DNA, 18 bp, Homo sapiens
cagccacgatcagctcac

SEQ ID NO: 9212 - DNA, 18 bp, Homo sapiens
catggccagcttgctctg

SEQ ID NO: 9213 - DNA, 23 bp, Homo sapiens
gcccggccagccgggtctacctg

SEQ ID NO: 9214 - DNA, 21 bp, Homo sapiens
cagctgggcgtgtgccacctg

SEQ ID NO: 9215 - DNA, 61 bp, Rana tigrina ranavirus
gctctccgacgtcagccgcgcagggcacgtaccagcactggtcggggtaggcgtggagagt

SEQ ID NO: 9216 - DNA, 24 bp, Rana tigrina ranavirus
actggtcggggtaggcgtggagag

SEQ ID NO: 9217 - DNA, 18 bp, Homo sapiens
ctgtgaaaggtgtggaga

SEQ ID NO: 9218 - DNA, 22 bp, Homo sapiens
actggctggaagacgtggagag

SEQ ID NO: 9219 - DNA, 21 bp, Homo sapiens
ctggcttggcggcgtggagag

SEQ ID NO: 9220 - DNA, 18 bp, Homo sapiens
ggggctgggtgtggagag

SEQ ID NO: 9221 - DNA, 17 bp, Homo sapiens
ggttgggtgggtggaga

SEQ ID NO: 9222 - DNA, 17 bp, Homo sapiens
cggttggggtagaggag

SEQ ID NO: 9223 - DNA, 19 bp, Homo sapiens
ctggtcgggtgggtgggag

SEQ ID NO: 9224 - DNA, 20 bp, Homo sapiens
ctggtgggggtggcatggag

SEQ ID NO: 9225 - DNA, 23 bp, Homo sapiens
tggtcggggtaggtccccattgg

SEQ ID NO: 9226 - DNA, 17 bp, Homo sapiens
tggtcagggtaagggag

SEQ ID NO: 9227 - DNA, 18 bp, Homo sapiens
ctgggcgggcgcgtggag

SEQ ID NO: 9228 - DNA, 17 bp, Homo sapiens
ctagctgggcgtggaga

SEQ ID NO: 9229 - DNA, 21 bp, Homo sapiens
ctggtcgggggtggggcgcga

SEQ ID NO: 9230 - DNA, 17 bp, Homo sapiens
ggttgggagcgtgggga

SEQ ID NO: 9231 - DNA, 20 bp, Homo sapiens
ctggccggggtggggcggag

SEQ ID NO: 9232 - DNA, 16 bp, Homo sapiens
tggtcgggggggcggg

SEQ ID NO: 9233 - DNA, 75 bp, Rana tigrina ranavirus
ctcaacgaactcagggtgatggggaccaaggacagcaacaacaagtccctcaagacttactttgaggtgtttgag

SEQ ID NO: 9234 - DNA, 24 bp, Rana tigrina ranavirus
acgaactcagggtgatggggacca

SEQ ID NO: 9235 - DNA, 19 bp, Homo sapiens
ctcagggtggcagaagcca

SEQ ID NO: 9236 - DNA, 17 bp, Homo sapiens
gagctcagggtagagac

SEQ ID NO: 9237 - DNA, 18 bp, Homo sapiens
gaacatgtgatgggggcc

SEQ ID NO: 9238 - DNA, 18 bp, Homo sapiens
gaactcagtgtgaggggg

SEQ ID NO: 9239 - DNA, 23 bp, Homo sapiens
acgagctggtggggatggggacc

SEQ ID NO: 9240 - DNA, 20 bp, Homo sapiens
acaaactcggggagtgggac

SEQ ID NO: 9241 - DNA, 17 bp, Homo sapiens
gaactcagggtagagcc

SEQ ID NO: 9242 - DNA, 20 bp, Homo sapiens
cggctcgggcgcggggacca

SEQ ID NO: 9243 - DNA, 23 bp, Homo sapiens
gagctcagggctcttcggtgggg

SEQ ID NO: 9244 - DNA, 18 bp, Homo sapiens
ccgaggtgtgatggggac

SEQ ID NO: 9245 - DNA, 19 bp, Homo sapiens
acgagtcagggcccctggg

SEQ ID NO: 9246 - DNA, 20 bp, Homo sapiens
gattcagggcattgggacca

SEQ ID NO: 9247 - DNA, 16 bp, Homo sapiens
cgaatctggggatgga

SEQ ID NO: 9248 - DNA, 20 bp, Homo sapiens
ctcagggtgacagataacca

SEQ ID NO: 9249 - DNA, 16 bp, Homo sapiens
gaactggggtgggaac

SEQ ID NO: 9250 - DNA, 21 bp, Homo sapiens
ccagctcagcagtggggacca

SEQ ID NO: 9251 - DNA, 18 bp, Homo sapiens
cgcgctcagggctgggcc

SEQ ID NO: 9252 - DNA, 17 bp, Homo sapiens
gagctcagagtggggaa

SEQ ID NO: 9253 - DNA, 17 bp, Homo sapiens
actcaaggtgatcccca

SEQ ID NO: 9254 - DNA, 21 bp, Homo sapiens
aactcaggggctcaaggacca

SEQ ID NO: 9255 - DNA, 30 bp, Homo sapiens
accaacttagggtgaatcctgtggtcccca

SEQ ID NO: 9256 - DNA, 17 bp, Homo sapiens
acaaacttgggtcgggg

SEQ ID NO: 9257 - DNA, 15 bp, Homo sapiens
ctcagggccagggcc

SEQ ID NO: 9258 - DNA, 17 bp, Homo sapiens
gagctcagggtttgaag

SEQ ID NO: 9259 - DNA, 25 bp, Homo sapiens
accaactcagggtgcctctggatca

SEQ ID NO: 9260 - DNA, 16 bp, Homo sapiens
tcagggccagggacca

SEQ ID NO: 9261 - DNA, 18 bp, Homo sapiens
cgaactcatggtgggacc

SEQ ID NO: 9262 - DNA, 18 bp, Homo sapiens
cgaacccaggggcgggcc

SEQ ID NO: 9263 - DNA, 26 bp, Homo sapiens
actcaggggtgaagttatggtcccca

SEQ ID NO: 9264 - DNA, 19 bp, Homo sapiens
gacctcagaatgggggcca

SEQ ID NO: 9265 - DNA, 19 bp, Homo sapiens
gagccagggtgatgttccc

SEQ ID NO: 9266 - DNA, 20 bp, Homo sapiens
cgaattcgggagatggacca

SEQ ID NO: 9267 - DNA, 19 bp, Homo sapiens
accaactcaggtgcaggga

SEQ ID NO: 9268 - DNA, 19 bp, Homo sapiens
gagcccagggtaggacggg

SEQ ID NO: 9269 - DNA, 18 bp, Homo sapiens
aactcagggttaaatgga

SEQ ID NO: 9270 - DNA, 20 bp, Homo sapiens
acgcgctcagggcccgggcc

SEQ ID NO: 9271 - DNA, 19 bp, Homo sapiens
actcagggtgacgtggacc

SEQ ID NO: 9272 - DNA, 17 bp, Homo sapiens
cgggctcagggtggggg

SEQ ID NO: 9273 - DNA, 20 bp, Homo sapiens
cggctccactgtgggggcca

SEQ ID NO: 9274 - DNA, 22 bp, Homo sapiens
acaaactcagggtttggggcca

SEQ ID NO: 9275 - DNA, 19 bp, Homo sapiens
gagctgggcagtggggacc

SEQ ID NO: 9276 - DNA, 17 bp, Homo sapiens
gagctcagggtaggccc

SEQ ID NO: 9277 - DNA, 24 bp, Homo sapiens
acgagccatcccctatggggacca

SEQ ID NO: 9278 - DNA, 18 bp, Homo sapiens
gattcagtatggggatca

SEQ ID NO: 9279 - DNA, 21 bp, Homo sapiens
aagcttagggtggggcggcca

SEQ ID NO: 9280 - DNA, 17 bp, Homo sapiens
gacccatgatggggacc

SEQ ID NO: 9281 - DNA, 18 bp, Homo sapiens
actttgggtgataatgga

SEQ ID NO: 9282 - DNA, 17 bp, Homo sapiens
gaacgccagtgtggggg

SEQ ID NO: 9283 - DNA, 19 bp, Homo sapiens
caagcttggggtattaagg

SEQ ID NO: 9284 - DNA, 63 bp, Rana tigrina ranavirus
tctggggtccaggacacaatctctgctagagcgcaaccgcggggagggttcctgagctctgga

SEQ ID NO: 9285 - DNA, 24 bp, Rana tigrina ranavirus
tccaggacacaatctctgctagag

SEQ ID NO: 9286 - DNA, 18 bp, Homo sapiens
agggaatctctgctggag

SEQ ID NO: 9287 - DNA, 29 bp, Homo sapiens
tccaagacgcagtttttggctctagcaga

SEQ ID NO: 9288 - DNA, 19 bp, Homo sapiens
tctaggactcagacctaga

SEQ ID NO: 9289 - DNA, 18 bp, Homo sapiens
tccagggacacctctgct

SEQ ID NO: 9290 - DNA, 18 bp, Homo sapiens
ggacacaacctggccgag

SEQ ID NO: 9291 - DNA, 18 bp, Homo sapiens
tccgggacacaacttccg

SEQ ID NO: 9292 - DNA, 22 bp, Homo sapiens
cccaggacatgatcaggtggag

SEQ ID NO: 9293 - DNA, 17 bp, Homo sapiens
tccaggatcagtctctg

SEQ ID NO: 9294 - DNA, 19 bp, Homo sapiens
ggacacaaggttgctggag

SEQ ID NO: 9295 - DNA, 24 bp, Homo sapiens
tccaggaacagtccccacctggag

SEQ ID NO: 9296 - DNA, 22 bp, Homo sapiens
cccaggacatggagctttagag

SEQ ID NO: 9297 - DNA, 19 bp, Homo sapiens
tctgggacacaattttctg

SEQ ID NO: 9298 - DNA, 24 bp, Homo sapiens
tctaggacatggattttgctagag

SEQ ID NO: 9299 - DNA, 19 bp, Homo sapiens
tccatgggccctctgctag

SEQ ID NO: 9300 - DNA, 24 bp, Homo sapiens
tccaggactcagtttttctatcag

SEQ ID NO: 9301 - DNA, 21 bp, Homo sapiens
tccaggacaaaatcaacagag

SEQ ID NO: 9302 - DNA, 26 bp, Homo sapiens
tccaggacacagtgagggctctagcg

SEQ ID NO: 9303 - DNA, 20 bp, Homo sapiens
tccgagggtctctgctggag

SEQ ID NO: 9304 - DNA, 17 bp, Homo sapiens
cagggcacaatctacag

SEQ ID NO: 9305 - DNA, 18 bp, Homo sapiens
tccagaacgcagtctgga

SEQ ID NO: 9306 - DNA, 19 bp, Homo sapiens
cccaggacgcaccacagct

SEQ ID NO: 9307 - DNA, 19 bp, Homo sapiens
cccaggacgcgcccgcgct

SEQ ID NO: 9308 - DNA, 72 bp, Equine herpesvirus 2
tgggtggttaacaagaacaacaccctgctgcgctttgactacacctgcgccctcaggtccctctgccaccca

SEQ ID NO: 9309 - DNA, 24 bp, Equine herpesvirus 2
ctgcgccctcaggtccctctgcca

SEQ ID NO: 9310 - DNA, 19 bp, Homo sapiens
tgcgccctcacgtcccctg

SEQ ID NO: 9311 - DNA, 19 bp, Homo sapiens
tgtgctctgccctctgcca

SEQ ID NO: 9312 - DNA, 21 bp, Homo sapiens
ctgcgctctcaggccggactc

SEQ ID NO: 9313 - DNA, 18 bp, Homo sapiens
ccgcgctctcggcctgcc

SEQ ID NO: 9314 - DNA, 17 bp, Homo sapiens
tgctccctcctctgcca

SEQ ID NO: 9315 - DNA, 17 bp, Homo sapiens
ctgcttgatccctctgc

SEQ ID NO: 9316 - DNA, 19 bp, Homo sapiens
cgcctcgccttcctctgcc

SEQ ID NO: 9317 - DNA, 17 bp, Homo sapiens
tggcccagtcctctgcc

SEQ ID NO: 9318 - DNA, 17 bp, Homo sapiens
gcgcccgctcctctgcc

SEQ ID NO: 9319 - DNA, 21 bp, Homo sapiens
ctgcacagtgtctctttgtca

SEQ ID NO: 9320 - DNA, 23 bp, Homo sapiens
ctgggcaggaggtccttctgcca

SEQ ID NO: 9321 - DNA, 24 bp, Homo sapiens
gcctctcagaccaggcctctgcca

SEQ ID NO: 9322 - DNA, 21 bp, Homo sapiens
ctgcccttctcagctctgcca

SEQ ID NO: 9323 - DNA, 22 bp, Homo sapiens
ctgcgccctcagctcacgtctg

SEQ ID NO: 9324 - DNA, 16 bp, Homo sapiens
tgtgcctcaggtcctc

SEQ ID NO: 9325 - DNA, 24 bp, Homo sapiens
ctgtgccatctcccctctctgcca

SEQ ID NO: 9326 - DNA, 17 bp, Homo sapiens
gccctggctctctgcca

SEQ ID NO: 9327 - DNA, 21 bp, Homo sapiens
ctgtgcccccaggctctgcca

SEQ ID NO: 9328 - DNA, 22 bp, Homo sapiens
ctgtgtcctctcccctttctgc

SEQ ID NO: 9329 - DNA, 17 bp, Homo sapiens
ctgtcctctctctctgc

SEQ ID NO: 9330 - DNA, 20 bp, Homo sapiens
ctgtgccccaggtcctccct

SEQ ID NO: 9331 - DNA, 19 bp, Homo sapiens
ctgctcccactcctctgcc

SEQ ID NO: 9332 - DNA, 18 bp, Homo sapiens
ctgctcactccctctgcc

SEQ ID NO: 9333 - DNA, 18 bp, Homo sapiens
ctgtcccaccccctctgc

SEQ ID NO: 9334 - DNA, 22 bp, Homo sapiens
ctgtgtccttgttcctctgcca

SEQ ID NO: 9335 - DNA, 16 bp, Homo sapiens
ctgcccctcagtctgc

SEQ ID NO: 9336 - DNA, 18 bp, Homo sapiens
ctgcgccctcgcactgcc

SEQ ID NO: 9337 - DNA, 21 bp, Homo sapiens
gccttccttcttcctctgcca

SEQ ID NO: 9338 - DNA, 18 bp, Homo sapiens
ctgtgcctcaggtgggcc

SEQ ID NO: 9339 - DNA, 18 bp, Homo sapiens
tgcatcctcaggtttcta

SEQ ID NO: 9340 - DNA, 24 bp, Homo sapiens
ctgtggcctcctgtgcctctgcca

SEQ ID NO: 9341 - DNA, 22 bp, Homo sapiens
ctgcgcccttggggcgtggctg

SEQ ID NO: 9342 - DNA, 19 bp, Homo sapiens
gcctcggcaacccctctgc

SEQ ID NO: 9343 - DNA, 20 bp, Homo sapiens
tgtgcctgtcatctctgcca

SEQ ID NO: 9344 - DNA, 17 bp, Homo sapiens
gccctcaggtcacacca

SEQ ID NO: 9345 - DNA, 20 bp, Homo sapiens
ctgtgccctactgcctctgc

SEQ ID NO: 9346 - DNA, 23 bp, Homo sapiens
ctgcgccctgtggaaaggctgcc

SEQ ID NO: 9347 - DNA, 21 bp, Homo sapiens
ctggctctcaggttccctctg

SEQ ID NO: 9348 - DNA, 17 bp, Homo sapiens
gccttcctccctctgcc

SEQ ID NO: 9349 - DNA, 18 bp, Homo sapiens
ctgtcctctccctctgcc

SEQ ID NO: 9350 - DNA, 18 bp, Homo sapiens
gcgcccggctcctctgcc

SEQ ID NO: 9351 - DNA, 23 bp, Homo sapiens
ctggcttatttctccctctgcca

SEQ ID NO: 9352 - DNA, 17 bp, Homo sapiens
ctgcccctcaggtcctc

SEQ ID NO: 9353 - DNA, 19 bp, Homo sapiens
gcctctgcacacctctgcc

SEQ ID NO: 9354 - DNA, 22 bp, Homo sapiens
ctgcgccccttggggactgcca

SEQ ID NO: 9355 - DNA, 17 bp, Homo sapiens
ctgcttcctccctctgc

SEQ ID NO: 9356 - DNA, 16 bp, Homo sapiens
ctggccctgcctctgc

SEQ ID NO: 9357 - DNA, 18 bp, Homo sapiens
gcctccgaagccctctgc

SEQ ID NO: 9358 - DNA, 24 bp, Homo sapiens
ctgctgcctgatccctccctctgc

SEQ ID NO: 9359 - DNA, 18 bp, Homo sapiens
ctgcgcccccaggttccc

SEQ ID NO: 9360 - DNA, 22 bp, Homo sapiens
ctgctcctcgggtccctcacca

SEQ ID NO: 9361 - DNA, 20 bp, Homo sapiens
gccctcgaagctctctgcca

SEQ ID NO: 9362 - DNA, 21 bp, Homo sapiens
ctgctgccctcctcctctgcc

SEQ ID NO: 9363 - DNA, 22 bp, Homo sapiens
ctatgccctcaggtttgcacca

SEQ ID NO: 9364 - DNA, 21 bp, Homo sapiens
tgtcccctcttctctctgcca

SEQ ID NO: 9365 - DNA, 21 bp, Homo sapiens
gccccgtatcttccctctgcc

SEQ ID NO: 9366 - DNA, 15 bp, Homo sapiens
gccccaccctctgcc

SEQ ID NO: 9367 - DNA, 20 bp, Homo sapiens
ctgtgccctcagcttctcct

SEQ ID NO: 9368 - DNA, 19 bp, Homo sapiens
ctgcccctccgtctctgcc

SEQ ID NO: 9369 - DNA, 18 bp, Homo sapiens
ctggccttggtctctgcc

SEQ ID NO: 9370 - DNA, 21 bp, Homo sapiens
tgtgcccgtccttccctctgc

SEQ ID NO: 9371 - DNA, 17 bp, Homo sapiens
ctgcccctcgggtttgc

SEQ ID NO: 9372 - DNA, 22 bp, Homo sapiens
ctgcccctccccatctctgtca

SEQ ID NO: 9373 - DNA, 20 bp, Homo sapiens
tgagctccttctctctgcca

SEQ ID NO: 9374 - DNA, 21 bp, Homo sapiens
ctgtggccgtcttctctgcca

SEQ ID NO: 9375 - DNA, 17 bp, Homo sapiens
tggcccggctctctgcc

SEQ ID NO: 9376 - DNA, 20 bp, Homo sapiens
ctgccccctgtcccctctgc

SEQ ID NO: 9377 - DNA, 18 bp, Homo sapiens
gccctcagtcagctgtca

SEQ ID NO: 9378 - DNA, 17 bp, Homo sapiens
ctgcgccccgggctctg

SEQ ID NO: 9379 - DNA, 21 bp, Homo sapiens
ctgctgcctctccctctgcca

SEQ ID NO: 9380 - DNA, 19 bp, Homo sapiens
ctgttctcagcctctgcca

SEQ ID NO: 9381 - DNA, 20 bp, Homo sapiens
ctgtgcttccaggtctttcc

SEQ ID NO: 9382 - DNA, 17 bp, Homo sapiens
ctgctgcccctctctgc

SEQ ID NO: 9383 - DNA, 22 bp, Homo sapiens
ctgagcctttgtcactctgcca

SEQ ID NO: 9384 - DNA, 17 bp, Homo sapiens
tgggccctcaggtttgc

SEQ ID NO: 9385 - DNA, 18 bp, Homo sapiens
ctgtgcccccagggtgcc

SEQ ID NO: 9386 - DNA, 16 bp, Homo sapiens
ctgccccaccctctgc

SEQ ID NO: 9387 - DNA, 22 bp, Homo sapiens
ctgcgccctcgggcgggctctg

SEQ ID NO: 9388 - DNA, 18 bp, Homo sapiens
ctgtccagtctctctgcc

SEQ ID NO: 9389 - DNA, 19 bp, Homo sapiens
ctgcgctctcaggccagcc

SEQ ID NO: 9390 - DNA, 23 bp, Homo sapiens
ctgtgtccccactggctctgcca

SEQ ID NO: 9391 - DNA, 20 bp, Homo sapiens
cgcgccctcgggccctgcca

SEQ ID NO: 9392 - DNA, 15 bp, Homo sapiens
gccctgccctctgcc

SEQ ID NO: 9393 - DNA, 23 bp, Homo sapiens
ctgcccctccggcctctttgcca

SEQ ID NO: 9394 - DNA, 20 bp, Homo sapiens
ctgctcttcttcccctctgc

SEQ ID NO: 9395 - DNA, 21 bp, Homo sapiens
ctgcgccctcgggctgctcca

SEQ ID NO: 9396 - DNA, 17 bp, Homo sapiens
ctgccaggtccctttgc

SEQ ID NO: 9397 - DNA, 19 bp, Homo sapiens
ctgtcctcagaccctttgc

SEQ ID NO: 9398 - DNA, 18 bp, Homo sapiens
ctgccctctcaggtcacc

SEQ ID NO: 9399 - DNA, 16 bp, Homo sapiens
gcccaagtccctctgc

SEQ ID NO: 9400 - DNA, 19 bp, Homo sapiens
ctggtcctcaggtcttctg

SEQ ID NO: 9401 - DNA, 19 bp, Homo sapiens
gccctctgagcccctctgc

SEQ ID NO: 9402 - DNA, 18 bp, Homo sapiens
ctggccctcaggcctgcc

SEQ ID NO: 9403 - DNA, 22 bp, Homo sapiens
ctggcccccacctttctctgcc

SEQ ID NO: 9404 - DNA, 16 bp, Homo sapiens
gccctcagccactgcc

SEQ ID NO: 9405 - DNA, 23 bp, Homo sapiens
ctgtcccttcggtggcctctgcc

SEQ ID NO: 9406 - DNA, 15 bp, Homo sapiens
tggccggccctctgc

SEQ ID NO: 9407 - DNA, 20 bp, Homo sapiens
gcctctgcacacctctgcca

SEQ ID NO: 9408 - DNA, 16 bp, Homo sapiens
ctgcgcccctctctgc

SEQ ID NO: 9409 - DNA, 17 bp, Homo sapiens
tggccttctcctctgcc

SEQ ID NO: 9410 - DNA, 21 bp, Homo sapiens
gcgcctttacagtctctgcca

SEQ ID NO: 9411 - DNA, 24 bp, Homo sapiens
ctgggctctcaggtccgagggcca

SEQ ID NO: 9412 - DNA, 23 bp, Homo sapiens
ctgtattctcactccctctgtca

SEQ ID NO: 9413 - DNA, 21 bp, Homo sapiens
tgtgctggggtccctctgcca

SEQ ID NO: 9414 - DNA, 16 bp, Homo sapiens
ccgcgcccagcctcct

SEQ ID NO: 9415 - DNA, 128 bp, Equine herpesvirus 2
cccctgtttgacttttacgcggtgggcgcgccgggcgccaggggtgtggcctacagggccacccacaggggcatggtgggcaacatcccccagtccctggcccccgccgggtttcaggagtgcagggg

SEQ ID NO: 9416 - DNA, 24 bp, Equine herpesvirus 2
tcccccagtccctggcccccgccg

SEQ ID NO: 9417 - DNA, 19 bp, Homo sapiens
ccccagggagcccccgccg

SEQ ID NO: 9418 - DNA, 21 bp, Homo sapiens
tccaccagtccctggaacccg

SEQ ID NO: 9419 - DNA, 18 bp, Homo sapiens
tcccccatccctggtccc

SEQ ID NO: 9420 - DNA, 18 bp, Homo sapiens
tcccacagaagcccccgc

SEQ ID NO: 9421 - DNA, 26 bp, Homo sapiens
tctcctggccctgggggcgcccgccg

SEQ ID NO: 9422 - DNA, 18 bp, Homo sapiens
tcccccagctctggcccc

SEQ ID NO: 9423 - DNA, 23 bp, Homo sapiens
tctcctgtcccgcgaccccgccg

SEQ ID NO: 9424 - DNA, 21 bp, Homo sapiens
ccactgttctggcccctgccg

SEQ ID NO: 9425 - DNA, 24 bp, Homo sapiens
tcctctggtccctgatcctaggcc

SEQ ID NO: 9426 - DNA, 22 bp, Homo sapiens
ccccccggggcagcccccgccg

SEQ ID NO: 9427 - DNA, 21 bp, Homo sapiens
tcccctagcgccatcccctgc

SEQ ID NO: 9428 - DNA, 20 bp, Homo sapiens
gtctccggtcctccccgccg

SEQ ID NO: 9429 - DNA, 23 bp, Homo sapiens
tcccccagctcccagctccctgc

SEQ ID NO: 9430 - DNA, 20 bp, Homo sapiens
ccccggccctggaaaggccg

SEQ ID NO: 9431 - DNA, 24 bp, Homo sapiens
cctcccagtccctccactctgccg

SEQ ID NO: 9432 - DNA, 18 bp, Homo sapiens
cccggtcgctccccgccg

SEQ ID NO: 9433 - DNA, 21 bp, Homo sapiens
tctcccgcaccgctcccgccg

SEQ ID NO: 9434 - DNA, 16 bp, Homo sapiens
ccccagtccagctcgc

SEQ ID NO: 9435 - DNA, 20 bp, Homo sapiens
cccccggccggggccctcgc

SEQ ID NO: 9436 - DNA, 24 bp, Homo sapiens
tcccccggctcctggggctcgccg

SEQ ID NO: 9437 - DNA, 23 bp, Homo sapiens
cccagtcccgccgctccctgccg

SEQ ID NO: 9438 - DNA, 21 bp, Homo sapiens
tcccccaggctgtcccctcgc

SEQ ID NO: 9439 - DNA, 17 bp, Homo sapiens
tctcccggtcctggccc

SEQ ID NO: 9440 - DNA, 20 bp, Homo sapiens
tcccccagcctgctggctgc

SEQ ID NO: 9441 - DNA, 24 bp, Homo sapiens
ccccggtcctggcccaccccgccg

SEQ ID NO: 9442 - DNA, 18 bp, Homo sapiens
cccagcccctcctcgtcg

SEQ ID NO: 9443 - DNA, 17 bp, Homo sapiens
ccccaggtcctgccccc

SEQ ID NO: 9444 - DNA, 22 bp, Homo sapiens
tcccctggccctgggggcgccg

SEQ ID NO: 9445 - DNA, 21 bp, Homo sapiens
tcccttgttccctggcacccg

SEQ ID NO: 9446 - DNA, 21 bp, Homo sapiens
cccagtctgcggcccccgccg

SEQ ID NO: 9447 - DNA, 18 bp, Homo sapiens
cccatcgccggcccctgc

SEQ ID NO: 9448 - DNA, 22 bp, Homo sapiens
tctccacataaggcccccgccg

SEQ ID NO: 9449 - DNA, 17 bp, Homo sapiens
cccccagcgcccccgcc

SEQ ID NO: 9450 - DNA, 21 bp, Homo sapiens
ccccggtcccggtccccgccg

SEQ ID NO: 9451 - DNA, 21 bp, Homo sapiens
tctcctgggccttggcccccg

SEQ ID NO: 9452 - DNA, 19 bp, Homo sapiens
cccctcggccgcccccgcc

SEQ ID NO: 9453 - DNA, 22 bp, Homo sapiens
ccccctggttcttggcccctcc

SEQ ID NO: 9454 - DNA, 18 bp, Homo sapiens
tcccctggtcctggcccc

SEQ ID NO: 9455 - DNA, 19 bp, Homo sapiens
cccagtcccgctcctgccg

SEQ ID NO: 9456 - DNA, 27 bp, Homo sapiens
tcccccacgttccccccacccccgccg

SEQ ID NO: 9457 - DNA, 18 bp, Homo sapiens
atccctcgggcccccgcc

SEQ ID NO: 9458 - DNA, 19 bp, Homo sapiens
tcccctgctctctggcccc

SEQ ID NO: 9459 - DNA, 20 bp, Homo sapiens
tcctccggccgcccccgccg

SEQ ID NO: 9460 - DNA, 16 bp, Homo sapiens
ccagtcccgcccctgc

SEQ ID NO: 9461 - DNA, 25 bp, Homo sapiens
tcccccagtcccgtagccctcgtcg

SEQ ID NO: 9462 - DNA, 19 bp, Homo sapiens
tcccccggcctgcctccgc

SEQ ID NO: 9463 - DNA, 24 bp, Homo sapiens
cccagtcctccctacggctcctgc

SEQ ID NO: 9464 - DNA, 27 bp, Homo sapiens
tcccccaggccttggcaggtcctgccg

SEQ ID NO: 9465 - DNA, 23 bp, Homo sapiens
tcaccctagtcctagccctgccg

SEQ ID NO: 9466 - DNA, 16 bp, Homo sapiens
agtccctaccctgccg

SEQ ID NO: 9467 - DNA, 20 bp, Homo sapiens
ccctagccctggctcttgcc

SEQ ID NO: 9468 - DNA, 21 bp, Homo sapiens
cctctgtggctctccccgccg

SEQ ID NO: 9469 - DNA, 18 bp, Homo sapiens
cccccggcggcccttgcc

SEQ ID NO: 9470 - DNA, 24 bp, Homo sapiens
cccccagtcccgcggcccccgccg

SEQ ID NO: 9471 - DNA, 118 bp, Equine herpesvirus 2
ggggcccgccagctacgcgagctacgtggtcaggggggacaacctggtgacggccgtcagctacgggcgggccatggtcgccttcgaccagtttgtgtccaggctggtggacaacccc

SEQ ID NO: 9472 - DNA, 24 bp, Equine herpesvirus 2
gcgggccatggtcgccttcgacca

SEQ ID NO: 9473 - DNA, 18 bp, Homo sapiens
gcgggccatggtccctcc

SEQ ID NO: 9474 - DNA, 19 bp, Homo sapiens
gcgggccatggctgggacc

SEQ ID NO: 9475 - DNA, 19 bp, Homo sapiens
gcgcgcatcgccttcggcc

SEQ ID NO: 9476 - DNA, 21 bp, Homo sapiens
gcaggccatgccttttggcca

SEQ ID NO: 9477 - DNA, 24 bp, Homo sapiens
gctgggctgtgccgcctttcggcc

SEQ ID NO: 9478 - DNA, 77 bp, Lumpy skin disease virus
gcgtctaaatttaaaaaagtttatatattagtaccaaatataaatatactaaagatttttaattatagtatggacgt

SEQ ID NO: 9479 - DNA, 24 bp, Lumpy skin disease virus
tctaaatttaaaaaagtttatata

SEQ ID NO: 9480 - DNA, 19 bp, Homo sapiens
tctaaattttaaaaagctt

SEQ ID NO: 9481 - DNA, 18 bp, Homo sapiens
tcaaaatttaaaaaagtt

SEQ ID NO: 9482 - DNA, 19 bp, Homo sapiens
taaatttaaaaagtttata

SEQ ID NO: 9483 - DNA, 19 bp, Homo sapiens
tctaaatttaagagctcat

SEQ ID NO: 9484 - DNA, 20 bp, Homo sapiens
taaatcacaaagtttatata

SEQ ID NO: 9485 - DNA, 18 bp, Homo sapiens
tcttaatttaaaaaagtt

SEQ ID NO: 9486 - DNA, 25 bp, Homo sapiens
tctaaattttaagaagtcctatata

SEQ ID NO: 9487 - DNA, 23 bp, Homo sapiens
tccaaatttgaaaaaaatttata

SEQ ID NO: 9488 - DNA, 60 bp, Lumpy skin disease virus
tgtttacaatagtaactagtaaaatgaagtcatcattagaagatttattatctgtataca

SEQ ID NO: 9489 - DNA, 24 bp, Lumpy skin disease virus
ttagaagatttattatctgtatac

SEQ ID NO: 9490 - DNA, 19 bp, Homo sapiens
gaagatttacaaggtatac

SEQ ID NO: 9491 - DNA, 16 bp, Homo sapiens
ttagaaaattttgtat

SEQ ID NO: 9492 - DNA, 20 bp, Homo sapiens
ttaaaagatttattgcagta

SEQ ID NO: 9493 - DNA, 21 bp, Homo sapiens
ttagaagcatttactgtatac

SEQ ID NO: 9494 - DNA, 20 bp, Homo sapiens
ttagaaatgacatctgtata

SEQ ID NO: 9495 - DNA, 21 bp, Homo sapiens
taggagattactgctgtatac

SEQ ID NO: 9496 - DNA, 19 bp, Homo sapiens
ttagagatttattccactg

SEQ ID NO: 9497 - DNA, 105 bp, Lumpy skin disease virus
ggttagaaacatttggtttatgacaattccggataccttttctcagtataatcaaatcttgggaagatcaataagaaagttttcatataataatataacagaacc

SEQ ID NO: 9498 - DNA, 24 bp, Lumpy skin disease virus
tatgacaattccggataccttttc

SEQ ID NO: 9499 - DNA, 20 bp, Homo sapiens
tgacaattccagtggctttc

SEQ ID NO: 9500 - DNA, 23 bp, Homo sapiens
tatgacaattcatttctcttttc

SEQ ID NO: 9501 - DNA, 21 bp, Homo sapiens
atgacaattcgttcccttttc

SEQ ID NO: 9502 - DNA, 20 bp, Homo sapiens
cataaccaagataccttttc

SEQ ID NO: 9503 - DNA, 20 bp, Homo sapiens
tgacaagtgacaaccttttc

SEQ ID NO: 9504 - DNA, 20 bp, Homo sapiens
tgacaacttcgattcttttc

SEQ ID NO: 9505 - DNA, 17 bp, Homo sapiens
gacagttcttacctttt

SEQ ID NO: 9506 - DNA, 19 bp, Homo sapiens
caattccaattgtcctttt

SEQ ID NO: 9507 - DNA, 23 bp, Homo sapiens
atggcagttccggatggctgttc

SEQ ID NO: 9508 - DNA, 19 bp, Homo sapiens
tgcaattcgatcacctttt

SEQ ID NO: 9509 - DNA, 22 bp, Homo sapiens
tatggaattttggacacctttt

SEQ ID NO: 9510 - DNA, 64 bp, Alcelaphine herpesvirus 1
ggctgcctaatcttacagggagcagaaagacacacagactctgctatcgggagatcaaggtgcc

SEQ ID NO: 9511 - DNA, 23 bp, Alcelaphine herpesvirus 1
tgctatcgggagatcaaggtgcc

SEQ ID NO: 9512 - DNA, 22 bp, Homo sapiens
tgccattcaaaattaaggtgcc

SEQ ID NO: 9513 - DNA, 18 bp, Homo sapiens
tgctattgtggaggatgc

SEQ ID NO: 9514 - DNA, 18 bp, Homo sapiens
tgtatcagattgaggtgc

SEQ ID NO: 9515 - DNA, 20 bp, Homo sapiens
tgcaaaccaagatcaaggtg

SEQ ID NO: 9516 - DNA, 20 bp, Homo sapiens
tgctatggtctccaaggtgc

SEQ ID NO: 9517 - DNA, 21 bp, Homo sapiens
tgcaatctcaatcaaggtgcc

SEQ ID NO: 9518 - DNA, 22 bp, Homo sapiens
tgccatcggacaggagggtgcc

SEQ ID NO: 9519 - DNA, 19 bp, Homo sapiens
tgcagtgaagatcagggtg

SEQ ID NO: 9520 - DNA, 18 bp, Homo sapiens
ctgtcgggagatctcagc

SEQ ID NO: 9521 - DNA, 19 bp, Homo sapiens
tcagtccaagatcaaggtg

SEQ ID NO: 9522 - DNA, 16 bp, Homo sapiens
tgctgtcaggagaggc

SEQ ID NO: 9523 - DNA, 17 bp, Homo sapiens
gctagagatcagggtgc

SEQ ID NO: 9524 - DNA, 131 bp, Bovine herpesvirus 1
ataagtttatatatatattattggcccgagtgcgagccctgggacccgcgccagctctcacgaccgtgcccgtgagaacgctggcagaatgccagcgttcgcacaaaactcaataagtatatatatattat

SEQ ID NO: 9525 - DNA, 24 bp, Bovine herpesvirus 1
tatattattggcccgagtgcgagc

SEQ ID NO: 9526 - DNA, 26 bp, Homo sapiens
tacattattggctttcttttgtgagc

SEQ ID NO: 9527 - DNA, 20 bp, Homo sapiens
tatgtcattggcatctagtg

SEQ ID NO: 9528 - DNA, 22 bp, Homo sapiens
tattattggctgcattacagag

SEQ ID NO: 9529 - DNA, 18 bp, Homo sapiens
taattattaggctgagtg

SEQ ID NO: 9530 - DNA, 20 bp, Homo sapiens
catgttattggcttctgagt

SEQ ID NO: 9531 - DNA, 98 bp, Bovine herpesvirus 1
ggcgagggtcctggcagaaggccggccggtcggagctggctagccggccgcggctggatgtctgtctctctggctggccggctttctgctccttcgtc

SEQ ID NO: 9532 - DNA, 24 bp, Bovine herpesvirus 1
tggcagaaggccggccggtcggag

SEQ ID NO: 9533 - DNA, 18 bp, Homo sapiens
ggcagaaggctggctgga

SEQ ID NO: 9534 - DNA, 20 bp, Homo sapiens
tggcagaaggcgggctgtgg

SEQ ID NO: 9535 - DNA, 20 bp, Homo sapiens
ggcagaaggccggcccagag

SEQ ID NO: 9536 - DNA, 19 bp, Homo sapiens
tggcagaggagccggagag

SEQ ID NO: 9537 - DNA, 18 bp, Homo sapiens
tggcaggtggccggccag

SEQ ID NO: 9538 - DNA, 17 bp, Homo sapiens
tggcggggcggccggtc

SEQ ID NO: 9539 - DNA, 18 bp, Homo sapiens
tggcggaggggcggccgg

SEQ ID NO: 9540 - DNA, 26 bp, Homo sapiens
tggtgcgagggccagaagggttggag

SEQ ID NO: 9541 - DNA, 27 bp, Homo sapiens
tggcagaaggctggtagctccgaccgg

SEQ ID NO: 9542 - DNA, 23 bp, Homo sapiens
tggcagaagcttggccgtgtgag

SEQ ID NO: 9543 - DNA, 17 bp, Homo sapiens
tggcagaaggtggctgg

SEQ ID NO: 9544 - DNA, 21 bp, Homo sapiens
tagcagagttctcggtcggag

SEQ ID NO: 9545 - DNA, 23 bp, Homo sapiens
tggtggaaggtaggctggggcgg

SEQ ID NO: 9546 - DNA, 22 bp, Homo sapiens
tggtggggggccagcccccaag

SEQ ID NO: 9547 - DNA, 22 bp, Homo sapiens
tggtggaagagccggtcctcga

SEQ ID NO: 9548 - DNA, 23 bp, Homo sapiens
tggagagggcggctaggtcggag

SEQ ID NO: 9549 - DNA, 22 bp, Homo sapiens
ggcaggaggccggcagcaggag

SEQ ID NO: 9550 - DNA, 18 bp, Homo sapiens
tggcagaagctggtccag

SEQ ID NO: 9551 - DNA, 23 bp, Homo sapiens
tgccagaaggctgaacactggag

SEQ ID NO: 9552 - DNA, 22 bp, Homo sapiens
tggcaggagagctgggcgggag

SEQ ID NO: 9553 - DNA, 20 bp, Homo sapiens
tggcggcgggccggcctagg

SEQ ID NO: 9554 - DNA, 16 bp, Homo sapiens
gcagacgccggtcgga

SEQ ID NO: 9555 - DNA, 16 bp, Homo sapiens
tggcagaaggctgtgg

SEQ ID NO: 9556 - DNA, 21 bp, Homo sapiens
gcgggaggccggcgggtggag

SEQ ID NO: 9557 - DNA, 21 bp, Homo sapiens
tggcaggagggctggtcagag

SEQ ID NO: 9558 - DNA, 24 bp, Homo sapiens
tggcagaagcctggtacccagggg

SEQ ID NO: 9559 - DNA, 22 bp, Homo sapiens
ggcaggaggctggccggcccgg

SEQ ID NO: 9560 - DNA, 21 bp, Homo sapiens
tgtagaaggccggcctatcag

SEQ ID NO: 9561 - DNA, 80 bp, Bovine herpesvirus 1
tccctgcttgctcacggccgcccctcacccttctccctttcgcgattggcgggaggaccccggcggtgagcaagcaggga

SEQ ID NO: 9562 - DNA, 24 bp, Bovine herpesvirus 1
gaggaccccggcggtgagcaagca

SEQ ID NO: 9563 - DNA, 26 bp, Homo sapiens
ggagcccagctggtggtgagtgagca

SEQ ID NO: 9564 - DNA, 17 bp, Homo sapiens
gggacctcggcggcggc

SEQ ID NO: 9565 - DNA, 23 bp, Homo sapiens
gaggaccctgcacaaagcaggca

SEQ ID NO: 9566 - DNA, 25 bp, Homo sapiens
gagggcattcaccgggtgggtgagc

SEQ ID NO: 9567 - DNA, 17 bp, Homo sapiens
ggccccgggagtgagca

SEQ ID NO: 9568 - DNA, 22 bp, Homo sapiens
gaaccccggctcggggtaagca

SEQ ID NO: 9569 - DNA, 19 bp, Homo sapiens
aaggaccccaggggcaggc

SEQ ID NO: 9570 - DNA, 18 bp, Homo sapiens
aagggtcccggcagcgag

SEQ ID NO: 9571 - DNA, 19 bp, Homo sapiens
gaggcctctgccagcaagc

SEQ ID NO: 9572 - DNA, 19 bp, Homo sapiens
gagggccgcggcgaggggc

SEQ ID NO: 9573 - DNA, 22 bp, Homo sapiens
gaggttcccggcagcccaggca

SEQ ID NO: 9574 - DNA, 18 bp, Homo sapiens
gggtccccagagtgggca

SEQ ID NO: 9575 - DNA, 21 bp, Homo sapiens
ggacccggcggctcgccaggc

SEQ ID NO: 9576 - DNA, 17 bp, Homo sapiens
gaggaccctggagggag

SEQ ID NO: 9577 - DNA, 17 bp, Homo sapiens
gagggccccggcgaagc

SEQ ID NO: 9578 - DNA, 17 bp, Homo sapiens
ggggtcccggcgagagc

SEQ ID NO: 9579 - DNA, 21 bp, Homo sapiens
gagggtcccggcggcaggagc

SEQ ID NO: 9580 - DNA, 17 bp, Homo sapiens
ggccccggagagcaagc

SEQ ID NO: 9581 - DNA, 21 bp, Homo sapiens
gggacccacagtgagtgggca

SEQ ID NO: 9582 - DNA, 22 bp, Homo sapiens
gaggaccccagggttgcaagca

SEQ ID NO: 9583 - DNA, 17 bp, Homo sapiens
gaggaccctgcctgagc

SEQ ID NO: 9584 - DNA, 20 bp, Homo sapiens
gagaaccccaggggcaggca

SEQ ID NO: 9585 - DNA, 19 bp, Homo sapiens
aggactttggtgataagca

SEQ ID NO: 9586 - DNA, 22 bp, Homo sapiens
gaggacccaggccacacgggca

SEQ ID NO: 9587 - DNA, 25 bp, Homo sapiens
gagggccccggcgcgagaggtgggc

SEQ ID NO: 9588 - DNA, 23 bp, Homo sapiens
gaggaccctgagccctggtgggc

SEQ ID NO: 9589 - DNA, 17 bp, Homo sapiens
ggatccacagagcaggc

SEQ ID NO: 9590 - DNA, 21 bp, Homo sapiens
gaggaccctggccccaccaag

SEQ ID NO: 9591 - DNA, 18 bp, Homo sapiens
gagggatccggcggcggc

SEQ ID NO: 9592 - DNA, 25 bp, Homo sapiens
aggaccccgggggacagggcgggca

SEQ ID NO: 9593 - DNA, 22 bp, Homo sapiens
ggggccccggcgtgtgctgggc

SEQ ID NO: 9594 - DNA, 21 bp, Homo sapiens
ggaccccggcgggtgagggac

SEQ ID NO: 9595 - DNA, 18 bp, Homo sapiens
aaggaccctggtggggca

SEQ ID NO: 9596 - DNA, 17 bp, Homo sapiens
ggggcgggtgagcaggc

SEQ ID NO: 9597 - DNA, 20 bp, Homo sapiens
gaggtcctcggaggtgagca

SEQ ID NO: 9598 - DNA, 18 bp, Homo sapiens
agggccccagtgagcaag

SEQ ID NO: 9599 - DNA, 18 bp, Homo sapiens
gaggaatcataatgagca

SEQ ID NO: 9600 - DNA, 18 bp, Homo sapiens
gaggaatcacaatgagca

SEQ ID NO: 9601 - DNA, 18 bp, Homo sapiens
gaggaccccgggtaggtg

SEQ ID NO: 9602 - DNA, 19 bp, Homo sapiens
aaggactggagagtgagca

SEQ ID NO: 9603 - DNA, 18 bp, Homo sapiens
gaggaccccgccgaggca

SEQ ID NO: 9604 - DNA, 18 bp, Homo sapiens
aggaccccatgagcaggc

SEQ ID NO: 9605 - DNA, 26 bp, Homo sapiens
gaggaccccgcggttcggctcgggca

SEQ ID NO: 9606 - DNA, 20 bp, Homo sapiens
ggaccccaggcggcctagca

SEQ ID NO: 9607 - DNA, 16 bp, Homo sapiens
ggccgcggcgagagca

SEQ ID NO: 9608 - DNA, 19 bp, Homo sapiens
gaggctccggcggcgggca

SEQ ID NO: 9609 - DNA, 18 bp, Homo sapiens
agaccccggcgggcgggc

SEQ ID NO: 9610 - DNA, 22 bp, Homo sapiens
gggttctgggggtgagcaggca

SEQ ID NO: 9611 - DNA, 20 bp, Homo sapiens
ggctccggcgaatgcaggca

SEQ ID NO: 9612 - DNA, 25 bp, Homo sapiens
gaggacgccgggcacgcggtaggca

SEQ ID NO: 9613 - DNA, 19 bp, Homo sapiens
agggtccccagagcgagca

SEQ ID NO: 9614 - DNA, 20 bp, Homo sapiens
ggccccagcgagggcaggca

SEQ ID NO: 9615 - DNA, 18 bp, Homo sapiens
ggacaccgacagtaagca

SEQ ID NO: 9616 - DNA, 19 bp, Homo sapiens
gaagattctggaagcaagc

SEQ ID NO: 9617 - DNA, 20 bp, Homo sapiens
gaggagcctggcagtgagca

SEQ ID NO: 9618 - DNA, 19 bp, Homo sapiens
ggggtcccggcggcggagc

SEQ ID NO: 9619 - DNA, 18 bp, Homo sapiens
gaggaccccggcgtcggc

SEQ ID NO: 9620 - DNA, 22 bp, Homo sapiens
gggtcccggcgggctccgcagc

SEQ ID NO: 9621 - DNA, 22 bp, Homo sapiens
gagaaccccggtctgacaggtg

SEQ ID NO: 9622 - DNA, 17 bp, Homo sapiens
aggaccctggtccaagc

SEQ ID NO: 9623 - DNA, 16 bp, Homo sapiens
gagggacttgagcaag

SEQ ID NO: 9624 - DNA, 18 bp, Homo sapiens
ggaacccactgggcaagc

SEQ ID NO: 9625 - DNA, 23 bp, Homo sapiens
gagggtcctggcagctctgagca

SEQ ID NO: 9626 - DNA, 20 bp, Homo sapiens
gagcactttgcaggtgagca

SEQ ID NO: 9627 - DNA, 23 bp, Homo sapiens
gagagccccggcgggcagcgggc

SEQ ID NO: 9628 - DNA, 21 bp, Homo sapiens
ggcgccccggcgcagctgggc

SEQ ID NO: 9629 - DNA, 21 bp, Homo sapiens
ggaccccgcggcgtccgggca

SEQ ID NO: 9630 - DNA, 18 bp, Homo sapiens
ggccccggggttgcgggc

SEQ ID NO: 9631 - DNA, 19 bp, Homo sapiens
gagcacctgcctgagcaag

SEQ ID NO: 9632 - DNA, 18 bp, Homo sapiens
ggaccttcggagtgagca

SEQ ID NO: 9633 - DNA, 18 bp, Homo sapiens
ggggccgtgcggtgagca

SEQ ID NO: 9634 - DNA, 19 bp, Homo sapiens
gaggacccgaaggtgagca

SEQ ID NO: 9635 - DNA, 25 bp, Homo sapiens
gaggacccgctccactgagcaggca

SEQ ID NO: 9636 - DNA, 21 bp, Homo sapiens
agccggggcggtgggcgggca

SEQ ID NO: 9637 - DNA, 17 bp, Homo sapiens
ggctcccggcggtggca

SEQ ID NO: 9638 - DNA, 20 bp, Homo sapiens
gaggaccccggggctggggc

SEQ ID NO: 9639 - DNA, 24 bp, Homo sapiens
gaggttagctttggtgagcaagca

SEQ ID NO: 9640 - DNA, 21 bp, Homo sapiens
agggcccggcggtgggcgggc

SEQ ID NO: 9641 - DNA, 98 bp, Bovine herpesvirus 1
cccgccaagtgagctccgcccacccagcccccaccctcatctcgggcccgggggcgggcagacgggggtgggggctgggtgggcggagctcactcggg

SEQ ID NO: 9642 - DNA, 24 bp, Bovine herpesvirus 1
agacgggggtgggggctgggtggg

SEQ ID NO: 9643 - DNA, 19 bp, Homo sapiens
gggggccaagctgggtggg

SEQ ID NO: 9644 - DNA, 16 bp, Homo sapiens
cgggggacctgggtgg

SEQ ID NO: 9645 - DNA, 18 bp, Homo sapiens
aggcgggggtgggagttg

SEQ ID NO: 9646 - DNA, 20 bp, Homo sapiens
ggggatgggatgggggtggg

SEQ ID NO: 9647 - DNA, 18 bp, Homo sapiens
gatgggggtggggaaggg

SEQ ID NO: 9648 - DNA, 18 bp, Homo sapiens
aggcgggggtgggctggg

SEQ ID NO: 9649 - DNA, 18 bp, Homo sapiens
gggcgggggggcgggtgg

SEQ ID NO: 9650 - DNA, 21 bp, Homo sapiens
gatgggagtgggcagggtggg

SEQ ID NO: 9651 - DNA, 18 bp, Homo sapiens
acgggggtgggggcaggg

SEQ ID NO: 9652 - DNA, 18 bp, Homo sapiens
gggttgggagctgggtgg

SEQ ID NO: 9653 - DNA, 19 bp, Homo sapiens
gggtggggtggcatggtgg

SEQ ID NO: 9654 - DNA, 22 bp, Homo sapiens
aggcgtggggtgggaaagtggg

SEQ ID NO: 9655 - DNA, 18 bp, Homo sapiens
agacggggtgggggtgcg

SEQ ID NO: 9656 - DNA, 17 bp, Homo sapiens
agatggggggggggggg

SEQ ID NO: 9657 - DNA, 21 bp, Homo sapiens
gatgggggtggtggtggtggg

SEQ ID NO: 9658 - DNA, 21 bp, Homo sapiens
gggcgaggggtgcagggtggg

SEQ ID NO: 9659 - DNA, 18 bp, Homo sapiens
agagggggtggaggtggg

SEQ ID NO: 9660 - DNA, 18 bp, Homo sapiens
ggggtggggaggggtggg

SEQ ID NO: 9661 - DNA, 19 bp, Homo sapiens
gggggtgggtcagggtggg

SEQ ID NO: 9662 - DNA, 18 bp, Homo sapiens
gggtggggggtggggtgg

SEQ ID NO: 9663 - DNA, 19 bp, Homo sapiens
ggggtggggaggtggtggg

SEQ ID NO: 9664 - DNA, 16 bp, Homo sapiens
gggtggggctgggggg

SEQ ID NO: 9665 - DNA, 22 bp, Homo sapiens
agatgggggtgctgggggtggg

SEQ ID NO: 9666 - DNA, 19 bp, Homo sapiens
ggggtggggcaggagtggg

SEQ ID NO: 9667 - DNA, 19 bp, Homo sapiens
aggcggcggtgggggaggg

SEQ ID NO: 9668 - DNA, 21 bp, Homo sapiens
cgggggcgggggcgttcccgg

SEQ ID NO: 9669 - DNA, 21 bp, Homo sapiens
aggggtgggggcagtgatggg

SEQ ID NO: 9670 - DNA, 22 bp, Homo sapiens
aggcgggagtgggggtgacagg

SEQ ID NO: 9671 - DNA, 20 bp, Homo sapiens
gggggttggggctgggtggg

SEQ ID NO: 9672 - DNA, 23 bp, Homo sapiens
cgggggtgggggtcctaggtggg

SEQ ID NO: 9673 - DNA, 20 bp, Homo sapiens
cgggggcgggggccgccggg

SEQ ID NO: 9674 - DNA, 19 bp, Homo sapiens
ggggtgggggtgggggtgg

SEQ ID NO: 9675 - DNA, 17 bp, Homo sapiens
ggggtgggaaaggtggg

SEQ ID NO: 9676 - DNA, 18 bp, Homo sapiens
gacggggtggagggtggg

SEQ ID NO: 9677 - DNA, 20 bp, Homo sapiens
gacggggtgggaggggtggg

SEQ ID NO: 9678 - DNA, 18 bp, Homo sapiens
aggcgggggtgggggggg

SEQ ID NO: 9679 - DNA, 19 bp, Homo sapiens
gatgggggtggaggctggg

SEQ ID NO: 9680 - DNA, 18 bp, Homo sapiens
ggggtggagtggggtggg

SEQ ID NO: 9681 - DNA, 18 bp, Homo sapiens
ggggtggggtggagtggg

SEQ ID NO: 9682 - DNA, 21 bp, Homo sapiens
gggggtggggtgaggggtggg

SEQ ID NO: 9683 - DNA, 18 bp, Homo sapiens
gaagggggtggggctggg

SEQ ID NO: 9684 - DNA, 18 bp, Homo sapiens
gggggtggggggattggg

SEQ ID NO: 9685 - DNA, 15 bp, Homo sapiens
gggggtggaaggtgg

SEQ ID NO: 9686 - DNA, 24 bp, Homo sapiens
gatgggggttgggggtcgggtggg

SEQ ID NO: 9687 - DNA, 21 bp, Homo sapiens
gggggcgggggtgtcccaggg

SEQ ID NO: 9688 - DNA, 19 bp, Homo sapiens
cggggcgtgggggtgaggg

SEQ ID NO: 9689 - DNA, 18 bp, Homo sapiens
ggaggtgcagggggtggg

SEQ ID NO: 9690 - DNA, 21 bp, Homo sapiens
gggcagggggccttgggtggg

SEQ ID NO: 9691 - DNA, 22 bp, Homo sapiens
gggggtggggagggcaggtggg

SEQ ID NO: 9692 - DNA, 22 bp, Homo sapiens
gattggggtgggggtagttggg

SEQ ID NO: 9693 - DNA, 19 bp, Homo sapiens
agaagggggtggaggtggg

SEQ ID NO: 9694 - DNA, 19 bp, Homo sapiens
agacgggggctgggggctg

SEQ ID NO: 9695 - DNA, 20 bp, Homo sapiens
gggggtgcgggctccacagg

SEQ ID NO: 9696 - DNA, 22 bp, Homo sapiens
aggcggggctgggggcggtggg

SEQ ID NO: 9697 - DNA, 20 bp, Homo sapiens
cgggggtggggatgcatggg

SEQ ID NO: 9698 - DNA, 23 bp, Homo sapiens
cagtaggtagggggctgggtggg

SEQ ID NO: 9699 - DNA, 17 bp, Homo sapiens
ggggtgggggctctggg

SEQ ID NO: 9700 - DNA, 18 bp, Homo sapiens
ggggggaaggtgggtggg

SEQ ID NO: 9701 - DNA, 20 bp, Homo sapiens
ggggcctgtggttgggtggg

SEQ ID NO: 9702 - DNA, 19 bp, Homo sapiens
gggatgggggtgtgggtgg

SEQ ID NO: 9703 - DNA, 20 bp, Homo sapiens
aggcggggggggggttcagg

SEQ ID NO: 9704 - DNA, 20 bp, Homo sapiens
ggggtgggattgggggtggg

SEQ ID NO: 9705 - DNA, 21 bp, Homo sapiens
cgggggtgggggcagctcggg

SEQ ID NO: 9706 - DNA, 19 bp, Homo sapiens
agatgggggtggcgggcgg

SEQ ID NO: 9707 - DNA, 21 bp, Homo sapiens
gggggtggagggccagctggg

SEQ ID NO: 9708 - DNA, 22 bp, Homo sapiens
gggtggggtgggcaagggtggg

SEQ ID NO: 9709 - DNA, 18 bp, Homo sapiens
ggggtgggggtggggtgg

SEQ ID NO: 9710 - DNA, 15 bp, Homo sapiens
ggggtgagggggtgg

SEQ ID NO: 9711 - DNA, 20 bp, Homo sapiens
gaggggcagggctgggtggg

SEQ ID NO: 9712 - DNA, 19 bp, Homo sapiens
gggtgggggtggtgagtgg

SEQ ID NO: 9713 - DNA, 21 bp, Homo sapiens
agaagggggtgagggggtggg

SEQ ID NO: 9714 - DNA, 17 bp, Homo sapiens
aggtgggggctgggggg

SEQ ID NO: 9715 - DNA, 21 bp, Homo sapiens
gggtgggggctgggggttggg

SEQ ID NO: 9716 - DNA, 20 bp, Homo sapiens
gagggtggggaggacctggg

SEQ ID NO: 9717 - DNA, 23 bp, Homo sapiens
gggggtggcgggtactgagtggg

SEQ ID NO: 9718 - DNA, 27 bp, Homo sapiens
agatgggggtgggaggctgtcagtggg

SEQ ID NO: 9719 - DNA, 17 bp, Homo sapiens
ggggtgggagctgtggg

SEQ ID NO: 9720 - DNA, 18 bp, Homo sapiens
gggtggggctgagggtgg

SEQ ID NO: 9721 - DNA, 16 bp, Homo sapiens
gggggtgggggggcgg

SEQ ID NO: 9722 - DNA, 19 bp, Homo sapiens
caggggtggggggggtggg

SEQ ID NO: 9723 - DNA, 19 bp, Homo sapiens
ggggtgggggtgagggtgg

SEQ ID NO: 9724 - DNA, 22 bp, Homo sapiens
gggctgcagggggctgggtggg

SEQ ID NO: 9725 - DNA, 19 bp, Homo sapiens
gatggggtgtgggggcagg

SEQ ID NO: 9726 - DNA, 19 bp, Homo sapiens
ggatgggagtgcagggtgg

SEQ ID NO: 9727 - DNA, 23 bp, Homo sapiens
ggagcggggggcggttgggtggg

SEQ ID NO: 9728 - DNA, 16 bp, Homo sapiens
gggggtgggaggtggg

SEQ ID NO: 9729 - DNA, 20 bp, Homo sapiens
agatgtgggtgggggctgag

SEQ ID NO: 9730 - DNA, 17 bp, Homo sapiens
gggggtgcgggggtggg

SEQ ID NO: 9731 - DNA, 20 bp, Homo sapiens
agatgggggacttgggtggg

SEQ ID NO: 9732 - DNA, 17 bp, Homo sapiens
gggcggggctgggcggg

SEQ ID NO: 9733 - DNA, 19 bp, Homo sapiens
gacgggggtgggggctggg

SEQ ID NO: 9734 - DNA, 18 bp, Homo sapiens
ggtggtgggggcggtggg

SEQ ID NO: 9735 - DNA, 19 bp, Homo sapiens
gggagtgggggtgcactgg

SEQ ID NO: 9736 - DNA, 18 bp, Homo sapiens
agacggggtgggaagtgg

SEQ ID NO: 9737 - DNA, 18 bp, Homo sapiens
ggagtgggggtggggtgg

SEQ ID NO: 9738 - DNA, 23 bp, Homo sapiens
agatgggtgtggggtcatttggg

SEQ ID NO: 9739 - DNA, 26 bp, Homo sapiens
gatggagggtggggatggagggtggg

SEQ ID NO: 9740 - DNA, 19 bp, Homo sapiens
gggtggggatggagggtgg

SEQ ID NO: 9741 - DNA, 16 bp, Homo sapiens
gagggggtgggggtgg

SEQ ID NO: 9742 - DNA, 18 bp, Homo sapiens
gggtggatggctgggtgg

SEQ ID NO: 9743 - DNA, 16 bp, Homo sapiens
gggggtgggggtgtgg

SEQ ID NO: 9744 - DNA, 19 bp, Homo sapiens
gggggtggggcggggtggg

SEQ ID NO: 9745 - DNA, 23 bp, Homo sapiens
agatgggggtggggggaggtggg

SEQ ID NO: 9746 - DNA, 22 bp, Homo sapiens
gggtggggtgggcagtggtggg

SEQ ID NO: 9747 - DNA, 20 bp, Homo sapiens
gatggggttgggggacaggg

SEQ ID NO: 9748 - DNA, 24 bp, Homo sapiens
aggcgggggtaggggagcggtggg

SEQ ID NO: 9749 - DNA, 22 bp, Homo sapiens
cggtggggaagggttgggtggg

SEQ ID NO: 9750 - DNA, 19 bp, Homo sapiens
gggcggggtgggcaggtgg

SEQ ID NO: 9751 - DNA, 17 bp, Homo sapiens
ggggtgggggtgggtgg

SEQ ID NO: 9752 - DNA, 23 bp, Homo sapiens
gggctggcttggggttgggtggg

SEQ ID NO: 9753 - DNA, 19 bp, Homo sapiens
cggcggtgggggcccgtgg

SEQ ID NO: 9754 - DNA, 17 bp, Homo sapiens
gatgggggtggggaggg

SEQ ID NO: 9755 - DNA, 19 bp, Homo sapiens
agggtgggggcctgggtgg

SEQ ID NO: 9756 - DNA, 19 bp, Homo sapiens
gggggtgggggcaatgcgg

SEQ ID NO: 9757 - DNA, 22 bp, Homo sapiens
gggctggtgaaggctgggtggg

SEQ ID NO: 9758 - DNA, 19 bp, Homo sapiens
gatgggggcgggggcctgg

SEQ ID NO: 9759 - DNA, 18 bp, Homo sapiens
gatggaggtgagggtggg

SEQ ID NO: 9760 - DNA, 25 bp, Homo sapiens
aggcaggggtgggggtggccatggg

SEQ ID NO: 9761 - DNA, 18 bp, Homo sapiens
ggggatggggagggtggg

SEQ ID NO: 9762 - DNA, 20 bp, Homo sapiens
gggggtgggggacgggtggg

SEQ ID NO: 9763 - DNA, 16 bp, Homo sapiens
acgggggtggggtggg

SEQ ID NO: 9764 - DNA, 23 bp, Homo sapiens
aggcaggggtgggggtcacaagg

SEQ ID NO: 9765 - DNA, 18 bp, Homo sapiens
gacgggggtgggggcagg

SEQ ID NO: 9766 - DNA, 19 bp, Homo sapiens
aggcgggggtgggggatgg

SEQ ID NO: 9767 - DNA, 22 bp, Homo sapiens
cgggggcgggggcgggggtggg

SEQ ID NO: 9768 - DNA, 19 bp, Homo sapiens
gggtggggtggcagggtgg

SEQ ID NO: 9769 - DNA, 20 bp, Homo sapiens
gatggggatgggggttctgg

SEQ ID NO: 9770 - DNA, 18 bp, Homo sapiens
ggggatgggagtggtggg

SEQ ID NO: 9771 - DNA, 21 bp, Homo sapiens
gggggtggggaagcctgtggg

SEQ ID NO: 9772 - DNA, 21 bp, Homo sapiens
gggggtggggtagagggtggg

SEQ ID NO: 9773 - DNA, 18 bp, Homo sapiens
gggggtggtggggctggg

SEQ ID NO: 9774 - DNA, 19 bp, Homo sapiens
gggtggaggttctgggtgg

SEQ ID NO: 9775 - DNA, 20 bp, Homo sapiens
agactgggggtgggcgtggg

SEQ ID NO: 9776 - DNA, 22 bp, Homo sapiens
aggcaggggtggaggaggtggg

SEQ ID NO: 9777 - DNA, 18 bp, Homo sapiens
agacggggtgtgggtggg

SEQ ID NO: 9778 - DNA, 17 bp, Homo sapiens
gaggggggtgggggtgg

SEQ ID NO: 9779 - DNA, 20 bp, Homo sapiens
agatgggggtgctgggtggg

SEQ ID NO: 9780 - DNA, 18 bp, Homo sapiens
cgggggtaggggttgcgg

SEQ ID NO: 9781 - DNA, 24 bp, Homo sapiens
gatggggatggggcaggcggtggg

SEQ ID NO: 9782 - DNA, 18 bp, Homo sapiens
aggtggggacctgggtgg

SEQ ID NO: 9783 - DNA, 21 bp, Homo sapiens
gggagtggcgctgagggtggg

SEQ ID NO: 9784 - DNA, 26 bp, Homo sapiens
agacgggcactggggggctgggtggg

SEQ ID NO: 9785 - DNA, 21 bp, Homo sapiens
agacgtgggtggggggccggg

SEQ ID NO: 9786 - DNA, 19 bp, Homo sapiens
cgggggaggggggagtggg

SEQ ID NO: 9787 - DNA, 18 bp, Homo sapiens
gatgggggtgggggtggg

SEQ ID NO: 9788 - DNA, 18 bp, Homo sapiens
gggaggtgggggtctggg

SEQ ID NO: 9789 - DNA, 18 bp, Homo sapiens
cgggggtggcagggtggg

SEQ ID NO: 9790 - DNA, 17 bp, Homo sapiens
gggggtgggagtgaggg

SEQ ID NO: 9791 - DNA, 19 bp, Homo sapiens
gacgggggtgggggtaggg

SEQ ID NO: 9792 - DNA, 17 bp, Homo sapiens
gggggtagggggtgtgg

SEQ ID NO: 9793 - DNA, 19 bp, Homo sapiens
gatggcgggtgggggcagg

SEQ ID NO: 9794 - DNA, 17 bp, Homo sapiens
gggggtgggggtgaagg

SEQ ID NO: 9795 - DNA, 18 bp, Homo sapiens
agatgggggcctgggtgg

SEQ ID NO: 9796 - DNA, 21 bp, Homo sapiens
aggcgggggtgggggcacagg

SEQ ID NO: 9797 - DNA, 18 bp, Homo sapiens
ggggtggggcggggtggg

SEQ ID NO: 9798 - DNA, 22 bp, Homo sapiens
aggcagggacaggttgggtggg

SEQ ID NO: 9799 - DNA, 20 bp, Homo sapiens
cgacggcggggctgggtggg

SEQ ID NO: 9800 - DNA, 20 bp, Homo sapiens
gggtgtgggggactcatggg

SEQ ID NO: 9801 - DNA, 21 bp, Homo sapiens
gacgaggggtggggttctggg

SEQ ID NO: 9802 - DNA, 21 bp, Homo sapiens
gatgggggtgggggacttggg

SEQ ID NO: 9803 - DNA, 22 bp, Homo sapiens
gagggtgaatggactgggtggg

SEQ ID NO: 9804 - DNA, 18 bp, Homo sapiens
gggcggggggcggggtgg

SEQ ID NO: 9805 - DNA, 18 bp, Homo sapiens
gggtgggggtcggggtga

SEQ ID NO: 9806 - DNA, 19 bp, Homo sapiens
gatcggggtggggggtagg

SEQ ID NO: 9807 - DNA, 21 bp, Homo sapiens
aggtggggagtggagggtggg

SEQ ID NO: 9808 - DNA, 25 bp, Homo sapiens
agatgggggtggggtgtctgccggg

SEQ ID NO: 9809 - DNA, 23 bp, Homo sapiens
aggcgggggcgggggagggtggg

SEQ ID NO: 9810 - DNA, 22 bp, Homo sapiens
gggggtggggggttagggtggg

SEQ ID NO: 9811 - DNA, 19 bp, Homo sapiens
agaccggggacttgggtgg

SEQ ID NO: 9812 - DNA, 18 bp, Homo sapiens
caggggtgggggcgcggg

SEQ ID NO: 9813 - DNA, 18 bp, Homo sapiens
cgtggcggggctgggtgg

SEQ ID NO: 9814 - DNA, 17 bp, Homo sapiens
gggtggtggtggggggg

SEQ ID NO: 9815 - DNA, 19 bp, Homo sapiens
gggtggagggtggtggtgg

SEQ ID NO: 9816 - DNA, 24 bp, Homo sapiens
agacaggggttagctctgggtggg

SEQ ID NO: 9817 - DNA, 20 bp, Homo sapiens
ggggtgggggttcctctggg

SEQ ID NO: 9818 - DNA, 18 bp, Homo sapiens
aaacgggggtgggggtgg

SEQ ID NO: 9819 - DNA, 18 bp, Homo sapiens
ggggtggggaggactggg

SEQ ID NO: 9820 - DNA, 21 bp, Homo sapiens
gacgggtgtgggggctggggg

SEQ ID NO: 9821 - DNA, 19 bp, Homo sapiens
ggagtctggggttgggtgg

SEQ ID NO: 9822 - DNA, 20 bp, Homo sapiens
cgggggtggggggaggtggg

SEQ ID NO: 9823 - DNA, 21 bp, Homo sapiens
ggtgggcgtggggtacatggg

SEQ ID NO: 9824 - DNA, 19 bp, Homo sapiens
ggactgggtggttgggtgg

SEQ ID NO: 9825 - DNA, 15 bp, Homo sapiens
ggggtgggggcgcgg

SEQ ID NO: 9826 - DNA, 19 bp, Homo sapiens
gggcggggagactgggtgg

SEQ ID NO: 9827 - DNA, 20 bp, Homo sapiens
gacggagccagctgggtggg

SEQ ID NO: 9828 - DNA, 22 bp, Homo sapiens
ggtggtggggagatggggtggg

SEQ ID NO: 9829 - DNA, 16 bp, Homo sapiens
ggggtgggggctgtgg

SEQ ID NO: 9830 - DNA, 25 bp, Homo sapiens
gatggggtgtggattgcagggtggg

SEQ ID NO: 9831 - DNA, 18 bp, Homo sapiens
gggggtgaagatggtggg

SEQ ID NO: 9832 - DNA, 21 bp, Homo sapiens
gacgggggcgggggctggggg

SEQ ID NO: 9833 - DNA, 20 bp, Homo sapiens
gatgggggtggcagagtggg

SEQ ID NO: 9834 - DNA, 19 bp, Homo sapiens
gggtgtgggggcctgtggg

SEQ ID NO: 9835 - DNA, 20 bp, Homo sapiens
cgggggtgggggcccgaggg

SEQ ID NO: 9836 - DNA, 18 bp, Homo sapiens
ggggtggggggctctggg

SEQ ID NO: 9837 - DNA, 16 bp, Homo sapiens
gggcgtgggggcgcgg

SEQ ID NO: 9838 - DNA, 17 bp, Homo sapiens
gggggtggggaggtggg

SEQ ID NO: 9839 - DNA, 17 bp, Homo sapiens
cgggggggggggcgcgg

SEQ ID NO: 9840 - DNA, 19 bp, Homo sapiens
aggcgggggtagggggcgg

SEQ ID NO: 9841 - DNA, 18 bp, Homo sapiens
ggggttggggagcctggg

SEQ ID NO: 9842 - DNA, 19 bp, Homo sapiens
gggtgggcacgggggtggg

SEQ ID NO: 9843 - DNA, 18 bp, Homo sapiens
gaggggtgtgggggtggg

SEQ ID NO: 9844 - DNA, 15 bp, Homo sapiens
aggggtgggaggtgg

SEQ ID NO: 9845 - DNA, 19 bp, Homo sapiens
ggtgggcggtggggctggg

SEQ ID NO: 9846 - DNA, 17 bp, Homo sapiens
gggtgggaggtgggggg

SEQ ID NO: 9847 - DNA, 18 bp, Homo sapiens
agatggggtgggggctgg

SEQ ID NO: 9848 - DNA, 21 bp, Homo sapiens
aaggtgggggtgcagggtggg

SEQ ID NO: 9849 - DNA, 23 bp, Homo sapiens
cggtggctttggggctgggtggg

SEQ ID NO: 9850 - DNA, 20 bp, Homo sapiens
aggcaggggtgggggcaggg

SEQ ID NO: 9851 - DNA, 18 bp, Homo sapiens
gatgggggtgggggatgg

SEQ ID NO: 9852 - DNA, 18 bp, Homo sapiens
gggtgggggtggcggtgg

SEQ ID NO: 9853 - DNA, 23 bp, Homo sapiens
gagggggtgggggccaaggtggg

SEQ ID NO: 9854 - DNA, 63 bp, Bovine herpesvirus 1
ggcgtgtcgcgctcgctcgcccgggcggttcatccgcttcggctttaggcagccgcggccgcc

SEQ ID NO: 9855 - DNA, 17 bp, Bovine herpesvirus 1
aggcagccgcggccgcc

SEQ ID NO: 9856 - DNA, 18 bp, Homo sapiens
aggcagcctcacggccgc

SEQ ID NO: 9857 - DNA, 18 bp, Homo sapiens
agcagccacggagccgcc

SEQ ID NO: 9858 - DNA, 19 bp, Homo sapiens
ggcagccagtccggtcgcc

SEQ ID NO: 9859 - DNA, 18 bp, Homo sapiens
agacagccaatgactgcc

SEQ ID NO: 9860 - DNA, 18 bp, Homo sapiens
agcagccagggacccgcc

SEQ ID NO: 9861 - DNA, 18 bp, Homo sapiens
gcaccggccgcggccgcc

SEQ ID NO: 9862 - DNA, 19 bp, Homo sapiens
ggcagccggagcagctgcc

SEQ ID NO: 9863 - DNA, 20 bp, Homo sapiens
ggtcagccacgcaggctgcc

SEQ ID NO: 9864 - DNA, 19 bp, Homo sapiens
ggcagccgcactggccgcc

SEQ ID NO: 9865 - DNA, 19 bp, Homo sapiens
aggcgaccacaggggccgc

SEQ ID NO: 9866 - DNA, 16 bp, Homo sapiens
gcagccgcggccgccg

SEQ ID NO: 9867 - DNA, 17 bp, Homo sapiens
agccgccgcggccgccg

SEQ ID NO: 9868 - DNA, 23 bp, Homo sapiens
aggcagcccccccaaggctgccg

SEQ ID NO: 9869 - DNA, 18 bp, Homo sapiens
ggcaccgcagcggccgcc

SEQ ID NO: 9870 - DNA, 18 bp, Homo sapiens
aggaagccgcggcaggcc

SEQ ID NO: 9871 - DNA, 18 bp, Homo sapiens
aggagccacgatgctgcc

SEQ ID NO: 9872 - DNA, 16 bp, Homo sapiens
acagccgcggccgccg

SEQ ID NO: 9873 - DNA, 21 bp, Homo sapiens
aggcaaccaagaggggctgcc

SEQ ID NO: 9874 - DNA, 19 bp, Homo sapiens
agccagctcgcaagccgcc

SEQ ID NO: 9875 - DNA, 19 bp, Homo sapiens
agcagccaccacagccgcc

SEQ ID NO: 9876 - DNA, 19 bp, Homo sapiens
agccagcacagcagccgcc

SEQ ID NO: 9877 - DNA, 18 bp, Homo sapiens
agacagccccgcaccgcc

SEQ ID NO: 9878 - DNA, 19 bp, Homo sapiens
aggcagccaccagggctgc

SEQ ID NO: 9879 - DNA, 21 bp, Homo sapiens
agcagccaccatctggctgcc

SEQ ID NO: 9880 - DNA, 18 bp, Homo sapiens
ggcagccgcgcagccgcc

SEQ ID NO: 9881 - DNA, 18 bp, Homo sapiens
gcagccacccgagccgcc

SEQ ID NO: 9882 - DNA, 18 bp, Homo sapiens
gggagccgcggcttcgcc

SEQ ID NO: 9883 - DNA, 21 bp, Homo sapiens
ggccggcgcgcggtggccgcc

SEQ ID NO: 9884 - DNA, 19 bp, Homo sapiens
aggcagcctttcacccgcc

SEQ ID NO: 9885 - DNA, 23 bp, Homo sapiens
ggctggccacagcatggccgccg

SEQ ID NO: 9886 - DNA, 19 bp, Homo sapiens
ggcagcctccacagccgcc

SEQ ID NO: 9887 - DNA, 18 bp, Homo sapiens
aggcagcccccaaccgcc

SEQ ID NO: 9888 - DNA, 19 bp, Homo sapiens
aggcagccggcacccttgc

SEQ ID NO: 9889 - DNA, 20 bp, Homo sapiens
ggctcaaccaccggctgccg

SEQ ID NO: 9890 - DNA, 18 bp, Homo sapiens
aggcagccaaagactgcc

SEQ ID NO: 9891 - DNA, 17 bp, Homo sapiens
agcagccgcggccgccg

SEQ ID NO: 9892 - DNA, 19 bp, Homo sapiens
aggagccgcagaggacgcc

SEQ ID NO: 9893 - DNA, 18 bp, Homo sapiens
agcagccacacaactgcc

SEQ ID NO: 9894 - DNA, 20 bp, Homo sapiens
agcagaagacagcggccgcc

SEQ ID NO: 9895 - DNA, 18 bp, Homo sapiens
ggctgcccgctggccgcc

SEQ ID NO: 9896 - DNA, 18 bp, Homo sapiens
agcggccgcagcagcgcc

SEQ ID NO: 9897 - DNA, 18 bp, Homo sapiens
aagcagcccagatcctgc

SEQ ID NO: 9898 - DNA, 18 bp, Homo sapiens
ggccgccgcccggccgcc

SEQ ID NO: 9899 - DNA, 64 bp, Human herpesvirus 8
ggccacatgtgcggtatgggggtcgactatcaaaacgtggccctgacgctgacttacaacggcc

SEQ ID NO: 9900 - DNA, 21 bp, Human herpesvirus 8
tgacgctgacttacaacggcc

SEQ ID NO: 9901 - DNA, 22 bp, Homo sapiens
taacgctgacgagacggtggcc

SEQ ID NO: 9902 - DNA, 16 bp, Homo sapiens
tggcactgactccggc

SEQ ID NO: 9903 - DNA, 19 bp, Homo sapiens
tgagcagattgcaacggcc

SEQ ID NO: 9904 - DNA, 19 bp, Homo sapiens
tgacgctggcctcagagcc

SEQ ID NO: 9905 - DNA, 16 bp, Homo sapiens
tgagctgacttcagcc

SEQ ID NO: 9906 - DNA, 20 bp, Homo sapiens
tgacgctgcttccacgggcc

SEQ ID NO: 9907 - DNA, 19 bp, Homo sapiens
tgacatggatacaacggcc

SEQ ID NO: 9908 - DNA, 19 bp, Homo sapiens
tgacgctggaccacttggc

SEQ ID NO: 9909 - DNA, 18 bp, Homo sapiens
tgagctgggctcagacgg

SEQ ID NO: 9910 - DNA, 19 bp, Homo sapiens
tgacgctgcttgtgcggcc

SEQ ID NO: 9911 - DNA, 18 bp, Homo sapiens
tgacgctggcttagggcc

SEQ ID NO: 9912 - DNA, 20 bp, Homo sapiens
tgacttgacttagacaggcc

SEQ ID NO: 9913 - DNA, 19 bp, Homo sapiens
tgacgctgctgaggacggc

SEQ ID NO: 9914 - DNA, 20 bp, Homo sapiens
tgacactggcttacgggacc

SEQ ID NO: 9915 - DNA, 18 bp, Homo sapiens
tgacgctgatgctactgg

SEQ ID NO: 9916 - DNA, 21 bp, Homo sapiens
tgacgctggcaaaacgcggcc

SEQ ID NO: 9917 - DNA, 16 bp, Homo sapiens
tgacgctgatttaggc

SEQ ID NO: 9918 - DNA, 19 bp, Homo sapiens
tgaggctgactccatggcc

SEQ ID NO: 9919 - DNA, 19 bp, Homo sapiens
tgacgctgggctgcaggcc

SEQ ID NO: 9920 - DNA, 19 bp, Homo sapiens
aacgctgcagccaacggcc

SEQ ID NO: 9921 - DNA, 19 bp, Homo sapiens
cggcgctgacccactggcc

SEQ ID NO: 9922 - DNA, 17 bp, Homo sapiens
gatgctgacttaaagcc

SEQ ID NO: 9923 - DNA, 18 bp, Homo sapiens
gctgccgggtacaacggc

SEQ ID NO: 9924 - DNA, 19 bp, Homo sapiens
gctgcccacagcaacggcc

SEQ ID NO: 9925 - DNA, 65 bp, Human herpesvirus 8
cctccagtacgtcgtggtcaacggtacagacgtgtttttggaccagccttgccatatgctgcagg

SEQ ID NO: 9926 - DNA, 24 bp, Human herpesvirus 8
tccagtacgtcgtggtcaacggta

SEQ ID NO: 9927 - DNA, 20 bp, Homo sapiens
agttacatgtggtcaatggt

SEQ ID NO: 9928 - DNA, 19 bp, Homo sapiens
tccagttgtcgtggcttcg

SEQ ID NO: 9929 - DNA, 82 bp, Bovine herpesvirus 1
gcttgctttggcccgccttgcgcttttgcatttggctcgcccctgcccggtttaatttgcatagccccctggcccgcagtgc

SEQ ID NO: 9930 - DNA, 21 bp, Bovine herpesvirus 1
tagccccctggcccgcagtgc

SEQ ID NO: 9931 - DNA, 18 bp, Homo sapiens
cagccaagccccgcagtg

SEQ ID NO: 9932 - DNA, 22 bp, Homo sapiens
acccaacccgggcccgtggtgc

SEQ ID NO: 9933 - DNA, 15 bp, Homo sapiens
tagcccctggccgtg

SEQ ID NO: 9934 - DNA, 19 bp, Homo sapiens
cagcccaccttctgcagtg

SEQ ID NO: 9935 - DNA, 18 bp, Homo sapiens
cagcccactccgcggtgc

SEQ ID NO: 9936 - DNA, 19 bp, Homo sapiens
gcgccccagcccgcggtgc

SEQ ID NO: 9937 - DNA, 22 bp, Homo sapiens
cagcccaaaatgtccgtagtgc

SEQ ID NO: 9938 - DNA, 18 bp, Homo sapiens
gcccactagctgcggtgc

SEQ ID NO: 9939 - DNA, 18 bp, Homo sapiens
agcccgcagccgcggtgc

SEQ ID NO: 9940 - DNA, 19 bp, Homo sapiens
cagcctcctggcccgcggc

SEQ ID NO: 9941 - DNA, 26 bp, Homo sapiens
cagccccgcagccctggcctgtagtg

SEQ ID NO: 9942 - DNA, 18 bp, Homo sapiens
gccctctggcccgagagc

SEQ ID NO: 9943 - DNA, 18 bp, Homo sapiens
agtcccttggtccgcagt

SEQ ID NO: 9944 - DNA, 20 bp, Homo sapiens
agcccccttgcggcgcggtg

SEQ ID NO: 9945 - DNA, 19 bp, Homo sapiens
cagctccctggccaccagc

SEQ ID NO: 9946 - DNA, 19 bp, Homo sapiens
agctccgcatgcgcagtgc

SEQ ID NO: 9947 - DNA, 17 bp, Homo sapiens
agccctctggggcgtgc

SEQ ID NO: 9948 - DNA, 20 bp, Homo sapiens
cagccccctgcagcctggtg

SEQ ID NO: 9949 - DNA, 17 bp, Homo sapiens
gccgccctggccgcctg

SEQ ID NO: 9950 - DNA, 20 bp, Homo sapiens
tagcttccagcggcaggtgc

SEQ ID NO: 9951 - DNA, 16 bp, Homo sapiens
agccccctcccatgtg

SEQ ID NO: 9952 - DNA, 18 bp, Homo sapiens
gctccctggcctccaggc

SEQ ID NO: 9953 - DNA, 18 bp, Homo sapiens
tagccccccggcccatgc

SEQ ID NO: 9954 - DNA, 21 bp, Homo sapiens
cagccctcttcagctgcagtg

SEQ ID NO: 9955 - DNA, 22 bp, Homo sapiens
gcccaccccggccctcgcggtg

SEQ ID NO: 9956 - DNA, 18 bp, Homo sapiens
gctcggcccctgcagtgc

SEQ ID NO: 9957 - DNA, 18 bp, Homo sapiens
tagccccctagcctgggc

SEQ ID NO: 9958 - DNA, 18 bp, Homo sapiens
gcgtcggcctcgcagtgc

SEQ ID NO: 9959 - DNA, 19 bp, Homo sapiens
gccctcctggtgggcgtgc

SEQ ID NO: 9960 - DNA, 16 bp, Homo sapiens
gccctctggcccatgc

SEQ ID NO: 9961 - DNA, 16 bp, Homo sapiens
gccctctccacagtgc

SEQ ID NO: 9962 - DNA, 19 bp, Homo sapiens
tagtgccctggcccggggc

SEQ ID NO: 9963 - DNA, 22 bp, Homo sapiens
cagcccctgacggcccgcggtg

SEQ ID NO: 9964 - DNA, 19 bp, Homo sapiens
taaccccctggctctaagc

SEQ ID NO: 9965 - DNA, 22 bp, Homo sapiens
cagccccttctggaggtggtgc

SEQ ID NO: 9966 - DNA, 21 bp, Homo sapiens
tagcccttttgtccgagaggc

SEQ ID NO: 9967 - DNA, 19 bp, Homo sapiens
tagcccgctgacacagtgc

SEQ ID NO: 9968 - DNA, 16 bp, Homo sapiens
gctcccagcacagtgc

SEQ ID NO: 9969 - DNA, 19 bp, Homo sapiens
agtcctctggcccacaggc

SEQ ID NO: 9970 - DNA, 20 bp, Homo sapiens
tagcccgctggtccctggtg

SEQ ID NO: 9971 - DNA, 18 bp, Homo sapiens
gccccctgagccctgagc

SEQ ID NO: 9972 - DNA, 19 bp, Homo sapiens
gcccgccaggccgtagtgc

SEQ ID NO: 9973 - DNA, 16 bp, Homo sapiens
cagccccccggcagtg

SEQ ID NO: 9974 - DNA, 18 bp, Homo sapiens
gccaggcccccgcagtgc

SEQ ID NO: 9975 - DNA, 20 bp, Homo sapiens
tagcccactgtgtgctagtg

SEQ ID NO: 9976 - DNA, 18 bp, Homo sapiens
gcttccctggccggctgc

SEQ ID NO: 9977 - DNA, 19 bp, Homo sapiens
tagccccctgggctcttgc

SEQ ID NO: 9978 - DNA, 18 bp, Homo sapiens
cagcctgctccgcagtgc

SEQ ID NO: 9979 - DNA, 22 bp, Homo sapiens
cagcccccagcatctgtggtgc

SEQ ID NO: 9980 - DNA, 20 bp, Homo sapiens
gcccgtccccacccgcggtg

SEQ ID NO: 9981 - DNA, 21 bp, Homo sapiens
cagccccctggcctgcacagc

SEQ ID NO: 9982 - DNA, 19 bp, Homo sapiens
tagcccccatggccgggtg

SEQ ID NO: 9983 - DNA, 17 bp, Homo sapiens
gcccaaccctgcagtgc

SEQ ID NO: 9984 - DNA, 20 bp, Homo sapiens
cagccccctggcctgggagt

SEQ ID NO: 9985 - DNA, 19 bp, Homo sapiens
taacctcctggcccagggt

SEQ ID NO: 9986 - DNA, 16 bp, Homo sapiens
cagcccagccgcagtg

SEQ ID NO: 9987 - DNA, 19 bp, Homo sapiens
tagcccacctggtagctgc

SEQ ID NO: 9988 - DNA, 16 bp, Homo sapiens
cagccccctgagagtg

SEQ ID NO: 9989 - DNA, 19 bp, Homo sapiens
gctcccctggcctggaggc

SEQ ID NO: 9990 - DNA, 20 bp, Homo sapiens
gcctcgcctccccgcagtgc

SEQ ID NO: 9991 - DNA, 16 bp, Homo sapiens
gctcctggcgcagtgc

SEQ ID NO: 9992 - DNA, 16 bp, Homo sapiens
tagtcccctgacagtg

SEQ ID NO: 9993 - DNA, 19 bp, Homo sapiens
cagccccctggcccttcgt

SEQ ID NO: 9994 - DNA, 18 bp, Homo sapiens
gctcccctggcttcggtg

SEQ ID NO: 9995 - DNA, 19 bp, Homo sapiens
tagccgcaacccgcagtgc

SEQ ID NO: 9996 - DNA, 20 bp, Homo sapiens
taaccccctccctgtggtgc

SEQ ID NO: 9997 - DNA, 16 bp, Homo sapiens
gccccctggctcaggc

SEQ ID NO: 9998 - DNA, 18 bp, Homo sapiens
taggtccctggcccgtgc

SEQ ID NO: 9999 - DNA, 21 bp, Homo sapiens
tagccccctggtcccattttg

SEQ ID NO: 10000 - DNA, 19 bp, Homo sapiens
agccccctccccgcggtgc

SEQ ID NO: 10001 - DNA, 21 bp, Homo sapiens
accccctggcgcggctggtgc

SEQ ID NO: 10002 - DNA, 18 bp, Homo sapiens
gccctgggcctgcagtgc

SEQ ID NO: 10003 - DNA, 21 bp, Homo sapiens
gctccctggccacggacgtgc

SEQ ID NO: 10004 - DNA, 17 bp, Homo sapiens
accccttggcccactgc

SEQ ID NO: 10005 - DNA, 22 bp, Homo sapiens
tagatccctggcggtgacagtg

SEQ ID NO: 10006 - DNA, 18 bp, Homo sapiens
cagccctggtcgcagtgc

SEQ ID NO: 10007 - DNA, 16 bp, Homo sapiens
gcccactgggcagtgc

SEQ ID NO: 10008 - DNA, 17 bp, Homo sapiens
gctcctggcccatgtgc

SEQ ID NO: 10009 - DNA, 19 bp, Homo sapiens
tagccccctgcgcccaggc

SEQ ID NO: 10010 - DNA, 17 bp, Homo sapiens
cagccccctccacagtg

SEQ ID NO: 10011 - DNA, 68 bp, Lumpy skin disease virus
ttaaatttgataaataacttagatattttgtttcaagaacaagataaagaactttatccaaatcttaa

SEQ ID NO: 10012 - DNA, 24 bp, Lumpy skin disease virus
aatttgataaataacttagatatt

SEQ ID NO: 10013 - DNA, 22 bp, Homo sapiens
aatttgataaacaacaaacatt

SEQ ID NO: 10014 - DNA, 26 bp, Homo sapiens
aatttgacaaataatgaataaatatt

SEQ ID NO: 10015 - DNA, 21 bp, Homo sapiens
atttgacaacagatagatatt

SEQ ID NO: 10016 - DNA, 67 bp, Bovine herpesvirus 1
gggacggacggcgggccgggagcgggcggcagtgcggcgccttctccttccccttcccctccttctc

SEQ ID NO: 10017 - DNA, 24 bp, Bovine herpesvirus 1
cttctccttccccttcccctcctt

SEQ ID NO: 10018 - DNA, 22 bp, Homo sapiens
tcctcctttccccgctttcctt

SEQ ID NO: 10019 - DNA, 18 bp, Homo sapiens
tctctttctccttcccct

SEQ ID NO: 10020 - DNA, 25 bp, Homo sapiens
ctctccttctcttcctcactctctt

SEQ ID NO: 10021 - DNA, 21 bp, Homo sapiens
cccgttctttttcccctcctt

SEQ ID NO: 10022 - DNA, 20 bp, Homo sapiens
ttctctcttttcccttctcc

SEQ ID NO: 10023 - DNA, 22 bp, Homo sapiens
ctcctctttccctccctcgctt

SEQ ID NO: 10024 - DNA, 18 bp, Homo sapiens
cttctgctcttccctcct

SEQ ID NO: 10025 - DNA, 21 bp, Homo sapiens
ttctcctcttgttccttcctt

SEQ ID NO: 10026 - DNA, 18 bp, Homo sapiens
cttctgtttcccctttcc

SEQ ID NO: 10027 - DNA, 19 bp, Homo sapiens
ttctttttcccctttcctt

SEQ ID NO: 10028 - DNA, 23 bp, Homo sapiens
tccttctttcctcccacctcctt

SEQ ID NO: 10029 - DNA, 21 bp, Homo sapiens
ctcctcccgcttcctcttctt

SEQ ID NO: 10030 - DNA, 22 bp, Homo sapiens
cttctccctttattccttcctt

SEQ ID NO: 10031 - DNA, 21 bp, Homo sapiens
ttctccctccccctcttcctt

SEQ ID NO: 10032 - DNA, 22 bp, Homo sapiens
cctcttcttccccttttagcct

SEQ ID NO: 10033 - DNA, 19 bp, Homo sapiens
ccttccttctttccttcct

SEQ ID NO: 10034 - DNA, 18 bp, Homo sapiens
ctttccttccttcctttc

SEQ ID NO: 10035 - DNA, 19 bp, Homo sapiens
ttctccttatcttctactc

SEQ ID NO: 10036 - DNA, 20 bp, Homo sapiens
cttctcctcctcagctcctt

SEQ ID NO: 10037 - DNA, 19 bp, Homo sapiens
cttctcctgcctcctcctc

SEQ ID NO: 10038 - DNA, 21 bp, Homo sapiens
cttctcttctttcttttcctt

SEQ ID NO: 10039 - DNA, 20 bp, Homo sapiens
cttttccttccttgtcccct

SEQ ID NO: 10040 - DNA, 25 bp, Homo sapiens
cttctcttctttcttttccttcctt

SEQ ID NO: 10041 - DNA, 17 bp, Homo sapiens
ctccttcttcccttcct

SEQ ID NO: 10042 - DNA, 20 bp, Homo sapiens
ttctccttttcttgctcctt

SEQ ID NO: 10043 - DNA, 19 bp, Homo sapiens
ctctccttcttcttcttct

SEQ ID NO: 10044 - DNA, 29 bp, Homo sapiens
cttcccctcccttcttcttctcctcctta

SEQ ID NO: 10045 - DNA, 19 bp, Homo sapiens
ctttctttcccctttccct

SEQ ID NO: 10046 - DNA, 17 bp, Homo sapiens
ttccctttctttcccct

SEQ ID NO: 10047 - DNA, 19 bp, Homo sapiens
cttcccctcccacccccct

SEQ ID NO: 10048 - DNA, 19 bp, Homo sapiens
ttctctctctccctccctc

SEQ ID NO: 10049 - DNA, 18 bp, Homo sapiens
tcctccctttcctcttct

SEQ ID NO: 10050 - DNA, 23 bp, Homo sapiens
cttctccctcttcccccctcctt

SEQ ID NO: 10051 - DNA, 22 bp, Homo sapiens
ctctcctttccttctctctctt

SEQ ID NO: 10052 - DNA, 21 bp, Homo sapiens
tctccttttcatcacctcctt

SEQ ID NO: 10053 - DNA, 19 bp, Homo sapiens
ttctccttccactttcccc

SEQ ID NO: 10054 - DNA, 22 bp, Homo sapiens
ctcctggagtcttcctcttctt

SEQ ID NO: 10055 - DNA, 18 bp, Homo sapiens
ctcctcttcttcctcttc

SEQ ID NO: 10056 - DNA, 20 bp, Homo sapiens
cttctcttcccagttccctc

SEQ ID NO: 10057 - DNA, 19 bp, Homo sapiens
ttctcctttctccctcctt

SEQ ID NO: 10058 - DNA, 28 bp, Homo sapiens
ttctcctttttcttttcctttctctctt

SEQ ID NO: 10059 - DNA, 19 bp, Homo sapiens
cttttccctcccttttccc

SEQ ID NO: 10060 - DNA, 19 bp, Homo sapiens
cttctccctcttcacttcc

SEQ ID NO: 10061 - DNA, 26 bp, Homo sapiens
ctcttcacttccttctttctttcctt

SEQ ID NO: 10062 - DNA, 20 bp, Homo sapiens
tctcctctcactttctcctt

SEQ ID NO: 10063 - DNA, 21 bp, Homo sapiens
tcctcctttccccctcctcct

SEQ ID NO: 10064 - DNA, 21 bp, Homo sapiens
tctccttctcttgcattcctt

SEQ ID NO: 10065 - DNA, 18 bp, Homo sapiens
cttcccttcctttcccct

SEQ ID NO: 10066 - DNA, 20 bp, Homo sapiens
ctccctcccttcccttcctt

SEQ ID NO: 10067 - DNA, 18 bp, Homo sapiens
tcctttccccttccagtc

SEQ ID NO: 10068 - DNA, 27 bp, Homo sapiens
ctcctcctttccttcctcccttcctta

SEQ ID NO: 10069 - DNA, 19 bp, Homo sapiens
tcctccttttccaaccttc

SEQ ID NO: 10070 - DNA, 23 bp, Homo sapiens
ttctcttctccctcctcctcctt

SEQ ID NO: 10071 - DNA, 20 bp, Homo sapiens
ttctcctcccgaggtccttc

SEQ ID NO: 10072 - DNA, 17 bp, Homo sapiens
cttctcctctttctctc

SEQ ID NO: 10073 - DNA, 22 bp, Homo sapiens
cttctctctctccccctcttct

SEQ ID NO: 10074 - DNA, 27 bp, Homo sapiens
cttttccttcctgccctccctctcctt

SEQ ID NO: 10075 - DNA, 20 bp, Homo sapiens
cttctcccttcctctctctt

SEQ ID NO: 10076 - DNA, 17 bp, Homo sapiens
ttctcctttttctcctc

SEQ ID NO: 10077 - DNA, 23 bp, Homo sapiens
cctctctcttcctttttttcctt

SEQ ID NO: 10078 - DNA, 18 bp, Homo sapiens
cttctcctttgtcccctt

SEQ ID NO: 10079 - DNA, 22 bp, Homo sapiens
cttctcctcctcttcttttcct

SEQ ID NO: 10080 - DNA, 18 bp, Homo sapiens
ctcctccttctcctcctc

SEQ ID NO: 10081 - DNA, 30 bp, Homo sapiens
cttctcctttctccctccctcccttcctta

SEQ ID NO: 10082 - DNA, 18 bp, Homo sapiens
cttcttttcttccccttc

SEQ ID NO: 10083 - DNA, 19 bp, Homo sapiens
ctctcatcttcttcccctc

SEQ ID NO: 10084 - DNA, 21 bp, Homo sapiens
ttcccttcccctttccttcct

SEQ ID NO: 10085 - DNA, 19 bp, Homo sapiens
ttcctcttccccttccccc

SEQ ID NO: 10086 - DNA, 18 bp, Homo sapiens
tcctgcccccctttcctc

SEQ ID NO: 10087 - DNA, 23 bp, Homo sapiens
ttctttcataatttcccctcctt

SEQ ID NO: 10088 - DNA, 24 bp, Homo sapiens
ctctctttctcctctctctctctc

SEQ ID NO: 10089 - DNA, 21 bp, Homo sapiens
cttctccttccccatcggcct

SEQ ID NO: 10090 - DNA, 22 bp, Homo sapiens
ctcctccttcttcttcttcctc

SEQ ID NO: 10091 - DNA, 24 bp, Homo sapiens
cttcttcttcctctttttcttctt

SEQ ID NO: 10092 - DNA, 24 bp, Homo sapiens
ctcctcctcctccttcttcttctt

SEQ ID NO: 10093 - DNA, 19 bp, Homo sapiens
ctcctcttccttctcttct

SEQ ID NO: 10094 - DNA, 21 bp, Homo sapiens
ctttccttcccatccctcctt

SEQ ID NO: 10095 - DNA, 21 bp, Homo sapiens
ctcctttacttctttttcctc

SEQ ID NO: 10096 - DNA, 27 bp, Homo sapiens
ctccttccttctgcccttcccttcctt

SEQ ID NO: 10097 - DNA, 18 bp, Homo sapiens
cttttcttccctccttcc

SEQ ID NO: 10098 - DNA, 25 bp, Homo sapiens
ttctccttccctctcagaccttctt

SEQ ID NO: 10099 - DNA, 22 bp, Homo sapiens
cttctcctttcactcaagccct

SEQ ID NO: 10100 - DNA, 20 bp, Homo sapiens
cctctccttccccttcccct

SEQ ID NO: 10101 - DNA, 26 bp, Homo sapiens
ttctccttatctcctacccttctctt

SEQ ID NO: 10102 - DNA, 23 bp, Homo sapiens
tcctccttcttctcgtttgcctt

SEQ ID NO: 10103 - DNA, 22 bp, Homo sapiens
tctcactccccttctcttcctt

SEQ ID NO: 10104 - DNA, 18 bp, Homo sapiens
cttctcctgtcttttccc

SEQ ID NO: 10105 - DNA, 21 bp, Homo sapiens
ctctcctttgtttctttcctt

SEQ ID NO: 10106 - DNA, 18 bp, Homo sapiens
cctctcttttcctatcct

SEQ ID NO: 10107 - DNA, 20 bp, Homo sapiens
cttcttcttcccctccccct

SEQ ID NO: 10108 - DNA, 20 bp, Homo sapiens
ttctcttcccttcccccctt

SEQ ID NO: 10109 - DNA, 21 bp, Homo sapiens
cttcgggctttttttcccctc

SEQ ID NO: 10110 - DNA, 25 bp, Homo sapiens
ctcctccttcctctcttaactcctt

SEQ ID NO: 10111 - DNA, 20 bp, Homo sapiens
ctgctcttttttccctcctt

SEQ ID NO: 10112 - DNA, 26 bp, Homo sapiens
cctcttttttttgttctttcctcctt

SEQ ID NO: 10113 - DNA, 19 bp, Homo sapiens
cttctcctatccctttccc

SEQ ID NO: 10114 - DNA, 18 bp, Homo sapiens
ttctccttcccctgctcc

SEQ ID NO: 10115 - DNA, 25 bp, Homo sapiens
ttctcctttccccttccccacgctt

SEQ ID NO: 10116 - DNA, 19 bp, Homo sapiens
cttctcctctaccccttcc

SEQ ID NO: 10117 - DNA, 23 bp, Homo sapiens
cctctccttttcacagcctcctt

SEQ ID NO: 10118 - DNA, 16 bp, Homo sapiens
cctcccttccttcctt

SEQ ID NO: 10119 - DNA, 18 bp, Homo sapiens
tccttttcttccccttct

SEQ ID NO: 10120 - DNA, 16 bp, Homo sapiens
cttccccttcttcctt

SEQ ID NO: 10121 - DNA, 21 bp, Homo sapiens
ttcctcttcccccaggtcctt

SEQ ID NO: 10122 - DNA, 19 bp, Homo sapiens
ctttcccttccagcccctc

SEQ ID NO: 10123 - DNA, 20 bp, Homo sapiens
cttttccttttcccctcctt

SEQ ID NO: 10124 - DNA, 22 bp, Homo sapiens
ttcttttccttttcccctcctt

SEQ ID NO: 10125 - DNA, 23 bp, Homo sapiens
cctttttctttgaaaccctcctt

SEQ ID NO: 10126 - DNA, 17 bp, Homo sapiens
tcttcttcccctcccct

SEQ ID NO: 10127 - DNA, 23 bp, Homo sapiens
ttctcctttaccctcctctcctt

SEQ ID NO: 10128 - DNA, 18 bp, Homo sapiens
cttctccctcggccttcc

SEQ ID NO: 10129 - DNA, 20 bp, Homo sapiens
tccaaaatcttcccctcctt

SEQ ID NO: 10130 - DNA, 24 bp, Homo sapiens
ttctcctttttttcccttttcctt

SEQ ID NO: 10131 - DNA, 19 bp, Homo sapiens
cttttcctcctccctcctt

SEQ ID NO: 10132 - DNA, 19 bp, Homo sapiens
cttttccttctcctcttcc

SEQ ID NO: 10133 - DNA, 18 bp, Homo sapiens
cctctccttccttcttcc

SEQ ID NO: 10134 - DNA, 23 bp, Homo sapiens
ttcttccttttctttccctcctt

SEQ ID NO: 10135 - DNA, 18 bp, Homo sapiens
cttccccttccctttccc

SEQ ID NO: 10136 - DNA, 18 bp, Homo sapiens
ctcctcctattccctcct

SEQ ID NO: 10137 - DNA, 26 bp, Homo sapiens
cttttccttcccaccatttcttcctt

SEQ ID NO: 10138 - DNA, 22 bp, Homo sapiens
cttctcccagcttcctctcctt

SEQ ID NO: 10139 - DNA, 19 bp, Homo sapiens
cctttctcctcccctcctt

SEQ ID NO: 10140 - DNA, 18 bp, Homo sapiens
cttcttcctcctcttccc

SEQ ID NO: 10141 - DNA, 18 bp, Homo sapiens
ctcctcctcctcctcttc

SEQ ID NO: 10142 - DNA, 20 bp, Homo sapiens
tccctccttttcctcttctt

SEQ ID NO: 10143 - DNA, 20 bp, Homo sapiens
ttctcctttccctttaccct

SEQ ID NO: 10144 - DNA, 18 bp, Homo sapiens
ctccttcttcctctctct

SEQ ID NO: 10145 - DNA, 24 bp, Homo sapiens
cttcatcctttcttctgtctcctt

SEQ ID NO: 10146 - DNA, 18 bp, Homo sapiens
ttctcctcttctctctct

SEQ ID NO: 10147 - DNA, 23 bp, Homo sapiens
cttctcctgtgtttcctttcctt

SEQ ID NO: 10148 - DNA, 23 bp, Homo sapiens
tcttaatgccccttcctctcctt

SEQ ID NO: 10149 - DNA, 25 bp, Homo sapiens
ctcccaggccttctttctcttcctt

SEQ ID NO: 10150 - DNA, 26 bp, Homo sapiens
ctccttcttcttcttctaagagcctt

SEQ ID NO: 10151 - DNA, 25 bp, Homo sapiens
ttctccctttctccttcttcttctt

SEQ ID NO: 10152 - DNA, 23 bp, Homo sapiens
ttctccttctctttcttctgctc

SEQ ID NO: 10153 - DNA, 18 bp, Homo sapiens
cttctctttcttctgctc

SEQ ID NO: 10154 - DNA, 18 bp, Homo sapiens
cttttcctttcctcccct

SEQ ID NO: 10155 - DNA, 20 bp, Homo sapiens
cctcttcttccccttctact

SEQ ID NO: 10156 - DNA, 27 bp, Homo sapiens
cttttccttccttccttcctttcctta

SEQ ID NO: 10157 - DNA, 26 bp, Homo sapiens
ctcctctcccctccttttccttcctt

SEQ ID NO: 10158 - DNA, 16 bp, Homo sapiens
ttctcctctcctcctc

SEQ ID NO: 10159 - DNA, 20 bp, Homo sapiens
cctcttcttccccctctcct

SEQ ID NO: 10160 - DNA, 19 bp, Homo sapiens
cctctcttcctctcctcct

SEQ ID NO: 10161 - DNA, 22 bp, Homo sapiens
ctcctccttcctccacatcctc

SEQ ID NO: 10162 - DNA, 20 bp, Homo sapiens
ttcttccttccccttccccc

SEQ ID NO: 10163 - DNA, 18 bp, Homo sapiens
cttctcccctttcttccc

SEQ ID NO: 10164 - DNA, 18 bp, Homo sapiens
cttctcctctcctcgcct

SEQ ID NO: 10165 - DNA, 18 bp, Homo sapiens
cttccccttcctgctcct

SEQ ID NO: 10166 - DNA, 18 bp, Homo sapiens
cctcccttttcccctcct

SEQ ID NO: 10167 - DNA, 19 bp, Homo sapiens
ctctcctttttcttctctc

SEQ ID NO: 10168 - DNA, 21 bp, Homo sapiens
cttcccttccccgttccctct

SEQ ID NO: 10169 - DNA, 17 bp, Homo sapiens
ttctccctctctctctc

SEQ ID NO: 10170 - DNA, 20 bp, Homo sapiens
tccatcccttttccctcctt

SEQ ID NO: 10171 - DNA, 21 bp, Homo sapiens
cttcccttttctcccaccctc

SEQ ID NO: 10172 - DNA, 27 bp, Homo sapiens
cttctcctattttccttttttttcctt

SEQ ID NO: 10173 - DNA, 21 bp, Homo sapiens
ctcctccttcctgcttttcct

SEQ ID NO: 10174 - DNA, 19 bp, Homo sapiens
tctccttcacgctctcctt

SEQ ID NO: 10175 - DNA, 20 bp, Homo sapiens
cttctccttccccttatccc

SEQ ID NO: 10176 - DNA, 16 bp, Homo sapiens
ttctccttcttctcct

SEQ ID NO: 10177 - DNA, 26 bp, Homo sapiens
tcctccttcttttccttcttcttctt

SEQ ID NO: 10178 - DNA, 21 bp, Homo sapiens
tccttccttccttccctcctt

SEQ ID NO: 10179 - DNA, 22 bp, Homo sapiens
ccctccttccttccttcctttc

SEQ ID NO: 10180 - DNA, 19 bp, Homo sapiens
cttctctctcccctttccc

SEQ ID NO: 10181 - DNA, 21 bp, Homo sapiens
ctcctctttctccttcctctc

SEQ ID NO: 10182 - DNA, 26 bp, Homo sapiens
ctgctccttcccactcacctttcctt

SEQ ID NO: 10183 - DNA, 23 bp, Homo sapiens
ctctccttctctgcctgtctctt

SEQ ID NO: 10184 - DNA, 24 bp, Homo sapiens
cttttcctccttgaccccctcctt

SEQ ID NO: 10185 - DNA, 18 bp, Homo sapiens
cttctctctttccctccc

SEQ ID NO: 10186 - DNA, 29 bp, Homo sapiens
tcctccttcccttgcttcctctctcctta

SEQ ID NO: 10187 - DNA, 25 bp, Homo sapiens
ttctccctctctttctccctctctt

SEQ ID NO: 10188 - DNA, 24 bp, Homo sapiens
ctcctctttcctttcttcctcctt

SEQ ID NO: 10189 - DNA, 22 bp, Homo sapiens
ctcggggctccttcccctcctt

SEQ ID NO: 10190 - DNA, 24 bp, Homo sapiens
cttctcctccagcgttctctcctt

SEQ ID NO: 10191 - DNA, 25 bp, Homo sapiens
cccttccttccacctttctctcctt

SEQ ID NO: 10192 - DNA, 19 bp, Homo sapiens
ctcctccttttccttcccc

SEQ ID NO: 10193 - DNA, 19 bp, Homo sapiens
tcccccttcccttttcctc

SEQ ID NO: 10194 - DNA, 18 bp, Homo sapiens
ttctctctctctgctcct

SEQ ID NO: 10195 - DNA, 21 bp, Homo sapiens
ctcctccttccccacatcctt

SEQ ID NO: 10196 - DNA, 19 bp, Homo sapiens
cttcgtccttcccctttcc

SEQ ID NO: 10197 - DNA, 22 bp, Homo sapiens
cttcctcttcctcttctcctcc

SEQ ID NO: 10198 - DNA, 18 bp, Homo sapiens
cttttccttctccctccc

SEQ ID NO: 10199 - DNA, 25 bp, Homo sapiens
ttcttgtcgccccctccttttcctt

SEQ ID NO: 10200 - DNA, 19 bp, Homo sapiens
cttcctccctccctccctt

SEQ ID NO: 10201 - DNA, 19 bp, Homo sapiens
ttctccttccctgttctcc

SEQ ID NO: 10202 - DNA, 19 bp, Homo sapiens
cctctcctttttcattcct

SEQ ID NO: 10203 - DNA, 25 bp, Homo sapiens
cttctccctcggtcatttcttcctt

SEQ ID NO: 10204 - DNA, 24 bp, Homo sapiens
cttctttctccccgtcccctcctt

SEQ ID NO: 10205 - DNA, 22 bp, Homo sapiens
ttctcatttcggaaccctcctt

SEQ ID NO: 10206 - DNA, 18 bp, Homo sapiens
cttccctccttccttcct

SEQ ID NO: 10207 - DNA, 23 bp, Homo sapiens
cttcccttcttagcagcctcctt

SEQ ID NO: 10208 - DNA, 24 bp, Homo sapiens
ctccttccttcccctcccctcctt

SEQ ID NO: 10209 - DNA, 19 bp, Homo sapiens
ttctccctcttcttctcct

SEQ ID NO: 10210 - DNA, 20 bp, Homo sapiens
ttctcccttctatctctctt

SEQ ID NO: 10211 - DNA, 19 bp, Homo sapiens
cttctctttgccttcccct

SEQ ID NO: 10212 - DNA, 19 bp, Homo sapiens
cctctcctttcttcatcct

SEQ ID NO: 10213 - DNA, 17 bp, Homo sapiens
ctttcctttcccttccc

SEQ ID NO: 10214 - DNA, 18 bp, Homo sapiens
cttcccctttctcctcct

SEQ ID NO: 10215 - DNA, 21 bp, Homo sapiens
cttttcctttctccccatctt

SEQ ID NO: 10216 - DNA, 20 bp, Homo sapiens
cttctccgttttctcccctt

SEQ ID NO: 10217 - DNA, 16 bp, Homo sapiens
cttcccttcccttccc

SEQ ID NO: 10218 - DNA, 20 bp, Homo sapiens
cttcccctttcttctttctc

SEQ ID NO: 10219 - DNA, 19 bp, Homo sapiens
cctctcctttcctccttcc

SEQ ID NO: 10220 - DNA, 19 bp, Homo sapiens
cctgtcccctttccctcct

SEQ ID NO: 10221 - DNA, 19 bp, Homo sapiens
ttctcctctccttcctttc

SEQ ID NO: 10222 - DNA, 25 bp, Homo sapiens
cttcctttttcctccttacttcctt

SEQ ID NO: 10223 - DNA, 22 bp, Homo sapiens
tccttcttcctcctccctcctt

SEQ ID NO: 10224 - DNA, 21 bp, Homo sapiens
cttcctcctttctactgcctt

SEQ ID NO: 10225 - DNA, 21 bp, Homo sapiens
cttcttcttcctttttccccc

SEQ ID NO: 10226 - DNA, 30 bp, Homo sapiens
tcctccttcattcttcctttttcctcctta

SEQ ID NO: 10227 - DNA, 23 bp, Homo sapiens
ctccttcctacttccttcttctt

SEQ ID NO: 10228 - DNA, 23 bp, Homo sapiens
ttctacttcctcctgtcttcctt

SEQ ID NO: 10229 - DNA, 20 bp, Homo sapiens
ctcctccttcgtcttcttct

SEQ ID NO: 10230 - DNA, 22 bp, Homo sapiens
cttctcctctctcttcttcctt

SEQ ID NO: 10231 - DNA, 19 bp, Homo sapiens
cctctccttccctttcccc

SEQ ID NO: 10232 - DNA, 24 bp, Homo sapiens
ttctccttcctggtggtcctcctt

SEQ ID NO: 10233 - DNA, 21 bp, Homo sapiens
cttcatcctttttttcccctc

SEQ ID NO: 10234 - DNA, 20 bp, Homo sapiens
cttcccctttggcttcctct

SEQ ID NO: 10235 - DNA, 23 bp, Homo sapiens
ttctttttctctccctcctcctt

SEQ ID NO: 10236 - DNA, 23 bp, Homo sapiens
cctcttcttcatcgctcctcctt

SEQ ID NO: 10237 - DNA, 25 bp, Homo sapiens
cttcgcctacatcctttccctcctt

SEQ ID NO: 10238 - DNA, 22 bp, Homo sapiens
tctccttctctcttctcttctt

SEQ ID NO: 10239 - DNA, 19 bp, Homo sapiens
ttctctcttctcttcttct

SEQ ID NO: 10240 - DNA, 28 bp, Homo sapiens
ttcttcctcccctttcttcccttcctta

SEQ ID NO: 10241 - DNA, 23 bp, Homo sapiens
ctctccttctctcttctcttctt

SEQ ID NO: 10242 - DNA, 27 bp, Homo sapiens
cttcttttcttccccttccccttctta

SEQ ID NO: 10243 - DNA, 27 bp, Homo sapiens
cttccccttcttttcttccccttctta

SEQ ID NO: 10244 - DNA, 24 bp, Homo sapiens
ttctcctttaccctcaatatcctt

SEQ ID NO: 10245 - DNA, 28 bp, Homo sapiens
ctcctctctcccgtctctttctctcctt

SEQ ID NO: 10246 - DNA, 21 bp, Homo sapiens
cttcccttctcagctttcctt

SEQ ID NO: 10247 - DNA, 21 bp, Homo sapiens
ctcctctttcactttttcctc

SEQ ID NO: 10248 - DNA, 23 bp, Homo sapiens
tctccctcaatttttctttcctt

SEQ ID NO: 10249 - DNA, 18 bp, Homo sapiens
cctcctccttctcctcct

SEQ ID NO: 10250 - DNA, 21 bp, Homo sapiens
tcctttcttccttccttcctt

SEQ ID NO: 10251 - DNA, 22 bp, Homo sapiens
tccctcccttctttccttcctt

SEQ ID NO: 10252 - DNA, 18 bp, Homo sapiens
ctttccttcctttcttcc

SEQ ID NO: 10253 - DNA, 21 bp, Homo sapiens
ctcctccttattcctttcctt

SEQ ID NO: 10254 - DNA, 21 bp, Homo sapiens
cttcttcctcccccactcctt

SEQ ID NO: 10255 - DNA, 23 bp, Homo sapiens
ctcctctgcaaacccttcctttc

SEQ ID NO: 10256 - DNA, 20 bp, Homo sapiens
ttctcctcttcaaactcctt

SEQ ID NO: 10257 - DNA, 22 bp, Homo sapiens
tctccttctccttctccttctt

SEQ ID NO: 10258 - DNA, 20 bp, Homo sapiens
cttctccttctccttcttct

SEQ ID NO: 10259 - DNA, 27 bp, Homo sapiens
ctcctccttctcctctatctcctcctt

SEQ ID NO: 10260 - DNA, 19 bp, Homo sapiens
cttctccttttccttactc

SEQ ID NO: 10261 - DNA, 20 bp, Homo sapiens
ttcccctttccattttcctt

SEQ ID NO: 10262 - DNA, 20 bp, Homo sapiens
cttcccttttccttttcctc

SEQ ID NO: 10263 - DNA, 22 bp, Homo sapiens
ttctctcccttcccttttcctt

SEQ ID NO: 10264 - DNA, 19 bp, Homo sapiens
ttctcctttccttcttctc

SEQ ID NO: 10265 - DNA, 18 bp, Homo sapiens
cttctctctcctctatcc

SEQ ID NO: 10266 - DNA, 20 bp, Homo sapiens
cttcctttcttcctttcctt

SEQ ID NO: 10267 - DNA, 21 bp, Homo sapiens
ctccaccccctttttttcctt

SEQ ID NO: 10268 - DNA, 15 bp, Homo sapiens
ttctccttttcccct

SEQ ID NO: 10269 - DNA, 17 bp, Homo sapiens
cttcatcctttcacctc

SEQ ID NO: 10270 - DNA, 17 bp, Homo sapiens
tctcctttcctttctcc

SEQ ID NO: 10271 - DNA, 20 bp, Homo sapiens
ttctcccttgttctttcctt

SEQ ID NO: 10272 - DNA, 21 bp, Homo sapiens
ctcttccttccccaactcctt

SEQ ID NO: 10273 - DNA, 20 bp, Homo sapiens
tcctgaacctttccctcctt

SEQ ID NO: 10274 - DNA, 22 bp, Homo sapiens
cttctctttcctcctccaacct

SEQ ID NO: 10275 - DNA, 19 bp, Homo sapiens
cttctcctgctctgccttc

SEQ ID NO: 10276 - DNA, 17 bp, Homo sapiens
ctttcctttcctttccc

SEQ ID NO: 10277 - DNA, 22 bp, Homo sapiens
cctttccctccctcccttcctt

SEQ ID NO: 10278 - DNA, 20 bp, Homo sapiens
ctcctttccttcctttcctt

SEQ ID NO: 10279 - DNA, 24 bp, Homo sapiens
ctccctccctcctttccttcctta

SEQ ID NO: 10280 - DNA, 22 bp, Homo sapiens
ctttccttcctttcctttcctt

SEQ ID NO: 10281 - DNA, 22 bp, Homo sapiens
ttctcctttctctctgatcctt

SEQ ID NO: 10282 - DNA, 20 bp, Homo sapiens
cttccccttccccttcgcct

SEQ ID NO: 10283 - DNA, 22 bp, Homo sapiens
tctccttcaattttctcttctt

SEQ ID NO: 10284 - DNA, 87 bp, Bovine herpesvirus 1
ccgcgcgtgccttttttttgttttaccgcggcgcgggagaagccctcgccggctctctcgccgcggcggccggcggggcgcgcgcgg

SEQ ID NO: 10285 - DNA, 24 bp, Bovine herpesvirus 1
tcgccgcggcggccggcggggcgc

SEQ ID NO: 10286 - DNA, 23 bp, Homo sapiens
tcgcccgcgcgggggcggggcgc

SEQ ID NO: 10287 - DNA, 17 bp, Homo sapiens
gccgggcggggcgggcg

SEQ ID NO: 10288 - DNA, 21 bp, Homo sapiens
cgccagaggctggcggggcgc

SEQ ID NO: 10289 - DNA, 23 bp, Homo sapiens
cgccgcggcggctgcccaggtgc

SEQ ID NO: 10290 - DNA, 21 bp, Homo sapiens
tcggcgcgcggggcggggcgc

SEQ ID NO: 10291 - DNA, 21 bp, Homo sapiens
tccccgcggcggccggtaagc

SEQ ID NO: 10292 - DNA, 19 bp, Homo sapiens
cgccgcggtggctggatgc

SEQ ID NO: 10293 - DNA, 15 bp, Homo sapiens
cgcggcggccggggc

SEQ ID NO: 10294 - DNA, 19 bp, Homo sapiens
gcgcggtggcccggggcgc

SEQ ID NO: 10295 - DNA, 24 bp, Homo sapiens
tcgcgcggcggccggcggaggcgc

SEQ ID NO: 10296 - DNA, 22 bp, Homo sapiens
ccgggggcggttggcggggcgc

SEQ ID NO: 10297 - DNA, 27 bp, Homo sapiens
ccgctgcggcggccgctgcgcgccccg

SEQ ID NO: 10298 - DNA, 22 bp, Homo sapiens
cgtcgtggccggcaccgggcgc

SEQ ID NO: 10299 - DNA, 27 bp, Homo sapiens
tcgcggcggtggccgctgcgcgccccg

SEQ ID NO: 10300 - DNA, 20 bp, Homo sapiens
gccgcggcgtgggcggggcg

SEQ ID NO: 10301 - DNA, 20 bp, Homo sapiens
tcgcccggcggccggccaaa

SEQ ID NO: 10302 - DNA, 19 bp, Homo sapiens
gcggcgaaacccggggcgc

SEQ ID NO: 10303 - DNA, 17 bp, Homo sapiens
cgctgcggcggcgggcg

SEQ ID NO: 10304 - DNA, 18 bp, Homo sapiens
tcgccgcggtcgccgcgc

SEQ ID NO: 10305 - DNA, 19 bp, Homo sapiens
tcgctggggcggccggggc

SEQ ID NO: 10306 - DNA, 20 bp, Homo sapiens
cgcggcggcggcggcggcgc

SEQ ID NO: 10307 - DNA, 20 bp, Homo sapiens
gccgcggcggccgccaccgc

SEQ ID NO: 10308 - DNA, 18 bp, Homo sapiens
cgccgcggcggcccgtgc

SEQ ID NO: 10309 - DNA, 18 bp, Homo sapiens
tcgccgcggcgccggagc

SEQ ID NO: 10310 - DNA, 24 bp, Homo sapiens
tcgccgccgcccaaggcggggcgc

SEQ ID NO: 10311 - DNA, 24 bp, Homo sapiens
ccgccattttggtcggtggggcgc

SEQ ID NO: 10312 - DNA, 22 bp, Homo sapiens
tcgctggggtggctggcatcgc

SEQ ID NO: 10313 - DNA, 17 bp, Homo sapiens
tcccgcggcggccgggg

SEQ ID NO: 10314 - DNA, 17 bp, Homo sapiens
cgcggcggcggcggcgc

SEQ ID NO: 10315 - DNA, 25 bp, Homo sapiens
gctgcggcggccgctgcgcgccccg

SEQ ID NO: 10316 - DNA, 19 bp, Homo sapiens
ccgctgccccggcggggcg

SEQ ID NO: 10317 - DNA, 19 bp, Homo sapiens
cgccgtggagcgcggggcg

SEQ ID NO: 10318 - DNA, 17 bp, Homo sapiens
tcgccgcggcgccgggg

SEQ ID NO: 10319 - DNA, 21 bp, Homo sapiens
tcgcgcggcggctgtggagcg

SEQ ID NO: 10320 - DNA, 19 bp, Homo sapiens
tctccgcggcggcggggcg

SEQ ID NO: 10321 - DNA, 19 bp, Homo sapiens
ccgccgcggcggctgctgc

SEQ ID NO: 10322 - DNA, 22 bp, Homo sapiens
tcgctgcggccgctgcttctgc

SEQ ID NO: 10323 - DNA, 17 bp, Homo sapiens
cgcggcggccgcggcgc

SEQ ID NO: 10324 - DNA, 22 bp, Homo sapiens
gccgcggcggtgggagcagcgc

SEQ ID NO: 10325 - DNA, 18 bp, Homo sapiens
gcggccaccgcggggcgc

SEQ ID NO: 10326 - DNA, 21 bp, Homo sapiens
gcttgcggcggccctcggcgc

SEQ ID NO: 10327 - DNA, 22 bp, Homo sapiens
tcgccgcggaggccaccagtgc

SEQ ID NO: 10328 - DNA, 19 bp, Homo sapiens
gccgcagcggcccctgcgc

SEQ ID NO: 10329 - DNA, 20 bp, Homo sapiens
cgctcaagctggcggggcgc

SEQ ID NO: 10330 - DNA, 18 bp, Homo sapiens
tcgcagtggcggcggcgg

SEQ ID NO: 10331 - DNA, 20 bp, Homo sapiens
tctccgcggcggcgccggcg

SEQ ID NO: 10332 - DNA, 78 bp, Bovine herpesvirus 1
ggcggtggcggccgcgtctctctcctttccccgcgcctctttcttgttccgcgggcttctttcttggccgtctcctcc

SEQ ID NO: 10333 - DNA, 24 bp, Bovine herpesvirus 1
tggcggccgcgtctctctcctttc

SEQ ID NO: 10334 - DNA, 25 bp, Homo sapiens
tgccggccgcgcagtctctcttttc

SEQ ID NO: 10335 - DNA, 20 bp, Homo sapiens
tggtgacccttttctccttt

SEQ ID NO: 10336 - DNA, 20 bp, Homo sapiens
agctcggtctctcttctttc

SEQ ID NO: 10337 - DNA, 22 bp, Homo sapiens
tgggggctgatgatctcctttc

SEQ ID NO: 10338 - DNA, 22 bp, Homo sapiens
tggaggccccgtctctcctttc

SEQ ID NO: 10339 - DNA, 22 bp, Homo sapiens
tggagaaactttctctcctttc

SEQ ID NO: 10340 - DNA, 20 bp, Homo sapiens
tggtggctacttctcctttc

SEQ ID NO: 10341 - DNA, 21 bp, Homo sapiens
tgactttcgtctctctctttt

SEQ ID NO: 10342 - DNA, 21 bp, Homo sapiens
tgatggctgtgtacctccttt

SEQ ID NO: 10343 - DNA, 16 bp, Homo sapiens
tggctgccgcctcctt

SEQ ID NO: 10344 - DNA, 21 bp, Homo sapiens
tggctggctgttacctccttt

SEQ ID NO: 10345 - DNA, 16 bp, Homo sapiens
tggcagcccctgcttt

SEQ ID NO: 10346 - DNA, 22 bp, Homo sapiens
tggctggctcctctctcctttc

SEQ ID NO: 10347 - DNA, 22 bp, Homo sapiens
tggttggaatctctctttcttt

SEQ ID NO: 10348 - DNA, 18 bp, Homo sapiens
tggaggcccctctccttt

SEQ ID NO: 10349 - DNA, 18 bp, Homo sapiens
tggcgattcctctccttt

SEQ ID NO: 10350 - DNA, 80 bp, Bovine herpesvirus 1
tccctgcttgctcaccgccggggtcctcccgccaatcgcgaaagggagaagggtgaggggcggccgtgagcaagcaggga

SEQ ID NO: 10351 - DNA, 24 bp, Bovine herpesvirus 1
gcttgctcaccgccggggtcctcc

SEQ ID NO: 10352 - DNA, 21 bp, Homo sapiens
ttgctcacagctttattcctc

SEQ ID NO: 10353 - DNA, 19 bp, Homo sapiens
gcctgctcactggcttctc

SEQ ID NO: 10354 - DNA, 20 bp, Homo sapiens
gctcgctcactgctggccgg

SEQ ID NO: 10355 - DNA, 19 bp, Homo sapiens
ttcctcattcaagtcctcc

SEQ ID NO: 10356 - DNA, 18 bp, Homo sapiens
gcttgctcgctccgggat

SEQ ID NO: 10357 - DNA, 20 bp, Homo sapiens
cttgctcaggcagggtcctc

SEQ ID NO: 10358 - DNA, 26 bp, Homo sapiens
gcctgctcgccgctctgggcgtcctc

SEQ ID NO: 10359 - DNA, 24 bp, Homo sapiens
cttgctcactgctctccggaggac

SEQ ID NO: 10360 - DNA, 20 bp, Homo sapiens
gcttgctcgctcccagctcc

SEQ ID NO: 10361 - DNA, 20 bp, Homo sapiens
gcttgctcactcttgcatcc

SEQ ID NO: 10362 - DNA, 19 bp, Homo sapiens
ttgctcactgctgtactcc

SEQ ID NO: 10363 - DNA, 27 bp, Homo sapiens
gctgctcactgctcatttcggaggacc

SEQ ID NO: 10364 - DNA, 21 bp, Homo sapiens
gcttgcttgcctccgcacctc

SEQ ID NO: 10365 - DNA, 21 bp, Homo sapiens
gcttgctcttgtagatcttcc

SEQ ID NO: 10366 - DNA, 18 bp, Homo sapiens
ttgctcactccagacttc

SEQ ID NO: 10367 - DNA, 16 bp, Homo sapiens
gcctgctcagggtcct

SEQ ID NO: 10368 - DNA, 30 bp, Homo sapiens
gcttgcccactgccgtgctctggaggaccc

SEQ ID NO: 10369 - DNA, 17 bp, Homo sapiens
ttgctcactgcctcctc

SEQ ID NO: 10370 - DNA, 22 bp, Homo sapiens
gcttgctcacatgctcactagc

SEQ ID NO: 10371 - DNA, 25 bp, Homo sapiens
gcttgctgtactgctggccggaggc

SEQ ID NO: 10372 - DNA, 22 bp, Homo sapiens
gctttttcactgccaggatcct

SEQ ID NO: 10373 - DNA, 22 bp, Homo sapiens
gctcacacctgctggggtcctc

SEQ ID NO: 10374 - DNA, 24 bp, Homo sapiens
gcttgctcacgttgactggactcc

SEQ ID NO: 10375 - DNA, 19 bp, Homo sapiens
gcttccgcctggggtcctc

SEQ ID NO: 10376 - DNA, 27 bp, Homo sapiens
gcttgctcattcctggcaggcatctcc

SEQ ID NO: 10377 - DNA, 22 bp, Homo sapiens
gcttcctcactgtgagtcctcc

SEQ ID NO: 10378 - DNA, 26 bp, Homo sapiens
gcttcctcaccgccgatgagacctcc

SEQ ID NO: 10379 - DNA, 20 bp, Homo sapiens
gctgccgtctcggggtcctc

SEQ ID NO: 10380 - DNA, 19 bp, Homo sapiens
gctgctcaccagtgtcctc

SEQ ID NO: 10381 - DNA, 18 bp, Homo sapiens
gcttgctcctggctcctc

SEQ ID NO: 10382 - DNA, 22 bp, Homo sapiens
gcttgtccacgggaggtcctcc

SEQ ID NO: 10383 - DNA, 28 bp, Homo sapiens
gcttgctcctgcgcctttggaggacccc

SEQ ID NO: 10384 - DNA, 20 bp, Homo sapiens
gcttgctgttgctgggatcc

SEQ ID NO: 10385 - DNA, 73 bp, Bovine herpesvirus 1
gggaaagagaaggaggggaaggggaaggagaaggcgccgcactgccgcccgctcccggcccgccgtccgtccc

SEQ ID NO: 10386 - DNA, 24 bp, Bovine herpesvirus 1
aggggaaggagaaggcgccgcact

SEQ ID NO: 10387 - DNA, 22 bp, Homo sapiens
ggggaagggggggcacgaaggc

SEQ ID NO: 10388 - DNA, 18 bp, Homo sapiens
aggggaaggggagagccc

SEQ ID NO: 10389 - DNA, 21 bp, Homo sapiens
ggggtagggagaagagaccac

SEQ ID NO: 10390 - DNA, 21 bp, Homo sapiens
gggagggagaaggaggcatgc

SEQ ID NO: 10391 - DNA, 25 bp, Homo sapiens
aggggtgaggagggggcttaactgc

SEQ ID NO: 10392 - DNA, 26 bp, Homo sapiens
agggaagggggaggtgtgaaacgtgc

SEQ ID NO: 10393 - DNA, 23 bp, Homo sapiens
aggggaggagaagttgcctgtgc

SEQ ID NO: 10394 - DNA, 18 bp, Homo sapiens
aggggaagggagaggtgc

SEQ ID NO: 10395 - DNA, 21 bp, Homo sapiens
ggggaaggggggggccatacc

SEQ ID NO: 10396 - DNA, 22 bp, Homo sapiens
aggagaaggggaggggggaggc

SEQ ID NO: 10397 - DNA, 22 bp, Homo sapiens
ggggagggggcccggccgcact

SEQ ID NO: 10398 - DNA, 22 bp, Homo sapiens
aggggaaggaaaaagatgcact

SEQ ID NO: 10399 - DNA, 18 bp, Homo sapiens
ggggaaggggaggagaca

SEQ ID NO: 10400 - DNA, 20 bp, Homo sapiens
ggggaaggtgaaggctgggc

SEQ ID NO: 10401 - DNA, 17 bp, Homo sapiens
aagggagggaggagggc

SEQ ID NO: 10402 - DNA, 19 bp, Homo sapiens
ggggaaggagagcgcgggc

SEQ ID NO: 10403 - DNA, 18 bp, Homo sapiens
gaggagaggaggaggcgc

SEQ ID NO: 10404 - DNA, 22 bp, Homo sapiens
agggaggaggagaggccgcgct

SEQ ID NO: 10405 - DNA, 17 bp, Homo sapiens
aggggaagggacgtgca

SEQ ID NO: 10406 - DNA, 18 bp, Homo sapiens
ggtggaaggaggccgcac

SEQ ID NO: 10407 - DNA, 18 bp, Homo sapiens
aggggaaggaggaggtgc

SEQ ID NO: 10408 - DNA, 18 bp, Homo sapiens
aggggagtgggaaggcgc

SEQ ID NO: 10409 - DNA, 21 bp, Homo sapiens
aggaggagccggcgccgcgct

SEQ ID NO: 10410 - DNA, 17 bp, Homo sapiens
aggggaaggagagctgc

SEQ ID NO: 10411 - DNA, 21 bp, Homo sapiens
aggggaagcaggagcggcact

SEQ ID NO: 10412 - DNA, 19 bp, Homo sapiens
aggggggaggatggcgcgc

SEQ ID NO: 10413 - DNA, 19 bp, Homo sapiens
aggggtgggggaagcacca

SEQ ID NO: 10414 - DNA, 20 bp, Homo sapiens
agggaggaggaggaaggggc

SEQ ID NO: 10415 - DNA, 19 bp, Homo sapiens
aggagaaggggaagcgcca

SEQ ID NO: 10416 - DNA, 18 bp, Homo sapiens
ggggagaggagaaggggc

SEQ ID NO: 10417 - DNA, 18 bp, Homo sapiens
aggggaaggaggggggcg

SEQ ID NO: 10418 - DNA, 18 bp, Homo sapiens
aggggaaggggaggccac

SEQ ID NO: 10419 - DNA, 17 bp, Homo sapiens
ggggaaggggaagggcc

SEQ ID NO: 10420 - DNA, 18 bp, Homo sapiens
aggagaagggggagccgc

SEQ ID NO: 10421 - DNA, 18 bp, Homo sapiens
aggggaggaagaaagtgc

SEQ ID NO: 10422 - DNA, 19 bp, Homo sapiens
aggggagggagaagatccc

SEQ ID NO: 10423 - DNA, 17 bp, Homo sapiens
aggggaaggggaggccc

SEQ ID NO: 10424 - DNA, 19 bp, Homo sapiens
aggggaaggagagagaagc

SEQ ID NO: 10425 - DNA, 22 bp, Homo sapiens
aggggaagggcgggggcgaggc

SEQ ID NO: 10426 - DNA, 22 bp, Homo sapiens
ggggaaagggggggggcccact

SEQ ID NO: 10427 - DNA, 18 bp, Homo sapiens
ggggaagggagggcaggc

SEQ ID NO: 10428 - DNA, 18 bp, Homo sapiens
aggggggggagggggcca

SEQ ID NO: 10429 - DNA, 18 bp, Homo sapiens
aggggggagaagacccgc

SEQ ID NO: 10430 - DNA, 21 bp, Homo sapiens
aggggaagaggggaggctggc

SEQ ID NO: 10431 - DNA, 20 bp, Homo sapiens
aggggaggggagaaaggtgc

SEQ ID NO: 10432 - DNA, 26 bp, Homo sapiens
aggggaaggggaggataccggtcact

SEQ ID NO: 10433 - DNA, 21 bp, Homo sapiens
aggggagggaggggccacgct

SEQ ID NO: 10434 - DNA, 17 bp, Homo sapiens
agggaagggaggctgca

SEQ ID NO: 10435 - DNA, 23 bp, Homo sapiens
aggggtgggagaaggaagtgtgc

SEQ ID NO: 10436 - DNA, 22 bp, Homo sapiens
agggagaaggggagaaatgtac

SEQ ID NO: 10437 - DNA, 21 bp, Homo sapiens
aggggaagaggggcagaggca

SEQ ID NO: 10438 - DNA, 21 bp, Homo sapiens
agggaaggaggggaatagaca

SEQ ID NO: 10439 - DNA, 24 bp, Homo sapiens
ggggtggaggagagggctggttgc

SEQ ID NO: 10440 - DNA, 18 bp, Homo sapiens
ggggaaagagaaccgcac

SEQ ID NO: 10441 - DNA, 20 bp, Homo sapiens
gggggaggaaaaaagtgtgc

SEQ ID NO: 10442 - DNA, 21 bp, Homo sapiens
aggggaaggggaggtcaggcc

SEQ ID NO: 10443 - DNA, 17 bp, Homo sapiens
ggggaaggaggagggcc

SEQ ID NO: 10444 - DNA, 19 bp, Homo sapiens
aggggaaggaagggcatac

SEQ ID NO: 10445 - DNA, 20 bp, Homo sapiens
agggaagggaggaggacgac

SEQ ID NO: 10446 - DNA, 19 bp, Homo sapiens
ggggaagggggaggcagca

SEQ ID NO: 10447 - DNA, 18 bp, Homo sapiens
ggggaaggaggcaggggc

SEQ ID NO: 10448 - DNA, 21 bp, Homo sapiens
aggggaagggagggacgaggc

SEQ ID NO: 10449 - DNA, 23 bp, Homo sapiens
agggcaaggggagccacagcact

SEQ ID NO: 10450 - DNA, 20 bp, Homo sapiens
aggggaaaggagagggttcc

SEQ ID NO: 10451 - DNA, 17 bp, Homo sapiens
aggagaaggagatgcac

SEQ ID NO: 10452 - DNA, 16 bp, Homo sapiens
ggagaaggagaggccc

SEQ ID NO: 10453 - DNA, 22 bp, Homo sapiens
aggggaggaggggcaaagcact

SEQ ID NO: 10454 - DNA, 19 bp, Homo sapiens
ggggaaagggagcgagcgc

SEQ ID NO: 10455 - DNA, 22 bp, Homo sapiens
aagggaagggggtccttgcact

SEQ ID NO: 10456 - DNA, 16 bp, Homo sapiens
aggggaaggggctgca

SEQ ID NO: 10457 - DNA, 16 bp, Homo sapiens
ggggaaggaaagggcc

SEQ ID NO: 10458 - DNA, 24 bp, Homo sapiens
aggggaagagggaagagaagatac

SEQ ID NO: 10459 - DNA, 16 bp, Homo sapiens
aggggaagggaagggc

SEQ ID NO: 10460 - DNA, 22 bp, Homo sapiens
ggggaagggggaggatgactgc

SEQ ID NO: 10461 - DNA, 21 bp, Homo sapiens
agggaggagaagtggcctgca

SEQ ID NO: 10462 - DNA, 18 bp, Homo sapiens
aggggaagaaggctgtgc

SEQ ID NO: 10463 - DNA, 21 bp, Homo sapiens
ggggagggagaaggtggtagc

SEQ ID NO: 10464 - DNA, 20 bp, Homo sapiens
agggagggagaaggaggggc

SEQ ID NO: 10465 - DNA, 19 bp, Homo sapiens
aggggaagggggaagcacc

SEQ ID NO: 10466 - DNA, 18 bp, Homo sapiens
gggggaggcagaaggagc

SEQ ID NO: 10467 - DNA, 16 bp, Homo sapiens
aggggaggagaagggc

SEQ ID NO: 10468 - DNA, 16 bp, Homo sapiens
ggggaagggggccgca

SEQ ID NO: 10469 - DNA, 19 bp, Homo sapiens
aggggaggagagcgagcgc

SEQ ID NO: 10470 - DNA, 21 bp, Homo sapiens
aggggaaggggatggtcagca

SEQ ID NO: 10471 - DNA, 18 bp, Homo sapiens
ggggaaggaggtggctgc

SEQ ID NO: 10472 - DNA, 20 bp, Homo sapiens
aggggaaggagtggcttcgc

SEQ ID NO: 10473 - DNA, 19 bp, Homo sapiens
aggaggaggagagggaggc

SEQ ID NO: 10474 - DNA, 18 bp, Homo sapiens
agaggagggagaaggaac

SEQ ID NO: 10475 - DNA, 19 bp, Homo sapiens
ggggaaggggcgagaccac

SEQ ID NO: 10476 - DNA, 25 bp, Homo sapiens
aggggaggggagaagggagggcact

SEQ ID NO: 10477 - DNA, 18 bp, Homo sapiens
aggtgaaggagaaggccc

SEQ ID NO: 10478 - DNA, 19 bp, Homo sapiens
ggggaaggtgagggctgac

SEQ ID NO: 10479 - DNA, 19 bp, Homo sapiens
aggggaaggaagaggcagc

SEQ ID NO: 10480 - DNA, 19 bp, Homo sapiens
ggggaagggaaggaaggac

SEQ ID NO: 10481 - DNA, 25 bp, Homo sapiens
agggaagggggaggaaccaggcact

SEQ ID NO: 10482 - DNA, 16 bp, Homo sapiens
agggaaggagggggcc

SEQ ID NO: 10483 - DNA, 18 bp, Homo sapiens
gggaaggagagacggcac

SEQ ID NO: 10484 - DNA, 18 bp, Homo sapiens
aggggaaggaggtggcac

SEQ ID NO: 10485 - DNA, 20 bp, Homo sapiens
agggcgagggagggggcgcc

SEQ ID NO: 10486 - DNA, 18 bp, Homo sapiens
ggagaaggagggggtgcc

SEQ ID NO: 10487 - DNA, 20 bp, Homo sapiens
agaggagggaggaactgtgc

SEQ ID NO: 10488 - DNA, 18 bp, Homo sapiens
aggggaaggagggggccc

SEQ ID NO: 10489 - DNA, 21 bp, Homo sapiens
agggaaggggagagtaagtgc

SEQ ID NO: 10490 - DNA, 23 bp, Homo sapiens
aggggaagggtgggggagaaacg

SEQ ID NO: 10491 - DNA, 73 bp, Bovine herpesvirus 1
cgcataaggcaccgcggctgggcccttcacacaggcaaaagtagggaggcagggccgcggcgagtaatttgcg

SEQ ID NO: 10492 - DNA, 24 bp, Bovine herpesvirus 1
taaggcaccgcggctgggcccttc

SEQ ID NO: 10493 - DNA, 19 bp, Homo sapiens
ggctggacagaggctcttc

SEQ ID NO: 10494 - DNA, 20 bp, Homo sapiens
agggttcgtgcaggcccttc

SEQ ID NO: 10495 - DNA, 18 bp, Homo sapiens
ggcacggctgggcccttc

SEQ ID NO: 10496 - DNA, 19 bp, Homo sapiens
ggcaccgcccaagcttttc

SEQ ID NO: 10497 - DNA, 22 bp, Homo sapiens
taaagcaccaacagggctcttc

SEQ ID NO: 10498 - DNA, 27 bp, Homo sapiens
aggcaccgtggccgctttcgaagggcc

SEQ ID NO: 10499 - DNA, 19 bp, Homo sapiens
taaggtgttcacagccctt

SEQ ID NO: 10500 - DNA, 24 bp, Homo sapiens
taagacactgcctggcagctcttc

SEQ ID NO: 10501 - DNA, 22 bp, Homo sapiens
taaggcacagtggctgggtcct

SEQ ID NO: 10502 - DNA, 21 bp, Homo sapiens
aaggatagggctgggcccttc

SEQ ID NO: 10503 - DNA, 23 bp, Homo sapiens
ggggtgctgaggcttggtccttc

SEQ ID NO: 10504 - DNA, 18 bp, Homo sapiens
tgagcaccctgggtcctt

SEQ ID NO: 10505 - DNA, 19 bp, Homo sapiens
taaggcacgtgcggctgga

SEQ ID NO: 10506 - DNA, 24 bp, Homo sapiens
aggggtgctggacctgggctcttc

SEQ ID NO: 10507 - DNA, 18 bp, Homo sapiens
tgagcaggctgggccctt

SEQ ID NO: 10508 - DNA, 23 bp, Homo sapiens
ggggcacggctggatggcccttc

SEQ ID NO: 10509 - DNA, 18 bp, Homo sapiens
aaggtgccgtgggccctt

SEQ ID NO: 10510 - DNA, 19 bp, Homo sapiens
tgagcactgcggctggtcc

SEQ ID NO: 10511 - DNA, 20 bp, Homo sapiens
aggcttgtaggcagcccttc

SEQ ID NO: 10512 - DNA, 18 bp, Homo sapiens
aggtgcagctgggtcctt

SEQ ID NO: 10513 - DNA, 30 bp, Homo sapiens
tgagccgccgcggctcctcgtggcctttcg

SEQ ID NO: 10514 - DNA, 18 bp, Homo sapiens
aggtgaggctgggccctt

SEQ ID NO: 10515 - DNA, 18 bp, Homo sapiens
aggcatcctgggctcttc

SEQ ID NO: 10516 - DNA, 17 bp, Homo sapiens
ggtcaccagggcccttc

SEQ ID NO: 10517 - DNA, 19 bp, Homo sapiens
ggctggacacaggcccttc

SEQ ID NO: 10518 - DNA, 18 bp, Homo sapiens
taaggcacggcgtccctt

SEQ ID NO: 10519 - DNA, 22 bp, Homo sapiens
taaggcactggtaacatccttc

SEQ ID NO: 10520 - DNA, 18 bp, Homo sapiens
agacaccgtggctgcctt

SEQ ID NO: 10521 - DNA, 20 bp, Homo sapiens
agggccgtgctgggcccttc

SEQ ID NO: 10522 - DNA, 93 bp, Bovine herpesvirus 1
ccgagtgagctccgcccacccagcccccacccccgtctgcccgcccccgggcccgagatgagggtgggggctgggtgggcggagctcacttgg

SEQ ID NO: 10523 - DNA, 24 bp, Bovine herpesvirus 1
cgagatgagggtgggggctgggtg

SEQ ID NO: 10524 - DNA, 21 bp, Homo sapiens
gaggtgggggtgagggggaca

SEQ ID NO: 10525 - DNA, 23 bp, Homo sapiens
gaggcagggtgggggttgggtgc

SEQ ID NO: 10526 - DNA, 20 bp, Homo sapiens
gagggggtgggctggcagtg

SEQ ID NO: 10527 - DNA, 22 bp, Homo sapiens
tgggggtgggggtggaggggtg

SEQ ID NO: 10528 - DNA, 18 bp, Homo sapiens
gaggtgggagtggaggtg

SEQ ID NO: 10529 - DNA, 19 bp, Homo sapiens
gagggggtgggggagagtg

SEQ ID NO: 10530 - DNA, 18 bp, Homo sapiens
gagctgggggtgggggtg

SEQ ID NO: 10531 - DNA, 28 bp, Homo sapiens
cgggctgagggtgggggccacttgggtg

SEQ ID NO: 10532 - DNA, 20 bp, Homo sapiens
agatgggggtgctgggggtg

SEQ ID NO: 10533 - DNA, 23 bp, Homo sapiens
gaggggaggactgaggctgggtg

SEQ ID NO: 10534 - DNA, 18 bp, Homo sapiens
tgggggttggggctgggt

SEQ ID NO: 10535 - DNA, 19 bp, Homo sapiens
cgaggtgaaggtggggatg

SEQ ID NO: 10536 - DNA, 22 bp, Homo sapiens
gaggtagggtggggagaaggtg

SEQ ID NO: 10537 - DNA, 18 bp, Homo sapiens
tggggtgggggtgggggt

SEQ ID NO: 10538 - DNA, 20 bp, Homo sapiens
gagtatgggagggctgggtg

SEQ ID NO: 10539 - DNA, 18 bp, Homo sapiens
tggggtggggtggggatg

SEQ ID NO: 10540 - DNA, 23 bp, Homo sapiens
gagggagggggaagggctgggtg

SEQ ID NO: 10541 - DNA, 25 bp, Homo sapiens
gaggggagggtgggggcatggggtg

SEQ ID NO: 10542 - DNA, 18 bp, Homo sapiens
tgggggtgggagggggtg

SEQ ID NO: 10543 - DNA, 21 bp, Homo sapiens
tgggggtggggggattgggtg

SEQ ID NO: 10544 - DNA, 18 bp, Homo sapiens
cgggggtggggggcggtg

SEQ ID NO: 10545 - DNA, 19 bp, Homo sapiens
gattggggtggggattctg

SEQ ID NO: 10546 - DNA, 22 bp, Homo sapiens
cgaggtgagggaggtgatggtg

SEQ ID NO: 10547 - DNA, 17 bp, Homo sapiens
gattggggtgggggtag

SEQ ID NO: 10548 - DNA, 20 bp, Homo sapiens
gatgtgggcttggctgggtg

SEQ ID NO: 10549 - DNA, 18 bp, Homo sapiens
tgggatgggggtgtgggt

SEQ ID NO: 10550 - DNA, 23 bp, Homo sapiens
gagatggggttggggggacagtg

SEQ ID NO: 10551 - DNA, 18 bp, Homo sapiens
gagggggtggggaaggtg

SEQ ID NO: 10552 - DNA, 17 bp, Homo sapiens
tggggtgggggcgggtg

SEQ ID NO: 10553 - DNA, 20 bp, Homo sapiens
gagggtggtaaagttgggtg

SEQ ID NO: 10554 - DNA, 21 bp, Homo sapiens
gaggtgggggtggagggccag

SEQ ID NO: 10555 - DNA, 18 bp, Homo sapiens
tgggggtgggggtggggt

SEQ ID NO: 10556 - DNA, 22 bp, Homo sapiens
aggtgaggggcagggctgggtg

SEQ ID NO: 10557 - DNA, 19 bp, Homo sapiens
tggggtgggggtggtgagt

SEQ ID NO: 10558 - DNA, 22 bp, Homo sapiens
aggtgagggtggggaggacctg

SEQ ID NO: 10559 - DNA, 18 bp, Homo sapiens
gaggtgagtgtggaggtg

SEQ ID NO: 10560 - DNA, 22 bp, Homo sapiens
tggaggtgggtttggctgggtg

SEQ ID NO: 10561 - DNA, 19 bp, Homo sapiens
ggggtgggggtggcgggta

SEQ ID NO: 10562 - DNA, 18 bp, Homo sapiens
aggatgtgggggctgggt

SEQ ID NO: 10563 - DNA, 18 bp, Homo sapiens
tgagggtgcggaggtctg

SEQ ID NO: 10564 - DNA, 22 bp, Homo sapiens
ccagatgagatctggctgggtg

SEQ ID NO: 10565 - DNA, 19 bp, Homo sapiens
gatgaggagtggagaggtg

SEQ ID NO: 10566 - DNA, 19 bp, Homo sapiens
tgaggggtgaagctgggtg

SEQ ID NO: 10567 - DNA, 20 bp, Homo sapiens
gatgatgggggtggtgggtg

SEQ ID NO: 10568 - DNA, 19 bp, Homo sapiens
tgggggtgggggtgagggt

SEQ ID NO: 10569 - DNA, 17 bp, Homo sapiens
gagtgagggtggttggt

SEQ ID NO: 10570 - DNA, 19 bp, Homo sapiens
tggggtggggggacagggt

SEQ ID NO: 10571 - DNA, 18 bp, Homo sapiens
tgggagtgggggtggggt

SEQ ID NO: 10572 - DNA, 17 bp, Homo sapiens
tggggtgggggtggggt

SEQ ID NO: 10573 - DNA, 22 bp, Homo sapiens
gagatgggggtggggggaggtg

SEQ ID NO: 10574 - DNA, 19 bp, Homo sapiens
gagggggtggcaaaaggtg

SEQ ID NO: 10575 - DNA, 16 bp, Homo sapiens
tggggtgggggtgggt

SEQ ID NO: 10576 - DNA, 18 bp, Homo sapiens
gagatgggggtggtgggc

SEQ ID NO: 10577 - DNA, 19 bp, Homo sapiens
cgggatgggggcgggggcc

SEQ ID NO: 10578 - DNA, 19 bp, Homo sapiens
aggtaatgggggctgggtg

SEQ ID NO: 10579 - DNA, 18 bp, Homo sapiens
tgggatggaggtgagggt

SEQ ID NO: 10580 - DNA, 18 bp, Homo sapiens
tgagggtggggggaactg

SEQ ID NO: 10581 - DNA, 19 bp, Homo sapiens
tgggggtgggggacgggtg

SEQ ID NO: 10582 - DNA, 19 bp, Homo sapiens
tgaggtaggaatgctgggt

SEQ ID NO: 10583 - DNA, 17 bp, Homo sapiens
tgaggttggagtgggtg

SEQ ID NO: 10584 - DNA, 18 bp, Homo sapiens
agggtgtcggggctgggt

SEQ ID NO: 10585 - DNA, 21 bp, Homo sapiens
cggggtgagggtgggggaccg

SEQ ID NO: 10586 - DNA, 19 bp, Homo sapiens
tggggtggggtggacaggt

SEQ ID NO: 10587 - DNA, 16 bp, Homo sapiens
gagagggtggcctggg

SEQ ID NO: 10588 - DNA, 18 bp, Homo sapiens
gaaggtgggggtggggta

SEQ ID NO: 10589 - DNA, 20 bp, Homo sapiens
gggtgaggggaacctgggtg

SEQ ID NO: 10590 - DNA, 22 bp, Homo sapiens
gaggtgagggtagggagcactg

SEQ ID NO: 10591 - DNA, 22 bp, Homo sapiens
gaggtgggggtggggcagactg

SEQ ID NO: 10592 - DNA, 19 bp, Homo sapiens
tgggggtgggggtgggggt

SEQ ID NO: 10593 - DNA, 21 bp, Homo sapiens
tgcggacatgggggctgggtg

SEQ ID NO: 10594 - DNA, 18 bp, Homo sapiens
gaggtggggggggggggt

SEQ ID NO: 10595 - DNA, 19 bp, Homo sapiens
tggaggtgggggtatgggt

SEQ ID NO: 10596 - DNA, 20 bp, Homo sapiens
gagtgggatgtggttgggtg

SEQ ID NO: 10597 - DNA, 22 bp, Homo sapiens
gatgagggtttcgcactgggtg

SEQ ID NO: 10598 - DNA, 18 bp, Homo sapiens
gagggagggtgggaaccg

SEQ ID NO: 10599 - DNA, 21 bp, Homo sapiens
cgagatgatggtgtctgggtg

SEQ ID NO: 10600 - DNA, 17 bp, Homo sapiens
tggggtggggcggggtg

SEQ ID NO: 10601 - DNA, 18 bp, Homo sapiens
cgacggcggggctgggtg

SEQ ID NO: 10602 - DNA, 17 bp, Homo sapiens
tggggtgggggttgggc

SEQ ID NO: 10603 - DNA, 22 bp, Homo sapiens
tggaggtgggagaggttgggtg

SEQ ID NO: 10604 - DNA, 25 bp, Homo sapiens
gaggtgagggtgaatggactgggtg

SEQ ID NO: 10605 - DNA, 20 bp, Homo sapiens
agggtgggggtggaggggtg

SEQ ID NO: 10606 - DNA, 22 bp, Homo sapiens
caaggtgggggtggagggggtg

SEQ ID NO: 10607 - DNA, 19 bp, Homo sapiens
tggggagggggctctgggt

SEQ ID NO: 10608 - DNA, 19 bp, Homo sapiens
gagttgggggtggagggtg

SEQ ID NO: 10609 - DNA, 20 bp, Homo sapiens
tgagggcctcctgctgggtg

SEQ ID NO: 10610 - DNA, 23 bp, Homo sapiens
gatgggggtgggggaagagggtg

SEQ ID NO: 10611 - DNA, 22 bp, Homo sapiens
gagatggggtggggatgaggtg

SEQ ID NO: 10612 - DNA, 18 bp, Homo sapiens
agggtgagggtgggggtg

SEQ ID NO: 10613 - DNA, 16 bp, Homo sapiens
tggggtggaggtgggc

SEQ ID NO: 10614 - DNA, 21 bp, Homo sapiens
tggggtgaggtggcactggtg

SEQ ID NO: 10615 - DNA, 18 bp, Homo sapiens
gagatggggggcttgggt

SEQ ID NO: 10616 - DNA, 22 bp, Homo sapiens
cgagctgggggtggggaagctg

SEQ ID NO: 10617 - DNA, 22 bp, Homo sapiens
gatggtgagggtggcgtgggtg

SEQ ID NO: 10618 - DNA, 19 bp, Homo sapiens
gaggtgggggtgaagatgg

SEQ ID NO: 10619 - DNA, 20 bp, Homo sapiens
gagagggacacagctgggtg

SEQ ID NO: 10620 - DNA, 21 bp, Homo sapiens
gatgagggcataatctgggtg

SEQ ID NO: 10621 - DNA, 20 bp, Homo sapiens
cgggatgggggtgggggatg

SEQ ID NO: 10622 - DNA, 18 bp, Homo sapiens
tggggtgacgggctgggt

SEQ ID NO: 10623 - DNA, 77 bp, Bovine herpesvirus 1
gggggaaaggggaaggaggggaggctagaagcagcgggcgggcccgtcgtccgccgcccatccgcctagcggctgcc

SEQ ID NO: 10624 - DNA, 24 bp, Bovine herpesvirus 1
ccgccgcccatccgcctagcggct

SEQ ID NO: 10625 - DNA, 27 bp, Homo sapiens
ccgccgcccgctcggttagccgctagg

SEQ ID NO: 10626 - DNA, 18 bp, Homo sapiens
ccgccgcccgctgcctgc

SEQ ID NO: 10627 - DNA, 24 bp, Homo sapiens
ccgccgccttttctagccccggct

SEQ ID NO: 10628 - DNA, 18 bp, Homo sapiens
gccgcctgcccgcccagc

SEQ ID NO: 10629 - DNA, 26 bp, Homo sapiens
ccgccgcccgtcccccgggccgggct

SEQ ID NO: 10630 - DNA, 18 bp, Homo sapiens
ccctcccgcctagcggct

SEQ ID NO: 10631 - DNA, 18 bp, Homo sapiens
ccgccgccttccgcaggc

SEQ ID NO: 10632 - DNA, 18 bp, Homo sapiens
ccgccgccctccgtctgc

SEQ ID NO: 10633 - DNA, 20 bp, Homo sapiens
cgccgcccaccaaaccggct

SEQ ID NO: 10634 - DNA, 19 bp, Homo sapiens
ccgccgccagtccgcccgc

SEQ ID NO: 10635 - DNA, 23 bp, Homo sapiens
cgccgcccacttgcttccgcgct

SEQ ID NO: 10636 - DNA, 20 bp, Homo sapiens
ccttgcccattttagcggct

SEQ ID NO: 10637 - DNA, 19 bp, Homo sapiens
ccgccgcccggcccgcggc

SEQ ID NO: 10638 - DNA, 24 bp, Homo sapiens
ccgccgcctagtcctcggcagcgg

SEQ ID NO: 10639 - DNA, 20 bp, Homo sapiens
ccgctcgtcggccagcggct

SEQ ID NO: 10640 - DNA, 18 bp, Homo sapiens
ccgccgcccgctctcggc

SEQ ID NO: 10641 - DNA, 21 bp, Homo sapiens
gccacccatttgccatatact

SEQ ID NO: 10642 - DNA, 20 bp, Homo sapiens
gctgcccgctctgcgccgct

SEQ ID NO: 10643 - DNA, 19 bp, Homo sapiens
ccgccgcctgcctgctgcc

SEQ ID NO: 10644 - DNA, 17 bp, Homo sapiens
gctcatccgccctggct

SEQ ID NO: 10645 - DNA, 28 bp, Homo sapiens
ccgccgcccggccgttttagccgctagg

SEQ ID NO: 10646 - DNA, 17 bp, Homo sapiens
ccgccgcccgtcccagc

SEQ ID NO: 10647 - DNA, 19 bp, Homo sapiens
ccgccgcccgctccgcggc

SEQ ID NO: 10648 - DNA, 17 bp, Homo sapiens
cgccgtctgccgcagcc

SEQ ID NO: 10649 - DNA, 18 bp, Homo sapiens
ccgccgcccggctgcggc

SEQ ID NO: 10650 - DNA, 19 bp, Homo sapiens
gccgtccatttgccaggct

SEQ ID NO: 10651 - DNA, 19 bp, Homo sapiens
cgccgcccgcccgtcgcgg

SEQ ID NO: 10652 - DNA, 19 bp, Homo sapiens
ccgccgccatccaaatggc

SEQ ID NO: 10653 - DNA, 21 bp, Homo sapiens
ccgccgcccgccgccaccact

SEQ ID NO: 10654 - DNA, 19 bp, Homo sapiens
ccgccgcccgccccgcggc

SEQ ID NO: 10655 - DNA, 19 bp, Homo sapiens
ccgccgacccgtcagcggc

SEQ ID NO: 10656 - DNA, 19 bp, Homo sapiens
ccgccgccttctgcagcgc

SEQ ID NO: 10657 - DNA, 22 bp, Homo sapiens
cgccgcccgcccgcccgcggct

SEQ ID NO: 10658 - DNA, 21 bp, Homo sapiens
ccgccgccccttcgcctccgc

SEQ ID NO: 10659 - DNA, 19 bp, Homo sapiens
ccgccgcctctcccgcggc

SEQ ID NO: 10660 - DNA, 17 bp, Homo sapiens
ccgccgccctctgctgc

SEQ ID NO: 10661 - DNA, 16 bp, Homo sapiens
ccgcccccatccacgg

SEQ ID NO: 10662 - DNA, 19 bp, Homo sapiens
ccgccgcgcgtccgccggc

SEQ ID NO: 10663 - DNA, 20 bp, Homo sapiens
ccgccgctcctctgccgcct

SEQ ID NO: 10664 - DNA, 19 bp, Homo sapiens
cgctgcccgtccgccacca

SEQ ID NO: 10665 - DNA, 19 bp, Homo sapiens
ccgccctccatccgcctgc

SEQ ID NO: 10666 - DNA, 27 bp, Homo sapiens
ccgccgcccgctgtcctagccgctagg

SEQ ID NO: 10667 - DNA, 19 bp, Homo sapiens
cgccgcccgtccgcctcgc

SEQ ID NO: 10668 - DNA, 19 bp, Homo sapiens
ccgccgccatcttgccggc

SEQ ID NO: 10669 - DNA, 23 bp, Homo sapiens
ccgccgcccgcccggagcaggct

SEQ ID NO: 10670 - DNA, 23 bp, Homo sapiens
ccgccgccgtctgcgtcccggct

SEQ ID NO: 10671 - DNA, 21 bp, Homo sapiens
ccgccgcctgtgccgcgggct

SEQ ID NO: 10672 - DNA, 17 bp, Homo sapiens
gctgccatccgcccaac

SEQ ID NO: 10673 - DNA, 23 bp, Homo sapiens
ccgccgcccgtgcacaggcggct

SEQ ID NO: 10674 - DNA, 18 bp, Homo sapiens
ccgccgcctgctccgccc

SEQ ID NO: 10675 - DNA, 22 bp, Homo sapiens
ccgccgcccgtgcgccgcacct

SEQ ID NO: 10676 - DNA, 23 bp, Homo sapiens
ccatttagcactgcctagcggct

SEQ ID NO: 10677 - DNA, 18 bp, Homo sapiens
ccgccctcgtcccacggc

SEQ ID NO: 10678 - DNA, 21 bp, Homo sapiens
cgcggcccgtttcccgcggct

SEQ ID NO: 10679 - DNA, 26 bp, Homo sapiens
cgccgcccgtcgttctagccgctagg

SEQ ID NO: 10680 - DNA, 21 bp, Homo sapiens
ccgccgccccatctgttgccc

SEQ ID NO: 10681 - DNA, 23 bp, Homo sapiens
ccgccgcctaccgcttgggaact

SEQ ID NO: 10682 - DNA, 19 bp, Homo sapiens
ccccgcccaccctggtggc

SEQ ID NO: 10683 - DNA, 21 bp, Homo sapiens
ccgccgcccgaccgcccggct

SEQ ID NO: 10684 - DNA, 18 bp, Homo sapiens
ccgcccccatctgcctgc

SEQ ID NO: 10685 - DNA, 84 bp, Bovine herpesvirus 1
ggacaggcccccccgctggcgcaaaaatacaatagctctcgattatccgccattggattttttgcccgcgcgggggcgatgtcc

SEQ ID NO: 10686 - DNA, 24 bp, Bovine herpesvirus 1
cattggattttttgcccgcgcggg

SEQ ID NO: 10687 - DNA, 24 bp, Homo sapiens
ttggatttttttttttcccgcggg

SEQ ID NO: 10688 - DNA, 24 bp, Homo sapiens
cagtgggctgcttgcccgtgtggg

SEQ ID NO: 10689 - DNA, 19 bp, Homo sapiens
tgggcggcgcccgcgcggg

SEQ ID NO: 10690 - DNA, 23 bp, Homo sapiens
cattggaatttttgttccctagg

SEQ ID NO: 10691 - DNA, 71 bp, Bovine herpesvirus 1
gccgcagccccagctgcccccccggcgcgcgcgatagcgaggttgctcgggggggcgctgttgccgccggc

SEQ ID NO: 10692 - DNA, 24 bp, Bovine herpesvirus 1
cagctgcccccccggcgcgcgcga

SEQ ID NO: 10693 - DNA, 21 bp, Homo sapiens
gcttcctccctgggcgcacga

SEQ ID NO: 10694 - DNA, 18 bp, Homo sapiens
cagctgccttccggcccg

SEQ ID NO: 10695 - DNA, 21 bp, Homo sapiens
cagctgctcaccacgcgcgcg

SEQ ID NO: 10696 - DNA, 20 bp, Homo sapiens
cagcgtctcccaggcgcgcg

SEQ ID NO: 10697 - DNA, 24 bp, Homo sapiens
cagccgcctctcgaccgccgcgcg

SEQ ID NO: 10698 - DNA, 21 bp, Homo sapiens
cagctgcgctcagggcgcgcg

SEQ ID NO: 10699 - DNA, 20 bp, Homo sapiens
gctgcccctgcgcgcccgcg

SEQ ID NO: 10700 - DNA, 19 bp, Homo sapiens
agctgccctccctgtggcg

SEQ ID NO: 10701 - DNA, 22 bp, Homo sapiens
agccaaggtcccggcgcgcgcg

SEQ ID NO: 10702 - DNA, 22 bp, Homo sapiens
gctgccccttcgccccggcgcg

SEQ ID NO: 10703 - DNA, 18 bp, Homo sapiens
cagtcgctccccagcgcg

SEQ ID NO: 10704 - DNA, 18 bp, Homo sapiens
gctgccccaccccgcgcg

SEQ ID NO: 10705 - DNA, 20 bp, Homo sapiens
tgactgcgagggcgcgcgcg

SEQ ID NO: 10706 - DNA, 20 bp, Homo sapiens
cagtgtctcctccacgcgcg

SEQ ID NO: 10707 - DNA, 21 bp, Homo sapiens
cagctgccgcctccggccacg

SEQ ID NO: 10708 - DNA, 26 bp, Homo sapiens
actgccttccccgtggtcgcgcgcgc

SEQ ID NO: 10709 - DNA, 17 bp, Homo sapiens
gctgctccgcgcgcgcg

SEQ ID NO: 10710 - DNA, 18 bp, Homo sapiens
gctgccccccatggtgcg

SEQ ID NO: 10711 - DNA, 18 bp, Homo sapiens
cagctgccccccggcccg

SEQ ID NO: 10712 - DNA, 18 bp, Homo sapiens
cagctgccccccgaaacg

SEQ ID NO: 10713 - DNA, 21 bp, Homo sapiens
cagctgccttccctgtgcccg

SEQ ID NO: 10714 - DNA, 25 bp, Homo sapiens
cagccgccctcccggcaccgcagcg

SEQ ID NO: 10715 - DNA, 17 bp, Homo sapiens
tgtccccccagcagcca

SEQ ID NO: 10716 - DNA, 19 bp, Homo sapiens
cagctgcctccctgcttca

SEQ ID NO: 10717 - DNA, 28 bp, Homo sapiens
cagctgcccttctgccgatcgcgcgcgc

SEQ ID NO: 10718 - DNA, 18 bp, Homo sapiens
cagctgccgccccggccg

SEQ ID NO: 10719 - DNA, 23 bp, Homo sapiens
cagcagccttcccggcgctggcg

SEQ ID NO: 10720 - DNA, 20 bp, Homo sapiens
gctcctcccgctcgcgcgcg

SEQ ID NO: 10721 - DNA, 19 bp, Homo sapiens
cagcagctcccggcgcgcg

SEQ ID NO: 10722 - DNA, 19 bp, Homo sapiens
cagctgcctccccagtacg

SEQ ID NO: 10723 - DNA, 19 bp, Homo sapiens
agctgccccctcagctgcg

SEQ ID NO: 10724 - DNA, 19 bp, Homo sapiens
cagcggccgggcgcgcgcg

SEQ ID NO: 10725 - DNA, 20 bp, Homo sapiens
gcgcctcggggtgcgcgcga

SEQ ID NO: 10726 - DNA, 21 bp, Homo sapiens
gccgccccctccccgctgcga

SEQ ID NO: 10727 - DNA, 19 bp, Homo sapiens
cagctgcctcctggtagcg

SEQ ID NO: 10728 - DNA, 25 bp, Homo sapiens
cagctgcctccctggtgatcgcgcc

SEQ ID NO: 10729 - DNA, 21 bp, Homo sapiens
cagctgccacctcggaggacg

SEQ ID NO: 10730 - DNA, 21 bp, Homo sapiens
gctgccggaccggcgcgcgcg

SEQ ID NO: 10731 - DNA, 28 bp, Homo sapiens
cagctgccttccacgtgatcgcgcgcgc

SEQ ID NO: 10732 - DNA, 19 bp, Homo sapiens
gctgcccccgtggctgccg

SEQ ID NO: 10733 - DNA, 18 bp, Homo sapiens
gctgtccggcggcgcgcg

SEQ ID NO: 10734 - DNA, 19 bp, Homo sapiens
cagctgcctcccggggacg

SEQ ID NO: 10735 - DNA, 18 bp, Homo sapiens
cagcttctccagcgcgcg

SEQ ID NO: 10736 - DNA, 21 bp, Homo sapiens
cagctgcctcctgggctccga

SEQ ID NO: 10737 - DNA, 20 bp, Homo sapiens
cagctgcctgcttgcacgcg

SEQ ID NO: 10738 - DNA, 18 bp, Homo sapiens
cagctcctttggcgcgca

SEQ ID NO: 10739 - DNA, 26 bp, Homo sapiens
cagccgccttctctttggtgtgcgcg

SEQ ID NO: 10740 - DNA, 20 bp, Homo sapiens
cagctgcctcccgtacagcg

SEQ ID NO: 10741 - DNA, 19 bp, Homo sapiens
cagctgggcccggcgcgcg

SEQ ID NO: 10742 - DNA, 21 bp, Homo sapiens
cagctgcccatccggcgccgc

SEQ ID NO: 10743 - DNA, 17 bp, Homo sapiens
gctgcccgccgcgcgcg

SEQ ID NO: 10744 - DNA, 29 bp, Homo sapiens
cagctgccccccaggagtgatcgcgcgcg

SEQ ID NO: 10745 - DNA, 21 bp, Homo sapiens
cagctgccccttggcagctga

SEQ ID NO: 10746 - DNA, 15 bp, Homo sapiens
gctgcggcgcgcgcg

SEQ ID NO: 10747 - DNA, 19 bp, Homo sapiens
cagtggccccctcgggcgc

SEQ ID NO: 10748 - DNA, 21 bp, Homo sapiens
caggtgctcccgccgcgcgcg

SEQ ID NO: 10749 - DNA, 22 bp, Homo sapiens
cagcggccggccggcgcgcgcg

SEQ ID NO: 10750 - DNA, 18 bp, Homo sapiens
cagccgtcctcacgcgcg

SEQ ID NO: 10751 - DNA, 23 bp, Homo sapiens
cagtggctccagacagcgcgcga

SEQ ID NO: 10752 - DNA, 19 bp, Homo sapiens
gctgctcctccgacacgcg

SEQ ID NO: 10753 - DNA, 28 bp, Homo sapiens
cagctgcccacccgggtgatcgcgcgcg

SEQ ID NO: 10754 - DNA, 21 bp, Homo sapiens
acttgccccggcaggcgcgcg

SEQ ID NO: 10755 - DNA, 20 bp, Homo sapiens
cagctgccatctcgggcacg

SEQ ID NO: 10756 - DNA, 21 bp, Homo sapiens
cagctgcccccatggtccacg

SEQ ID NO: 10757 - DNA, 18 bp, Homo sapiens
gcggccttggcgcgcgcg

SEQ ID NO: 10758 - DNA, 23 bp, Homo sapiens
cagctcttccggcgcgtgcgcga

SEQ ID NO: 10759 - DNA, 19 bp, Homo sapiens
cagtgtcccccccaacgcg

SEQ ID NO: 10760 - DNA, 63 bp, Bovine herpesvirus 4
ccataaagaccattacctcggggctccagtttggtgtggatgccttagagagggggttagtgg

SEQ ID NO: 10761 - DNA, 23 bp, Bovine herpesvirus 4
tgccttagagagggggttagtgg

SEQ ID NO: 10762 - DNA, 18 bp, Homo sapiens
cttggaggggctatgtgg

SEQ ID NO: 10763 - DNA, 18 bp, Homo sapiens
tgcctggaggggggccag

SEQ ID NO: 10764 - DNA, 19 bp, Homo sapiens
tgctttgaagagggggtag

SEQ ID NO: 10765 - DNA, 19 bp, Homo sapiens
tgccattaggggccagtgg

SEQ ID NO: 10766 - DNA, 18 bp, Homo sapiens
ccttggagagaagagtgg

SEQ ID NO: 10767 - DNA, 20 bp, Homo sapiens
tgctgtagagaggccagtgg

SEQ ID NO: 10768 - DNA, 20 bp, Homo sapiens
tgccttagggggaggggctt

SEQ ID NO: 10769 - DNA, 20 bp, Homo sapiens
tgccttgagagggagaatgg

SEQ ID NO: 10770 - DNA, 20 bp, Homo sapiens
tgtcttggagagggagcaag

SEQ ID NO: 10771 - DNA, 21 bp, Homo sapiens
cctttggggagggggctgtgg

SEQ ID NO: 10772 - DNA, 23 bp, Homo sapiens
tgcccttggagggacagaggtgg

SEQ ID NO: 10773 - DNA, 18 bp, Homo sapiens
tgtcttggaggagggggc

SEQ ID NO: 10774 - DNA, 21 bp, Homo sapiens
tgctttggaaaggggaagtgg

SEQ ID NO: 10775 - DNA, 20 bp, Homo sapiens
ttagagaggtggaatagtgg

SEQ ID NO: 10776 - DNA, 20 bp, Homo sapiens
taccttggagaggaatgtgg

SEQ ID NO: 10777 - DNA, 18 bp, Homo sapiens
tgtcttaaagggggtttg

SEQ ID NO: 10778 - DNA, 22 bp, Homo sapiens
tgtcttagaaggggcacccagg

SEQ ID NO: 10779 - DNA, 22 bp, Homo sapiens
tgcctgggagagggggaccttg

SEQ ID NO: 10780 - DNA, 19 bp, Homo sapiens
ccttagagggggcccttgg

SEQ ID NO: 10781 - DNA, 19 bp, Homo sapiens
gccttggaggggagggtgg

SEQ ID NO: 10782 - DNA, 21 bp, Homo sapiens
tgctttaggaggctgaggtgg

SEQ ID NO: 10783 - DNA, 21 bp, Homo sapiens
ctaggggaggggtcaacctgg

SEQ ID NO: 10784 - DNA, 18 bp, Homo sapiens
tgccttaggaggaaggtg

SEQ ID NO: 10785 - DNA, 25 bp, Homo sapiens
tgtcttggagaggaggtaaaagtgg

SEQ ID NO: 10786 - DNA, 22 bp, Homo sapiens
tgctgtggagaggatggagtgg

SEQ ID NO: 10787 - DNA, 19 bp, Homo sapiens
gccttggagggggcactgg

SEQ ID NO: 10788 - DNA, 18 bp, Homo sapiens
ttagaaggtttgctgtgg

SEQ ID NO: 10789 - DNA, 64 bp, Bovine herpesvirus 4
tggattatttctcccaacaccccagtattcaacaacatcagtgataaggggtgtggagtctcca

SEQ ID NO: 10790 - DNA, 24 bp, Bovine herpesvirus 4
tatttctcccaacaccccagtatt

SEQ ID NO: 10791 - DNA, 22 bp, Homo sapiens
tatttcttttggtgccagtatt

SEQ ID NO: 10792 - DNA, 17 bp, Homo sapiens
tatttctccccagtact

SEQ ID NO: 10793 - DNA, 19 bp, Homo sapiens
tttctcttggcaccccaat

SEQ ID NO: 10794 - DNA, 19 bp, Homo sapiens
atttctcctaacactaagt

SEQ ID NO: 10795 - DNA, 21 bp, Homo sapiens
tttctaccaatacctacctgt

SEQ ID NO: 10796 - DNA, 19 bp, Homo sapiens
cttctcccaaacaggtatt

SEQ ID NO: 10797 - DNA, 20 bp, Homo sapiens
tttctcccaaaagtgccagt

SEQ ID NO: 10798 - DNA, 18 bp, Homo sapiens
tatttccccaacacccca

SEQ ID NO: 10799 - DNA, 21 bp, Homo sapiens
tatctctctcagcatctcagc

SEQ ID NO: 10800 - DNA, 19 bp, Homo sapiens
tatttctctcaatataccc

SEQ ID NO: 10801 - DNA, 20 bp, Homo sapiens
tacttctcccagcatccaca

SEQ ID NO: 10802 - DNA, 61 bp, Chimpanzee cytomegalovirus
ccacccagagccacatgaggatcccgtcgcgggaacggacccacatggcggcggagggtgg

SEQ ID NO: 10803 - DNA, 24 bp, Chimpanzee cytomegalovirus
acggacccacatggcggcggaggg

SEQ ID NO: 10804 - DNA, 21 bp, Homo sapiens
cgggccgggggtggcggaggg

SEQ ID NO: 10805 - DNA, 24 bp, Homo sapiens
acggggctgcatggcggctccaag

SEQ ID NO: 10806 - DNA, 18 bp, Homo sapiens
cggcccgtgtccgggggg

SEQ ID NO: 10807 - DNA, 19 bp, Homo sapiens
acggagccggaggcggagg

SEQ ID NO: 10808 - DNA, 19 bp, Homo sapiens
acgtgcccgttagcggagg

SEQ ID NO: 10809 - DNA, 25 bp, Homo sapiens
acggcgtccacatgggccatgaggg

SEQ ID NO: 10810 - DNA, 19 bp, Homo sapiens
cgggctggcgtgcagagag

SEQ ID NO: 10811 - DNA, 23 bp, Homo sapiens
cggcctcgcgcgctcgcggaggg

SEQ ID NO: 10812 - DNA, 16 bp, Homo sapiens
cgggcccaggcggagg

SEQ ID NO: 10813 - DNA, 18 bp, Homo sapiens
cgcccggctggcggaggg

SEQ ID NO: 10814 - DNA, 18 bp, Homo sapiens
ggacccacaggtccaggg

SEQ ID NO: 10815 - DNA, 23 bp, Homo sapiens
cgggccggcgggcgggcggaggg

SEQ ID NO: 10816 - DNA, 17 bp, Homo sapiens
cggctccggggcggagg

SEQ ID NO: 10817 - DNA, 21 bp, Homo sapiens
cggccggggggcggcggaggg

SEQ ID NO: 10818 - DNA, 20 bp, Homo sapiens
cggacttggctggcggaggg

SEQ ID NO: 10819 - DNA, 19 bp, Homo sapiens
cggcccgcaggtcgggggg

SEQ ID NO: 10820 - DNA, 21 bp, Homo sapiens
actgacccacatgggcgaggg

SEQ ID NO: 10821 - DNA, 22 bp, Homo sapiens
cgggcccaacggacggcggggg

SEQ ID NO: 10822 - DNA, 22 bp, Homo sapiens
ggacatgcgtactagcggaggg

SEQ ID NO: 10823 - DNA, 21 bp, Homo sapiens
ggcccacgggtgggcggaggg

SEQ ID NO: 10824 - DNA, 20 bp, Homo sapiens
cgagcctggggcggcggggg

SEQ ID NO: 10825 - DNA, 16 bp, Homo sapiens
gaccccatggcggagg

SEQ ID NO: 10826 - DNA, 20 bp, Homo sapiens
ggatccggcggcggcggggg

SEQ ID NO: 10827 - DNA, 23 bp, Homo sapiens
cggctcacgtcccgggcggaggg

SEQ ID NO: 10828 - DNA, 19 bp, Homo sapiens
ggaccatgagggcggaggg

SEQ ID NO: 10829 - DNA, 18 bp, Homo sapiens
ggaccgcagggcggaggg

SEQ ID NO: 10830 - DNA, 18 bp, Homo sapiens
ggacccgaggggcggagg

SEQ ID NO: 10831 - DNA, 21 bp, Homo sapiens
cggatccacaaggcgttcagg

SEQ ID NO: 10832 - DNA, 21 bp, Homo sapiens
cgggtacagcggggcggaggg

SEQ ID NO: 10833 - DNA, 18 bp, Homo sapiens
ggcccgggcggcggaggg

SEQ ID NO: 10834 - DNA, 21 bp, Homo sapiens
ggacccacaggggccaatggg

SEQ ID NO: 10835 - DNA, 19 bp, Homo sapiens
cggcccggccggcggaggg

SEQ ID NO: 10836 - DNA, 22 bp, Homo sapiens
cggcccaagcggcggcggaggg

SEQ ID NO: 10837 - DNA, 23 bp, Homo sapiens
cgggctcagaggcgcgcggaggg

SEQ ID NO: 10838 - DNA, 28 bp, Homo sapiens
acggaccccagaggccggcggcggaggg

SEQ ID NO: 10839 - DNA, 21 bp, Homo sapiens
cggctcccggacggtggaggg

SEQ ID NO: 10840 - DNA, 17 bp, Homo sapiens
acggacccgggcggagg

SEQ ID NO: 10841 - DNA, 20 bp, Homo sapiens
ggccacgtcgtggcggaggg

SEQ ID NO: 10842 - DNA, 21 bp, Homo sapiens
ggactgtcacagagcggaggg

SEQ ID NO: 10843 - DNA, 19 bp, Homo sapiens
gggcccggggggcggaggg

SEQ ID NO: 10844 - DNA, 18 bp, Homo sapiens
gggctcacacggccaggg

SEQ ID NO: 10845 - DNA, 20 bp, Homo sapiens
acgggctcactgggacaggg

SEQ ID NO: 10846 - DNA, 21 bp, Homo sapiens
acggacccagtggggagaggg

SEQ ID NO: 10847 - DNA, 85 bp, Bovine herpesvirus 4
ccatgtcagaggtccagtacccatgatactggcatcactgttaaacagacagttcttgtcaatgggtttgtggcctttgccatgg

SEQ ID NO: 10848 - DNA, 24 bp, Bovine herpesvirus 4
tcaatgggtttgtggcctttgcca

SEQ ID NO: 10849 - DNA, 19 bp, Homo sapiens
tcaatggtttgtggccctt

SEQ ID NO: 10850 - DNA, 18 bp, Homo sapiens
tgggtttgtagctccctg

SEQ ID NO: 10851 - DNA, 16 bp, Homo sapiens
gggcctgtctttgcca

SEQ ID NO: 10852 - DNA, 19 bp, Homo sapiens
tcaattgtaggcttttgcc

SEQ ID NO: 10853 - DNA, 19 bp, Homo sapiens
aattaaattgtggcctttg

SEQ ID NO: 10854 - DNA, 17 bp, Homo sapiens
tcaaagggtagcctttg

SEQ ID NO: 10855 - DNA, 17 bp, Homo sapiens
tgggtttctgtttgcca

SEQ ID NO: 10856 - DNA, 16 bp, Homo sapiens
ataggtcagcctttgc

SEQ ID NO: 10857 - DNA, 19 bp, Homo sapiens
tcaatgggtttggcaactg

SEQ ID NO: 10858 - DNA, 21 bp, Homo sapiens
tcagagggtttgtggagtctg

SEQ ID NO: 10859 - DNA, 15 bp, Homo sapiens
aatgggtttctttgc

SEQ ID NO: 10860 - DNA, 18 bp, Homo sapiens
tcgctgggtttgtttgcc

SEQ ID NO: 10861 - DNA, 15 bp, Homo sapiens
tgggttggcctttgc

SEQ ID NO: 10862 - DNA, 63 bp, Bovine herpesvirus 4
gagaacagatgaggtcgtcgcagaaaatctcctgtataatggaaggggatcatcatctgtctt

SEQ ID NO: 10863 - DNA, 24 bp, Bovine herpesvirus 4
tataatggaaggggatcatcatct

SEQ ID NO: 10864 - DNA, 21 bp, Homo sapiens
atagttgaagaaccatcatct

SEQ ID NO: 10865 - DNA, 19 bp, Homo sapiens
tataatggtgatccatcat

SEQ ID NO: 10866 - DNA, 21 bp, Homo sapiens
tgataggggacccagttatct

SEQ ID NO: 10867 - DNA, 18 bp, Homo sapiens
tgaaatggaatcatcatc

SEQ ID NO: 10868 - DNA, 18 bp, Homo sapiens
taaatggaggggatcgtc

SEQ ID NO: 10869 - DNA, 22 bp, Homo sapiens
taaatggaagggggctggctct

SEQ ID NO: 10870 - DNA, 19 bp, Homo sapiens
taaatggaagaaaatcatc

SEQ ID NO: 10871 - DNA, 20 bp, Homo sapiens
atagtggaaggggatggcac

SEQ ID NO: 10872 - DNA, 18 bp, Homo sapiens
tgtaaaggaaccatcatc

SEQ ID NO: 10873 - DNA, 110 bp, Bovine herpesvirus 4
tatccaatatgttgttgtgaatggcacagatgtatttctggaacagccctgtcagtttttccaagaggcctatccaacaatttgtgccagtcacaggagcatgctggatg

SEQ ID NO: 10874 - DNA, 24 bp, Bovine herpesvirus 4
tccaatatgttgttgtgaatggca

SEQ ID NO: 10875 - DNA, 19 bp, Homo sapiens
tggtgttcagtgagtggca

SEQ ID NO: 10876 - DNA, 22 bp, Homo sapiens
cagtatgttgtatgacttggca

SEQ ID NO: 10877 - DNA, 20 bp, Homo sapiens
caacatgttttaagatggca

SEQ ID NO: 10878 - DNA, 18 bp, Homo sapiens
cccaaccgttgtgaatgg

SEQ ID NO: 10879 - DNA, 20 bp, Homo sapiens
tatgttcccagagaatggca

SEQ ID NO: 10880 - DNA, 21 bp, Homo sapiens
tccgagaatcgctgtggatgg

SEQ ID NO: 10881 - DNA, 80 bp, Bovine herpesvirus 4
atcactcaattccagaccctgcctacgagtataggagcactatcaatccctgggcatcacaggtggggtccttgggtgat

SEQ ID NO: 10882 - DNA, 24 bp, Bovine herpesvirus 4
catcacaggtggggtccttgggtg

SEQ ID NO: 10883 - DNA, 21 bp, Homo sapiens
catccactgtgtccttgggtg

SEQ ID NO: 10884 - DNA, 18 bp, Homo sapiens
ggcagacatccttgggtg

SEQ ID NO: 10885 - DNA, 19 bp, Homo sapiens
tcacaggttggggtccccg

SEQ ID NO: 10886 - DNA, 21 bp, Homo sapiens
tcacaggtgagggtgccggtg

SEQ ID NO: 10887 - DNA, 18 bp, Homo sapiens
atctgggtggggcggggt

SEQ ID NO: 10888 - DNA, 23 bp, Homo sapiens
atcacaggtcgggagaggaggtg

SEQ ID NO: 10889 - DNA, 23 bp, Homo sapiens
tcacaggggcctcttcttgggtg

SEQ ID NO: 10890 - DNA, 15 bp, Homo sapiens
aggtggggcctggtg

SEQ ID NO: 10891 - DNA, 19 bp, Homo sapiens
agtgggatgtggttgggtg

SEQ ID NO: 10892 - DNA, 19 bp, Homo sapiens
acaggtgggagactgggtg

SEQ ID NO: 10893 - DNA, 23 bp, Homo sapiens
cacgcgggtggggtgtgggggtg

SEQ ID NO: 10894 - DNA, 24 bp, Homo sapiens
catcctgggtataagtcttgggtg

SEQ ID NO: 10895 - DNA, 15 bp, Homo sapiens
acaggtggggcaggt

SEQ ID NO: 10896 - DNA, 17 bp, Homo sapiens
tcatggtggggttgagt

SEQ ID NO: 10897 - DNA, 22 bp, Homo sapiens
catctgggggtctccttgggtg

SEQ ID NO: 10898 - DNA, 112 bp, Human herpesvirus 2
ggccgccgcgcgcccccgcccggccgccgcgcgcccccgcccggccgccgcgcgcccccgcccggccgccgcgcgcccccgcccggccgccgcgcgcccccgcccggccgcc

SEQ ID NO: 10899 - DNA, 24 bp, Human herpesvirus 2
ccgccgcgcgcccccgcccggccg

SEQ ID NO: 10900 - DNA, 18 bp, Homo sapiens
ccgccgcccggcccggcc

SEQ ID NO: 10901 - DNA, 27 bp, Homo sapiens
ccgcacgcgcgccccacgcttcggccg

SEQ ID NO: 10902 - DNA, 22 bp, Homo sapiens
ccgccgcagcgctcccagcccg

SEQ ID NO: 10903 - DNA, 20 bp, Homo sapiens
gctgcccgcccacctggccg

SEQ ID NO: 10904 - DNA, 17 bp, Homo sapiens
ccgccgcgcgcaccggc

SEQ ID NO: 10905 - DNA, 17 bp, Homo sapiens
ccaccgcgcgccttggc

SEQ ID NO: 10906 - DNA, 23 bp, Homo sapiens
cctccgcgtgctctcgcctaccg

SEQ ID NO: 10907 - DNA, 22 bp, Homo sapiens
ccggctccgcttcgcctggccg

SEQ ID NO: 10908 - DNA, 23 bp, Homo sapiens
ccgccgcagcgtcacagcggccg

SEQ ID NO: 10909 - DNA, 19 bp, Homo sapiens
gccgcgcgtccagaccggc

SEQ ID NO: 10910 - DNA, 20 bp, Homo sapiens
cgccgcgcgcgcccgggccg

SEQ ID NO: 10911 - DNA, 18 bp, Homo sapiens
ccgccgcgcgtccgcgcc

SEQ ID NO: 10912 - DNA, 22 bp, Homo sapiens
gctgccccccgccgtctggccg

SEQ ID NO: 10913 - DNA, 19 bp, Homo sapiens
ccgcgcgcgtccgggcggc

SEQ ID NO: 10914 - DNA, 19 bp, Homo sapiens
ccgccgccgcccccagtcg

SEQ ID NO: 10915 - DNA, 23 bp, Homo sapiens
ccgccgctgccctcgcccggccg

SEQ ID NO: 10916 - DNA, 19 bp, Homo sapiens
ccgcgcgcccctcgcgtcg

SEQ ID NO: 10917 - DNA, 20 bp, Homo sapiens
ccgccgcgcgcgcccctccg

SEQ ID NO: 10918 - DNA, 16 bp, Homo sapiens
ccgccgccgctccggc

SEQ ID NO: 10919 - DNA, 21 bp, Homo sapiens
ccgccgccgcccccgaagtcg

SEQ ID NO: 10920 - DNA, 24 bp, Homo sapiens
ccgccgcgcgcctccagctcctcc

SEQ ID NO: 10921 - DNA, 23 bp, Homo sapiens
ccgccgccgccgcctcccggccg

SEQ ID NO: 10922 - DNA, 21 bp, Homo sapiens
ccgccgctcgcccccggcacg

SEQ ID NO: 10923 - DNA, 21 bp, Homo sapiens
gccgccgccgccgcccggccg

SEQ ID NO: 10924 - DNA, 20 bp, Homo sapiens
ccgcccgcgctccccggccg

SEQ ID NO: 10925 - DNA, 22 bp, Homo sapiens
ccgccgcggctcccgccccccg

SEQ ID NO: 10926 - DNA, 17 bp, Homo sapiens
ccggcgcgcgccccgcc

SEQ ID NO: 10927 - DNA, 19 bp, Homo sapiens
ccgccgcggccctccggcc

SEQ ID NO: 10928 - DNA, 22 bp, Homo sapiens
ccgccgtccgccggcccggccg

SEQ ID NO: 10929 - DNA, 18 bp, Homo sapiens
ccgccgcgccgcttccgc

SEQ ID NO: 10930 - DNA, 18 bp, Homo sapiens
acgcgcagggcccggccg

SEQ ID NO: 10931 - DNA, 22 bp, Homo sapiens
ccgcccgcgccggacccggccg

SEQ ID NO: 10932 - DNA, 21 bp, Homo sapiens
ccgccgcgctcccctagcccg

SEQ ID NO: 10933 - DNA, 21 bp, Homo sapiens
ccgcccgcgcccccgcccccg

SEQ ID NO: 10934 - DNA, 15 bp, Homo sapiens
gcccgcgcccccccg

SEQ ID NO: 10935 - DNA, 20 bp, Homo sapiens
ccgcgcgcgccctcgcagcc

SEQ ID NO: 10936 - DNA, 23 bp, Homo sapiens
ccgccccgcgccccctgcagccg

SEQ ID NO: 10937 - DNA, 18 bp, Homo sapiens
ccgccgcccgctcccccg

SEQ ID NO: 10938 - DNA, 18 bp, Homo sapiens
ccgctcgcgcccctcccg

SEQ ID NO: 10939 - DNA, 24 bp, Homo sapiens
ccgcggccatggcccgctcggccg

SEQ ID NO: 10940 - DNA, 18 bp, Homo sapiens
cccccgcgcgccccggcc

SEQ ID NO: 10941 - DNA, 21 bp, Homo sapiens
ccgcccgcgccccgccggccg

SEQ ID NO: 10942 - DNA, 21 bp, Homo sapiens
ccgccgcgctttcccgcttcg

SEQ ID NO: 10943 - DNA, 18 bp, Homo sapiens
ccgtccgtgctcccagcc

SEQ ID NO: 10944 - DNA, 18 bp, Homo sapiens
ccgcccgcgctcctcccg

SEQ ID NO: 10945 - DNA, 19 bp, Homo sapiens
cgtcgcgcgcccccgggcc

SEQ ID NO: 10946 - DNA, 19 bp, Homo sapiens
gccgctgcccccgccgccg

SEQ ID NO: 10947 - DNA, 18 bp, Homo sapiens
cggcgcgcgcctcgggcc

SEQ ID NO: 10948 - DNA, 24 bp, Homo sapiens
ccgccgcgccccgccccccggccg

SEQ ID NO: 10949 - DNA, 22 bp, Homo sapiens
ccgccgccgccgatcccggccg

SEQ ID NO: 10950 - DNA, 21 bp, Homo sapiens
ccgccgccgcctccccggccg

SEQ ID NO: 10951 - DNA, 24 bp, Homo sapiens
ccggtagcgcatcctgcccggccg

SEQ ID NO: 10952 - DNA, 17 bp, Homo sapiens
cccgcgccggcccggcc

SEQ ID NO: 10953 - DNA, 21 bp, Homo sapiens
ccgctgctcgctgcccggccg

SEQ ID NO: 10954 - DNA, 24 bp, Homo sapiens
ccgccgcgtgccgcgccccggccg

SEQ ID NO: 10955 - DNA, 23 bp, Homo sapiens
ccgccgcgtccctctccaccggc

SEQ ID NO: 10956 - DNA, 18 bp, Homo sapiens
ccgccgcggagctccggc

SEQ ID NO: 10957 - DNA, 24 bp, Homo sapiens
ccgccgcgctgcaaaccgctcggc

SEQ ID NO: 10958 - DNA, 19 bp, Homo sapiens
cctcgcgccgtgcccggcc

SEQ ID NO: 10959 - DNA, 17 bp, Homo sapiens
ccgccgcgcagctcggc

SEQ ID NO: 10960 - DNA, 18 bp, Homo sapiens
ccgcgcgcgctcccggcc

SEQ ID NO: 10961 - DNA, 18 bp, Homo sapiens
ccgcgcgcaagcctggcc

SEQ ID NO: 10962 - DNA, 22 bp, Homo sapiens
ccgccgcgcgccctacgcgccg

SEQ ID NO: 10963 - DNA, 22 bp, Homo sapiens
gctgcgcgccctgcttcggtcg

SEQ ID NO: 10964 - DNA, 19 bp, Homo sapiens
gctgcacgccccagggtcg

SEQ ID NO: 10965 - DNA, 20 bp, Homo sapiens
ccggcgtgcgcccccggccc

SEQ ID NO: 10966 - DNA, 17 bp, Homo sapiens
ccgcgcgcgccctcacc

SEQ ID NO: 10967 - DNA, 18 bp, Homo sapiens
ccgccgctgtccccgccc

SEQ ID NO: 10968 - DNA, 21 bp, Homo sapiens
ccgccgcgcagtccccgaccc

SEQ ID NO: 10969 - DNA, 21 bp, Homo sapiens
ccgccgcgggctccctcctcg

SEQ ID NO: 10970 - DNA, 22 bp, Homo sapiens
cctccgcgcgcctccccggccg

SEQ ID NO: 10971 - DNA, 19 bp, Homo sapiens
ccgctccgcgttcccaacc

SEQ ID NO: 10972 - DNA, 15 bp, Homo sapiens
cgccgcgcgcccggc

SEQ ID NO: 10973 - DNA, 18 bp, Homo sapiens
cgccgcgcgccctccccg

SEQ ID NO: 10974 - DNA, 17 bp, Homo sapiens
ccgccgcgccggctggc

SEQ ID NO: 10975 - DNA, 19 bp, Homo sapiens
gctgcgcgcccctctcacc

SEQ ID NO: 10976 - DNA, 16 bp, Homo sapiens
ccgccggcgccccggc

SEQ ID NO: 10977 - DNA, 19 bp, Homo sapiens
ccgcccgcgcgctctcgcc

SEQ ID NO: 10978 - DNA, 23 bp, Homo sapiens
ccgcccctagctccgcccggccg

SEQ ID NO: 10979 - DNA, 23 bp, Homo sapiens
ccgccgcggttcccgctcctccg

SEQ ID NO: 10980 - DNA, 18 bp, Homo sapiens
ccgccccgcagcccggcc

SEQ ID NO: 10981 - DNA, 19 bp, Homo sapiens
ccgcgcggggacgcccggc

SEQ ID NO: 10982 - DNA, 17 bp, Homo sapiens
ccgcctgcgcccccggc

SEQ ID NO: 10983 - DNA, 17 bp, Homo sapiens
ccgccgcgcgtcgctcg

SEQ ID NO: 10984 - DNA, 19 bp, Homo sapiens
gcagggccctgcccggccg

SEQ ID NO: 10985 - DNA, 28 bp, Homo sapiens
ccgccgctcgccccgcacagcccggccg

SEQ ID NO: 10986 - DNA, 21 bp, Homo sapiens
ccgcccgcgcccccgtcgccg

SEQ ID NO: 10987 - DNA, 19 bp, Homo sapiens
ccgccgcgcgccgcccgcc

SEQ ID NO: 10988 - DNA, 20 bp, Homo sapiens
ccccgcgcgccctcagcccg

SEQ ID NO: 10989 - DNA, 18 bp, Homo sapiens
ccgccgcgctccgaggcc

SEQ ID NO: 10990 - DNA, 21 bp, Homo sapiens
ccgccgctcccgccgcccggc

SEQ ID NO: 10991 - DNA, 23 bp, Homo sapiens
ccgctgcgcgcgctcccgcgccg

SEQ ID NO: 10992 - DNA, 19 bp, Homo sapiens
ccgcgcacacccgctcggc

SEQ ID NO: 10993 - DNA, 21 bp, Homo sapiens
ccgcccgagcgcccgcccggc

SEQ ID NO: 10994 - DNA, 24 bp, Homo sapiens
ccgcccgcgtcccttcaggtgccg

SEQ ID NO: 10995 - DNA, 20 bp, Homo sapiens
ccgccgcggcctctcacccg

SEQ ID NO: 10996 - DNA, 23 bp, Homo sapiens
ccgccgcgcagctccgttggccg

SEQ ID NO: 10997 - DNA, 27 bp, Homo sapiens
ccgccgcgcagcacccccgctcggccg

SEQ ID NO: 10998 - DNA, 22 bp, Homo sapiens
ccgccgcgcgctctccgggccg

SEQ ID NO: 10999 - DNA, 18 bp, Homo sapiens
ccccgcgcgcctctggcc

SEQ ID NO: 11000 - DNA, 21 bp, Homo sapiens
gccgtgcgcccccggaggccg

SEQ ID NO: 11001 - DNA, 22 bp, Homo sapiens
gccgcgcgctcggccacggccg

SEQ ID NO: 11002 - DNA, 20 bp, Homo sapiens
ccgccgcggcccccgaaggc

SEQ ID NO: 11003 - DNA, 22 bp, Homo sapiens
ccgccccgcccgcgtccggccg

SEQ ID NO: 11004 - DNA, 22 bp, Homo sapiens
ccgccgcggctcccgtcggccg

SEQ ID NO: 11005 - DNA, 18 bp, Homo sapiens
ccgcccgcagcgtccggc

SEQ ID NO: 11006 - DNA, 21 bp, Homo sapiens
ccgccgcggcttagccggccg

SEQ ID NO: 11007 - DNA, 19 bp, Homo sapiens
ccccttcccctgcccggcc

SEQ ID NO: 11008 - DNA, 20 bp, Homo sapiens
ccgccgcgtcctcccgggcc

SEQ ID NO: 11009 - DNA, 19 bp, Homo sapiens
ccgccgccgcgtcctcccg

SEQ ID NO: 11010 - DNA, 18 bp, Homo sapiens
gccgcgaccgcccggccg

SEQ ID NO: 11011 - DNA, 21 bp, Homo sapiens
ccgccgcgtttcccccaaccg

SEQ ID NO: 11012 - DNA, 23 bp, Homo sapiens
gccgcccaggcctcccgcctggc

SEQ ID NO: 11013 - DNA, 21 bp, Homo sapiens
ccgccgccgcccccgccacca

SEQ ID NO: 11014 - DNA, 21 bp, Homo sapiens
ccactgcgcgcccggcccggc

SEQ ID NO: 11015 - DNA, 23 bp, Homo sapiens
ccgccgtcgtcaccgcccggccg

SEQ ID NO: 11016 - DNA, 18 bp, Homo sapiens
ccgccgccgcctctcccg

SEQ ID NO: 11017 - DNA, 20 bp, Homo sapiens
gccgcgcactcccaacgccg

SEQ ID NO: 11018 - DNA, 16 bp, Homo sapiens
ccgccgcggccctggc

SEQ ID NO: 11019 - DNA, 16 bp, Homo sapiens
gccgcgcgccctcccg

SEQ ID NO: 11020 - DNA, 18 bp, Homo sapiens
ccgtccgcgctcccctcg

SEQ ID NO: 11021 - DNA, 22 bp, Homo sapiens
gccgctgctacatgcccggccg

SEQ ID NO: 11022 - DNA, 20 bp, Homo sapiens
cctccgcgcgcctctccccg

SEQ ID NO: 11023 - DNA, 18 bp, Homo sapiens
ccgccgcgcgcccgcccg

SEQ ID NO: 11024 - DNA, 20 bp, Homo sapiens
ccgccgcgagttcccggggc

SEQ ID NO: 11025 - DNA, 18 bp, Homo sapiens
ccgcccgcacgcccggcc

SEQ ID NO: 11026 - DNA, 17 bp, Homo sapiens
cgccgcgccccctcccg

SEQ ID NO: 11027 - DNA, 20 bp, Homo sapiens
ccgcgtgcccccgccggtcg

SEQ ID NO: 11028 - DNA, 16 bp, Homo sapiens
ccgccgcgcgtccgcc

SEQ ID NO: 11029 - DNA, 21 bp, Homo sapiens
ccgccgcgctccccgccagcc

SEQ ID NO: 11030 - DNA, 23 bp, Homo sapiens
ccgcgcgcgtccccagcgccggc

SEQ ID NO: 11031 - DNA, 21 bp, Homo sapiens
ccgctgctgcttccctagccg

SEQ ID NO: 11032 - DNA, 19 bp, Homo sapiens
ccagcctccccgcccggcc

SEQ ID NO: 11033 - DNA, 19 bp, Homo sapiens
ccgccgtcgcctccgctcg

SEQ ID NO: 11034 - DNA, 20 bp, Homo sapiens
ccgccgcgccgcctcctgcc

SEQ ID NO: 11035 - DNA, 22 bp, Homo sapiens
gccgccgaggacggcccggccg

SEQ ID NO: 11036 - DNA, 18 bp, Homo sapiens
ccgcccgcgcctccgccc

SEQ ID NO: 11037 - DNA, 18 bp, Homo sapiens
ccgccgccgtccccgccc

SEQ ID NO: 11038 - DNA, 19 bp, Homo sapiens
ccgccccgcgtccttcggc

SEQ ID NO: 11039 - DNA, 17 bp, Homo sapiens
cgctggcgcccccggcc

SEQ ID NO: 11040 - DNA, 22 bp, Homo sapiens
ccgccgcgggcctcccaggccg

SEQ ID NO: 11041 - DNA, 21 bp, Homo sapiens
ccgtcgacccccgcctggccg

SEQ ID NO: 11042 - DNA, 24 bp, Homo sapiens
gccgcgcagtctccagttcggccg

SEQ ID NO: 11043 - DNA, 21 bp, Homo sapiens
ccgtcgccgcccccgccgccg

SEQ ID NO: 11044 - DNA, 24 bp, Homo sapiens
ccgccgccgcgcaccgcccggccg

SEQ ID NO: 11045 - DNA, 21 bp, Homo sapiens
ccgccgcatgggccccggccg

SEQ ID NO: 11046 - DNA, 17 bp, Homo sapiens
ccgccgcgcgtccgccc

SEQ ID NO: 11047 - DNA, 16 bp, Homo sapiens
gctgcgccgcccggcc

SEQ ID NO: 11048 - DNA, 16 bp, Homo sapiens
ccgccgcgccgctggc

SEQ ID NO: 11049 - DNA, 16 bp, Homo sapiens
gccggcccgcccggcc

SEQ ID NO: 11050 - DNA, 19 bp, Homo sapiens
ccgccgcgcgcaggcggcc

SEQ ID NO: 11051 - DNA, 16 bp, Homo sapiens
ccgccgccgcccgggc

SEQ ID NO: 11052 - DNA, 20 bp, Homo sapiens
gcccccacaccctgcctggc

SEQ ID NO: 11053 - DNA, 18 bp, Homo sapiens
ccgccgcgcccgggtggc

SEQ ID NO: 11054 - DNA, 19 bp, Homo sapiens
ccgcccgcgcccctcagcc

SEQ ID NO: 11055 - DNA, 17 bp, Homo sapiens
ccgccgccgttcccggc

SEQ ID NO: 11056 - DNA, 16 bp, Homo sapiens
ccgcccgcgccccgcc

SEQ ID NO: 11057 - DNA, 22 bp, Homo sapiens
ccgccgcccgccctcaggcccg

SEQ ID NO: 11058 - DNA, 23 bp, Homo sapiens
ccgccgcgtagctcttggcctcg

SEQ ID NO: 11059 - DNA, 18 bp, Homo sapiens
ccgctccgcgcccctccg

SEQ ID NO: 11060 - DNA, 19 bp, Homo sapiens
ccgcgcgcgttcacgggcc

SEQ ID NO: 11061 - DNA, 18 bp, Homo sapiens
ccgccgccgcctcgggcc

SEQ ID NO: 11062 - DNA, 24 bp, Homo sapiens
ccgccgtgctctccggcccggccg

SEQ ID NO: 11063 - DNA, 21 bp, Homo sapiens
ccgacgtgcgtcctccgcccg

SEQ ID NO: 11064 - DNA, 19 bp, Homo sapiens
ccgccgcggcgcctctgcc

SEQ ID NO: 11065 - DNA, 18 bp, Homo sapiens
ccgccgccgctctcggcc

SEQ ID NO: 11066 - DNA, 23 bp, Homo sapiens
ccgccgcggccttccgggagccg

SEQ ID NO: 11067 - DNA, 21 bp, Homo sapiens
ccgccgcgcccccggcggccg

SEQ ID NO: 11068 - DNA, 22 bp, Homo sapiens
ccgccgcgtcctcccagcgccg

SEQ ID NO: 11069 - DNA, 18 bp, Homo sapiens
ccgccgcgcctcctcggc

SEQ ID NO: 11070 - DNA, 17 bp, Homo sapiens
cctcgcgcgcctccacc

SEQ ID NO: 11071 - DNA, 19 bp, Homo sapiens
ccgtcgcgccgcccgggcc

SEQ ID NO: 11072 - DNA, 18 bp, Homo sapiens
ccgccgcgctccctccgc

SEQ ID NO: 11073 - DNA, 18 bp, Homo sapiens
ccgccgtgcgcgccgagc

SEQ ID NO: 11074 - DNA, 23 bp, Homo sapiens
ccgccgcgcctcttccccggccg

SEQ ID NO: 11075 - DNA, 22 bp, Homo sapiens
cctcgtgggccctccgcccggc

SEQ ID NO: 11076 - DNA, 19 bp, Homo sapiens
cgccgtgcgtccccggccg

SEQ ID NO: 11077 - DNA, 22 bp, Homo sapiens
cgtcgccgcccgagccgttggc

SEQ ID NO: 11078 - DNA, 21 bp, Homo sapiens
ccgctgcacgcccaacggccg

SEQ ID NO: 11079 - DNA, 21 bp, Homo sapiens
ccgctgcgcgctccgccagcc

SEQ ID NO: 11080 - DNA, 18 bp, Homo sapiens
ccgccccgcgtccccgcc

SEQ ID NO: 11081 - DNA, 21 bp, Homo sapiens
ccgccgccgcctccgggatcg

SEQ ID NO: 11082 - DNA, 20 bp, Homo sapiens
ccgccgcggctgccgccggc

SEQ ID NO: 11083 - DNA, 22 bp, Homo sapiens
ccgccacgcgcctcctgggccg

SEQ ID NO: 11084 - DNA, 24 bp, Homo sapiens
ccgccgttccccgccgcccggccg

SEQ ID NO: 11085 - DNA, 20 bp, Homo sapiens
gccgcgcgctcccgccaggc

SEQ ID NO: 11086 - DNA, 19 bp, Homo sapiens
ccccgacacacttgcctgg

SEQ ID NO: 11087 - DNA, 19 bp, Homo sapiens
gctgccgcccccgccgccg

SEQ ID NO: 11088 - DNA, 18 bp, Homo sapiens
ccgccgcgacgctccagc

SEQ ID NO: 11089 - DNA, 20 bp, Homo sapiens
cctgcgcagctgcccggccg

SEQ ID NO: 11090 - DNA, 17 bp, Homo sapiens
ccgccgccgcccccgcc

SEQ ID NO: 11091 - DNA, 20 bp, Homo sapiens
ccgccgccgcctctcgcccg

SEQ ID NO: 11092 - DNA, 19 bp, Homo sapiens
gctcgctcacccgcccggc

SEQ ID NO: 11093 - DNA, 17 bp, Homo sapiens
cgccgcgcgcccgggcc

SEQ ID NO: 11094 - DNA, 18 bp, Homo sapiens
gcctgcgcccccgacacc

SEQ ID NO: 11095 - DNA, 19 bp, Homo sapiens
ccgccgcggctcccggggc

SEQ ID NO: 11096 - DNA, 18 bp, Homo sapiens
ccgctggcgcccccgccc

SEQ ID NO: 11097 - DNA, 23 bp, Homo sapiens
ccgcctgcgctcccggaaggccg

SEQ ID NO: 11098 - DNA, 22 bp, Homo sapiens
ccgcccgcgcccccagctcggc

SEQ ID NO: 11099 - DNA, 20 bp, Homo sapiens
gccgcgcgccacagcggccg

SEQ ID NO: 11100 - DNA, 26 bp, Homo sapiens
ccgccgcgggcctgcggtcccggccg

SEQ ID NO: 11101 - DNA, 21 bp, Homo sapiens
ccgtgtgcgccccctggcccg

SEQ ID NO: 11102 - DNA, 19 bp, Homo sapiens
ccgccgcgtgcctctcgcc

SEQ ID NO: 11103 - DNA, 18 bp, Homo sapiens
cccgccccccgcccggcc

SEQ ID NO: 11104 - DNA, 25 bp, Homo sapiens
ccgcccggccggccccgctcggtcg

SEQ ID NO: 11105 - DNA, 17 bp, Homo sapiens
cgcgtgcgctcccagcc

SEQ ID NO: 11106 - DNA, 16 bp, Homo sapiens
gcccgcgctccgagcc

SEQ ID NO: 11107 - DNA, 18 bp, Homo sapiens
ccgccgcgcgccctcccg

SEQ ID NO: 11108 - DNA, 19 bp, Homo sapiens
cgtcgcgcgcctccagtcg

SEQ ID NO: 11109 - DNA, 16 bp, Homo sapiens
cctgcgcgccccggcc

SEQ ID NO: 11110 - DNA, 16 bp, Homo sapiens
ccgcccgcgccctccc

SEQ ID NO: 11111 - DNA, 18 bp, Homo sapiens
ccgccgctgcctcctccg

SEQ ID NO: 11112 - DNA, 24 bp, Homo sapiens
ccgccgcgcccctcccggaggccg

SEQ ID NO: 11113 - DNA, 18 bp, Homo sapiens
ccgccgcgtcccccgccc

SEQ ID NO: 11114 - DNA, 26 bp, Homo sapiens
ccgccgcggcctccaaccaccggccg

SEQ ID NO: 11115 - DNA, 21 bp, Homo sapiens
gcggcggccgccgcccggccg

SEQ ID NO: 11116 - DNA, 24 bp, Homo sapiens
ccaccgcaacttctcctgcctggc

SEQ ID NO: 11117 - DNA, 129 bp, Amsacta moorei entomopoxvirus
agtaaaatatgaggatttttttgacggaatgatattatgatcctcgattgatatttttatttcattattattaacactatcatctattaatatattattttccatacattcttcttcatataatttact

SEQ ID NO: 11118 - DNA, 24 bp, Amsacta moorei entomopoxvirus
taaaatatgaggatttttttgacg

SEQ ID NO: 11119 - DNA, 19 bp, Homo sapiens
taaaatgtaggactttgac

SEQ ID NO: 11120 - DNA, 23 bp, Homo sapiens
taaaatatcaggaagaatcttga

SEQ ID NO: 11121 - DNA, 20 bp, Homo sapiens
taaaatgtggggactttttt

SEQ ID NO: 11122 - DNA, 62 bp, Human herpesvirus 2
agggactccggagaaggaaggctgctccgcgcaccggcgcgcccttctcctctcccctccct

SEQ ID NO: 11123 - DNA, 24 bp, Human herpesvirus 2
gcgcgcccttctcctctcccctcc

SEQ ID NO: 11124 - DNA, 18 bp, Homo sapiens
gcctgctctttcctctcc

SEQ ID NO: 11125 - DNA, 18 bp, Homo sapiens
gtgcgtccctctcccctc

SEQ ID NO: 11126 - DNA, 22 bp, Homo sapiens
gccgccccataccctctcctct

SEQ ID NO: 11127 - DNA, 16 bp, Homo sapiens
gcctctgtctcccctc

SEQ ID NO: 11128 - DNA, 19 bp, Homo sapiens
cgctctccacctctcctcc

SEQ ID NO: 11129 - DNA, 20 bp, Homo sapiens
gcggctcttcctctcctctc

SEQ ID NO: 11130 - DNA, 22 bp, Homo sapiens
gctcgcccttcttttctgctcc

SEQ ID NO: 11131 - DNA, 19 bp, Homo sapiens
cgtcgccttttctcccctc

SEQ ID NO: 11132 - DNA, 22 bp, Homo sapiens
acgcgctcttcccgccccctcc

SEQ ID NO: 11133 - DNA, 26 bp, Homo sapiens
gcccttcttcttgtgtgtcccttccg

SEQ ID NO: 11134 - DNA, 19 bp, Homo sapiens
gcacgtttccctctcccct

SEQ ID NO: 11135 - DNA, 20 bp, Homo sapiens
gcccttcctgactctcctcc

SEQ ID NO: 11136 - DNA, 18 bp, Homo sapiens
gcgctctttctcctcacc

SEQ ID NO: 11137 - DNA, 19 bp, Homo sapiens
gcctctctcctctcctctc

SEQ ID NO: 11138 - DNA, 23 bp, Homo sapiens
gcccccccatgactttcccctcc

SEQ ID NO: 11139 - DNA, 19 bp, Homo sapiens
gcgctccttctcctcctcc

SEQ ID NO: 11140 - DNA, 18 bp, Homo sapiens
gcgctccttaccccctcc

SEQ ID NO: 11141 - DNA, 17 bp, Homo sapiens
gcccctgtctctcccct

SEQ ID NO: 11142 - DNA, 20 bp, Homo sapiens
gcggcccctgtctctcccct

SEQ ID NO: 11143 - DNA, 21 bp, Homo sapiens
gctgcgctttcccctcccttc

SEQ ID NO: 11144 - DNA, 18 bp, Homo sapiens
gcgttccttctcctgtcc

SEQ ID NO: 11145 - DNA, 23 bp, Homo sapiens
gcgcgctcctctctctgctttcc

SEQ ID NO: 11146 - DNA, 21 bp, Homo sapiens
gctgtggcctttttcccctcc

SEQ ID NO: 11147 - DNA, 15 bp, Homo sapiens
cgcgtcctccctccc

SEQ ID NO: 11148 - DNA, 22 bp, Homo sapiens
gcgcgcctcctccctcctctcc

SEQ ID NO: 11149 - DNA, 16 bp, Homo sapiens
gcggctttctctctcc

SEQ ID NO: 11150 - DNA, 20 bp, Homo sapiens
gcacgccccatgctctctct

SEQ ID NO: 11151 - DNA, 19 bp, Homo sapiens
gctccccttcctctcctct

SEQ ID NO: 11152 - DNA, 19 bp, Homo sapiens
gctgcctgtctctcccctc

SEQ ID NO: 11153 - DNA, 19 bp, Homo sapiens
cccttggcttctcccctcc

SEQ ID NO: 11154 - DNA, 19 bp, Homo sapiens
gccctccttctctttcctc

SEQ ID NO: 11155 - DNA, 25 bp, Homo sapiens
gcgcccccaccgcgctcttccctcc

SEQ ID NO: 11156 - DNA, 18 bp, Homo sapiens
gctcgcctttccccctcc

SEQ ID NO: 11157 - DNA, 17 bp, Homo sapiens
cgcaccctctcccctcc

SEQ ID NO: 11158 - DNA, 22 bp, Homo sapiens
gccgctgcctcctcttccttcc

SEQ ID NO: 11159 - DNA, 20 bp, Homo sapiens
cgtgccctcccttttcctcc

SEQ ID NO: 11160 - DNA, 18 bp, Homo sapiens
gcggctcttcttcccctc

SEQ ID NO: 11161 - DNA, 23 bp, Homo sapiens
gcggctctcgcgacctcccctcc

SEQ ID NO: 11162 - DNA, 23 bp, Homo sapiens
gctcgctctttctgtctcctctc

SEQ ID NO: 11163 - DNA, 23 bp, Homo sapiens
cgtcctcctcttcctcttccctc

SEQ ID NO: 11164 - DNA, 18 bp, Homo sapiens
cgcgcctcctcttccctc

SEQ ID NO: 11165 - DNA, 21 bp, Homo sapiens
ccgtcctcgattctcccctcc

SEQ ID NO: 11166 - DNA, 19 bp, Homo sapiens
gcctgcccttctgctctcc

SEQ ID NO: 11167 - DNA, 23 bp, Homo sapiens
gcgccccttttctagagccttcc

SEQ ID NO: 11168 - DNA, 18 bp, Homo sapiens
gcgcgcctcgccctctcc

SEQ ID NO: 11169 - DNA, 21 bp, Homo sapiens
gcatcttcttctctcccctcc

SEQ ID NO: 11170 - DNA, 20 bp, Homo sapiens
gcgggtcctacctcccctcc

SEQ ID NO: 11171 - DNA, 19 bp, Homo sapiens
gcgctgggttctcccctcc

SEQ ID NO: 11172 - DNA, 18 bp, Homo sapiens
gcgcgcctccctcccctc

SEQ ID NO: 11173 - DNA, 22 bp, Homo sapiens
cgctgagccctcctctcctctc

SEQ ID NO: 11174 - DNA, 22 bp, Homo sapiens
gctgctcttctcggccccctcc

SEQ ID NO: 11175 - DNA, 18 bp, Homo sapiens
gcttcctcctcttccttc

SEQ ID NO: 11176 - DNA, 20 bp, Homo sapiens
gccccctctcctcttccttc

SEQ ID NO: 11177 - DNA, 20 bp, Homo sapiens
gctgcctcccagtctcctct

SEQ ID NO: 11178 - DNA, 19 bp, Homo sapiens
gcgccactctctcctctcc

SEQ ID NO: 11179 - DNA, 17 bp, Homo sapiens
gctctcccctcccctcc

SEQ ID NO: 11180 - DNA, 21 bp, Homo sapiens
gccccaccctcctcttccctc

SEQ ID NO: 11181 - DNA, 19 bp, Homo sapiens
gcggcccttccttcccctc

SEQ ID NO: 11182 - DNA, 18 bp, Homo sapiens
gccgccctccttccctcc

SEQ ID NO: 11183 - DNA, 22 bp, Homo sapiens
gcgcgtccttctcctgcaggcc

SEQ ID NO: 11184 - DNA, 21 bp, Homo sapiens
gcggccctccactctcccctc

SEQ ID NO: 11185 - DNA, 22 bp, Homo sapiens
gccgcctccccctttcctttcc

SEQ ID NO: 11186 - DNA, 17 bp, Homo sapiens
gctgcctttccctctcc

SEQ ID NO: 11187 - DNA, 19 bp, Homo sapiens
gcgtgtcctaacctcccct

SEQ ID NO: 11188 - DNA, 18 bp, Homo sapiens
gcgccctttctccgcctc

SEQ ID NO: 11189 - DNA, 19 bp, Homo sapiens
cccttccggattcccctcc

SEQ ID NO: 11190 - DNA, 17 bp, Homo sapiens
gcggccctttcccctcc

SEQ ID NO: 11191 - DNA, 25 bp, Homo sapiens
cgccctcccttttcctctctcctcc

SEQ ID NO: 11192 - DNA, 22 bp, Homo sapiens
gcttttctctcctctcttttcc

SEQ ID NO: 11193 - DNA, 18 bp, Homo sapiens
gcgtctcttctcctctcc

SEQ ID NO: 11194 - DNA, 17 bp, Homo sapiens
gccgccctctcctctcc

SEQ ID NO: 11195 - DNA, 17 bp, Homo sapiens
gcttcctcctctcctct

SEQ ID NO: 11196 - DNA, 21 bp, Homo sapiens
gccctccctcttcttccttcc

SEQ ID NO: 11197 - DNA, 26 bp, Homo sapiens
gcgcgccccctctgtctctcccttcc

SEQ ID NO: 11198 - DNA, 19 bp, Homo sapiens
gctcgcgccttttctctcc

SEQ ID NO: 11199 - DNA, 18 bp, Homo sapiens
gctgccttcctctcctcc

SEQ ID NO: 11200 - DNA, 22 bp, Homo sapiens
gcctccagcccctctcccttcc

SEQ ID NO: 11201 - DNA, 23 bp, Homo sapiens
gctcgctttcttctcttccctcc

SEQ ID NO: 11202 - DNA, 19 bp, Homo sapiens
gcctctcggcctcccctcc

SEQ ID NO: 11203 - DNA, 18 bp, Homo sapiens
gcctctcccctctcctct

SEQ ID NO: 11204 - DNA, 17 bp, Homo sapiens
cgccttctttctcctcc

SEQ ID NO: 11205 - DNA, 20 bp, Homo sapiens
acagcctttttttcccctcc

SEQ ID NO: 11206 - DNA, 20 bp, Homo sapiens
gcagctttcctctcccctcc

SEQ ID NO: 11207 - DNA, 18 bp, Homo sapiens
gtgctccctttcctctcc

SEQ ID NO: 11208 - DNA, 18 bp, Homo sapiens
gcaacttctttcctctcc

SEQ ID NO: 11209 - DNA, 18 bp, Homo sapiens
gcggcttctttcctctcc

SEQ ID NO: 11210 - DNA, 20 bp, Homo sapiens
gcagctggcctctcccttcc

SEQ ID NO: 11211 - DNA, 22 bp, Homo sapiens
gcgtgccctcctctccaacctc

SEQ ID NO: 11212 - DNA, 19 bp, Homo sapiens
gcgcccctccccttccctc

SEQ ID NO: 11213 - DNA, 19 bp, Homo sapiens
acgccctcctctctcctcc

SEQ ID NO: 11214 - DNA, 21 bp, Homo sapiens
gctcgcccttcgggtctctcc

SEQ ID NO: 11215 - DNA, 17 bp, Homo sapiens
gcctgcctctctcccct

SEQ ID NO: 11216 - DNA, 17 bp, Homo sapiens
cctttcctctcctttcc

SEQ ID NO: 11217 - DNA, 18 bp, Homo sapiens
gcgcgcccttcctccctc

SEQ ID NO: 11218 - DNA, 18 bp, Homo sapiens
gctgcctttgtcctctcc

SEQ ID NO: 11219 - DNA, 20 bp, Homo sapiens
gcgcgctgcttccctcccct

SEQ ID NO: 11220 - DNA, 18 bp, Homo sapiens
cgtgctgctttcccctcc

SEQ ID NO: 11221 - DNA, 20 bp, Homo sapiens
gcgttcccttctctgcctcc

SEQ ID NO: 11222 - DNA, 19 bp, Homo sapiens
gcgccctcttctctgcctc

SEQ ID NO: 11223 - DNA, 19 bp, Homo sapiens
cggctcttctctcctctcc

SEQ ID NO: 11224 - DNA, 22 bp, Homo sapiens
gctcttctctcctctcctctcc

SEQ ID NO: 11225 - DNA, 20 bp, Homo sapiens
gcgcgcctctgctttcctct

SEQ ID NO: 11226 - DNA, 22 bp, Homo sapiens
gcccttctggactcttccttcc

SEQ ID NO: 11227 - DNA, 19 bp, Homo sapiens
gcgcccccttccttccttc

SEQ ID NO: 11228 - DNA, 23 bp, Homo sapiens
cgcgccctctctgcctctcctct

SEQ ID NO: 11229 - DNA, 19 bp, Homo sapiens
gcacctcctttctcccctc

SEQ ID NO: 11230 - DNA, 22 bp, Homo sapiens
gcgccctttgctcttctcccct

SEQ ID NO: 11231 - DNA, 19 bp, Homo sapiens
gcgtccccttgtcccctcc

SEQ ID NO: 11232 - DNA, 19 bp, Homo sapiens
gcctgccttcctctcccct

SEQ ID NO: 11233 - DNA, 21 bp, Homo sapiens
gccccagctcctctcctttcc

SEQ ID NO: 11234 - DNA, 18 bp, Homo sapiens
gctgcccttctccactcc

SEQ ID NO: 11235 - DNA, 18 bp, Homo sapiens
gctgccttcccttccctc

SEQ ID NO: 11236 - DNA, 21 bp, Homo sapiens
cacatttctcctctcctctcc

SEQ ID NO: 11237 - DNA, 23 bp, Homo sapiens
gcccgctgagtcctctcctctcc

SEQ ID NO: 11238 - DNA, 20 bp, Homo sapiens
gcggtgccttctctcccctc

SEQ ID NO: 11239 - DNA, 18 bp, Homo sapiens
gctcgcccttctccttcc

SEQ ID NO: 11240 - DNA, 21 bp, Homo sapiens
gcccaagctcctctcttttcc

SEQ ID NO: 11241 - DNA, 20 bp, Homo sapiens
gctgcttttccctcccctcc

SEQ ID NO: 11242 - DNA, 21 bp, Homo sapiens
gccgccctccgccttcccttc

SEQ ID NO: 11243 - DNA, 16 bp, Homo sapiens
cccctcttctcccttc

SEQ ID NO: 11244 - DNA, 18 bp, Homo sapiens
gccgctctgtctcccctc

SEQ ID NO: 11245 - DNA, 17 bp, Homo sapiens
cgcccatctctcccctc

SEQ ID NO: 11246 - DNA, 19 bp, Homo sapiens
gcgtggccttccctcccct

SEQ ID NO: 11247 - DNA, 17 bp, Homo sapiens
gctgcccttctcctgtc

SEQ ID NO: 11248 - DNA, 23 bp, Homo sapiens
cgctgcccttcttctttcctttc

SEQ ID NO: 11249 - DNA, 21 bp, Homo sapiens
gcttcctctcctttctcctcc

SEQ ID NO: 11250 - DNA, 17 bp, Homo sapiens
gcgtctccatctcccct

SEQ ID NO: 11251 - DNA, 24 bp, Homo sapiens
gcgtgatccccccctttcctttcc

SEQ ID NO: 11252 - DNA, 20 bp, Homo sapiens
gccgcccttctccgcccttc

SEQ ID NO: 11253 - DNA, 19 bp, Homo sapiens
cacacaccttctcccctcc

SEQ ID NO: 11254 - DNA, 19 bp, Homo sapiens
gcccgctcctctctttcct

SEQ ID NO: 11255 - DNA, 21 bp, Homo sapiens
gcctcctcctcttctcctctc

SEQ ID NO: 11256 - DNA, 19 bp, Homo sapiens
gccgcccatctctcccctc

SEQ ID NO: 11257 - DNA, 19 bp, Homo sapiens
gcttgcctttgtcccctcc

SEQ ID NO: 11258 - DNA, 20 bp, Homo sapiens
gcgcccccttctgggccctc

SEQ ID NO: 11259 - DNA, 23 bp, Homo sapiens
gcggcccttccccacctcccttc

SEQ ID NO: 11260 - DNA, 19 bp, Homo sapiens
gccttcttctcctcagtcc

SEQ ID NO: 11261 - DNA, 24 bp, Homo sapiens
gcccgcccttctctgcgggtctcc

SEQ ID NO: 11262 - DNA, 21 bp, Homo sapiens
gctgctcttccccttcccctc

SEQ ID NO: 11263 - DNA, 26 bp, Homo sapiens
gcgtgttctctcctccaaattcccct

SEQ ID NO: 11264 - DNA, 19 bp, Homo sapiens
gcggtgcccttcttctccc

SEQ ID NO: 11265 - DNA, 19 bp, Homo sapiens
gcccccaccgtctcccctc

SEQ ID NO: 11266 - DNA, 18 bp, Homo sapiens
gccgccctgctcctctcc

SEQ ID NO: 11267 - DNA, 20 bp, Homo sapiens
gctgctctgtctctcccctc

SEQ ID NO: 11268 - DNA, 20 bp, Homo sapiens
gcctgtccctttctcccctc

SEQ ID NO: 11269 - DNA, 19 bp, Homo sapiens
ggcgattcctctcctttcc

SEQ ID NO: 11270 - DNA, 61 bp, Human herpesvirus 2
ggggcttggccgccgaggtgcgccccggccggaggggcccccgcacctcggcggccgcccc

SEQ ID NO: 11271 - DNA, 18 bp, Human herpesvirus 2
cacctcggcggccgcccc

SEQ ID NO: 11272 - DNA, 21 bp, Homo sapiens
caccacggccaccagtgcccc

SEQ ID NO: 11273 - DNA, 15 bp, Homo sapiens
caccgcagccgcccc

SEQ ID NO: 11274 - DNA, 18 bp, Homo sapiens
cagcccaacagccgctcc

SEQ ID NO: 11275 - DNA, 18 bp, Homo sapiens
cactcagcgggctgctcc

SEQ ID NO: 11276 - DNA, 18 bp, Homo sapiens
cacctcgcagccgcgccc

SEQ ID NO: 11277 - DNA, 18 bp, Homo sapiens
cctcgcgctggccgcccc

SEQ ID NO: 11278 - DNA, 17 bp, Homo sapiens
cgcctcccggccgcccc

SEQ ID NO: 11279 - DNA, 17 bp, Homo sapiens
cacctagaagccgcccc

SEQ ID NO: 11280 - DNA, 16 bp, Homo sapiens
caccacgagccgcccc

SEQ ID NO: 11281 - DNA, 17 bp, Homo sapiens
cacccggcgacagcccc

SEQ ID NO: 11282 - DNA, 18 bp, Homo sapiens
cctcgcggccgccgcccc

SEQ ID NO: 11283 - DNA, 18 bp, Homo sapiens
cctcagcgccgccgctcc

SEQ ID NO: 11284 - DNA, 19 bp, Homo sapiens
cagctcgacaggttgcccc

SEQ ID NO: 11285 - DNA, 19 bp, Homo sapiens
acctcggcggggcggcccc

SEQ ID NO: 11286 - DNA, 18 bp, Homo sapiens
cacctcaactgctgcccc

SEQ ID NO: 11287 - DNA, 17 bp, Homo sapiens
caccccaaagccgttcc

SEQ ID NO: 11288 - DNA, 18 bp, Homo sapiens
cccctggcggccgctccg

SEQ ID NO: 11289 - DNA, 17 bp, Homo sapiens
caccccgcaatagcccc

SEQ ID NO: 11290 - DNA, 18 bp, Homo sapiens
cacccttggacaggcccc

SEQ ID NO: 11291 - DNA, 19 bp, Homo sapiens
cccggcggcggctcgctcc

SEQ ID NO: 11292 - DNA, 17 bp, Homo sapiens
caccccagccctgcccc

SEQ ID NO: 11293 - DNA, 18 bp, Homo sapiens
acctcttgcagccgctcc

SEQ ID NO: 11294 - DNA, 17 bp, Homo sapiens
caccccggtggggcccc

SEQ ID NO: 11295 - DNA, 20 bp, Homo sapiens
acctcagcgaccttcgcccc

SEQ ID NO: 11296 - DNA, 18 bp, Homo sapiens
cctcagccgcgtcgcccc

SEQ ID NO: 11297 - DNA, 19 bp, Homo sapiens
cctcggcagggtccgcccc

SEQ ID NO: 11298 - DNA, 19 bp, Homo sapiens
cacctcgaggccgggctcc

SEQ ID NO: 11299 - DNA, 20 bp, Homo sapiens
caccccggctgtcacgcccc

SEQ ID NO: 11300 - DNA, 19 bp, Homo sapiens
cctcggcggcgctcgctcc

SEQ ID NO: 11301 - DNA, 18 bp, Homo sapiens
caccccggggcgcgcccc

SEQ ID NO: 11302 - DNA, 18 bp, Homo sapiens
cacccgcgagcctgcccc

SEQ ID NO: 11303 - DNA, 18 bp, Homo sapiens
caccggagcggccgctcc

SEQ ID NO: 11304 - DNA, 19 bp, Homo sapiens
acctcggcggcccggctcc

SEQ ID NO: 11305 - DNA, 17 bp, Homo sapiens
cacccgcgctgggcccc

SEQ ID NO: 11306 - DNA, 16 bp, Homo sapiens
cacccgagactgcccc

SEQ ID NO: 11307 - DNA, 18 bp, Homo sapiens
cctcaccacggccgcccc

SEQ ID NO: 11308 - DNA, 18 bp, Homo sapiens
cctcaacacggccgcccc

SEQ ID NO: 11309 - DNA, 20 bp, Homo sapiens
cctcttggcgaccaggcccc

SEQ ID NO: 11310 - DNA, 17 bp, Homo sapiens
cacccgccgactgcccc

SEQ ID NO: 11311 - DNA, 18 bp, Homo sapiens
cacctccaccaccgcccc

SEQ ID NO: 11312 - DNA, 20 bp, Homo sapiens
cacctcggcaggggcacccc

SEQ ID NO: 11313 - DNA, 16 bp, Homo sapiens
cacctcagcaggcccc

SEQ ID NO: 11314 - DNA, 18 bp, Homo sapiens
cctggaggcggccgcccc

SEQ ID NO: 11315 - DNA, 18 bp, Homo sapiens
cacccgcgaggccgcccc

SEQ ID NO: 11316 - DNA, 23 bp, Homo sapiens
caccccggcgtgtggcgtcgccc

SEQ ID NO: 11317 - DNA, 19 bp, Homo sapiens
cacctcagcaagcagctcc

SEQ ID NO: 11318 - DNA, 21 bp, Homo sapiens
caccccgggccagcctgctcc

SEQ ID NO: 11319 - DNA, 17 bp, Homo sapiens
cacctcggcccggcccc

SEQ ID NO: 11320 - DNA, 19 bp, Homo sapiens
caccatgtctgcccgcccc

SEQ ID NO: 11321 - DNA, 17 bp, Homo sapiens
caccccagcagcgcccc

SEQ ID NO: 11322 - DNA, 16 bp, Homo sapiens
cacctgagaccgcccc

SEQ ID NO: 11323 - DNA, 20 bp, Homo sapiens
caccccggcagcagggcccc

SEQ ID NO: 11324 - DNA, 18 bp, Homo sapiens
cactcggcggggaccgcc

SEQ ID NO: 11325 - DNA, 16 bp, Homo sapiens
cacctggtgccacccc

SEQ ID NO: 11326 - DNA, 17 bp, Homo sapiens
cacacttcagccgcccc

SEQ ID NO: 11327 - DNA, 19 bp, Homo sapiens
cacccggccgccgtgctcc

SEQ ID NO: 11328 - DNA, 17 bp, Homo sapiens
caccgtggggccgcccc

SEQ ID NO: 11329 - DNA, 15 bp, Homo sapiens
cacctcggggacccc

SEQ ID NO: 11330 - DNA, 15 bp, Homo sapiens
caccaacgccgcccc

SEQ ID NO: 11331 - DNA, 19 bp, Homo sapiens
cgcctcggccgccgccgcc

SEQ ID NO: 11332 - DNA, 18 bp, Homo sapiens
ccttcggcaacccgcccc

SEQ ID NO: 11333 - DNA, 18 bp, Homo sapiens
caccctgcccaccgcccc

SEQ ID NO: 11334 - DNA, 17 bp, Homo sapiens
caccgcggccgcgcccc

SEQ ID NO: 11335 - DNA, 18 bp, Homo sapiens
cccgggccaggccgcccc

SEQ ID NO: 11336 - DNA, 19 bp, Homo sapiens
cacctcgctcccccgcccc

SEQ ID NO: 11337 - DNA, 20 bp, Homo sapiens
ccccggcgcgcggtcgcccc

SEQ ID NO: 11338 - DNA, 19 bp, Homo sapiens
ccgcggccctggccgcccc

SEQ ID NO: 11339 - DNA, 16 bp, Homo sapiens
cacctcgagatacccc

SEQ ID NO: 11340 - DNA, 18 bp, Homo sapiens
cctccggccgcccgcccc

SEQ ID NO: 11341 - DNA, 17 bp, Homo sapiens
cacttcggcaccacccc

SEQ ID NO: 11342 - DNA, 17 bp, Homo sapiens
cacctctgcaccgcccc

SEQ ID NO: 11343 - DNA, 19 bp, Homo sapiens
cacctgccacccccgcccc

SEQ ID NO: 11344 - DNA, 18 bp, Homo sapiens
caccggcatggccgcccc

SEQ ID NO: 11345 - DNA, 18 bp, Homo sapiens
caccccgactctcgcccc

SEQ ID NO: 11346 - DNA, 17 bp, Homo sapiens
catcttggcaccgcccc

SEQ ID NO: 11347 - DNA, 19 bp, Homo sapiens
cacttctggcagtagcccc

SEQ ID NO: 11348 - DNA, 18 bp, Homo sapiens
cacctcagcgaacggccc

SEQ ID NO: 11349 - DNA, 17 bp, Homo sapiens
cacctcgggccgcaccc

SEQ ID NO: 11350 - DNA, 18 bp, Homo sapiens
cctggcatcagccgcccc

SEQ ID NO: 11351 - DNA, 16 bp, Homo sapiens
caccccagcacgcccc

SEQ ID NO: 11352 - DNA, 18 bp, Homo sapiens
caccccggcccgcgcccc

SEQ ID NO: 11353 - DNA, 18 bp, Homo sapiens
cctcccgcgggccgcccc

SEQ ID NO: 11354 - DNA, 20 bp, Homo sapiens
acctcagctgcggctgctcc

SEQ ID NO: 11355 - DNA, 19 bp, Homo sapiens
cctcagggccatgcgtccc

SEQ ID NO: 11356 - DNA, 17 bp, Homo sapiens
cgcccctacgccgcccc

SEQ ID NO: 11357 - DNA, 20 bp, Homo sapiens
cacctcgataccagctgccc

SEQ ID NO: 11358 - DNA, 15 bp, Homo sapiens
caccccgcacgcccc

SEQ ID NO: 11359 - DNA, 18 bp, Homo sapiens
cacttcggagaccgcccc

SEQ ID NO: 11360 - DNA, 20 bp, Homo sapiens
cacctcggcggatgggcccc

SEQ ID NO: 11361 - DNA, 18 bp, Homo sapiens
cctcggccacctcgcccc

SEQ ID NO: 11362 - DNA, 18 bp, Homo sapiens
cctgggcctggccgcccc

SEQ ID NO: 11363 - DNA, 20 bp, Homo sapiens
cacctcgagaaccgggcccc

SEQ ID NO: 11364 - DNA, 19 bp, Homo sapiens
cacctcaagcccccgcccc

SEQ ID NO: 11365 - DNA, 15 bp, Homo sapiens
caccggagccgcccc

SEQ ID NO: 11366 - DNA, 18 bp, Homo sapiens
cacccgcgcaggcgcccc

SEQ ID NO: 11367 - DNA, 18 bp, Homo sapiens
cacctcagtgaagcgccc

SEQ ID NO: 11368 - DNA, 17 bp, Homo sapiens
cacttcggcagcgcccc

SEQ ID NO: 11369 - DNA, 18 bp, Homo sapiens
cacctgacacgccgcccc

SEQ ID NO: 11370 - DNA, 16 bp, Homo sapiens
cgcccccggccgcccc

SEQ ID NO: 11371 - DNA, 18 bp, Homo sapiens
cgcctcggccaccgcccc

SEQ ID NO: 11372 - DNA, 16 bp, Homo sapiens
caccccgggccgcccc

SEQ ID NO: 11373 - DNA, 19 bp, Homo sapiens
cacctcagagtcctgtccc

SEQ ID NO: 11374 - DNA, 18 bp, Homo sapiens
ccgccggcccgccgcccc

SEQ ID NO: 11375 - DNA, 18 bp, Homo sapiens
cccggcggacacggcccc

SEQ ID NO: 11376 - DNA, 17 bp, Homo sapiens
cacccccaccccgcccc

SEQ ID NO: 11377 - DNA, 16 bp, Homo sapiens
cacccggcagagcccc

SEQ ID NO: 11378 - DNA, 16 bp, Homo sapiens
cacccggcagggcccc

SEQ ID NO: 11379 - DNA, 19 bp, Homo sapiens
ccccagcgctggccgctcc

SEQ ID NO: 11380 - DNA, 21 bp, Homo sapiens
cacccggccagggcccgcccc

SEQ ID NO: 11381 - DNA, 18 bp, Homo sapiens
cacccttggcaccacccc

SEQ ID NO: 11382 - DNA, 17 bp, Homo sapiens
caccccgggccggcccc

SEQ ID NO: 11383 - DNA, 15 bp, Homo sapiens
cacccggcaggcccc

SEQ ID NO: 11384 - DNA, 17 bp, Homo sapiens
caccccgcccccgcccc

SEQ ID NO: 11385 - DNA, 19 bp, Homo sapiens
caccccgggccggagcccc

SEQ ID NO: 11386 - DNA, 23 bp, Homo sapiens
cacctcagccaccggccgctccg

SEQ ID NO: 11387 - DNA, 20 bp, Homo sapiens
cactttggcagccaagcccc

SEQ ID NO: 11388 - DNA, 16 bp, Homo sapiens
cagctcgacaggcccc

SEQ ID NO: 11389 - DNA, 17 bp, Homo sapiens
catctcacagccgcccc

SEQ ID NO: 11390 - DNA, 20 bp, Homo sapiens
cacctcggctgcatgcaccc

SEQ ID NO: 11391 - DNA, 16 bp, Homo sapiens
cacccggggccgcccc

SEQ ID NO: 11392 - DNA, 20 bp, Homo sapiens
cacctcggtcagtgcgtccc

SEQ ID NO: 11393 - DNA, 18 bp, Homo sapiens
caccccgggccgccgccc

SEQ ID NO: 11394 - DNA, 18 bp, Homo sapiens
cactgtcagggctgcccc

SEQ ID NO: 11395 - DNA, 18 bp, Homo sapiens
caccccggcgcccgcccc

SEQ ID NO: 11396 - DNA, 20 bp, Homo sapiens
cctcggcggcggctcgctcc

SEQ ID NO: 11397 - DNA, 18 bp, Homo sapiens
cacctcgatgagaccgcc

SEQ ID NO: 11398 - DNA, 20 bp, Homo sapiens
acctcggcggcacccgcccc

SEQ ID NO: 11399 - DNA, 19 bp, Homo sapiens
cacactcactctccgcccc

SEQ ID NO: 11400 - DNA, 21 bp, Homo sapiens
cacccccaggccggctgtccc

SEQ ID NO: 11401 - DNA, 21 bp, Homo sapiens
caccccggtagctgatgcccc

SEQ ID NO: 11402 - DNA, 18 bp, Homo sapiens
ccaggcggcggccgcccc

SEQ ID NO: 11403 - DNA, 21 bp, Homo sapiens
cacctcagctcccgttgctcc

SEQ ID NO: 11404 - DNA, 20 bp, Homo sapiens
caccccgggacccgcgcccc

SEQ ID NO: 11405 - DNA, 18 bp, Homo sapiens
cacctgcggccacttgcc

SEQ ID NO: 11406 - DNA, 18 bp, Homo sapiens
ccccggccgcgccgcccc

SEQ ID NO: 11407 - DNA, 19 bp, Homo sapiens
caccccggcactgctgccc

SEQ ID NO: 11408 - DNA, 20 bp, Homo sapiens
caccccagtcatgctgcccc

SEQ ID NO: 11409 - DNA, 19 bp, Homo sapiens
cgccttccgcagccgctcc

SEQ ID NO: 11410 - DNA, 15 bp, Homo sapiens
cacccacgccgcccc

SEQ ID NO: 11411 - DNA, 19 bp, Homo sapiens
acctcagcacgcacgctcc

SEQ ID NO: 11412 - DNA, 20 bp, Homo sapiens
caccccagctgtgctgcccc

SEQ ID NO: 11413 - DNA, 102 bp, Human herpesvirus 2
agaaacacgaggcgggggtcccagaaagggcaggcaggtcagccgcaccgcccgcgagccaacccgtatcctttttttctaggtgtttttgtttttgtttct

SEQ ID NO: 11414 - DNA, 24 bp, Human herpesvirus 2
aacccgtatcctttttttctaggt

SEQ ID NO: 11415 - DNA, 21 bp, Homo sapiens
aacctatgtagttttctaggt

SEQ ID NO: 11416 - DNA, 19 bp, Homo sapiens
cgatctttttctcttaggt

SEQ ID NO: 11417 - DNA, 21 bp, Homo sapiens
accagcaagttttttctgggt

SEQ ID NO: 11418 - DNA, 27 bp, Homo sapiens
aacctacagacttttttttttctgggt

SEQ ID NO: 11419 - DNA, 18 bp, Homo sapiens
atctctgttctttccagg

SEQ ID NO: 11420 - DNA, 19 bp, Homo sapiens
cccgttttttttcgaaggt

SEQ ID NO: 11421 - DNA, 20 bp, Homo sapiens
acctgtatccctcagcttgg

SEQ ID NO: 11422 - DNA, 18 bp, Homo sapiens
accctgtttgcctctagg

SEQ ID NO: 11423 - DNA, 16 bp, Homo sapiens
gtatcttgccctaggt

SEQ ID NO: 11424 - DNA, 19 bp, Homo sapiens
aacccatattttttttcag

SEQ ID NO: 11425 - DNA, 22 bp, Homo sapiens
ccctgtctttttcctcttaggt

SEQ ID NO: 11426 - DNA, 17 bp, Homo sapiens
gtatccctgttttgggt

SEQ ID NO: 11427 - DNA, 19 bp, Homo sapiens
aacccatattttttccagg

SEQ ID NO: 11428 - DNA, 99 bp, Human herpesvirus 2
ggaaagcggaaaaacggaggatggaagggcagaagatggggagtcccgatcctcctcctgcatcccctcgccttccattctccggccctccgcgagtcc

SEQ ID NO: 11429 - DNA, 24 bp, Human herpesvirus 2
aagcggaaaaacggaggatggaag

SEQ ID NO: 11430 - DNA, 21 bp, Homo sapiens
agcgaaggcacttgggggtgg

SEQ ID NO: 11431 - DNA, 17 bp, Homo sapiens
aagcgggaagaggacag

SEQ ID NO: 11432 - DNA, 16 bp, Homo sapiens
aagggggaagatggaa

SEQ ID NO: 11433 - DNA, 19 bp, Homo sapiens
agcggaaaagaggaaatgg

SEQ ID NO: 11434 - DNA, 18 bp, Homo sapiens
agcggacggaatgaatgg

SEQ ID NO: 11435 - DNA, 21 bp, Homo sapiens
agaggaagaatggaggattgg

SEQ ID NO: 11436 - DNA, 19 bp, Homo sapiens
agaggaaggacggggaaag

SEQ ID NO: 11437 - DNA, 20 bp, Homo sapiens
aagggaagaaaacatggagg

SEQ ID NO: 11438 - DNA, 18 bp, Homo sapiens
aggggaaagacggagggg

SEQ ID NO: 11439 - DNA, 20 bp, Homo sapiens
aagcgagaaaacgcaggagg

SEQ ID NO: 11440 - DNA, 18 bp, Homo sapiens
agtggaaagatgaatgga

SEQ ID NO: 11441 - DNA, 20 bp, Homo sapiens
ggagaaggaaatgatggaag

SEQ ID NO: 11442 - DNA, 20 bp, Homo sapiens
aagcggaaagtgtggtgggg

SEQ ID NO: 11443 - DNA, 17 bp, Homo sapiens
agggagaaaggatggaa

SEQ ID NO: 11444 - DNA, 16 bp, Homo sapiens
gcagaaaaaaatggaa

SEQ ID NO: 11445 - DNA, 20 bp, Homo sapiens
agcagaagaattaggggtgg

SEQ ID NO: 11446 - DNA, 22 bp, Homo sapiens
gctgagggacggaggacactgg

SEQ ID NO: 11447 - DNA, 18 bp, Homo sapiens
aagaggggagagatggaa

SEQ ID NO: 11448 - DNA, 23 bp, Homo sapiens
aagcgaaaaaaatgaggtggaag

SEQ ID NO: 11449 - DNA, 17 bp, Homo sapiens
gctggaaaatgaggagg

SEQ ID NO: 11450 - DNA, 17 bp, Homo sapiens
ggaaagatggatggaag

SEQ ID NO: 11451 - DNA, 18 bp, Homo sapiens
aagcggaaagtggggtgg

SEQ ID NO: 11452 - DNA, 19 bp, Homo sapiens
agggagggagaacatggga

SEQ ID NO: 11453 - DNA, 18 bp, Homo sapiens
agcggaaaggggagttgg

SEQ ID NO: 11454 - DNA, 18 bp, Homo sapiens
gcagaaaaaaaaaagtgg

SEQ ID NO: 11455 - DNA, 17 bp, Homo sapiens
ggacagagggatggaag

SEQ ID NO: 11456 - DNA, 21 bp, Homo sapiens
aagaggaaaatgcagggtgga

SEQ ID NO: 11457 - DNA, 23 bp, Homo sapiens
aagcgggtgagagaacatggaag

SEQ ID NO: 11458 - DNA, 17 bp, Homo sapiens
agtgggggaaaatggaa

SEQ ID NO: 11459 - DNA, 21 bp, Homo sapiens
aggggaagaatggaaggatgg

SEQ ID NO: 11460 - DNA, 18 bp, Homo sapiens
ggaaaaaaaaatggtgga

SEQ ID NO: 11461 - DNA, 18 bp, Homo sapiens
aagggaaaagcaatggaa

SEQ ID NO: 11462 - DNA, 17 bp, Homo sapiens
aagaggaaaaaagatgg

SEQ ID NO: 11463 - DNA, 21 bp, Homo sapiens
aagtgggaaaacggcagacag

SEQ ID NO: 11464 - DNA, 24 bp, Homo sapiens
aagcggaagaagccgctggatgga

SEQ ID NO: 11465 - DNA, 20 bp, Homo sapiens
aagctggaggatggggatgg

SEQ ID NO: 11466 - DNA, 22 bp, Homo sapiens
aagtgggtaagacggaagtgga

SEQ ID NO: 11467 - DNA, 19 bp, Homo sapiens
agcggggacacggaggatg

SEQ ID NO: 11468 - DNA, 19 bp, Homo sapiens
aagcgaaagagcggggcgg

SEQ ID NO: 11469 - DNA, 19 bp, Homo sapiens
aaggggaaagtggagccgg

SEQ ID NO: 11470 - DNA, 15 bp, Homo sapiens
aagggggaggacgga

SEQ ID NO: 11471 - DNA, 21 bp, Homo sapiens
agtggaaagacagggggaggg

SEQ ID NO: 11472 - DNA, 21 bp, Homo sapiens
aagtggagaaacaggagacag

SEQ ID NO: 11473 - DNA, 21 bp, Homo sapiens
ggaagtgggagaggatggaag

SEQ ID NO: 11474 - DNA, 18 bp, Homo sapiens
aagtggaaaaactggagg

SEQ ID NO: 11475 - DNA, 16 bp, Homo sapiens
aagtggaaggagtgga

SEQ ID NO: 11476 - DNA, 17 bp, Homo sapiens
agcgggaaagaggatgg

SEQ ID NO: 11477 - DNA, 18 bp, Homo sapiens
aagcgggaaggatggaaa

SEQ ID NO: 11478 - DNA, 19 bp, Homo sapiens
aagggaaggtgggatggaa

SEQ ID NO: 11479 - DNA, 15 bp, Homo sapiens
aagcggagaagatgg

SEQ ID NO: 11480 - DNA, 19 bp, Homo sapiens
agggaatggggaggatgga

SEQ ID NO: 11481 - DNA, 17 bp, Homo sapiens
gcagggaacaggatgga

SEQ ID NO: 11482 - DNA, 21 bp, Homo sapiens
agcgggaggagagaggatgga

SEQ ID NO: 11483 - DNA, 20 bp, Homo sapiens
ggaagaacaggaggtggaag

SEQ ID NO: 11484 - DNA, 24 bp, Homo sapiens
aagcggaaggacaggtttgggtgg

SEQ ID NO: 11485 - DNA, 21 bp, Homo sapiens
ggagaaatggggccatggaag

SEQ ID NO: 11486 - DNA, 18 bp, Homo sapiens
agggaaggtggacagaaa

SEQ ID NO: 11487 - DNA, 21 bp, Homo sapiens
aagtgaagggggagatggaag

SEQ ID NO: 11488 - DNA, 17 bp, Homo sapiens
ggaagaactgaggtgga

SEQ ID NO: 11489 - DNA, 22 bp, Homo sapiens
aacggaagaaaaacaatggaag

SEQ ID NO: 11490 - DNA, 22 bp, Homo sapiens
aacaaaatgagtggagggtgga

SEQ ID NO: 11491 - DNA, 15 bp, Homo sapiens
aagcagggagacgga

SEQ ID NO: 11492 - DNA, 21 bp, Homo sapiens
ggagtccccgggggatggaag

SEQ ID NO: 11493 - DNA, 20 bp, Homo sapiens
aggggaagtggaaggatgga

SEQ ID NO: 11494 - DNA, 20 bp, Homo sapiens
agtgaagaaatggagaacag

SEQ ID NO: 11495 - DNA, 18 bp, Homo sapiens
aagggagaaagaatggaa

SEQ ID NO: 11496 - DNA, 20 bp, Homo sapiens
agcggcggggcggaggacgg

SEQ ID NO: 11497 - DNA, 15 bp, Homo sapiens
aagcagaaagatgga

SEQ ID NO: 11498 - DNA, 19 bp, Homo sapiens
agcggaaagggaaaggagg

SEQ ID NO: 11499 - DNA, 20 bp, Homo sapiens
aagtggaaaaatggcagcag

SEQ ID NO: 11500 - DNA, 21 bp, Homo sapiens
aagcagggaaaatgatggagg

SEQ ID NO: 11501 - DNA, 21 bp, Homo sapiens
aagccggaaggtggataaaaa

SEQ ID NO: 11502 - DNA, 18 bp, Homo sapiens
aagcgggaagacagagga

SEQ ID NO: 11503 - DNA, 19 bp, Homo sapiens
aagtggaagaacaggagaa

SEQ ID NO: 11504 - DNA, 20 bp, Homo sapiens
ggaggaggaggacgtggaag

SEQ ID NO: 11505 - DNA, 21 bp, Homo sapiens
agcaggccaaggggatggaag

SEQ ID NO: 11506 - DNA, 20 bp, Homo sapiens
aagcgaagagcggacgaaaa

SEQ ID NO: 11507 - DNA, 19 bp, Homo sapiens
gcagaggtatggatggaag

SEQ ID NO: 11508 - DNA, 21 bp, Homo sapiens
aggggaaaagacacatggaag

SEQ ID NO: 11509 - DNA, 22 bp, Homo sapiens
aagtggaaaaatgaaataaaag

SEQ ID NO: 11510 - DNA, 19 bp, Homo sapiens
gctggaaagatggcggaag

SEQ ID NO: 11511 - DNA, 21 bp, Homo sapiens
agggagaacagagggtggaag

SEQ ID NO: 11512 - DNA, 19 bp, Homo sapiens
gcagaagaatggaaatgaa

SEQ ID NO: 11513 - DNA, 19 bp, Homo sapiens
gcagaggggtgcttggaag

SEQ ID NO: 11514 - DNA, 17 bp, Homo sapiens
agaggagaaaaatggaa

SEQ ID NO: 11515 - DNA, 15 bp, Homo sapiens
aagcagggaggatgg

SEQ ID NO: 11516 - DNA, 20 bp, Homo sapiens
agcgggagaacgatcggagg

SEQ ID NO: 11517 - DNA, 17 bp, Homo sapiens
gcggaaaacgcaggtgg

SEQ ID NO: 11518 - DNA, 23 bp, Homo sapiens
gcagaaagatggagatcaggaag

SEQ ID NO: 11519 - DNA, 20 bp, Homo sapiens
agggagaggtggaggacgaa

SEQ ID NO: 11520 - DNA, 22 bp, Homo sapiens
ggaaaaaccgaggcttccaaag

SEQ ID NO: 11521 - DNA, 20 bp, Homo sapiens
ggaagaatttgaaatggaag

SEQ ID NO: 11522 - DNA, 23 bp, Homo sapiens
agggagggtagaacagatggaag

SEQ ID NO: 11523 - DNA, 20 bp, Homo sapiens
aagggaaaaacggggcctgg

SEQ ID NO: 11524 - DNA, 22 bp, Homo sapiens
ggaaaatgccggcggagggtgg

SEQ ID NO: 11525 - DNA, 17 bp, Homo sapiens
acggaaggaaaagtgga

SEQ ID NO: 11526 - DNA, 15 bp, Homo sapiens
aaggggaaggatgga

SEQ ID NO: 11527 - DNA, 18 bp, Homo sapiens
gcgagaaggatgaatgga

SEQ ID NO: 11528 - DNA, 16 bp, Homo sapiens
agaggaaggaggatgg

SEQ ID NO: 11529 - DNA, 17 bp, Homo sapiens
agggagggaggatggaa

SEQ ID NO: 11530 - DNA, 17 bp, Homo sapiens
gggaaaacaaggatgga

SEQ ID NO: 11531 - DNA, 22 bp, Homo sapiens
aggtgagagacgccagaatgga

SEQ ID NO: 11532 - DNA, 22 bp, Homo sapiens
agctgggaaaatggaggccaag

SEQ ID NO: 11533 - DNA, 18 bp, Homo sapiens
agtggaaggaaggaggga

SEQ ID NO: 11534 - DNA, 17 bp, Homo sapiens
aaggggaggaagatgga

SEQ ID NO: 11535 - DNA, 22 bp, Homo sapiens
aagcaggaaaatgggatggaag

SEQ ID NO: 11536 - DNA, 19 bp, Homo sapiens
gcgggaaggttgatgaaag

SEQ ID NO: 11537 - DNA, 16 bp, Homo sapiens
gcgcggaggacggaag

SEQ ID NO: 11538 - DNA, 17 bp, Homo sapiens
ggaaggaaaaatggaag

SEQ ID NO: 11539 - DNA, 19 bp, Homo sapiens
aaggggacaagggatggaa

SEQ ID NO: 11540 - DNA, 17 bp, Homo sapiens
gggaaaacggatggaag

SEQ ID NO: 11541 - DNA, 24 bp, Homo sapiens
aagggaaaaacggggcctgggaag

SEQ ID NO: 11542 - DNA, 21 bp, Homo sapiens
gcgagaaagacgatgcttgga

SEQ ID NO: 11543 - DNA, 22 bp, Homo sapiens
ggggaaacggaggcctcaaaag

SEQ ID NO: 11544 - DNA, 19 bp, Homo sapiens
aagcaggaaaatggatgga

SEQ ID NO: 11545 - DNA, 17 bp, Homo sapiens
gcgaaaaacgggcgagg

SEQ ID NO: 11546 - DNA, 18 bp, Homo sapiens
ggacggaagtggggtgga

SEQ ID NO: 11547 - DNA, 63 bp, Human herpesvirus 2
gggccgcgggccagcagacgggccgcggcgccagcggcccacgcctcccgccgcattaggccc

SEQ ID NO: 11548 - DNA, 24 bp, Human herpesvirus 2
cccacgcctcccgccgcattaggc

SEQ ID NO: 11549 - DNA, 23 bp, Homo sapiens
cccgcgcccccgccgacccctgg

SEQ ID NO: 11550 - DNA, 18 bp, Homo sapiens
cccacgcctcccctgcgc

SEQ ID NO: 11551 - DNA, 19 bp, Homo sapiens
cccatgcctcccacctcgg

SEQ ID NO: 11552 - DNA, 20 bp, Homo sapiens
cccgggcctcccgcaccagg

SEQ ID NO: 11553 - DNA, 18 bp, Homo sapiens
cccgcgcctccccgcagg

SEQ ID NO: 11554 - DNA, 22 bp, Homo sapiens
cccacgccttcctccttccggc

SEQ ID NO: 11555 - DNA, 19 bp, Homo sapiens
ccctgcctcccgtcctggc

SEQ ID NO: 11556 - DNA, 17 bp, Homo sapiens
cgccctcccgcccgcgg

SEQ ID NO: 11557 - DNA, 18 bp, Homo sapiens
cccgcgcccccgccccgg

SEQ ID NO: 11558 - DNA, 22 bp, Homo sapiens
cccgcgccacccgccctccggc

SEQ ID NO: 11559 - DNA, 18 bp, Homo sapiens
cccacgccgtccgcgagg

SEQ ID NO: 11560 - DNA, 21 bp, Homo sapiens
cgcctcccgctcaacccgggc

SEQ ID NO: 11561 - DNA, 19 bp, Homo sapiens
cccgcccctcccgccgggg

SEQ ID NO: 11562 - DNA, 23 bp, Homo sapiens
cccgcgccgcccgccgccaccgc

SEQ ID NO: 11563 - DNA, 18 bp, Homo sapiens
ccgctcctcccgccgcgg

SEQ ID NO: 11564 - DNA, 16 bp, Homo sapiens
cccaccctcccgctag

SEQ ID NO: 11565 - DNA, 21 bp, Homo sapiens
ccacgccttccgcggaggggc

SEQ ID NO: 11566 - DNA, 19 bp, Homo sapiens
cccgcgccccccgccccgg

SEQ ID NO: 11567 - DNA, 19 bp, Homo sapiens
cgcctcccgcgggttaggc

SEQ ID NO: 11568 - DNA, 22 bp, Homo sapiens
cccgccctcctgcagcgcaggc

SEQ ID NO: 11569 - DNA, 17 bp, Homo sapiens
cccgtctcccgccaagg

SEQ ID NO: 11570 - DNA, 19 bp, Homo sapiens
cctgcctcccgtctcaggc

SEQ ID NO: 11571 - DNA, 22 bp, Homo sapiens
cccacgcctctccccgccctgc

SEQ ID NO: 11572 - DNA, 20 bp, Homo sapiens
cccgcgctcccgcctcgggg

SEQ ID NO: 11573 - DNA, 22 bp, Homo sapiens
ccccgcctcctgctgccacagc

SEQ ID NO: 11574 - DNA, 19 bp, Homo sapiens
cccggcctcccgcaagagg

SEQ ID NO: 11575 - DNA, 19 bp, Homo sapiens
catgcctcccacagcaggc

SEQ ID NO: 11576 - DNA, 19 bp, Homo sapiens
cccagcctctcgggctggg

SEQ ID NO: 11577 - DNA, 25 bp, Homo sapiens
cctccgcctcccgctccgcccgggc

SEQ ID NO: 11578 - DNA, 23 bp, Homo sapiens
cccgcgcctcccggcgcccccgc

SEQ ID NO: 11579 - DNA, 23 bp, Homo sapiens
cccgtgcctcccacctgcccggc

SEQ ID NO: 11580 - DNA, 19 bp, Homo sapiens
ccctcgcctcccgtggagg

SEQ ID NO: 11581 - DNA, 17 bp, Homo sapiens
ccgcgcctccccgcggg

SEQ ID NO: 11582 - DNA, 22 bp, Homo sapiens
cctacgccttccccttcccggc

SEQ ID NO: 11583 - DNA, 19 bp, Homo sapiens
cccaggcctcccgcctggc

SEQ ID NO: 11584 - DNA, 22 bp, Homo sapiens
cccacgcctcttgcccccatgc

SEQ ID NO: 11585 - DNA, 21 bp, Homo sapiens
ccttcgcctcccgttcccagg

SEQ ID NO: 11586 - DNA, 19 bp, Homo sapiens
cccgcctcccgcccgaggc

SEQ ID NO: 11587 - DNA, 20 bp, Homo sapiens
ccacacttcctccattaggc

SEQ ID NO: 11588 - DNA, 19 bp, Homo sapiens
cccagcctcccgcctgcgg

SEQ ID NO: 11589 - DNA, 22 bp, Homo sapiens
cccagcttcccctgctattggg

SEQ ID NO: 11590 - DNA, 20 bp, Homo sapiens
cacctcccgccacagctggg

SEQ ID NO: 11591 - DNA, 19 bp, Homo sapiens
cccgcgtccccgccgccgc

SEQ ID NO: 11592 - DNA, 15 bp, Homo sapiens
cacctcccgctcagg

SEQ ID NO: 11593 - DNA, 22 bp, Homo sapiens
cccacgcttcccgccgacgcgg

SEQ ID NO: 11594 - DNA, 22 bp, Homo sapiens
cccgcgtccccgccagccaggc

SEQ ID NO: 11595 - DNA, 18 bp, Homo sapiens
cctgcgcccccgccggag

SEQ ID NO: 11596 - DNA, 18 bp, Homo sapiens
cccgcgtccccgccgagg

SEQ ID NO: 11597 - DNA, 19 bp, Homo sapiens
cacgcctctcccacatggc

SEQ ID NO: 11598 - DNA, 18 bp, Homo sapiens
ccccgcctcccgtccggc

SEQ ID NO: 11599 - DNA, 21 bp, Homo sapiens
cacgcctcccgccccatgggc

SEQ ID NO: 11600 - DNA, 17 bp, Homo sapiens
ccacgcccctgctgcgg

SEQ ID NO: 11601 - DNA, 19 bp, Homo sapiens
cccatgccccccgccgggg

SEQ ID NO: 11602 - DNA, 17 bp, Homo sapiens
cgcctcccccgcctggc

SEQ ID NO: 11603 - DNA, 18 bp, Homo sapiens
cgcctcccgccacagggc

SEQ ID NO: 11604 - DNA, 26 bp, Homo sapiens
cccaggcctcccgctgtgtgatgggc

SEQ ID NO: 11605 - DNA, 22 bp, Homo sapiens
cccgcgcctcccctcgctcggc

SEQ ID NO: 11606 - DNA, 22 bp, Homo sapiens
cctgcgactcccgccgtcgggc

SEQ ID NO: 11607 - DNA, 21 bp, Homo sapiens
cccgccctcccgctcctaggc

SEQ ID NO: 11608 - DNA, 21 bp, Homo sapiens
cgctcctcccgctgcctcggc

SEQ ID NO: 11609 - DNA, 23 bp, Homo sapiens
cccacgccccctgctgcccacgc

SEQ ID NO: 11610 - DNA, 19 bp, Homo sapiens
cccgcgcctccccgtgccg

SEQ ID NO: 11611 - DNA, 17 bp, Homo sapiens
ccacgcctcccccgggg

SEQ ID NO: 11612 - DNA, 17 bp, Homo sapiens
ccccgcttcccgccgca

SEQ ID NO: 11613 - DNA, 65 bp, Camelpox virus
gaaaatttgtgagtatatcagatcatattataaagatgatataagttactttgaaacaggatttc

SEQ ID NO: 11614 - DNA, 24 bp, Camelpox virus
tgagtatatcagatcatattataa

SEQ ID NO: 11615 - DNA, 22 bp, Homo sapiens
tgagtatattggattagtcaca

SEQ ID NO: 11616 - DNA, 22 bp, Homo sapiens
gagtgtgcatgtcatattataa

SEQ ID NO: 11617 - DNA, 19 bp, Homo sapiens
agtatatcaactaattata

SEQ ID NO: 11618 - DNA, 20 bp, Homo sapiens
tgagtatacagaatacatat

SEQ ID NO: 11619 - DNA, 16 bp, Homo sapiens
tgagcattcatattat

SEQ ID NO: 11620 - DNA, 76 bp, Camelpox virus
gcaatgttaaagtgactcctccagattactcacctataatagcgagtattaaaggtaagagttatgacgcattagc

SEQ ID NO: 11621 - DNA, 77 bp, Camelpox virus
tatcaagatgtgtatatttgcgaaaattgtggagacatagcagcacaaatcaaaagtattaatacatgtcttagatg

SEQ ID NO: 11622 - DNA, 24 bp, Camelpox virus
cagcacaaatcaaaagtattaata

SEQ ID NO: 11623 - DNA, 18 bp, Homo sapiens
acacaaatcaaaatacca

SEQ ID NO: 11624 - DNA, 18 bp, Homo sapiens
agcacaaaccaaagacac

SEQ ID NO: 11625 - DNA, 19 bp, Homo sapiens
cagcacaatcaaatcagta

SEQ ID NO: 11626 - DNA, 23 bp, Homo sapiens
agcacattttaagaagtattaat

SEQ ID NO: 11627 - DNA, 19 bp, Homo sapiens
cagcacaaactagaaaata

SEQ ID NO: 11628 - DNA, 18 bp, Homo sapiens
cagtgcaattcaaaagca

SEQ ID NO: 11629 - DNA, 22 bp, Homo sapiens
cagcacaaatcaaagcccaata

SEQ ID NO: 11630 - DNA, 17 bp, Homo sapiens
cagtaaaatcaaaagca

SEQ ID NO: 11631 - DNA, 22 bp, Homo sapiens
cagcacaaataattaattaata

SEQ ID NO: 11632 - DNA, 20 bp, Homo sapiens
caggcaaatcaaaaccacca

SEQ ID NO: 11633 - DNA, 20 bp, Homo sapiens
cagcacaaatgggaagacca

SEQ ID NO: 11634 - DNA, 20 bp, Homo sapiens
cagcacaaatgcaggtagta

SEQ ID NO: 11635 - DNA, 18 bp, Homo sapiens
aacacaaatcaagtagta

SEQ ID NO: 11636 - DNA, 18 bp, Homo sapiens
cagcacaaatgcaataat

SEQ ID NO: 11637 - DNA, 19 bp, Homo sapiens
agcacagcatcaactagta

SEQ ID NO: 11638 - DNA, 23 bp, Homo sapiens
cagcacaaaatcgagaaataata

SEQ ID NO: 11639 - DNA, 18 bp, Homo sapiens
acacaaattaaaagatta

SEQ ID NO: 11640 - DNA, 20 bp, Homo sapiens
gccacaaatcaaaaggatta

SEQ ID NO: 11641 - DNA, 62 bp, Southern bean mosaic virus
gccgaggacttacttgacgaatctcctgtggacttggttcgcaggggtttgtgtgacccggt

SEQ ID NO: 11642 - DNA, 24 bp, Southern bean mosaic virus
acgaatctcctgtggacttggttc

SEQ ID NO: 11643 - DNA, 20 bp, Homo sapiens
gaattcttgtgggacagttc

SEQ ID NO: 11644 - DNA, 24 bp, Homo sapiens
cgggtctcctatgggtctgggttc

SEQ ID NO: 11645 - DNA, 15 bp, Homo sapiens
gaatcttgcttggtt

SEQ ID NO: 11646 - DNA, 18 bp, Homo sapiens
atctcctgggttcagttc

SEQ ID NO: 11647 - DNA, 17 bp, Homo sapiens
cttttatagcttggttc

SEQ ID NO: 11648 - DNA, 19 bp, Homo sapiens
cgagtctcctggggacgtg

SEQ ID NO: 11649 - DNA, 20 bp, Homo sapiens
gaatgtcctgtgggtagggt

SEQ ID NO: 11650 - DNA, 21 bp, Homo sapiens
acgggtctccgtcggcggttc

SEQ ID NO: 11651 - DNA, 18 bp, Homo sapiens
gaactcctgtgggcgggt

SEQ ID NO: 11652 - DNA, 16 bp, Homo sapiens
gagctcctgtggggct

SEQ ID NO: 11653 - DNA, 20 bp, Homo sapiens
cgggtttcctgtgaccgttc

SEQ ID NO: 11654 - DNA, 23 bp, Homo sapiens
gaacttcctcatagaatttggtt

SEQ ID NO: 11655 - DNA, 96 bp, Southern bean mosaic virus
gggctgatgtagagatgagaattgttctggggggctttggccataaactggctaaagccgcccagaataggttttcgtgtttcatgaactcagtct

SEQ ID NO: 11656 - DNA, 24 bp, Southern bean mosaic virus
aagccgcccagaataggttttcgt

SEQ ID NO: 11657 - DNA, 22 bp, Homo sapiens
agccacccagagtcctgctcgt

SEQ ID NO: 11658 - DNA, 19 bp, Homo sapiens
aagcttccagaagtattcg

SEQ ID NO: 11659 - DNA, 25 bp, Homo sapiens
aaaccagaacagggtaggtttttgt

SEQ ID NO: 11660 - DNA, 21 bp, Homo sapiens
aagccacccgggaggcttcgt

SEQ ID NO: 11661 - DNA, 18 bp, Homo sapiens
aagcctcccaggatggct

SEQ ID NO: 11662 - DNA, 18 bp, Homo sapiens
agccccctaggattccca

SEQ ID NO: 11663 - DNA, 18 bp, Homo sapiens
aagcccctcaggatacgt

SEQ ID NO: 11664 - DNA, 17 bp, Homo sapiens
agccgcccaggagtgct

SEQ ID NO: 11665 - DNA, 19 bp, Homo sapiens
agctgcctcaggtttttgt

SEQ ID NO: 11666 - DNA, 21 bp, Homo sapiens
agcccccagggtgcccctcgt

SEQ ID NO: 11667 - DNA, 20 bp, Homo sapiens
aagccgcccgggagggggct

SEQ ID NO: 11668 - DNA, 22 bp, Homo sapiens
gcctccagaatgctcgtttcgt

SEQ ID NO: 11669 - DNA, 20 bp, Homo sapiens
aagcctcctggaatgggacc

SEQ ID NO: 11670 - DNA, 65 bp, Infectious spleen and kidney necrosis virus
gtctggaccgcacagtgtgtgtggcaaaggcatcggcgttgcgacgcgcgctttgttcagcaggc

SEQ ID NO: 11671 - DNA, 24 bp, Infectious spleen and kidney necrosis virus
ccgcacagtgtgtgtggcaaaggc

SEQ ID NO: 11672 - DNA, 20 bp, Homo sapiens
gtatggtatgtactcaaggc

SEQ ID NO: 11673 - DNA, 19 bp, Homo sapiens
gcacagtaggtgcagaggc

SEQ ID NO: 11674 - DNA, 29 bp, Homo sapiens
ccccatagtgtgtgtgtttgtgcctttgc

SEQ ID NO: 11675 - DNA, 18 bp, Homo sapiens
gtgtgtgtggacagaagg

SEQ ID NO: 11676 - DNA, 21 bp, Homo sapiens
ccttatagtgtgtgtgggggg

SEQ ID NO: 11677 - DNA, 21 bp, Homo sapiens
gcgtcagagtgtggcagaggc

SEQ ID NO: 11678 - DNA, 21 bp, Homo sapiens
ccgtggtgcaaaggcagaggc

SEQ ID NO: 11679 - DNA, 22 bp, Homo sapiens
ccgtgcatgtgtgtgtcaaggc

SEQ ID NO: 11680 - DNA, 24 bp, Homo sapiens
ccgtgtgtgtgtgtgtgtccaggc

SEQ ID NO: 11681 - DNA, 23 bp, Homo sapiens
gcaaggtgtgtgtgtgtgccttg

SEQ ID NO: 11682 - DNA, 16 bp, Homo sapiens
ccacacgtggcaaggg

SEQ ID NO: 11683 - DNA, 20 bp, Homo sapiens
cacagtgtgagatgagaggc

SEQ ID NO: 11684 - DNA, 23 bp, Homo sapiens
ccgcacagtggatccctggaggc

SEQ ID NO: 11685 - DNA, 20 bp, Homo sapiens
gctggtgcgtgggcggaggc

SEQ ID NO: 11686 - DNA, 22 bp, Homo sapiens
gcatggtgtgcctatctgaagg

SEQ ID NO: 11687 - DNA, 25 bp, Homo sapiens
ccgtgtgtgtgcagggagcggaggc

SEQ ID NO: 11688 - DNA, 18 bp, Homo sapiens
gtataatgtggcaaaggc

SEQ ID NO: 11689 - DNA, 19 bp, Homo sapiens
gtatgtgtgtgcagggagg

SEQ ID NO: 11690 - DNA, 18 bp, Homo sapiens
gcacagttttcataaagg

SEQ ID NO: 11691 - DNA, 16 bp, Homo sapiens
gcagtgtgtgccaagg

SEQ ID NO: 11692 - DNA, 21 bp, Homo sapiens
gcacagtgtggaaacggaggc

SEQ ID NO: 11693 - DNA, 19 bp, Homo sapiens
ccccacagtgtgtccgggg

SEQ ID NO: 11694 - DNA, 18 bp, Homo sapiens
gcacgctgtgaacaaaag

SEQ ID NO: 11695 - DNA, 19 bp, Homo sapiens
gcacggtgtgtgggggagc

SEQ ID NO: 11696 - DNA, 17 bp, Homo sapiens
gcaagtgtgtgggaggc

SEQ ID NO: 11697 - DNA, 20 bp, Homo sapiens
gtgaggggatgtggcaaagg

SEQ ID NO: 11698 - DNA, 18 bp, Homo sapiens
gcacatgtaggttggagg

SEQ ID NO: 11699 - DNA, 19 bp, Homo sapiens
gcagcagtgtgtagaaggc

SEQ ID NO: 11700 - DNA, 20 bp, Homo sapiens
gcacagtgctgcaggggggc

SEQ ID NO: 11701 - DNA, 23 bp, Homo sapiens
gcacactgtgtgtgtgtgccttg

SEQ ID NO: 11702 - DNA, 20 bp, Homo sapiens
gcgtatgtagcactgggggc

SEQ ID NO: 11703 - DNA, 24 bp, Homo sapiens
cacatagctgacctgtggcagagg

SEQ ID NO: 11704 - DNA, 20 bp, Homo sapiens
cacagtgtcgactcgggggc

SEQ ID NO: 11705 - DNA, 19 bp, Homo sapiens
cgcagtgtgtaaaaaaggc

SEQ ID NO: 11706 - DNA, 21 bp, Homo sapiens
gtgtgtgtgaacacggggggc

SEQ ID NO: 11707 - DNA, 21 bp, Homo sapiens
gcacagtgtgtgttcccgggc

SEQ ID NO: 11708 - DNA, 21 bp, Homo sapiens
ccgcacagggctggtgaaggc

SEQ ID NO: 11709 - DNA, 23 bp, Homo sapiens
cagcatggcagggtggcgggggc

SEQ ID NO: 11710 - DNA, 21 bp, Homo sapiens
cgcagagtgtgtggcatgggc

SEQ ID NO: 11711 - DNA, 18 bp, Homo sapiens
cagcgtggtgttcaaagg

SEQ ID NO: 11712 - DNA, 22 bp, Homo sapiens
gcgccgtgtgtgggcagtgagg

SEQ ID NO: 11713 - DNA, 17 bp, Homo sapiens
gcacagtgtaacagagg

SEQ ID NO: 11714 - DNA, 24 bp, Homo sapiens
gcatgtgtgtgtgtatgtgccttg

SEQ ID NO: 11715 - DNA, 25 bp, Homo sapiens
gcacaatggccatggtggcagaggc

SEQ ID NO: 11716 - DNA, 23 bp, Homo sapiens
cctacagtgtggccatcaaaggc

SEQ ID NO: 11717 - DNA, 17 bp, Homo sapiens
cacgtggctggcagggg

SEQ ID NO: 11718 - DNA, 19 bp, Homo sapiens
cacagtgtaatcacaaggg

SEQ ID NO: 11719 - DNA, 18 bp, Homo sapiens
gtattgtgtggcaggggc

SEQ ID NO: 11720 - DNA, 19 bp, Homo sapiens
gcagatgagctggcaaagg

SEQ ID NO: 11721 - DNA, 21 bp, Homo sapiens
ccatggtgcacgagcaggggc

SEQ ID NO: 11722 - DNA, 20 bp, Homo sapiens
gccccaggtgtggcaggggc

SEQ ID NO: 11723 - DNA, 21 bp, Homo sapiens
ccgtcacaactgtggcaaggg

SEQ ID NO: 11724 - DNA, 21 bp, Homo sapiens
gcttagtgtgtggaccaaggc

SEQ ID NO: 11725 - DNA, 18 bp, Homo sapiens
gcacgtgtgactcggagg

SEQ ID NO: 11726 - DNA, 19 bp, Homo sapiens
caggtgtgtagctggaagg

SEQ ID NO: 11727 - DNA, 24 bp, Homo sapiens
ccacacagtggtctgagcagaggc

SEQ ID NO: 11728 - DNA, 21 bp, Homo sapiens
gcgtgaagtgtgtggcagagg

SEQ ID NO: 11729 - DNA, 18 bp, Homo sapiens
aggctgtgtggcaagggc

SEQ ID NO: 11730 - DNA, 18 bp, Homo sapiens
gtgtggtgtgggaagggc

SEQ ID NO: 11731 - DNA, 21 bp, Homo sapiens
ccgtgcagtgtgtgtccacgg

SEQ ID NO: 11732 - DNA, 17 bp, Homo sapiens
acagtgtgggcatgagg

SEQ ID NO: 11733 - DNA, 21 bp, Homo sapiens
ccgtcagtggcccgtgagggc

SEQ ID NO: 11734 - DNA, 20 bp, Homo sapiens
gtgtgtgccagggcaggggc

SEQ ID NO: 11735 - DNA, 18 bp, Homo sapiens
ccgcacagcgtgcaaagg

SEQ ID NO: 11736 - DNA, 17 bp, Homo sapiens
gcatgtgtgcgaaaagg

SEQ ID NO: 11737 - DNA, 18 bp, Homo sapiens
ccgagcggtgtgcagggg

SEQ ID NO: 11738 - DNA, 16 bp, Homo sapiens
gcacagttggcaaagg

SEQ ID NO: 11739 - DNA, 25 bp, Homo sapiens
ccgtgagtgtgtgtgtggtgccttg

SEQ ID NO: 11740 - DNA, 25 bp, Homo sapiens
acagtgtgatgtgaagcgcctttgc

SEQ ID NO: 11741 - DNA, 20 bp, Homo sapiens
ccgacggtggctggcggggg

SEQ ID NO: 11742 - DNA, 20 bp, Homo sapiens
gcacagcggccgggcagagg

SEQ ID NO: 11743 - DNA, 18 bp, Homo sapiens
gcacagtgtaactggagg

SEQ ID NO: 11744 - DNA, 18 bp, Homo sapiens
cagcttgtgtggcagagg

SEQ ID NO: 11745 - DNA, 17 bp, Homo sapiens
cagttttgggcaaaggc

SEQ ID NO: 11746 - DNA, 18 bp, Homo sapiens
cccacagattggcaaggg

SEQ ID NO: 11747 - DNA, 19 bp, Homo sapiens
ccgggtggtgtgcaagggg

SEQ ID NO: 11748 - DNA, 20 bp, Homo sapiens
gcacatgtgggggtgggggc

SEQ ID NO: 11749 - DNA, 20 bp, Homo sapiens
gcacagtgtctgtctctggc

SEQ ID NO: 11750 - DNA, 22 bp, Homo sapiens
cgcacgtgagcttggtggaggc

SEQ ID NO: 11751 - DNA, 20 bp, Homo sapiens
gcacgggtgctggcaggggc

SEQ ID NO: 11752 - DNA, 18 bp, Homo sapiens
caggtatctggcaaaggc

SEQ ID NO: 11753 - DNA, 22 bp, Homo sapiens
gtgcagtgtagcaactgaaggc

SEQ ID NO: 11754 - DNA, 18 bp, Homo sapiens
gcactgtgtgcagaaagg

SEQ ID NO: 11755 - DNA, 20 bp, Homo sapiens
gcacagtgtggagcaggggc

SEQ ID NO: 11756 - DNA, 20 bp, Homo sapiens
gctacagtctcggcaaaggc

SEQ ID NO: 11757 - DNA, 25 bp, Homo sapiens
ccgcgcgcggtccacgtggcagagg

SEQ ID NO: 11758 - DNA, 21 bp, Homo sapiens
cagtacagtgtggcagaaggc

SEQ ID NO: 11759 - DNA, 19 bp, Homo sapiens
ccttacagtgtgaaccagg

SEQ ID NO: 11760 - DNA, 66 bp, Infectious spleen and kidney necrosis virus
gtgtctatgccacgttgctcgcacatgcgtatcacagtacgcgtagccataaccttacactcacgc

SEQ ID NO: 11761 - DNA, 24 bp, Infectious spleen and kidney necrosis virus
tatgccacgttgctcgcacatgcg

SEQ ID NO: 11762 - DNA, 17 bp, Homo sapiens
acgtgcacacacgtgca

SEQ ID NO: 11763 - DNA, 20 bp, Homo sapiens
tatgtatatgcacacacgca

SEQ ID NO: 11764 - DNA, 16 bp, Homo sapiens
tgccatctgcacatgc

SEQ ID NO: 11765 - DNA, 73 bp, Southern bean mosaic virus
cggctgtttgttaagcaggagccccacgcctcccgaaaggtgagagagggccgcttccgcttgatatcatctg

SEQ ID NO: 11766 - DNA, 24 bp, Southern bean mosaic virus
aagcaggagccccacgcctcccga

SEQ ID NO: 11767 - DNA, 17 bp, Homo sapiens
agcaggagcctcactct

SEQ ID NO: 11768 - DNA, 21 bp, Homo sapiens
aaacaggagctccggccagcc

SEQ ID NO: 11769 - DNA, 20 bp, Homo sapiens
gcagggcccgggcctcccga

SEQ ID NO: 11770 - DNA, 20 bp, Homo sapiens
agcagggccccgcgcctccc

SEQ ID NO: 11771 - DNA, 19 bp, Homo sapiens
agccaggaactgcctcccg

SEQ ID NO: 11772 - DNA, 19 bp, Homo sapiens
gcagcagccccccgacccg

SEQ ID NO: 11773 - DNA, 17 bp, Homo sapiens
gaaggacccgcctcccg

SEQ ID NO: 11774 - DNA, 18 bp, Homo sapiens
agcagagccggcctcccg

SEQ ID NO: 11775 - DNA, 18 bp, Homo sapiens
agcaagggccccacggcc

SEQ ID NO: 11776 - DNA, 17 bp, Homo sapiens
aagtgggagcctcccaa

SEQ ID NO: 11777 - DNA, 20 bp, Homo sapiens
aagcaggagttcccccttac

SEQ ID NO: 11778 - DNA, 17 bp, Homo sapiens
gcaggagctcctcctcc

SEQ ID NO: 11779 - DNA, 20 bp, Homo sapiens
gcaggagccacagcgcccga

SEQ ID NO: 11780 - DNA, 17 bp, Homo sapiens
gccgggcccgcctcccg

SEQ ID NO: 11781 - DNA, 19 bp, Homo sapiens
aagcagcagccctagctct

SEQ ID NO: 11782 - DNA, 20 bp, Homo sapiens
gcaggagcccccaggtcccg

SEQ ID NO: 11783 - DNA, 16 bp, Homo sapiens
aagcaggagccacctc

SEQ ID NO: 11784 - DNA, 19 bp, Homo sapiens
agggggagccccgcgctct

SEQ ID NO: 11785 - DNA, 22 bp, Homo sapiens
aaccgggggccccacggtctcc

SEQ ID NO: 11786 - DNA, 21 bp, Homo sapiens
gcggcggccccacggcagcct

SEQ ID NO: 11787 - DNA, 20 bp, Homo sapiens
gcagtgagcctcctagcccc

SEQ ID NO: 11788 - DNA, 15 bp, Homo sapiens
gcaggaggcctcccg

SEQ ID NO: 11789 - DNA, 23 bp, Homo sapiens
aagcaggagcccttggtggaccc

SEQ ID NO: 11790 - DNA, 20 bp, Homo sapiens
aagcaggagcctcactgtcc

SEQ ID NO: 11791 - DNA, 23 bp, Homo sapiens
agcaggagcctctacacagcctc

SEQ ID NO: 11792 - DNA, 17 bp, Homo sapiens
ggagccaccacctcccg

SEQ ID NO: 11793 - DNA, 19 bp, Homo sapiens
aggaggagccctcctctcc

SEQ ID NO: 11794 - DNA, 18 bp, Homo sapiens
gcaggagcgcccccgcct

SEQ ID NO: 11795 - DNA, 18 bp, Homo sapiens
aagcaggatccccactgc

SEQ ID NO: 11796 - DNA, 19 bp, Homo sapiens
gcaggagccctccatgcct

SEQ ID NO: 11797 - DNA, 22 bp, Homo sapiens
aagcaggaagcccagagcctcc

SEQ ID NO: 11798 - DNA, 21 bp, Homo sapiens
gcaggagcttcttcaggcccc

SEQ ID NO: 11799 - DNA, 22 bp, Homo sapiens
aagcaggaagcctcaggcactc

SEQ ID NO: 11800 - DNA, 24 bp, Homo sapiens
aagcaagagccccaggccctctcc

SEQ ID NO: 11801 - DNA, 23 bp, Homo sapiens
aggagcaaagcccgcgcctcccg

SEQ ID NO: 11802 - DNA, 17 bp, Homo sapiens
gcaggagcgctttcccg

SEQ ID NO: 11803 - DNA, 20 bp, Homo sapiens
agtcaggagcccccgacccg

SEQ ID NO: 11804 - DNA, 17 bp, Homo sapiens
gcagggcccgcctcccg

SEQ ID NO: 11805 - DNA, 18 bp, Homo sapiens
ggacaggagcctcccccg

SEQ ID NO: 11806 - DNA, 18 bp, Homo sapiens
aaccagggctgcctcccg

SEQ ID NO: 11807 - DNA, 17 bp, Homo sapiens
gcagcggccgcctcccg

SEQ ID NO: 11808 - DNA, 22 bp, Homo sapiens
agggggagccccgcccgccccg

SEQ ID NO: 11809 - DNA, 22 bp, Homo sapiens
agcaggagctgtgcactcctga

SEQ ID NO: 11810 - DNA, 23 bp, Homo sapiens
aagcaggaaccctcacaacccga

SEQ ID NO: 11811 - DNA, 21 bp, Homo sapiens
gcggtggccccacgagtgcct

SEQ ID NO: 11812 - DNA, 17 bp, Homo sapiens
aagaggagccccactct

SEQ ID NO: 11813 - DNA, 24 bp, Homo sapiens
aggaggggctccaggccttttcga

SEQ ID NO: 11814 - DNA, 22 bp, Homo sapiens
gcaggagctgcagccgtttccg

SEQ ID NO: 11815 - DNA, 18 bp, Homo sapiens
agcagcagtccccagcct

SEQ ID NO: 11816 - DNA, 22 bp, Homo sapiens
aagcaggagtcctggtttcctc

SEQ ID NO: 11817 - DNA, 18 bp, Homo sapiens
agcgggagcccctgcccc

SEQ ID NO: 11818 - DNA, 19 bp, Homo sapiens
ggctcccccacgcctcccg

SEQ ID NO: 11819 - DNA, 20 bp, Homo sapiens
gcaggagccacacgtgcccc

SEQ ID NO: 11820 - DNA, 17 bp, Homo sapiens
agcaggagctccacccg

SEQ ID NO: 11821 - DNA, 19 bp, Homo sapiens
agcaggagcctcatactct

SEQ ID NO: 11822 - DNA, 21 bp, Homo sapiens
aggaggggcctagcctcccga

SEQ ID NO: 11823 - DNA, 20 bp, Homo sapiens
gccggagccccggtgcccga

SEQ ID NO: 11824 - DNA, 21 bp, Homo sapiens
gcggggggtccccgcctcccg

SEQ ID NO: 11825 - DNA, 19 bp, Homo sapiens
agcaggaggccctgagcct

SEQ ID NO: 11826 - DNA, 19 bp, Homo sapiens
agggcgcccgtgcctcccg

SEQ ID NO: 11827 - DNA, 22 bp, Homo sapiens
agcaggagccccggccccgcga

SEQ ID NO: 11828 - DNA, 19 bp, Homo sapiens
aagcaggagcaccgttcct

SEQ ID NO: 11829 - DNA, 19 bp, Homo sapiens
ggacagggtgcccacgcct

SEQ ID NO: 11830 - DNA, 18 bp, Homo sapiens
agcagaaggagcttcccg

SEQ ID NO: 11831 - DNA, 20 bp, Homo sapiens
gcaggaacctttacacttcc

SEQ ID NO: 11832 - DNA, 17 bp, Homo sapiens
agcaaggagtcctcccg

SEQ ID NO: 11833 - DNA, 20 bp, Homo sapiens
gcgggagccccgccctccca

SEQ ID NO: 11834 - DNA, 20 bp, Homo sapiens
gcaggagccccgccctccca

SEQ ID NO: 11835 - DNA, 20 bp, Homo sapiens
agcaggagctcagagagcct

SEQ ID NO: 11836 - DNA, 19 bp, Homo sapiens
agcaggagccaccatcctc

SEQ ID NO: 11837 - DNA, 18 bp, Homo sapiens
aagcaggaccccacaact

SEQ ID NO: 11838 - DNA, 23 bp, Homo sapiens
agtaggggctgggccgcctcccg

SEQ ID NO: 11839 - DNA, 17 bp, Homo sapiens
aagcaggaggcctaaca

SEQ ID NO: 11840 - DNA, 19 bp, Homo sapiens
agcaggagcacctggcccc

SEQ ID NO: 11841 - DNA, 19 bp, Homo sapiens
agctaggagccctgtcccc

SEQ ID NO: 11842 - DNA, 23 bp, Homo sapiens
gcgggagccccgcgatttcctcg

SEQ ID NO: 11843 - DNA, 16 bp, Homo sapiens
aagcagagcctcccaa

SEQ ID NO: 11844 - DNA, 20 bp, Homo sapiens
aagcgtgagtccatcgttcc

SEQ ID NO: 11845 - DNA, 23 bp, Homo sapiens
agcagggaccgctgtgcctcccg

SEQ ID NO: 11846 - DNA, 18 bp, Homo sapiens
gcaggagccaccacgccc

SEQ ID NO: 11847 - DNA, 21 bp, Homo sapiens
aagcaggagctcaatacacct

SEQ ID NO: 11848 - DNA, 19 bp, Homo sapiens
aacaggagccctagaacct

SEQ ID NO: 11849 - DNA, 17 bp, Homo sapiens
gcaggagccccggcttc

SEQ ID NO: 11850 - DNA, 71 bp, Southern bean mosaic virus
caaccatttccggtcgcttatacgaggtagagttctgctctcacgttataagggaagatcgatgttggttg

SEQ ID NO: 11851 - DNA, 23 bp, Southern bean mosaic virus
taagggaagatcgatgttggttg

SEQ ID NO: 11852 - DNA, 21 bp, Homo sapiens
gggaagatcggtttcctgttg

SEQ ID NO: 11853 - DNA, 18 bp, Homo sapiens
taagggaagttctaggtt

SEQ ID NO: 11854 - DNA, 19 bp, Homo sapiens
aggggggatatgctggttg

SEQ ID NO: 11855 - DNA, 19 bp, Homo sapiens
agggaagtttggttggttg

SEQ ID NO: 11856 - DNA, 20 bp, Homo sapiens
aggtgagactgtgttggttg

SEQ ID NO: 11857 - DNA, 21 bp, Homo sapiens
agggggagggcgagctggttg

SEQ ID NO: 11858 - DNA, 16 bp, Homo sapiens
aggggagagtcggtca

SEQ ID NO: 11859 - DNA, 20 bp, Homo sapiens
aaggggctctatgttggttg

SEQ ID NO: 11860 - DNA, 17 bp, Homo sapiens
taacggaagggttggtt

SEQ ID NO: 11861 - DNA, 109 bp, Infectious spleen and kidney necrosis virus
tctccactctctcggtgttccagaggcatgtcctcaatgctggtatactcaatggcgttatcaaagccgtgggccagcgtgtcctgggacagttgcaagggtgtgatga

SEQ ID NO: 11862 - DNA, 24 bp, Infectious spleen and kidney necrosis virus
tcggtgttccagaggcatgtcctc

SEQ ID NO: 11863 - DNA, 23 bp, Homo sapiens
tcagtgttctgagttcatgtcct

SEQ ID NO: 11864 - DNA, 17 bp, Homo sapiens
tcggtgtccaggagtct

SEQ ID NO: 11865 - DNA, 19 bp, Homo sapiens
tcggttttcagcaggttct

SEQ ID NO: 11866 - DNA, 18 bp, Homo sapiens
ggtgggaggcatgtcctc

SEQ ID NO: 11867 - DNA, 22 bp, Homo sapiens
tcgttgagatcaggcatgtcct

SEQ ID NO: 11868 - DNA, 20 bp, Homo sapiens
ggtgtttcatacctttcctc

SEQ ID NO: 11869 - DNA, 18 bp, Homo sapiens
tgttccaacagctgttct

SEQ ID NO: 11870 - DNA, 18 bp, Homo sapiens
tcggtgtttaggtcagtc

SEQ ID NO: 11871 - DNA, 22 bp, Homo sapiens
tcagtgtttttcctgtcatgtc

SEQ ID NO: 11872 - DNA, 21 bp, Homo sapiens
cgggcagactaggggcatgtc

SEQ ID NO: 11873 - DNA, 23 bp, Homo sapiens
tcagtgtttcagggactgtcttc

SEQ ID NO: 11874 - DNA, 67 bp, Infectious spleen and kidney necrosis virus
gtcaggacccctttggtccatgtcgcgcgggtcctccggttcaggcaggcgtctgaaggggcttgac

SEQ ID NO: 11875 - DNA, 24 bp, Infectious spleen and kidney necrosis virus
acccctttggtccatgtcgcgcgg

SEQ ID NO: 11876 - DNA, 17 bp, Homo sapiens
cctttagtctgtgtaca

SEQ ID NO: 11877 - DNA, 125 bp, Human herpesvirus 8
ttcccggggaggagggcaccaggttcccggggaggagggcaccaggttcccggggaggagggcaccaggttcccggggaggagggcaccaggttcccggggaggagggcaccaggttcccgggga

SEQ ID NO: 11878 - DNA, 24 bp, Human herpesvirus 8
ttcccggggaggagggcaccaggt

SEQ ID NO: 11879 - DNA, 19 bp, Homo sapiens
ctccacggggggcaccagg

SEQ ID NO: 11880 - DNA, 16 bp, Homo sapiens
ggggaagagaggaggt

SEQ ID NO: 11881 - DNA, 21 bp, Homo sapiens
ttcccggggggaggaccaggt

SEQ ID NO: 11882 - DNA, 16 bp, Homo sapiens
ttctcgggaagggcag

SEQ ID NO: 11883 - DNA, 18 bp, Homo sapiens
ttcctcggggacaccagg

SEQ ID NO: 11884 - DNA, 19 bp, Homo sapiens
ttcctggtgaggagggtcc

SEQ ID NO: 11885 - DNA, 21 bp, Homo sapiens
ttcctgggaggaggtgtgggt

SEQ ID NO: 11886 - DNA, 23 bp, Homo sapiens
tccccggggggtgcctgctgggt

SEQ ID NO: 11887 - DNA, 24 bp, Homo sapiens
ttctgggagagcaatacatcaggt

SEQ ID NO: 11888 - DNA, 19 bp, Homo sapiens
tccctggggaggagggaag

SEQ ID NO: 11889 - DNA, 26 bp, Homo sapiens
ttcctggggaggaggaggcaccgggt

SEQ ID NO: 11890 - DNA, 21 bp, Homo sapiens
ccagaaagaggggtgccaggt

SEQ ID NO: 11891 - DNA, 102 bp, Paramecium bursaria Chlorella virus 1
cacctctccatagttgcaaatacgctacgaaatgcccaaggacattgactaaacgtgtttctaaaatgttggccgcgtgtgtagggttttcagagggaggtg

SEQ ID NO: 11892 - DNA, 24 bp, Paramecium bursaria Chlorella virus 1
taaaatgttggccgcgtgtgtagg

SEQ ID NO: 11893 - DNA, 20 bp, Homo sapiens
tgttggccacgaaagacagg

SEQ ID NO: 11894 - DNA, 23 bp, Homo sapiens
taaaatgttggctggagtagagg

SEQ ID NO: 11895 - DNA, 20 bp, Homo sapiens
aaatcttggcaatgtgtagg

SEQ ID NO: 11896 - DNA, 20 bp, Homo sapiens
atataggctgtgtgtgtagg

SEQ ID NO: 11897 - DNA, 17 bp, Homo sapiens
atgttggccaaagtagg

SEQ ID NO: 11898 - DNA, 18 bp, Homo sapiens
taaaatgttggctgtgtg

SEQ ID NO: 11899 - DNA, 25 bp, Homo sapiens
aaaatgttcattgggtgtgtgtggg

SEQ ID NO: 11900 - DNA, 16 bp, Homo sapiens
taaaatgtgggctgca

SEQ ID NO: 11901 - DNA, 17 bp, Homo sapiens
gttggttcatgtgtagg

SEQ ID NO: 11902 - DNA, 22 bp, Homo sapiens
aaatgttgccgtgtcctgcagg

SEQ ID NO: 11903 - DNA, 19 bp, Homo sapiens
aatgttggccgctttgagg

SEQ ID NO: 11904 - DNA, 84 bp, Human herpesvirus 8
tacccagccgggtttacgcagctgcgtatacccagctgtgtttacgcagcggggtttacgcagctgggtagacccagctgggta

SEQ ID NO: 11905 - DNA, 24 bp, Human herpesvirus 8
acgcagctgcgtatacccagctgt

SEQ ID NO: 11906 - DNA, 17 bp, Homo sapiens
cggggctggcccagctg

SEQ ID NO: 11907 - DNA, 18 bp, Homo sapiens
gcgggctgcgtatgccca

SEQ ID NO: 11908 - DNA, 19 bp, Homo sapiens
cgcagttgtccccagctgt

SEQ ID NO: 11909 - DNA, 21 bp, Homo sapiens
acgcagacaatgtccagttgt

SEQ ID NO: 11910 - DNA, 23 bp, Homo sapiens
cgcggctgctccggcccagctgt

SEQ ID NO: 11911 - DNA, 20 bp, Homo sapiens
gcacctgtggtcccagctgt

SEQ ID NO: 11912 - DNA, 20 bp, Homo sapiens
gcagctggctgcccagctgt

SEQ ID NO: 11913 - DNA, 20 bp, Homo sapiens
gccagctgccttccagctgt

SEQ ID NO: 11914 - DNA, 19 bp, Homo sapiens
gctgcactcacccagctgt

SEQ ID NO: 11915 - DNA, 19 bp, Homo sapiens
gcagctgctagtcagctgt

SEQ ID NO: 11916 - DNA, 19 bp, Homo sapiens
gcagcccctgcccagctgt

SEQ ID NO: 11917 - DNA, 24 bp, Homo sapiens
accagttgccaaggacccagctgt

SEQ ID NO: 11918 - DNA, 20 bp, Homo sapiens
cggggctgctggccagctgt

SEQ ID NO: 11919 - DNA, 23 bp, Homo sapiens
acgcagctgtgtctgacctctgt

SEQ ID NO: 11920 - DNA, 21 bp, Homo sapiens
gctgcatgtgtgtccagctgt

SEQ ID NO: 11921 - DNA, 18 bp, Homo sapiens
gcagctgcgtatgcccag

SEQ ID NO: 11922 - DNA, 17 bp, Homo sapiens
gcagctgcgccagctgt

SEQ ID NO: 11923 - DNA, 21 bp, Homo sapiens
cgcagtgaccgttccagctgt

SEQ ID NO: 11924 - DNA, 18 bp, Homo sapiens
acatggcatgcccagctg

SEQ ID NO: 11925 - DNA, 17 bp, Homo sapiens
cacagctgtcccagttg

SEQ ID NO: 11926 - DNA, 23 bp, Homo sapiens
acgcagctgctgttaaatgctgt

SEQ ID NO: 11927 - DNA, 116 bp, Human herpesvirus 8
gaaggagggttgaatacagttgggggtagtccgctggtattcccagctgaggttgccttatttggtaatgcttccggaaataccacctgagtaccccattggtttataccttgttt

SEQ ID NO: 11928 - DNA, 24 bp, Human herpesvirus 8
tggtattcccagctgaggttgcct

SEQ ID NO: 11929 - DNA, 19 bp, Homo sapiens
tgggttcccagctccagcc

SEQ ID NO: 11930 - DNA, 19 bp, Homo sapiens
tggtttttctggctgagat

SEQ ID NO: 11931 - DNA, 21 bp, Homo sapiens
tgggttcctttttggttgcct

SEQ ID NO: 11932 - DNA, 20 bp, Homo sapiens
tggtacttctggctgaggct

SEQ ID NO: 11933 - DNA, 19 bp, Homo sapiens
tggtattcctagctgaaat

SEQ ID NO: 11934 - DNA, 17 bp, Homo sapiens
tggtgtcccagctgggt

SEQ ID NO: 11935 - DNA, 23 bp, Homo sapiens
tggtgtctcagctaagaatgcct

SEQ ID NO: 11936 - DNA, 22 bp, Homo sapiens
tggtaatcgctagaggttgcct

SEQ ID NO: 11937 - DNA, 19 bp, Homo sapiens
ggtattcctaaaaagttgc

SEQ ID NO: 11938 - DNA, 20 bp, Homo sapiens
tggtatccttggcttcagtc

SEQ ID NO: 11939 - DNA, 19 bp, Homo sapiens
tgatattcttagctgtgtt

SEQ ID NO: 11940 - DNA, 21 bp, Homo sapiens
tggttttctgactagttgcct

SEQ ID NO: 11941 - DNA, 21 bp, Homo sapiens
tggtatttccacatcatgcct

SEQ ID NO: 11942 - DNA, 21 bp, Homo sapiens
ggtattctcttatggttgtct

SEQ ID NO: 11943 - DNA, 18 bp, Homo sapiens
gtattcccagccctttgc

SEQ ID NO: 11944 - DNA, 22 bp, Homo sapiens
tggactcattggctgaggttgc

SEQ ID NO: 11945 - DNA, 15 bp, Homo sapiens
tagtattcccggttg

SEQ ID NO: 11946 - DNA, 19 bp, Homo sapiens
ggtattggtctgaggttgc

SEQ ID NO: 11947 - DNA, 20 bp, Homo sapiens
gtattcccagcttcaaggcc

SEQ ID NO: 11948 - DNA, 18 bp, Homo sapiens
tggtcttccagaggttgc

SEQ ID NO: 11949 - DNA, 22 bp, Homo sapiens
tggactcactggctgaggttgc

SEQ ID NO: 11950 - DNA, 94 bp, Human herpesvirus 8
gtgggcgccgcgcgcgtgctctctcagtcgcgcctagctgcttccaacagacaaaagcggggcgttagtgagggagtgcgcgcgctgcgctgac

SEQ ID NO: 11951 - DNA, 21 bp, Human herpesvirus 8
gagtgcgcgcgctgcgctgac

SEQ ID NO: 11952 - DNA, 17 bp, Homo sapiens
gagggccggctgcgctg

SEQ ID NO: 11953 - DNA, 18 bp, Homo sapiens
gagtgcgctgctgtgcga

SEQ ID NO: 11954 - DNA, 18 bp, Homo sapiens
gagctgcgccctgtgctg

SEQ ID NO: 11955 - DNA, 16 bp, Homo sapiens
gaggcggcccgcgctg

SEQ ID NO: 11956 - DNA, 18 bp, Homo sapiens
gtaggctgctgcgctgac

SEQ ID NO: 11957 - DNA, 20 bp, Homo sapiens
gagtgcggcgcgacgctgac

SEQ ID NO: 11958 - DNA, 16 bp, Homo sapiens
atgtgcacgctgctga

SEQ ID NO: 11959 - DNA, 16 bp, Homo sapiens
gagtgggcaacgctga

SEQ ID NO: 11960 - DNA, 20 bp, Homo sapiens
gagtgcgcgccgacagctga

SEQ ID NO: 11961 - DNA, 17 bp, Homo sapiens
gactgcgcccggcgctg

SEQ ID NO: 11962 - DNA, 18 bp, Homo sapiens
gtgccacccgtgcgctga

SEQ ID NO: 11963 - DNA, 21 bp, Homo sapiens
agtgcgcgcgagacggcgctg

SEQ ID NO: 11964 - DNA, 18 bp, Homo sapiens
gagtgcgccggccggctg

SEQ ID NO: 11965 - DNA, 19 bp, Homo sapiens
gaggcgcgcgcgaggtggc

SEQ ID NO: 11966 - DNA, 19 bp, Homo sapiens
gagccctggcgctgcgctg

SEQ ID NO: 11967 - DNA, 18 bp, Homo sapiens
gcgcgcgcactcccgctg

SEQ ID NO: 11968 - DNA, 18 bp, Homo sapiens
ggtgcgcgccaagctggc

SEQ ID NO: 11969 - DNA, 17 bp, Homo sapiens
gcgcgcgcggacgtgac

SEQ ID NO: 11970 - DNA, 19 bp, Homo sapiens
gcgtgcgcgccccgctgac

SEQ ID NO: 11971 - DNA, 18 bp, Homo sapiens
gagcgcgcgcgctggagc

SEQ ID NO: 11972 - DNA, 20 bp, Homo sapiens
gaggcgcagcccgcgctgac

SEQ ID NO: 11973 - DNA, 16 bp, Homo sapiens
gtgccgccgcgcctga

SEQ ID NO: 11974 - DNA, 18 bp, Homo sapiens
atgctgacgtgcgctgac

SEQ ID NO: 11975 - DNA, 17 bp, Homo sapiens
gtggcgctgcagctgac

SEQ ID NO: 11976 - DNA, 20 bp, Homo sapiens
gagtgcgcgggccagcggac

SEQ ID NO: 11977 - DNA, 19 bp, Homo sapiens
gactgcaggtctgcgctga

SEQ ID NO: 11978 - DNA, 18 bp, Homo sapiens
gagggcagactgcgctga

SEQ ID NO: 11979 - DNA, 18 bp, Homo sapiens
gtggccgcgccgtgctga

SEQ ID NO: 11980 - DNA, 16 bp, Homo sapiens
tgcgcgcgtccctgac

SEQ ID NO: 11981 - DNA, 19 bp, Homo sapiens
gagcgcgcgcgcgtgtggc

SEQ ID NO: 11982 - DNA, 21 bp, Homo sapiens
gagggcgcgcgccagcttctg

SEQ ID NO: 11983 - DNA, 17 bp, Homo sapiens
aagtcgcagctgcgctg

SEQ ID NO: 11984 - DNA, 19 bp, Homo sapiens
gagtgcgctcagccctggc

SEQ ID NO: 11985 - DNA, 18 bp, Homo sapiens
gaggcgcgggccgcgctg

SEQ ID NO: 11986 - DNA, 16 bp, Homo sapiens
gaggctcactgcgctg

SEQ ID NO: 11987 - DNA, 18 bp, Homo sapiens
gagtggcgcgctgtcgtg

SEQ ID NO: 11988 - DNA, 22 bp, Homo sapiens
gagtgcgctgaggacagctggc

SEQ ID NO: 11989 - DNA, 72 bp, Human herpesvirus 8
aaagactcgctcaacagcccgaaaaccatcagcccgaccgccgatggattaggtgctgctggacaagtcttt

SEQ ID NO: 11990 - DNA, 24 bp, Human herpesvirus 8
tggattaggtgctgctggacaagt

SEQ ID NO: 11991 - DNA, 22 bp, Homo sapiens
tggtttgggattctggacaagt

SEQ ID NO: 11992 - DNA, 18 bp, Homo sapiens
tgggataggtgctgctgg

SEQ ID NO: 11993 - DNA, 24 bp, Homo sapiens
tggagaacctgttgctggacaagt

SEQ ID NO: 11994 - DNA, 19 bp, Homo sapiens
tggattaggttttctcaag

SEQ ID NO: 11995 - DNA, 18 bp, Homo sapiens
ggtttctgctggacaagt

SEQ ID NO: 11996 - DNA, 93 bp, Human herpesvirus 8
gctctgaatttttctgcgcatgcgcgactcctcatctacataatttatgcacataaaaggattagcgcatgcaaattagtcagatagcagggc

SEQ ID NO: 11997 - DNA, 18 bp, Human herpesvirus 8
ttagtcagatagcagggc

SEQ ID NO: 11998 - DNA, 15 bp, Homo sapiens
tcagtcagacgcggc

SEQ ID NO: 11999 - DNA, 18 bp, Homo sapiens
agctggagatagcagggc

SEQ ID NO: 12000 - DNA, 17 bp, Homo sapiens
ttaatcagataattggc

SEQ ID NO: 12001 - DNA, 18 bp, Homo sapiens
tagtcaaactggcagggc

SEQ ID NO: 12002 - DNA, 15 bp, Homo sapiens
tcagtcaagcagggc

SEQ ID NO: 12003 - DNA, 15 bp, Homo sapiens
ctagaacagcagggc

SEQ ID NO: 12004 - DNA, 16 bp, Homo sapiens
tcagtcagagctgggc

SEQ ID NO: 12005 - DNA, 16 bp, Homo sapiens
ttagtcaaataagaac

SEQ ID NO: 12006 - DNA, 16 bp, Homo sapiens
tcagccccagcagggc

SEQ ID NO: 12007 - DNA, 15 bp, Homo sapiens
ttagccagagagggc

SEQ ID NO: 12008 - DNA, 18 bp, Homo sapiens
gtcaaacagaggcagggc

SEQ ID NO: 12009 - DNA, 15 bp, Homo sapiens
tcagccaagcagggc

SEQ ID NO: 12010 - DNA, 17 bp, Homo sapiens
ttaattaataacagggc

SEQ ID NO: 12011 - DNA, 15 bp, Homo sapiens
tcagtcaggcagggc

SEQ ID NO: 12012 - DNA, 17 bp, Homo sapiens
ttagatcggaacaaggc

SEQ ID NO: 12013 - DNA, 17 bp, Homo sapiens
tcagtcagaaagtgggc

SEQ ID NO: 12014 - DNA, 16 bp, Homo sapiens
ttagccaggcaatggc

SEQ ID NO: 12015 - DNA, 15 bp, Homo sapiens
ctagccaggcagggc

SEQ ID NO: 12016 - DNA, 17 bp, Homo sapiens
ttagtagccagcagggc

SEQ ID NO: 12017 - DNA, 16 bp, Homo sapiens
ctagcaaaagcagggc

SEQ ID NO: 12018 - DNA, 16 bp, Homo sapiens
ttagcagataacatgc

SEQ ID NO: 12019 - DNA, 17 bp, Homo sapiens
tcaagcagtagcagggc

SEQ ID NO: 12020 - DNA, 20 bp, Homo sapiens
tcagtcagagagcacggggc

SEQ ID NO: 12021 - DNA, 21 bp, Homo sapiens
ttagtcaatgaactttagggc

SEQ ID NO: 12022 - DNA, 18 bp, Homo sapiens
ttagtcaacgggcagggc

SEQ ID NO: 12023 - DNA, 16 bp, Homo sapiens
ttaggcagagcagggc

SEQ ID NO: 12024 - DNA, 15 bp, Homo sapiens
ttagtcaaacagggc

SEQ ID NO: 12025 - DNA, 17 bp, Homo sapiens
ttaatcagataaatagc

SEQ ID NO: 12026 - DNA, 16 bp, Homo sapiens
ctagcaacagcagggc

SEQ ID NO: 12027 - DNA, 17 bp, Homo sapiens
ttagtccttagcagggc

SEQ ID NO: 12028 - DNA, 21 bp, Homo sapiens
ttagtcaggctagctaagggc

SEQ ID NO: 12029 - DNA, 15 bp, Homo sapiens
ctagcccagcagggc

SEQ ID NO: 12030 - DNA, 16 bp, Homo sapiens
ttagtcaatagctggc

SEQ ID NO: 12031 - DNA, 16 bp, Homo sapiens
tcagcaccagcagggc

SEQ ID NO: 12032 - DNA, 18 bp, Homo sapiens
ttagtcaaatgaacgagg

SEQ ID NO: 12033 - DNA, 17 bp, Homo sapiens
ttagcagaaaacagggc

SEQ ID NO: 12034 - DNA, 18 bp, Homo sapiens
tcagtcagttaacctggg

SEQ ID NO: 12035 - DNA, 16 bp, Homo sapiens
ttagtcagcagggggc

SEQ ID NO: 12036 - DNA, 15 bp, Homo sapiens
ctagcagagcagggc

SEQ ID NO: 12037 - DNA, 16 bp, Homo sapiens
ttagccagactgcggc

SEQ ID NO: 12038 - DNA, 18 bp, Homo sapiens
ttagtcagagtccagggc

SEQ ID NO: 12039 - DNA, 72 bp, Human herpesvirus 8
ttgaccggcaagttccaggcatcctaagtgcttgatgtagacccttagggcaccagggactacctaggtcaa

SEQ ID NO: 12040 - DNA, 22 bp, Human herpesvirus 8
caccagggactacctaggtcaa

SEQ ID NO: 12041 - DNA, 17 bp, Homo sapiens
ccggaatctctaggtca

SEQ ID NO: 12042 - DNA, 19 bp, Homo sapiens
cagcagggactggagctca

SEQ ID NO: 12043 - DNA, 18 bp, Homo sapiens
ccaggggggccaggtcaa

SEQ ID NO: 12044 - DNA, 22 bp, Homo sapiens
caccagggagtatgactactag

SEQ ID NO: 12045 - DNA, 20 bp, Homo sapiens
caccaggactggctgggtca

SEQ ID NO: 12046 - DNA, 17 bp, Homo sapiens
caccagggctgagctca

SEQ ID NO: 12047 - DNA, 18 bp, Homo sapiens
caccagggctagaggtca

SEQ ID NO: 12048 - DNA, 15 bp, Homo sapiens
agggacacaggtcaa

SEQ ID NO: 12049 - DNA, 16 bp, Homo sapiens
accaggaactatatca

SEQ ID NO: 12050 - DNA, 17 bp, Homo sapiens
caccagggctgtagtgt

SEQ ID NO: 12051 - DNA, 24 bp, Homo sapiens
caccaaggcctagtgcctgggtca

SEQ ID NO: 12052 - DNA, 19 bp, Homo sapiens
cactgagggggccaggtca

SEQ ID NO: 12053 - DNA, 20 bp, Homo sapiens
cacgtgggggaccaggtcaa

SEQ ID NO: 12054 - DNA, 19 bp, Homo sapiens
caccaagggctgagatcaa

SEQ ID NO: 12055 - DNA, 19 bp, Homo sapiens
accagtgagagcaggtcaa

SEQ ID NO: 12056 - DNA, 21 bp, Homo sapiens
caccagagaaccacaggtcaa

SEQ ID NO: 12057 - DNA, 15 bp, Homo sapiens
caccagggactggcc

SEQ ID NO: 12058 - DNA, 20 bp, Homo sapiens
ccagggactgcctatcacaa

SEQ ID NO: 12059 - DNA, 20 bp, Homo sapiens
caccaagggctatttcccaa

SEQ ID NO: 12060 - DNA, 19 bp, Homo sapiens
cagtggatcacctaggtca

SEQ ID NO: 12061 - DNA, 17 bp, Homo sapiens
caccaggggccggctca

SEQ ID NO: 12062 - DNA, 17 bp, Homo sapiens
caacaggggccaggtca

SEQ ID NO: 12063 - DNA, 20 bp, Homo sapiens
caccagggcttgggaagtca

SEQ ID NO: 12064 - DNA, 19 bp, Homo sapiens
cccaggacccctgggtcaa

SEQ ID NO: 12065 - DNA, 17 bp, Homo sapiens
caccaaggactgagcca

SEQ ID NO: 12066 - DNA, 16 bp, Homo sapiens
accagggacacctggt

SEQ ID NO: 12067 - DNA, 22 bp, Homo sapiens
cactgggtacctagtaggtcaa

SEQ ID NO: 12068 - DNA, 20 bp, Homo sapiens
cagggactgccgcatgttca

SEQ ID NO: 12069 - DNA, 18 bp, Homo sapiens
cacaagaccgcctaggtc

SEQ ID NO: 12070 - DNA, 25 bp, Homo sapiens
caccaggggctggcttcgctgtcaa

SEQ ID NO: 12071 - DNA, 19 bp, Homo sapiens
caccaggaactgtattcaa

SEQ ID NO: 12072 - DNA, 15 bp, Homo sapiens
accaggactacaggc

SEQ ID NO: 12073 - DNA, 20 bp, Homo sapiens
caccagggctgcctgggtca

SEQ ID NO: 12074 - DNA, 16 bp, Homo sapiens
cactgggactataggt

SEQ ID NO: 12075 - DNA, 23 bp, Homo sapiens
caccaggagctgtctcactccag

SEQ ID NO: 12076 - DNA, 19 bp, Homo sapiens
cagggactgggtaagtcaa

SEQ ID NO: 12077 - DNA, 21 bp, Homo sapiens
caccagggaatagctttgtca

SEQ ID NO: 12078 - DNA, 15 bp, Homo sapiens
caccagggcctgcca

SEQ ID NO: 12079 - DNA, 16 bp, Homo sapiens
ccagaccacctgggtc

SEQ ID NO: 12080 - DNA, 24 bp, Homo sapiens
caccagggatcagagccaggtcaa

SEQ ID NO: 12081 - DNA, 19 bp, Homo sapiens
ccagggacagggaggtcaa

SEQ ID NO: 12082 - DNA, 20 bp, Homo sapiens
caccaggagacaagggtcaa

SEQ ID NO: 12083 - DNA, 18 bp, Homo sapiens
caccaggaactgacttgg

SEQ ID NO: 12084 - DNA, 18 bp, Homo sapiens
caccggggaccacagctc

SEQ ID NO: 12085 - DNA, 19 bp, Homo sapiens
aaggctaattttaggtcaa

SEQ ID NO: 12086 - DNA, 18 bp, Homo sapiens
caccaggaactgtgctaa

SEQ ID NO: 12087 - DNA, 19 bp, Homo sapiens
caccagggactgtcccgtc

SEQ ID NO: 12088 - DNA, 21 bp, Homo sapiens
ccagggactgtaggtaggtca

SEQ ID NO: 12089 - DNA, 17 bp, Homo sapiens
caccaggggcagtgcca

SEQ ID NO: 12090 - DNA, 18 bp, Homo sapiens
accagggatacctggggt

SEQ ID NO: 12091 - DNA, 20 bp, Homo sapiens
ccactgcctagcctaggtca

SEQ ID NO: 12092 - DNA, 20 bp, Homo sapiens
cactaggactaataagtcaa

SEQ ID NO: 12093 - DNA, 21 bp, Homo sapiens
caccaggcactagctaggtca

SEQ ID NO: 12094 - DNA, 19 bp, Homo sapiens
caccagggattatctgtgg

SEQ ID NO: 12095 - DNA, 21 bp, Homo sapiens
cagggactggcctggaggtca

SEQ ID NO: 12096 - DNA, 19 bp, Homo sapiens
caccaaggcctctgggtca

SEQ ID NO: 12097 - DNA, 19 bp, Homo sapiens
caccactcgtctaggtcaa

SEQ ID NO: 12098 - DNA, 17 bp, Homo sapiens
caccaggaactagctca

SEQ ID NO: 12099 - DNA, 18 bp, Homo sapiens
caccaggggccacagcag

SEQ ID NO: 12100 - DNA, 21 bp, Homo sapiens
acaagggttacattaggtcaa

SEQ ID NO: 12101 - DNA, 18 bp, Homo sapiens
caccagagactgctctaa

SEQ ID NO: 12102 - DNA, 19 bp, Homo sapiens
cagggacttcagaggtcaa

SEQ ID NO: 12103 - DNA, 18 bp, Homo sapiens
cagcagggactcaagtca

SEQ ID NO: 12104 - DNA, 16 bp, Homo sapiens
cagggactccttgtca

SEQ ID NO: 12105 - DNA, 16 bp, Homo sapiens
caccagggacggcgca

SEQ ID NO: 12106 - DNA, 20 bp, Homo sapiens
caccaggaggctacagctca

SEQ ID NO: 12107 - DNA, 19 bp, Homo sapiens
acacagggactagtcttgg

SEQ ID NO: 12108 - DNA, 20 bp, Homo sapiens
caggaactgagtctgggtca

SEQ ID NO: 12109 - DNA, 18 bp, Homo sapiens
ccagggacctatacatca

SEQ ID NO: 12110 - DNA, 18 bp, Homo sapiens
caccagagtcccagtgcc

SEQ ID NO: 12111 - DNA, 21 bp, Homo sapiens
caccagggactggctgtgcca

SEQ ID NO: 12112 - DNA, 22 bp, Homo sapiens
ccagagactgacaatgggtcaa

SEQ ID NO: 12113 - DNA, 18 bp, Homo sapiens
cacctgggactacaacag

SEQ ID NO: 12114 - DNA, 20 bp, Homo sapiens
caccagggacatggaggtca

SEQ ID NO: 12115 - DNA, 19 bp, Homo sapiens
caccaagggtcttggtcaa

SEQ ID NO: 12116 - DNA, 18 bp, Homo sapiens
caccagggactgccttca

SEQ ID NO: 12117 - DNA, 22 bp, Homo sapiens
caccagggacctacagacctag

SEQ ID NO: 12118 - DNA, 20 bp, Homo sapiens
accaactaaatctaggtcaa

SEQ ID NO: 12119 - DNA, 20 bp, Homo sapiens
cccaggactggcctaggtca

SEQ ID NO: 12120 - DNA, 106 bp, Human herpesvirus 8
ctgctggacggaggtagtataatcagctaggcctcagtattctatgtaacaaatgaatgccctagagtactgcggtttagctagttatactgcccggttccaccag

SEQ ID NO: 12121 - DNA, 24 bp, Human herpesvirus 8
aggtagtataatcagctaggcctc

SEQ ID NO: 12122 - DNA, 20 bp, Homo sapiens
aagtagtataattagtaagg

SEQ ID NO: 12123 - DNA, 19 bp, Homo sapiens
agtgcaatcagctgggtct

SEQ ID NO: 12124 - DNA, 21 bp, Homo sapiens
aggtagtattgttgtcccctc

SEQ ID NO: 12125 - DNA, 19 bp, Homo sapiens
aggtagtatatttaaacct

SEQ ID NO: 12126 - DNA, 20 bp, Homo sapiens
aggtggtaggatcagcacct

SEQ ID NO: 12127 - DNA, 18 bp, Homo sapiens
aggtagtatggcagttaa

SEQ ID NO: 12128 - DNA, 19 bp, Homo sapiens
agttagcccagctaggtct

SEQ ID NO: 12129 - DNA, 20 bp, Homo sapiens
aggtagtatgttcagagtct

SEQ ID NO: 12130 - DNA, 22 bp, Homo sapiens
aggtagcatgaattcaggcctc

SEQ ID NO: 12131 - DNA, 23 bp, Homo sapiens
ggagtgaggtctcagctaggtct

SEQ ID NO: 12132 - DNA, 18 bp, Homo sapiens
agtagtatggtcagttaa

SEQ ID NO: 12133 - DNA, 18 bp, Homo sapiens
ggtagtatggtcagctgg

SEQ ID NO: 12134 - DNA, 22 bp, Homo sapiens
aggtacgcgacggctaggcctc

SEQ ID NO: 12135 - DNA, 87 bp, Human herpesvirus 8
cctggaggggtgtcacattctgtgaccgcgacgttgacgttagacacacgtcgctgccgtcctcagaatgtgatagcccatcacagg

SEQ ID NO: 12136 - DNA, 19 bp, Human herpesvirus 8
tgtgatagcccatcacagg

SEQ ID NO: 12137 - DNA, 18 bp, Homo sapiens
tgtgtcaggcatcacagg

SEQ ID NO: 12138 - DNA, 16 bp, Homo sapiens
gtaatagtatcacagg

SEQ ID NO: 12139 - DNA, 19 bp, Homo sapiens
gtgaggtcctcatcacagg

SEQ ID NO: 12140 - DNA, 17 bp, Homo sapiens
gtggtatagatcacagg

SEQ ID NO: 12141 - DNA, 17 bp, Homo sapiens
tatggtagcatcacagg

SEQ ID NO: 12142 - DNA, 17 bp, Homo sapiens
tgtatagcccattacaa

SEQ ID NO: 12143 - DNA, 19 bp, Homo sapiens
tgagatgcagtatcacagg

SEQ ID NO: 12144 - DNA, 17 bp, Homo sapiens
tgtgatagcctctgagg

SEQ ID NO: 12145 - DNA, 21 bp, Homo sapiens
tgtgataaccaccctcacagg

SEQ ID NO: 12146 - DNA, 17 bp, Homo sapiens
tgtaataaaaccacagg

SEQ ID NO: 12147 - DNA, 18 bp, Homo sapiens
tgtggaagccatcacagg

SEQ ID NO: 12148 - DNA, 20 bp, Homo sapiens
tatgataatagcatcatagg

SEQ ID NO: 12149 - DNA, 17 bp, Homo sapiens
tggatgcaaaccacagg

SEQ ID NO: 12150 - DNA, 16 bp, Homo sapiens
tgtgacagacaacagg

SEQ ID NO: 12151 - DNA, 16 bp, Homo sapiens
tgtggcagcccacagg

SEQ ID NO: 12152 - DNA, 21 bp, Homo sapiens
tgtgacagctcctggcgcagg

SEQ ID NO: 12153 - DNA, 19 bp, Homo sapiens
tgtcactacatatcacagg

SEQ ID NO: 12154 - DNA, 16 bp, Homo sapiens
tgtgaagtaccacagg

SEQ ID NO: 12155 - DNA, 18 bp, Homo sapiens
tgtgacagccttgcaagg

SEQ ID NO: 12156 - DNA, 16 bp, Homo sapiens
gtggcccaatcacagg

SEQ ID NO: 12157 - DNA, 16 bp, Homo sapiens
tatgatagctcaaagg

SEQ ID NO: 12158 - DNA, 20 bp, Homo sapiens
tgtgacagtcattccacagg

SEQ ID NO: 12159 - DNA, 17 bp, Homo sapiens
tgtggataaatcacagg

SEQ ID NO: 12160 - DNA, 17 bp, Homo sapiens
tgtgacagttcaacaag

SEQ ID NO: 12161 - DNA, 17 bp, Homo sapiens
tgtgacagcctatccag

SEQ ID NO: 12162 - DNA, 16 bp, Homo sapiens
atgaacccatcatagg

SEQ ID NO: 12163 - DNA, 17 bp, Homo sapiens
gtcccagccatcacagg

SEQ ID NO: 12164 - DNA, 17 bp, Homo sapiens
tatgataggccaacagg

SEQ ID NO: 12165 - DNA, 16 bp, Homo sapiens
cgagacacatcacagg

SEQ ID NO: 12166 - DNA, 21 bp, Homo sapiens
tgtgacagcttctcctgcagg

SEQ ID NO: 12167 - DNA, 17 bp, Homo sapiens
tgtaatagctccccagg

SEQ ID NO: 12168 - DNA, 18 bp, Homo sapiens
tgtgatagcccaagtagg

SEQ ID NO: 12169 - DNA, 15 bp, Homo sapiens
tgtgacagctcacag

SEQ ID NO: 12170 - DNA, 17 bp, Homo sapiens
tggatagcccctccagg

SEQ ID NO: 12171 - DNA, 18 bp, Homo sapiens
tgtgacagagaccacagg

SEQ ID NO: 12172 - DNA, 19 bp, Homo sapiens
tgtggagacccatcacagg

SEQ ID NO: 12173 - DNA, 19 bp, Homo sapiens
tgttgtagcccaccctagg

SEQ ID NO: 12174 - DNA, 18 bp, Homo sapiens
tgtggtgcctatcacaag

SEQ ID NO: 12175 - DNA, 17 bp, Homo sapiens
tgtgataatcctccagg

SEQ ID NO: 12176 - DNA, 16 bp, Homo sapiens
atgaccccatcacggg

SEQ ID NO: 12177 - DNA, 18 bp, Homo sapiens
tgggacccccatcacagg

SEQ ID NO: 12178 - DNA, 16 bp, Homo sapiens
tgtgatagatcacagg

SEQ ID NO: 12179 - DNA, 19 bp, Homo sapiens
tatgttacctcatcacagg

SEQ ID NO: 12180 - DNA, 21 bp, Homo sapiens
tgtgatagcagtgtccgcagg

SEQ ID NO: 12181 - DNA, 20 bp, Homo sapiens
tgtgacagctttacagcagg

SEQ ID NO: 12182 - DNA, 19 bp, Homo sapiens
tgtgacagaatctcacagg

SEQ ID NO: 12183 - DNA, 61 bp, Human herpesvirus 8
gctgttgcgttggttgggagtttggggaccaaatttctataattggtgtcaccgcggcagc

SEQ ID NO: 12184 - DNA, 24 bp, Human herpesvirus 8
tgttgcgttggttgggagtttggg

SEQ ID NO: 12185 - DNA, 20 bp, Homo sapiens
ttggattttgggggtttggg

SEQ ID NO: 12186 - DNA, 22 bp, Homo sapiens
tattgggagttgggggtttggg

SEQ ID NO: 12187 - DNA, 62 bp, Equine herpesvirus 2
gtggctcgcgaccacccacctggattttggacctggcttttggacccgtggctcgcgaccac

SEQ ID NO: 12188 - DNA, 23 bp, Equine herpesvirus 2
ttggacccgtggctcgcgaccac

SEQ ID NO: 12189 - DNA, 18 bp, Homo sapiens
ttgagcccgtggcttcca

SEQ ID NO: 12190 - DNA, 17 bp, Homo sapiens
ttggtccgtggctcccg

SEQ ID NO: 12191 - DNA, 19 bp, Homo sapiens
ttggatgcgtggctcgaac

SEQ ID NO: 12192 - DNA, 16 bp, Homo sapiens
ttggaccctggctccg

SEQ ID NO: 12193 - DNA, 19 bp, Homo sapiens
ctggacccggggccgtggc

SEQ ID NO: 12194 - DNA, 23 bp, Homo sapiens
ggacccgtggcgacggcggccac

SEQ ID NO: 12195 - DNA, 18 bp, Homo sapiens
ttggaccctggctcccaa

SEQ ID NO: 12196 - DNA, 16 bp, Homo sapiens
ttggccccgtggcacc

SEQ ID NO: 12197 - DNA, 19 bp, Homo sapiens
ttgcacccgtggctcctgc

SEQ ID NO: 12198 - DNA, 20 bp, Homo sapiens
ttggacccatggacagaacc

SEQ ID NO: 12199 - DNA, 18 bp, Homo sapiens
tcggtccgtggctctccg

SEQ ID NO: 12200 - DNA, 21 bp, Homo sapiens
tggggcatggctcgtggccac

SEQ ID NO: 12201 - DNA, 21 bp, Homo sapiens
ttgggtccgtggctctggggc

SEQ ID NO: 12202 - DNA, 17 bp, Homo sapiens
ttggactcgtggctccg

SEQ ID NO: 12203 - DNA, 103 bp, Equine herpesvirus 2
ggctgacccaaaattttaaaaattggggttagccatcctgtacaaaaatattactttttgagagggccaggctgacccaaaattttaaaaattggggttagcc

SEQ ID NO: 12204 - DNA, 24 bp, Equine herpesvirus 2
agagggccaggctgacccaaaatt

SEQ ID NO: 12205 - DNA, 20 bp, Homo sapiens
agaggctcaggctgagccca

SEQ ID NO: 12206 - DNA, 18 bp, Homo sapiens
agagagccacatgactca

SEQ ID NO: 12207 - DNA, 17 bp, Homo sapiens
agagggctggctgaccc

SEQ ID NO: 12208 - DNA, 22 bp, Homo sapiens
ggtgtcaagttgacccaaaatt

SEQ ID NO: 12209 - DNA, 16 bp, Homo sapiens
aggaggttgcccaaaa

SEQ ID NO: 12210 - DNA, 17 bp, Homo sapiens
gagggccagatcctcca

SEQ ID NO: 12211 - DNA, 19 bp, Homo sapiens
aggcagctgatccaaaatt

SEQ ID NO: 12212 - DNA, 18 bp, Homo sapiens
agggggccaggtgacacc

SEQ ID NO: 12213 - DNA, 24 bp, Homo sapiens
agggaggctgatttacccaaaatt

SEQ ID NO: 12214 - DNA, 19 bp, Homo sapiens
agggggccaggctgggccc

SEQ ID NO: 12215 - DNA, 19 bp, Homo sapiens
agaggggccgggttggccc

SEQ ID NO: 12216 - DNA, 18 bp, Homo sapiens
agggtggcccccaaaact

SEQ ID NO: 12217 - DNA, 18 bp, Homo sapiens
aagggccaggtacaaaat

SEQ ID NO: 12218 - DNA, 19 bp, Homo sapiens
agaggttgcagtgacccaa

SEQ ID NO: 12219 - DNA, 19 bp, Homo sapiens
ggccaaggtctccaaaatt

SEQ ID NO: 12220 - DNA, 17 bp, Homo sapiens
agaaggccagggcccca

SEQ ID NO: 12221 - DNA, 66 bp, Equine herpesvirus 2
ccggcatgcttctcgcccgatccccccgatctcacccggccgggcagatcctgtgagatgcgccgg

SEQ ID NO: 12222 - DNA, 24 bp, Equine herpesvirus 2
cgggcagatcctgtgagatgcgcc

SEQ ID NO: 12223 - DNA, 21 bp, Homo sapiens
cgggccgatcctgttcccgcc

SEQ ID NO: 12224 - DNA, 21 bp, Homo sapiens
cgggtgtgacagagatgcgcc

SEQ ID NO: 12225 - DNA, 18 bp, Homo sapiens
gggcagatcttgtgaaat

SEQ ID NO: 12226 - DNA, 18 bp, Homo sapiens
cgggcagaccctgtggcc

SEQ ID NO: 12227 - DNA, 19 bp, Homo sapiens
ggacagattttgtggaaat

SEQ ID NO: 12228 - DNA, 20 bp, Homo sapiens
ggacagatcctgtgatatgc

SEQ ID NO: 12229 - DNA, 18 bp, Homo sapiens
gggcgatctgtgatgtgc

SEQ ID NO: 12230 - DNA, 23 bp, Homo sapiens
gggcagacctctcatggtgtgcc

SEQ ID NO: 12231 - DNA, 17 bp, Homo sapiens
ggcaatgtgagatgtgc

SEQ ID NO: 12232 - DNA, 26 bp, Homo sapiens
caggcagattcacccacaggtgtgcc

SEQ ID NO: 12233 - DNA, 22 bp, Homo sapiens
gggcagatccggggtttgtgcc

SEQ ID NO: 12234 - DNA, 19 bp, Homo sapiens
aggcagattttattagatg

SEQ ID NO: 12235 - DNA, 18 bp, Homo sapiens
gggggatcctgtgatgac

SEQ ID NO: 12236 - DNA, 65 bp, Human herpesvirus 4
gcgcgcataatggcggacctaggcctaaaacccccaggaagcgggtctatggttggctgcgctgc

SEQ ID NO: 12237 - DNA, 21 bp, Human herpesvirus 4
gtctatggttggctgcgctgc

SEQ ID NO: 12238 - DNA, 20 bp, Homo sapiens
gtcatggttatggaggctgc

SEQ ID NO: 12239 - DNA, 18 bp, Homo sapiens
gctaggttggctgtgctg

SEQ ID NO: 12240 - DNA, 19 bp, Homo sapiens
gtctttggttggccagagc

SEQ ID NO: 12241 - DNA, 17 bp, Homo sapiens
gtccatggtacttgctg

SEQ ID NO: 12242 - DNA, 18 bp, Homo sapiens
ctgatggggctgcgctgc

SEQ ID NO: 12243 - DNA, 21 bp, Homo sapiens
gtcagtcgcgcgctgcgctgc

SEQ ID NO: 12244 - DNA, 18 bp, Homo sapiens
gtccatgacgtgcgttgc

SEQ ID NO: 12245 - DNA, 16 bp, Homo sapiens
gtcttggactgcgctg

SEQ ID NO: 12246 - DNA, 17 bp, Homo sapiens
gtctggggttggccggc

SEQ ID NO: 12247 - DNA, 19 bp, Homo sapiens
gtgtatggctgagtgctgc

SEQ ID NO: 12248 - DNA, 21 bp, Homo sapiens
gtctctggttggcgatggtgc

SEQ ID NO: 12249 - DNA, 16 bp, Homo sapiens
tctgtggttggccctg

SEQ ID NO: 12250 - DNA, 18 bp, Homo sapiens
gtctatggctgcttttgc

SEQ ID NO: 12251 - DNA, 19 bp, Homo sapiens
gtctgtggccgtgcgctgc

SEQ ID NO: 12252 - DNA, 22 bp, Homo sapiens
tctatggttggagatgagctgc

SEQ ID NO: 12253 - DNA, 17 bp, Homo sapiens
tcctgtggctgcgctgc

SEQ ID NO: 12254 - DNA, 16 bp, Homo sapiens
gcctgttgctgcgctg

SEQ ID NO: 12255 - DNA, 21 bp, Homo sapiens
gcctgcatggcgctgcgctgc

SEQ ID NO: 12256 - DNA, 18 bp, Homo sapiens
gtctaggctgggtgctgc

SEQ ID NO: 12257 - DNA, 18 bp, Homo sapiens
gtttatggtggctgaggc

SEQ ID NO: 12258 - DNA, 20 bp, Homo sapiens
gtctatagttttggagttgc

SEQ ID NO: 12259 - DNA, 21 bp, Homo sapiens
gtctatggatgaagtatctgc

SEQ ID NO: 12260 - DNA, 20 bp, Homo sapiens
gtcagtggactccgcgctgc

SEQ ID NO: 12261 - DNA, 18 bp, Homo sapiens
gtctgctggttgcactgc

SEQ ID NO: 12262 - DNA, 19 bp, Homo sapiens
gtcctgctggttgcgctgc

SEQ ID NO: 12263 - DNA, 105 bp, Gallid herpesvirus 3
agccctcagaccgcgtccgcgccccgggccagcctagcgtcgcaaacgtctggaagagtctgtggagtttggtttcgagggccgtgcggggaaacgcagagggct

SEQ ID NO: 12264 - DNA, 24 bp, Gallid herpesvirus 3
tctgtggagtttggtttcgagggc

SEQ ID NO: 12265 - DNA, 18 bp, Homo sapiens
tctgtggagtttgcaggg

SEQ ID NO: 12266 - DNA, 18 bp, Homo sapiens
tctgggaggttttggggg

SEQ ID NO: 12267 - DNA, 19 bp, Homo sapiens
tctgtgggtttgatgaggg

SEQ ID NO: 12268 - DNA, 16 bp, Homo sapiens
tggagggtttcgaggg

SEQ ID NO: 12269 - DNA, 22 bp, Homo sapiens
tctgttgggtttggttttccag

SEQ ID NO: 12270 - DNA, 21 bp, Homo sapiens
tctgtggtgtttggttatggc

SEQ ID NO: 12271 - DNA, 18 bp, Homo sapiens
ctgtggagtttggagggg

SEQ ID NO: 12272 - DNA, 19 bp, Homo sapiens
tgtcgagtttggccagggc

SEQ ID NO: 12273 - DNA, 21 bp, Homo sapiens
tgttgagccacattttgaggg

SEQ ID NO: 12274 - DNA, 20 bp, Homo sapiens
tctgtggagtttgtgtctcg

SEQ ID NO: 12275 - DNA, 111 bp, Gallid herpesvirus 3
cgaaactgccgtgtaaacgaatgcttagcggagccgcgcccgggacgcgtcgtttcttgcgaaacggggtggatcgctcgcccgctcttagccctcgcgtacagtgcgtcg

SEQ ID NO: 12276 - DNA, 24 bp, Gallid herpesvirus 3
gtggatcgctcgcccgctcttagc

SEQ ID NO: 12277 - DNA, 21 bp, Homo sapiens
tggtcactctctgctcttagc

SEQ ID NO: 12278 - DNA, 64 bp, Gallid herpesvirus 3
cgttaaggtgtacgtgcgtgtacgagaccgcgtgcgagcggtctcgtcgtagtgcgtatgaacg

SEQ ID NO: 12279 - DNA, 24 bp, Gallid herpesvirus 3
taaggtgtacgtgcgtgtacgaga

SEQ ID NO: 12280 - DNA, 18 bp, Homo sapiens
taaggcgtgtggtgtgag

SEQ ID NO: 12281 - DNA, 21 bp, Homo sapiens
agtgtgcgtgcgtgttagaga

SEQ ID NO: 12282 - DNA, 18 bp, Homo sapiens
aaggagtgcgtgtgtgag

SEQ ID NO: 12283 - DNA, 22 bp, Homo sapiens
ggtgtgtgcgcgcctgtgcgag

SEQ ID NO: 12284 - DNA, 18 bp, Homo sapiens
taaagtgtgtgtgtgtgt

SEQ ID NO: 12285 - DNA, 23 bp, Homo sapiens
taaaactgcgtgtgtgtacgaga

SEQ ID NO: 12286 - DNA, 15 bp, Homo sapiens
aggtgtgcgtatgag

SEQ ID NO: 12287 - DNA, 18 bp, Homo sapiens
tgagtgtatgtgtgtgca

SEQ ID NO: 12288 - DNA, 18 bp, Homo sapiens
taaggtgtgtgtggtcca

SEQ ID NO: 12289 - DNA, 23 bp, Homo sapiens
aagggttcgcgcgtgcgtgtgcg

SEQ ID NO: 12290 - DNA, 18 bp, Homo sapiens
caaggtgtgtgtgtgtgt

SEQ ID NO: 12291 - DNA, 62 bp, Equine herpesvirus 2
gaatatttttaaagacttttttccccaacctctgggttgggttttttctctttaaaatattc

SEQ ID NO: 12292 - DNA, 24 bp, Equine herpesvirus 2
ttaaagacttttttccccaacctc

SEQ ID NO: 12293 - DNA, 18 bp, Homo sapiens
gacctttttctcaacttc

SEQ ID NO: 12294 - DNA, 19 bp, Homo sapiens
aaacttttttgcacaacct

SEQ ID NO: 12295 - DNA, 21 bp, Homo sapiens
tcaaagatattttccaacctc

SEQ ID NO: 12296 - DNA, 20 bp, Homo sapiens
tcagaggctctttccaacct

SEQ ID NO: 12297 - DNA, 20 bp, Homo sapiens
ttaaagcttcttcctaacct

SEQ ID NO: 12298 - DNA, 20 bp, Homo sapiens
aagaaatttttccccaatct

SEQ ID NO: 12299 - DNA, 18 bp, Homo sapiens
ctaaagacttttttcccc

SEQ ID NO: 12300 - DNA, 18 bp, Homo sapiens
gactttttctccaacctc

SEQ ID NO: 12301 - DNA, 18 bp, Homo sapiens
ttaaagccccctccaact

SEQ ID NO: 12302 - DNA, 26 bp, Homo sapiens
ttaaagacttatttttgaccacacct

SEQ ID NO: 12303 - DNA, 21 bp, Homo sapiens
ttaaaggtctctttccccaac

SEQ ID NO: 12304 - DNA, 18 bp, Homo sapiens
gagcctttttccaacctc

SEQ ID NO: 12305 - DNA, 23 bp, Homo sapiens
tcagagacttctgatccagcctc

SEQ ID NO: 12306 - DNA, 20 bp, Homo sapiens
agaggtttcgtccccaacct

SEQ ID NO: 12307 - DNA, 18 bp, Homo sapiens
ttagagacttttctctcc

SEQ ID NO: 12308 - DNA, 18 bp, Homo sapiens
ttaaagacttttgcacct

SEQ ID NO: 12309 - DNA, 23 bp, Homo sapiens
ttaaagacgagttccttagcctc

SEQ ID NO: 12310 - DNA, 20 bp, Homo sapiens
aaactacccttcccagcctc

SEQ ID NO: 12311 - DNA, 22 bp, Homo sapiens
ctaaagattgcaccccaacctc

SEQ ID NO: 12312 - DNA, 22 bp, Homo sapiens
ttaaaagttttcccccaacttc

SEQ ID NO: 12313 - DNA, 19 bp, Homo sapiens
agactctctttccagcctc

SEQ ID NO: 12314 - DNA, 131 bp, Equine herpesvirus 2
cccggggagataggcgctcgcggagagggggttgggcgaaggacggggggggtggtgcctggcgcgcgccccagcccgttccgcacgtctttgccccttgctccagtttgcaggttccctctttctccagg

SEQ ID NO: 12315 - DNA, 24 bp, Equine herpesvirus 2
cacgtctttgccccttgctccagt

SEQ ID NO: 12316 - DNA, 16 bp, Homo sapiens
gtctttgcctgtccag

SEQ ID NO: 12317 - DNA, 19 bp, Homo sapiens
gtccttgctttctgtcagt

SEQ ID NO: 12318 - DNA, 20 bp, Homo sapiens
gtttttccaacaactccagt

SEQ ID NO: 12319 - DNA, 23 bp, Homo sapiens
gcctccttccttcttgctccagt

SEQ ID NO: 12320 - DNA, 22 bp, Homo sapiens
gtgtttccgactttgctccagt

SEQ ID NO: 12321 - DNA, 20 bp, Homo sapiens
gtttttgcaagggctccagt

SEQ ID NO: 12322 - DNA, 22 bp, Homo sapiens
gtctttgcttcttcaccccggt

SEQ ID NO: 12323 - DNA, 21 bp, Homo sapiens
cacgtccttgccagctccagt

SEQ ID NO: 12324 - DNA, 15 bp, Homo sapiens
actctttgcccccca

SEQ ID NO: 12325 - DNA, 25 bp, Homo sapiens
cactccctctcttctttgttccagt

SEQ ID NO: 12326 - DNA, 16 bp, Homo sapiens
gcctttgccctgacca

SEQ ID NO: 12327 - DNA, 21 bp, Homo sapiens
gtctctgcctctgttttcagt

SEQ ID NO: 12328 - DNA, 18 bp, Homo sapiens
acgtcttttctcctgctc

SEQ ID NO: 12329 - DNA, 19 bp, Homo sapiens
cgtctctgccagctccagt

SEQ ID NO: 12330 - DNA, 20 bp, Homo sapiens
catctttgcttctctgaagt

SEQ ID NO: 12331 - DNA, 22 bp, Homo sapiens
atctctacaattttgctctagt

SEQ ID NO: 12332 - DNA, 21 bp, Homo sapiens
gtcttgccccagagttccagt

SEQ ID NO: 12333 - DNA, 24 bp, Homo sapiens
cacagaaggaccttttgctccagt

SEQ ID NO: 12334 - DNA, 22 bp, Homo sapiens
acggtctttgttcttgctcagt

SEQ ID NO: 12335 - DNA, 19 bp, Homo sapiens
gtcttcgcccccagccagt

SEQ ID NO: 12336 - DNA, 15 bp, Homo sapiens
gtctctgtgctccag

SEQ ID NO: 12337 - DNA, 23 bp, Homo sapiens
catgctttgcccttgtcctcagt

SEQ ID NO: 12338 - DNA, 23 bp, Homo sapiens
cactgtggggcccttgctccagt

SEQ ID NO: 12339 - DNA, 19 bp, Homo sapiens
gtctttgccccagaacagt

SEQ ID NO: 12340 - DNA, 24 bp, Homo sapiens
acgtctttgcctccaaggcctagt

SEQ ID NO: 12341 - DNA, 19 bp, Homo sapiens
ttgctgttcttgctccagt

SEQ ID NO: 12342 - DNA, 60 bp, Equine herpesvirus 2
tcccccaaagacactctcggccgaccgcagagggataactgcggttgggcgcgtgggcga

SEQ ID NO: 12343 - DNA, 19 bp, Equine herpesvirus 2
cggttgggcgcgtgggcga

SEQ ID NO: 12344 - DNA, 17 bp, Homo sapiens
cggctgggccaccggcg

SEQ ID NO: 12345 - DNA, 18 bp, Homo sapiens
cggtgggcaagtgggcga

SEQ ID NO: 12346 - DNA, 16 bp, Homo sapiens
cggtcgggcgggccga

SEQ ID NO: 12347 - DNA, 18 bp, Homo sapiens
ggttgggcggagccggcg

SEQ ID NO: 12348 - DNA, 19 bp, Homo sapiens
cggttgggcgcagggggcg

SEQ ID NO: 12349 - DNA, 18 bp, Homo sapiens
ggttgggcgggccgggcg

SEQ ID NO: 12350 - DNA, 16 bp, Homo sapiens
cggttggggcagacga

SEQ ID NO: 12351 - DNA, 21 bp, Homo sapiens
cggttaggcaaagccgggcga

SEQ ID NO: 12352 - DNA, 16 bp, Homo sapiens
ggtgggcaatgggtga

SEQ ID NO: 12353 - DNA, 19 bp, Homo sapiens
cggtcggggtcgcggggcg

SEQ ID NO: 12354 - DNA, 16 bp, Homo sapiens
cggtggccgcagggcg

SEQ ID NO: 12355 - DNA, 16 bp, Homo sapiens
cgcggacgcgtgggcg

SEQ ID NO: 12356 - DNA, 16 bp, Homo sapiens
cggctcaggtgggcga

SEQ ID NO: 12357 - DNA, 16 bp, Homo sapiens
ggcgaggcgtgggcga

SEQ ID NO: 12358 - DNA, 20 bp, Homo sapiens
cgtgcctcctgcgtgggcga

SEQ ID NO: 12359 - DNA, 15 bp, Homo sapiens
cggtggccgcgggcg

SEQ ID NO: 12360 - DNA, 18 bp, Homo sapiens
cgggtgggtgcgtgggcg

SEQ ID NO: 12361 - DNA, 19 bp, Homo sapiens
gggtgggcgaaatcagcga

SEQ ID NO: 12362 - DNA, 17 bp, Homo sapiens
cagttggaggccgggcg

SEQ ID NO: 12363 - DNA, 17 bp, Homo sapiens
cggtcggggcacgggcg

SEQ ID NO: 12364 - DNA, 15 bp, Homo sapiens
cggctggagcgggcg

SEQ ID NO: 12365 - DNA, 18 bp, Homo sapiens
cggctggcgagcgggcga

SEQ ID NO: 12366 - DNA, 19 bp, Homo sapiens
cggtcgggcccgcacggcg

SEQ ID NO: 12367 - DNA, 17 bp, Homo sapiens
cagcagccgcgtgggcg

SEQ ID NO: 12368 - DNA, 18 bp, Homo sapiens
cgggtgggcgaggggcga

SEQ ID NO: 12369 - DNA, 19 bp, Homo sapiens
cagacaaacgtgtgggcga

SEQ ID NO: 12370 - DNA, 16 bp, Homo sapiens
cggctggggcggggcg

SEQ ID NO: 12371 - DNA, 19 bp, Homo sapiens
cggttggaggcccggggcg

SEQ ID NO: 12372 - DNA, 16 bp, Homo sapiens
cggttgggctggacga

SEQ ID NO: 12373 - DNA, 17 bp, Homo sapiens
cggtatgggacggggcg

SEQ ID NO: 12374 - DNA, 15 bp, Homo sapiens
ggttgggccaggcga

SEQ ID NO: 12375 - DNA, 19 bp, Homo sapiens
cggtcggggtgcggggcga

SEQ ID NO: 12376 - DNA, 18 bp, Homo sapiens
ggttaggggcaagggcga

SEQ ID NO: 12377 - DNA, 17 bp, Homo sapiens
cggtggcgcgtgggtga

SEQ ID NO: 12378 - DNA, 15 bp, Homo sapiens
cggtgggccgcggcg

SEQ ID NO: 12379 - DNA, 15 bp, Homo sapiens
cggctgggccgggcg

SEQ ID NO: 12380 - DNA, 19 bp, Homo sapiens
cgggggtccgcgtgggcga

SEQ ID NO: 12381 - DNA, 17 bp, Homo sapiens
ggctgggagcaaggtga

SEQ ID NO: 12382 - DNA, 19 bp, Homo sapiens
cagttgggacaaagggcga

SEQ ID NO: 12383 - DNA, 21 bp, Homo sapiens
ggttgagcggccgcagggcga

SEQ ID NO: 12384 - DNA, 17 bp, Homo sapiens
cggctgggcccgggcga

SEQ ID NO: 12385 - DNA, 18 bp, Homo sapiens
cggtcgggctcaggggcg

SEQ ID NO: 12386 - DNA, 20 bp, Homo sapiens
cggctggagcctcgtgggcg

SEQ ID NO: 12387 - DNA, 18 bp, Homo sapiens
cgagcggacgcgtgggcg

SEQ ID NO: 12388 - DNA, 16 bp, Homo sapiens
ggctgggcgctggcga

SEQ ID NO: 12389 - DNA, 18 bp, Homo sapiens
cggctgggcaggcaggcg

SEQ ID NO: 12390 - DNA, 19 bp, Homo sapiens
cagcgcgtgggtgcgtggg

SEQ ID NO: 12391 - DNA, 16 bp, Homo sapiens
cagttgggtgcagacg

SEQ ID NO: 12392 - DNA, 19 bp, Homo sapiens
cggttggggctctgttgcg

SEQ ID NO: 12393 - DNA, 19 bp, Homo sapiens
ggttgggcctgccaggtga

SEQ ID NO: 12394 - DNA, 16 bp, Homo sapiens
cgggtgggcgcgggcg

SEQ ID NO: 12395 - DNA, 16 bp, Homo sapiens
cggctgggccggggcg

SEQ ID NO: 12396 - DNA, 17 bp, Homo sapiens
cggctgggtcggggcga

SEQ ID NO: 12397 - DNA, 21 bp, Homo sapiens
cggtgtgggtgcacgtgggcg

SEQ ID NO: 12398 - DNA, 16 bp, Homo sapiens
cggctgggcacgggcg

SEQ ID NO: 12399 - DNA, 17 bp, Homo sapiens
cggttgggtcagggtga

SEQ ID NO: 12400 - DNA, 17 bp, Homo sapiens
ggctggaaagtgggcga

SEQ ID NO: 12401 - DNA, 16 bp, Homo sapiens
cggttgaggctgggcg

SEQ ID NO: 12402 - DNA, 18 bp, Homo sapiens
cggttaggacattggtga

SEQ ID NO: 12403 - DNA, 17 bp, Homo sapiens
ggctggccgctgggtga

SEQ ID NO: 12404 - DNA, 18 bp, Homo sapiens
cggagcacgcgtgggcga

SEQ ID NO: 12405 - DNA, 18 bp, Homo sapiens
cggttggggcagacggcg

SEQ ID NO: 12406 - DNA, 19 bp, Homo sapiens
cggttgcggcaggaagcga

SEQ ID NO: 12407 - DNA, 17 bp, Homo sapiens
cggttgggggcataacg

SEQ ID NO: 12408 - DNA, 18 bp, Homo sapiens
cggtctgggcgcacctga

SEQ ID NO: 12409 - DNA, 16 bp, Homo sapiens
cggctgggcatggtga

SEQ ID NO: 12410 - DNA, 19 bp, Homo sapiens
cagttgggtctcagggtga

SEQ ID NO: 12411 - DNA, 17 bp, Homo sapiens
cggctgggcgcgctgcg

SEQ ID NO: 12412 - DNA, 16 bp, Homo sapiens
cggcacagcgtgggcg

SEQ ID NO: 12413 - DNA, 17 bp, Homo sapiens
ggttggacagtgggtga

SEQ ID NO: 12414 - DNA, 17 bp, Homo sapiens
cggttgggcagtgtcca

SEQ ID NO: 12415 - DNA, 17 bp, Homo sapiens
ggttagccaatgggcga

SEQ ID NO: 12416 - DNA, 19 bp, Homo sapiens
cggtggggcgcgcgcctcg

SEQ ID NO: 12417 - DNA, 60 bp, Equine herpesvirus 2
gagagtgaccacacaagaagagaaaaaaagtcattttaaatttttttattggttaatttc

SEQ ID NO: 12418 - DNA, 24 bp, Equine herpesvirus 2
ttaaatttttttattggttaattt

SEQ ID NO: 12419 - DNA, 24 bp, Homo sapiens
ttaaataaactgattggttaattt

SEQ ID NO: 12420 - DNA, 25 bp, Homo sapiens
ttaaatctttttatcaatttaattt

SEQ ID NO: 12421 - DNA, 82 bp, Murid herpesvirus 4
agcagacaggttagagcactgttgtgtgatgtgagaggagtaagtgtgtctccaccatcgcataacagttgataggtgggct

SEQ ID NO: 12422 - DNA, 24 bp, Murid herpesvirus 4
tgttgtgtgatgtgagaggagtaa

SEQ ID NO: 12423 - DNA, 20 bp, Homo sapiens
ttgggctgtgagaggagtaa

SEQ ID NO: 12424 - DNA, 19 bp, Homo sapiens
tgctgtgtagcagaggagt

SEQ ID NO: 12425 - DNA, 20 bp, Homo sapiens
tgtgtgtgatgtgcctaagt

SEQ ID NO: 12426 - DNA, 19 bp, Homo sapiens
tgttgtgtgattgtcgtga

SEQ ID NO: 12427 - DNA, 18 bp, Homo sapiens
gttgtgtgtcgaggggta

SEQ ID NO: 12428 - DNA, 19 bp, Homo sapiens
tgttgtgtgagtatggtgg

SEQ ID NO: 12429 - DNA, 19 bp, Homo sapiens
tgtggaatgtgaggggagt

SEQ ID NO: 12430 - DNA, 17 bp, Homo sapiens
tggtgtgtgatgggggt

SEQ ID NO: 12431 - DNA, 19 bp, Homo sapiens
tgttgtgtgatggacatgg

SEQ ID NO: 12432 - DNA, 20 bp, Homo sapiens
tgttgggcgatgagaggggt

SEQ ID NO: 12433 - DNA, 18 bp, Homo sapiens
tgttgtgtagtgtggtgg

SEQ ID NO: 12434 - DNA, 114 bp, Murid herpesvirus 4
cgatgtgtttgacaatgtactctttgctttcaactgcagggtgttttagaatggcttcaacagattcattaaaatgttctgtggtccatagaaagctctgatcaaacttcattg

SEQ ID NO: 12435 - DNA, 24 bp, Murid herpesvirus 4
tagaaagctctgatcaaacttcat

SEQ ID NO: 12436 - DNA, 17 bp, Homo sapiens
aaaagttcttcaaactt

SEQ ID NO: 12437 - DNA, 21 bp, Homo sapiens
aaaagctcctaacttgaactt

SEQ ID NO: 12438 - DNA, 19 bp, Homo sapiens
aaaagctcatccaaaactt

SEQ ID NO: 12439 - DNA, 17 bp, Homo sapiens
gagagctctgagaactt

SEQ ID NO: 12440 - DNA, 20 bp, Homo sapiens
gaaaacaggataaacttcat

SEQ ID NO: 12441 - DNA, 16 bp, Homo sapiens
tagaagctctgccttc

SEQ ID NO: 12442 - DNA, 24 bp, Homo sapiens
taggaagctccatctgagtttcat

SEQ ID NO: 12443 - DNA, 21 bp, Homo sapiens
tagaaacaggataaacttcat

SEQ ID NO: 12444 - DNA, 18 bp, Homo sapiens
tagcaagctctgaattca

SEQ ID NO: 12445 - DNA, 20 bp, Homo sapiens
gagaagctctccaacttcat

SEQ ID NO: 12446 - DNA, 18 bp, Homo sapiens
gaaagttgcaaacttcat

SEQ ID NO: 12447 - DNA, 20 bp, Homo sapiens
tagaaagcctgggcatccct

SEQ ID NO: 12448 - DNA, 16 bp, Homo sapiens
gagagctctgatttca

SEQ ID NO: 12449 - DNA, 19 bp, Homo sapiens
gacagcctttaaacttcat

SEQ ID NO: 12450 - DNA, 19 bp, Homo sapiens
tagaaagcattgaaattca

SEQ ID NO: 12451 - DNA, 18 bp, Homo sapiens
taaaaagctctgaactca

SEQ ID NO: 12452 - DNA, 22 bp, Homo sapiens
tagaaagcttttattacgatca

SEQ ID NO: 12453 - DNA, 67 bp, Murid herpesvirus 4
tctggatcttggtaggcggccgcgagggactgttgcttcttgtgctgtgaattctatcttgactgga

SEQ ID NO: 12454 - DNA, 24 bp, Murid herpesvirus 4
cttgtgctgtgaattctatcttga

SEQ ID NO: 12455 - DNA, 24 bp, Homo sapiens
cttgtactgtggatgcttatttga

SEQ ID NO: 12456 - DNA, 22 bp, Homo sapiens
cttggcctggattttatcttga

SEQ ID NO: 12457 - DNA, 21 bp, Homo sapiens
ttctgctgtgttacatcttga

SEQ ID NO: 12458 - DNA, 21 bp, Homo sapiens
cttggcttccttctgtcttga

SEQ ID NO: 12459 - DNA, 20 bp, Homo sapiens
ttgtgtttgaaccatcttga

SEQ ID NO: 12460 - DNA, 21 bp, Homo sapiens
tgtgccccaaattctgttttg

SEQ ID NO: 12461 - DNA, 68 bp, Murid herpesvirus 4
aatgctatggaattagtagtgggacccgggcgtggtccagtatcctgggtctggccgcttgtagcatt

SEQ ID NO: 12462 - DNA, 24 bp, Murid herpesvirus 4
tatggaattagtagtgggacccgg

SEQ ID NO: 12463 - DNA, 16 bp, Homo sapiens
catggaggtagtggga

SEQ ID NO: 12464 - DNA, 18 bp, Homo sapiens
tgggtggctgggacccgg

SEQ ID NO: 12465 - DNA, 21 bp, Homo sapiens
tggaacttgagcaggacttgg

SEQ ID NO: 12466 - DNA, 18 bp, Homo sapiens
tggggaggtgggacctgg

SEQ ID NO: 12467 - DNA, 18 bp, Homo sapiens
ggcacaggtgggacccgg

SEQ ID NO: 12468 - DNA, 22 bp, Homo sapiens
atgtcagggtagtgggacctgg

SEQ ID NO: 12469 - DNA, 82 bp, Human herpesvirus 4
cccaatgtgcaaatgtggtttgtatggctactttgtgttcctaaaaaatgcaacaatagaagtggaaaccctcagtcacggg

SEQ ID NO: 12470 - DNA, 24 bp, Human herpesvirus 4
gaagtggaaaccctcagtcacggg

SEQ ID NO: 12471 - DNA, 21 bp, Homo sapiens
gaagtggagattcccaaacgg

SEQ ID NO: 12472 - DNA, 18 bp, Homo sapiens
gaagtggagacagcatgg

SEQ ID NO: 12473 - DNA, 20 bp, Homo sapiens
gtgaagtcctcaatcaaggg

SEQ ID NO: 12474 - DNA, 22 bp, Homo sapiens
gaggtgaggtcctcatcacagg

SEQ ID NO: 12475 - DNA, 18 bp, Homo sapiens
gaagggaaacccaagcgg

SEQ ID NO: 12476 - DNA, 17 bp, Homo sapiens
gaagtggaagcactagg

SEQ ID NO: 12477 - DNA, 21 bp, Homo sapiens
gaagtggaaaattcttagagg

SEQ ID NO: 12478 - DNA, 25 bp, Homo sapiens
gaagtggaagaccttgcaagacggg

SEQ ID NO: 12479 - DNA, 20 bp, Homo sapiens
gaaatggaagcctttccacg

SEQ ID NO: 12480 - DNA, 22 bp, Homo sapiens
gaagtggaagcgctcggcccag

SEQ ID NO: 12481 - DNA, 26 bp, Homo sapiens
gaagtgaaaatcctcacctccatggg

SEQ ID NO: 12482 - DNA, 24 bp, Homo sapiens
gagatggaaactatatttcatggg

SEQ ID NO: 12483 - DNA, 23 bp, Homo sapiens
gaagtgggcacccccagcatggg

SEQ ID NO: 12484 - DNA, 22 bp, Homo sapiens
aagtggaaacacactttgtggg

SEQ ID NO: 12485 - DNA, 17 bp, Homo sapiens
gaagtgaagcccttacg

SEQ ID NO: 12486 - DNA, 21 bp, Homo sapiens
gaagtggaaatttgcagaacg

SEQ ID NO: 12487 - DNA, 19 bp, Homo sapiens
atgggggctctgccacggg

SEQ ID NO: 12488 - DNA, 21 bp, Homo sapiens
gaagtggaggttctccaaagg

SEQ ID NO: 12489 - DNA, 21 bp, Homo sapiens
gagctgggaacccaccacggg

SEQ ID NO: 12490 - DNA, 18 bp, Homo sapiens
gaaatggagactctctgg

SEQ ID NO: 12491 - DNA, 23 bp, Homo sapiens
agtgaagaccctcagaacacagg

SEQ ID NO: 12492 - DNA, 21 bp, Homo sapiens
agcgggggtcctcagccttgg

SEQ ID NO: 12493 - DNA, 89 bp, Human herpesvirus 4
gcgacctcgtgaatatgaggaccaacaaccctgtgcttggcgctcaggcgcaagtgtgtgtaatttgtcctccagatcgcagcaatcgc

SEQ ID NO: 12494 - DNA, 24 bp, Human herpesvirus 4
tgaggaccaacaaccctgtgcttg

SEQ ID NO: 12495 - DNA, 18 bp, Homo sapiens
taagggtcagcaaccctg

SEQ ID NO: 12496 - DNA, 21 bp, Homo sapiens
tggggccaggctctgtgcttg

SEQ ID NO: 12497 - DNA, 20 bp, Homo sapiens
tgaggaccacagctctgtgc

SEQ ID NO: 12498 - DNA, 19 bp, Homo sapiens
tgaggaccagcacccatct

SEQ ID NO: 12499 - DNA, 21 bp, Homo sapiens
acctgcatggccttgtgcttg

SEQ ID NO: 12500 - DNA, 21 bp, Homo sapiens
tgaggctcagcagtgcacttg

SEQ ID NO: 12501 - DNA, 22 bp, Homo sapiens
tggggacccagatttgtgcttg

SEQ ID NO: 12502 - DNA, 18 bp, Homo sapiens
tgaggccagcagctctac

SEQ ID NO: 12503 - DNA, 22 bp, Homo sapiens
tgtagggcaggccttgtgcttg

SEQ ID NO: 12504 - DNA, 18 bp, Homo sapiens
tgaggaccagcatctgtg

SEQ ID NO: 12505 - DNA, 18 bp, Homo sapiens
tgaggaccaacaattctg

SEQ ID NO: 12506 - DNA, 23 bp, Homo sapiens
tgggggccaagtgggtgcgcctg

SEQ ID NO: 12507 - DNA, 21 bp, Homo sapiens
tgagcatctactttgtgcttg

SEQ ID NO: 12508 - DNA, 20 bp, Homo sapiens
tgaggagggccctgtgcttg

SEQ ID NO: 12509 - DNA, 24 bp, Homo sapiens
tgatgactgtgctttctgtgcttg

SEQ ID NO: 12510 - DNA, 21 bp, Homo sapiens
tggggaccaacgggaggcttg

SEQ ID NO: 12511 - DNA, 19 bp, Homo sapiens
tgaggaacaacatatgctt

SEQ ID NO: 12512 - DNA, 21 bp, Homo sapiens
tgggactctaacctgtgcttg

SEQ ID NO: 12513 - DNA, 65 bp, Human herpesvirus 4
actaaccctaattcgatagcatatgcttcccgttgggtaacatatgctattgaattagggttagt

SEQ ID NO: 12514 - DNA, 24 bp, Human herpesvirus 4
accctaattcgatagcatatgctt

SEQ ID NO: 12515 - DNA, 23 bp, Homo sapiens
cctagtcaatgaggtatatgctt

SEQ ID NO: 12516 - DNA, 19 bp, Homo sapiens
acccttgtttaaatatgct

SEQ ID NO: 12517 - DNA, 20 bp, Homo sapiens
cctaattctcagcttatatg

SEQ ID NO: 12518 - DNA, 20 bp, Homo sapiens
ccctaattttatggtcacat

SEQ ID NO: 12519 - DNA, 21 bp, Homo sapiens
caattcataacatatatgctt

SEQ ID NO: 12520 - DNA, 123 bp, Human herpesvirus 6
tatcgcagcgttgcgacatcgtctcctacattctcgttgaataataagcctaagaaattttgcatgcattgcgagattgtaatattcaagcgaagtgaagaatttatgttcagccttgcggta

SEQ ID NO: 12521 - DNA, 24 bp, Human herpesvirus 6
tcgcagcgttgcgacatcgtctcc

SEQ ID NO: 12522 - DNA, 21 bp, Homo sapiens
tctggcggggacacatcgtct

SEQ ID NO: 12523 - DNA, 19 bp, Homo sapiens
tcggctccgacatcgtctc

SEQ ID NO: 12524 - DNA, 83 bp, Human herpesvirus 4
agcggggtctcggagctcctaggtcagaccacgaaaggtcagcctgcaaggtggatggcgtgttttctgaggttatccccgct

SEQ ID NO: 12525 - DNA, 24 bp, Human herpesvirus 4
tggcgtgttttctgaggttatccc

SEQ ID NO: 12526 - DNA, 20 bp, Homo sapiens
tggggtgttttctaaatgtt

SEQ ID NO: 12527 - DNA, 21 bp, Homo sapiens
tggtggttttctgcccctccc

SEQ ID NO: 12528 - DNA, 18 bp, Homo sapiens
gtgttttctatatatccc

SEQ ID NO: 12529 - DNA, 23 bp, Homo sapiens
tgggtgttttctaaaatttatcc

SEQ ID NO: 12530 - DNA, 18 bp, Homo sapiens
tgggtacggtgaggttat

SEQ ID NO: 12531 - DNA, 18 bp, Homo sapiens
tggcatgttttttagcct

SEQ ID NO: 12532 - DNA, 20 bp, Homo sapiens
tggtggttttctggcagtcc

SEQ ID NO: 12533 - DNA, 17 bp, Homo sapiens
tgggtgttttcttgatt

SEQ ID NO: 12534 - DNA, 21 bp, Homo sapiens
tggctgttttctgcagacatc

SEQ ID NO: 12535 - DNA, 21 bp, Homo sapiens
tgggtggtggtggggttgtcc

SEQ ID NO: 12536 - DNA, 16 bp, Homo sapiens
tggagtgttttctatc

SEQ ID NO: 12537 - DNA, 21 bp, Homo sapiens
gctctggttttggggttatcc

SEQ ID NO: 12538 - DNA, 21 bp, Homo sapiens
tgagcgccctctggggttatc

SEQ ID NO: 12539 - DNA, 22 bp, Homo sapiens
tggtatgttttcacagtgttcc

SEQ ID NO: 12540 - DNA, 19 bp, Homo sapiens
tggcatgtttttctattcc

SEQ ID NO: 12541 - DNA, 17 bp, Homo sapiens
tggcttggcgaggttat

SEQ ID NO: 12542 - DNA, 60 bp, Human herpesvirus 6
gacattaattcttacgctcatgggtacttcggtgacgacccttatgcgttaaaatgtgtt

SEQ ID NO: 12543 - DNA, 24 bp, Human herpesvirus 6
tcttacgctcatgggtacttcggt

SEQ ID NO: 12544 - DNA, 17 bp, Homo sapiens
cgttccgtcacttcggt

SEQ ID NO: 12545 - DNA, 25 bp, Homo sapiens
tctatgctcatgggtaagtaccgag

SEQ ID NO: 12546 - DNA, 128 bp, Tupaia herpesvirus
ctcccgggtacttactcgctaactctcgctgctcgggctcggtaaacttgacgcgcttagtttcgtcacagaaggcgtccatgttgatcaggtcatcggccgtgggttcaaagtcatggttcccgggg

SEQ ID NO: 12547 - DNA, 24 bp, Tupaia herpesvirus
cgtccatgttgatcaggtcatcgg

SEQ ID NO: 12548 - DNA, 15 bp, Homo sapiens
gtccatgttgacacc

SEQ ID NO: 12549 - DNA, 17 bp, Homo sapiens
cgccatgttggtcaggc

SEQ ID NO: 12550 - DNA, 17 bp, Homo sapiens
cgccatgttggtcatgc

SEQ ID NO: 12551 - DNA, 16 bp, Homo sapiens
gccatgttggtcagtc

SEQ ID NO: 12552 - DNA, 81 bp, Tupaia herpesvirus
ggaaaacgtaaaggtgggcccggtcagctggacgtccgagtctccgatgcctaacctgatacctggatctacctatgttcc

SEQ ID NO: 12553 - DNA, 24 bp, Tupaia herpesvirus
tgcctaacctgatacctggatcta

SEQ ID NO: 12554 - DNA, 19 bp, Homo sapiens
tgccgacaactctggatct

SEQ ID NO: 12555 - DNA, 21 bp, Homo sapiens
ccttggcaacatctggatcta

SEQ ID NO: 12556 - DNA, 22 bp, Homo sapiens
tgccaagtcaatcactggatct

SEQ ID NO: 12557 - DNA, 21 bp, Homo sapiens
cctgagtccagcttggatcta

SEQ ID NO: 12558 - DNA, 22 bp, Homo sapiens
cctggaatagatgcctggatct

SEQ ID NO: 12559 - DNA, 18 bp, Homo sapiens
ccttgacactctggatct

SEQ ID NO: 12560 - DNA, 21 bp, Homo sapiens
tgcctaacctgtgctccccta

SEQ ID NO: 12561 - DNA, 20 bp, Homo sapiens
gcctgacctgatactacctg

SEQ ID NO: 12562 - DNA, 24 bp, Homo sapiens
tgcccagcttggtgctgacatctg

SEQ ID NO: 12563 - DNA, 23 bp, Homo sapiens
tgctgagctgagggcctggatct

SEQ ID NO: 12564 - DNA, 20 bp, Homo sapiens
tgccggacctggtggtttct

SEQ ID NO: 12565 - DNA, 15 bp, Homo sapiens
tgcctaacctgggtc

SEQ ID NO: 12566 - DNA, 20 bp, Homo sapiens
tgctggcctgatacggttcc

SEQ ID NO: 12567 - DNA, 27 bp, Homo sapiens
gcctagctggatctggtgtctggatct

SEQ ID NO: 12568 - DNA, 103 bp, Amsacta moorei entomopoxvirus
tgtatttatgtttatttttttattatttattaatatatttgtgttaaaattattttctacattaatattatttaataaattaaaataaggtttatattttaca

SEQ ID NO: 12569 - DNA, 24 bp, Amsacta moorei entomopoxvirus
tttatgtttatttttttattattt

SEQ ID NO: 12570 - DNA, 18 bp, Homo sapiens
tatgtttatttatttatt

SEQ ID NO: 12571 - DNA, 21 bp, Homo sapiens
tttatgtttatatattttatt

SEQ ID NO: 12572 - DNA, 87 bp, Amsacta moorei entomopoxvirus
ttgtaataacattatttacattaaatttatcatttaatatttttcttaaatgtatttcagtttcatgtggtttatttgttattataa

SEQ ID NO: 12573 - DNA, 24 bp, Amsacta moorei entomopoxvirus
attaaatttatcatttaatatttt

SEQ ID NO: 12574 - DNA, 23 bp, Homo sapiens
attaaatctatcctaaatatttt

SEQ ID NO: 12575 - DNA, 70 bp, Tupaia herpesvirus
cgccggtggcgcgtccgcgcggcgggtgaggaaaaccgtccctcctcggcgcgacggacgcgtagcggcg

SEQ ID NO: 12576 - DNA, 24 bp, Tupaia herpesvirus
tcggcgcgacggacgcgtagcggc

SEQ ID NO: 12577 - DNA, 19 bp, Homo sapiens
tcggcgcggcgcggctcgg

SEQ ID NO: 12578 - DNA, 23 bp, Homo sapiens
tcggcggcggcggcggcagcggc

SEQ ID NO: 12579 - DNA, 19 bp, Homo sapiens
tcggcgcgagggcgctggc

SEQ ID NO: 12580 - DNA, 21 bp, Homo sapiens
tcggcgcggtcgggcggcggc

SEQ ID NO: 12581 - DNA, 18 bp, Homo sapiens
tcggcgcggcggcggcgg

SEQ ID NO: 12582 - DNA, 17 bp, Homo sapiens
cggcgcggcggcggcgg

SEQ ID NO: 12583 - DNA, 20 bp, Homo sapiens
tcggagtgacggacaatggc

SEQ ID NO: 12584 - DNA, 19 bp, Homo sapiens
tcggcgcggcgcggcgcgg

SEQ ID NO: 12585 - DNA, 16 bp, Homo sapiens
tcggcgcgcgggcccg

SEQ ID NO: 12586 - DNA, 18 bp, Homo sapiens
tcagcgcggcggcggcgg

SEQ ID NO: 12587 - DNA, 21 bp, Homo sapiens
tcggcacggcgggtcccgcgg

SEQ ID NO: 12588 - DNA, 18 bp, Homo sapiens
tcgacgcggcggcggcgg

SEQ ID NO: 12589 - DNA, 21 bp, Homo sapiens
ccggcgcggcggactcccggc

SEQ ID NO: 12590 - DNA, 20 bp, Homo sapiens
ccggcgcggctggtagcggc

SEQ ID NO: 12591 - DNA, 19 bp, Homo sapiens
tcggcggcgacggcagcgg

SEQ ID NO: 12592 - DNA, 96 bp, Tupaia herpesvirus
gtagaagtctcaggctagccggcagccccaaaataaacgtgtcgtctcgaacggaactaaataccgggtgtgtgtctctgtgtgtgaggtctctgc

SEQ ID NO: 12593 - DNA, 24 bp, Tupaia herpesvirus
agtctcaggctagccggcagcccc

SEQ ID NO: 12594 - DNA, 19 bp, Homo sapiens
tcgggctgctgcagcagcc

SEQ ID NO: 12595 - DNA, 18 bp, Homo sapiens
gctcaggctcgcggctcc

SEQ ID NO: 12596 - DNA, 18 bp, Homo sapiens
agctcagggaggcagccc

SEQ ID NO: 12597 - DNA, 20 bp, Homo sapiens
gttccgggcgaggcagcccc

SEQ ID NO: 12598 - DNA, 22 bp, Homo sapiens
gtcccgggacactggcagcccc

SEQ ID NO: 12599 - DNA, 16 bp, Homo sapiens
agtcccaggctcagcc

SEQ ID NO: 12600 - DNA, 23 bp, Homo sapiens
aggctcaggctcctccggcagcc

SEQ ID NO: 12601 - DNA, 16 bp, Homo sapiens
gcctcaggcgcggtcc

SEQ ID NO: 12602 - DNA, 17 bp, Homo sapiens
agctcaggctggctgcc

SEQ ID NO: 12603 - DNA, 19 bp, Homo sapiens
agcctcaggcagtggcccc

SEQ ID NO: 12604 - DNA, 16 bp, Homo sapiens
agtctcagagcggcag

SEQ ID NO: 12605 - DNA, 18 bp, Homo sapiens
agtctccaagtcggcagc

SEQ ID NO: 12606 - DNA, 18 bp, Homo sapiens
gctcaggcttcctggccc

SEQ ID NO: 12607 - DNA, 15 bp, Homo sapiens
gcctcaggctcagcc

SEQ ID NO: 12608 - DNA, 22 bp, Homo sapiens
agcctcacggtccggcagcccc

SEQ ID NO: 12609 - DNA, 23 bp, Homo sapiens
gctcaggccccgggggcagcccc

SEQ ID NO: 12610 - DNA, 20 bp, Homo sapiens
agctcaagcctggcagctcc

SEQ ID NO: 12611 - DNA, 21 bp, Homo sapiens
agccttgggtccagcagcccc

SEQ ID NO: 12612 - DNA, 20 bp, Homo sapiens
agtcccaggcgtctgcagcc

SEQ ID NO: 12613 - DNA, 23 bp, Homo sapiens
gctcaggctgggcgcgcggcccc

SEQ ID NO: 12614 - DNA, 22 bp, Homo sapiens
agactccggggccggcagtccc

SEQ ID NO: 12615 - DNA, 20 bp, Homo sapiens
tccaggctggagccagctcc

SEQ ID NO: 12616 - DNA, 22 bp, Homo sapiens
agcctcaggccccactggcagc

SEQ ID NO: 12617 - DNA, 19 bp, Homo sapiens
gtctcaggcctttggcccc

SEQ ID NO: 12618 - DNA, 18 bp, Homo sapiens
gtccaggcgggcagtccc

SEQ ID NO: 12619 - DNA, 16 bp, Homo sapiens
gtccggcgccggcagc

SEQ ID NO: 12620 - DNA, 24 bp, Homo sapiens
agtctcagcctggtccctggtccc

SEQ ID NO: 12621 - DNA, 18 bp, Homo sapiens
agcctcaggctgcagccc

SEQ ID NO: 12622 - DNA, 23 bp, Homo sapiens
gtctggggttctctggcagcccc

SEQ ID NO: 12623 - DNA, 23 bp, Homo sapiens
gctcgggcgcccctggcagcccc

SEQ ID NO: 12624 - DNA, 21 bp, Homo sapiens
gtctcaggttccttcagctcc

SEQ ID NO: 12625 - DNA, 19 bp, Homo sapiens
gctcaggcccctgcagtcc

SEQ ID NO: 12626 - DNA, 15 bp, Homo sapiens
gtcccaggctgcagc

SEQ ID NO: 12627 - DNA, 19 bp, Homo sapiens
agtcccaggctggaggccc

SEQ ID NO: 12628 - DNA, 23 bp, Homo sapiens
atctcaggctggccctggacccc

SEQ ID NO: 12629 - DNA, 25 bp, Homo sapiens
gtctcaggcgggctcggcgcgcccc

SEQ ID NO: 12630 - DNA, 23 bp, Homo sapiens
agtcccaggctggctgcagcccc

SEQ ID NO: 12631 - DNA, 19 bp, Homo sapiens
agtctcagttactagttcc

SEQ ID NO: 12632 - DNA, 20 bp, Homo sapiens
gtctcaggctgacgcattcc

SEQ ID NO: 12633 - DNA, 19 bp, Homo sapiens
agctcaggctctttcagcc

SEQ ID NO: 12634 - DNA, 19 bp, Homo sapiens
agtctcaggttcgggctcc

SEQ ID NO: 12635 - DNA, 17 bp, Homo sapiens
agctcaggctgcagtcc

SEQ ID NO: 12636 - DNA, 21 bp, Homo sapiens
agtctcagctctgccagttcc

SEQ ID NO: 12637 - DNA, 21 bp, Homo sapiens
gtcttgaactacccggcagcc

SEQ ID NO: 12638 - DNA, 18 bp, Homo sapiens
gtctcaggcacctccagc

SEQ ID NO: 12639 - DNA, 20 bp, Homo sapiens
atctcaggctgaatgctggc

SEQ ID NO: 12640 - DNA, 21 bp, Homo sapiens
caagcattagccggcagttcc

SEQ ID NO: 12641 - DNA, 20 bp, Homo sapiens
gtctctggtagtggcagccc

SEQ ID NO: 12642 - DNA, 18 bp, Homo sapiens
gcctcaggctgtggctcc

SEQ ID NO: 12643 - DNA, 17 bp, Homo sapiens
gtctcagactctgcagc

SEQ ID NO: 12644 - DNA, 20 bp, Homo sapiens
agtctcaggtgtcctggccc

SEQ ID NO: 12645 - DNA, 21 bp, Homo sapiens
gtttcaggactgtgacagccc

SEQ ID NO: 12646 - DNA, 21 bp, Homo sapiens
ctcttggctcctggcagcccc

SEQ ID NO: 12647 - DNA, 15 bp, Homo sapiens
gtcccaggctggccc

SEQ ID NO: 12648 - DNA, 18 bp, Homo sapiens
agtctcaggctgggggcc

SEQ ID NO: 12649 - DNA, 17 bp, Homo sapiens
agtctcagctaatgggc

SEQ ID NO: 12650 - DNA, 17 bp, Homo sapiens
gctcaggcttcggctcc

SEQ ID NO: 12651 - DNA, 19 bp, Homo sapiens
gtctcaggcagctggttcc

SEQ ID NO: 12652 - DNA, 19 bp, Homo sapiens
gtcccaggctggctgctcc

SEQ ID NO: 12653 - DNA, 16 bp, Homo sapiens
agctcgggcggcagcc

SEQ ID NO: 12654 - DNA, 24 bp, Homo sapiens
gtctcgggctcacagtgcagcccc

SEQ ID NO: 12655 - DNA, 18 bp, Homo sapiens
agctcgggttcagcagcc

SEQ ID NO: 12656 - DNA, 18 bp, Homo sapiens
gtcccaggctggctgggc

SEQ ID NO: 12657 - DNA, 22 bp, Homo sapiens
gtctcaggcggccgccagcccc

SEQ ID NO: 12658 - DNA, 17 bp, Homo sapiens
gtcctaagccggcagcc

SEQ ID NO: 12659 - DNA, 19 bp, Homo sapiens
agactcggaccggcagccc

SEQ ID NO: 12660 - DNA, 20 bp, Homo sapiens
gtctcagagctggcctgggc

SEQ ID NO: 12661 - DNA, 17 bp, Homo sapiens
agcctttggctggcagc

SEQ ID NO: 12662 - DNA, 23 bp, Homo sapiens
aggctcaggctggcactcatccc

SEQ ID NO: 12663 - DNA, 22 bp, Homo sapiens
gcctcgcggccgctggcggccc

SEQ ID NO: 12664 - DNA, 19 bp, Homo sapiens
gtctcaggctggagtgggc

SEQ ID NO: 12665 - DNA, 21 bp, Homo sapiens
gcctcagatcctggtggtccc

SEQ ID NO: 12666 - DNA, 20 bp, Homo sapiens
gtctcagggtggccacatcc

SEQ ID NO: 12667 - DNA, 17 bp, Homo sapiens
agctcaggctggctggc

SEQ ID NO: 12668 - DNA, 18 bp, Homo sapiens
agctcaggctggccgggc

SEQ ID NO: 12669 - DNA, 18 bp, Homo sapiens
gtctcaggctgggctgcc

SEQ ID NO: 12670 - DNA, 19 bp, Homo sapiens
gcctcaggctcccggctcc

SEQ ID NO: 12671 - DNA, 18 bp, Homo sapiens
gcttcaggcgccgcagcc

SEQ ID NO: 12672 - DNA, 19 bp, Homo sapiens
tctccgggctggcagcccc

SEQ ID NO: 12673 - DNA, 19 bp, Homo sapiens
gtctcaggctggcggtggc

SEQ ID NO: 12674 - DNA, 20 bp, Homo sapiens
agctgcagggccggcagtcc

SEQ ID NO: 12675 - DNA, 20 bp, Homo sapiens
agtctcaggtcgtccagtcc

SEQ ID NO: 12676 - DNA, 18 bp, Homo sapiens
agcttcaggctggcgccc

SEQ ID NO: 12677 - DNA, 19 bp, Homo sapiens
agcttcagctgcggcagcc

SEQ ID NO: 12678 - DNA, 21 bp, Homo sapiens
agtcccaggttagcacaaagc

SEQ ID NO: 12679 - DNA, 20 bp, Homo sapiens
gtcccaggtttcacacagcc

SEQ ID NO: 12680 - DNA, 18 bp, Homo sapiens
agtttctgggcagcagcc

SEQ ID NO: 12681 - DNA, 18 bp, Homo sapiens
gtctcaggcagaacacgc

SEQ ID NO: 12682 - DNA, 20 bp, Homo sapiens
gcctcaggctagcccagcag

SEQ ID NO: 12683 - DNA, 18 bp, Homo sapiens
agtctcaggcatggctcc

SEQ ID NO: 12684 - DNA, 17 bp, Homo sapiens
agtctcaggctggcacc

SEQ ID NO: 12685 - DNA, 18 bp, Homo sapiens
tcaggagaacggcagccc

SEQ ID NO: 12686 - DNA, 23 bp, Homo sapiens
agtttcagatgcaaagcagcccc

SEQ ID NO: 12687 - DNA, 23 bp, Homo sapiens
agtcttcaggtcagtggcagccc

SEQ ID NO: 12688 - DNA, 19 bp, Homo sapiens
aggctcgggctccggtccc

SEQ ID NO: 12689 - DNA, 18 bp, Homo sapiens
aatctcaggctatgtagc

SEQ ID NO: 12690 - DNA, 21 bp, Homo sapiens
gcctcagaccctggtggtccc

SEQ ID NO: 12691 - DNA, 22 bp, Homo sapiens
agcctcaggctctggacggccc

SEQ ID NO: 12692 - DNA, 22 bp, Homo sapiens
agttgccagggccggcagttcc

SEQ ID NO: 12693 - DNA, 21 bp, Homo sapiens
agtctgggttaccacagcccc

SEQ ID NO: 12694 - DNA, 16 bp, Homo sapiens
agcctcaggggcagcc

SEQ ID NO: 12695 - DNA, 21 bp, Homo sapiens
gtcccaggctggctggaggcc

SEQ ID NO: 12696 - DNA, 23 bp, Homo sapiens
ctccggacttagccggcggctcc

SEQ ID NO: 12697 - DNA, 18 bp, Homo sapiens
agcctcaggctggctgac

SEQ ID NO: 12698 - DNA, 21 bp, Homo sapiens
tctgcgccggccggcagctcc

SEQ ID NO: 12699 - DNA, 18 bp, Homo sapiens
aatctcaggcttacagcc

SEQ ID NO: 12700 - DNA, 19 bp, Homo sapiens
agtctcggctgagagagcc

SEQ ID NO: 12701 - DNA, 17 bp, Homo sapiens
agcctcaggctcccggc

SEQ ID NO: 12702 - DNA, 18 bp, Homo sapiens
agtcccaggctggtctcc

SEQ ID NO: 12703 - DNA, 23 bp, Homo sapiens
gtcacggagaagccggcagctcc

SEQ ID NO: 12704 - DNA, 22 bp, Homo sapiens
agtctctggagatggcagcccc

SEQ ID NO: 12705 - DNA, 21 bp, Homo sapiens
aatctcaggcagaaggcggcc

SEQ ID NO: 12706 - DNA, 22 bp, Homo sapiens
gtctcagggctggtgcagcccc

SEQ ID NO: 12707 - DNA, 17 bp, Homo sapiens
agcctcaggctaggtgc

SEQ ID NO: 12708 - DNA, 20 bp, Homo sapiens
gtcttcccagctggcagccc

SEQ ID NO: 12709 - DNA, 22 bp, Homo sapiens
agtctggttcgttggcagcccc

SEQ ID NO: 12710 - DNA, 23 bp, Homo sapiens
agcctcaggctgggaccagcccc

SEQ ID NO: 12711 - DNA, 23 bp, Homo sapiens
ctctgctggtggccggcagctcc

SEQ ID NO: 12712 - DNA, 23 bp, Homo sapiens
agctcaggctgggctgtagcccc

SEQ ID NO: 12713 - DNA, 62 bp, Human herpesvirus 7
tctaatatgtatgaaataatagatgtctgcatagacagtaatgcggttttgtacatgccaga

SEQ ID NO: 12714 - DNA, 24 bp, Human herpesvirus 7
taatatgtatgaaataatagatgt

SEQ ID NO: 12715 - DNA, 19 bp, Homo sapiens
taatatataaaaatagatg

SEQ ID NO: 12716 - DNA, 22 bp, Homo sapiens
taatatgtttgaaatggagata

SEQ ID NO: 12717 - DNA, 23 bp, Homo sapiens
taatatgtatcatcatgagatgt

SEQ ID NO: 12718 - DNA, 60 bp, Human herpesvirus 7
gtgtttatataattgtttaggggcaagtcagattacagtagattttaaaaatatttacac

SEQ ID NO: 12719 - DNA, 24 bp, Human herpesvirus 7
agattacagtagattttaaaaata

SEQ ID NO: 12720 - DNA, 24 bp, Homo sapiens
agactatccaaaattttaaaaata

SEQ ID NO: 12721 - DNA, 21 bp, Homo sapiens
attacataaattttaaaaata

SEQ ID NO: 12722 - DNA, 23 bp, Homo sapiens
aggtcacagtgaaggtaaaaata

SEQ ID NO: 12723 - DNA, 19 bp, Homo sapiens
gaatacagtagttaaaaat

SEQ ID NO: 12724 - DNA, 19 bp, Homo sapiens
acagctggattttaaaaat

SEQ ID NO: 12725 - DNA, 18 bp, Homo sapiens
gattacagcaggctccaa

SEQ ID NO: 12726 - DNA, 23 bp, Homo sapiens
aggtcacagtcatattaaaaata

SEQ ID NO: 12727 - DNA, 22 bp, Homo sapiens
gattcagttgatttttaaaaat

SEQ ID NO: 12728 - DNA, 25 bp, Homo sapiens
aattacagtaaaatgttttaaaaat

SEQ ID NO: 12729 - DNA, 21 bp, Homo sapiens
gattacactagtttaaaaata

SEQ ID NO: 12730 - DNA, 22 bp, Homo sapiens
agatacagtagcacacaaaata

SEQ ID NO: 12731 - DNA, 20 bp, Homo sapiens
gattaaagtagatcaataaa

SEQ ID NO: 12732 - DNA, 22 bp, Homo sapiens
agataaaaagattttaaaaata

SEQ ID NO: 12733 - DNA, 18 bp, Homo sapiens
gattacagtagggttaaa

SEQ ID NO: 12734 - DNA, 63 bp, Human herpesvirus 7
ttttttggttattggaaatgagatttctgaaaatctccttgataagatttccatttcaaaaga

SEQ ID NO: 12735 - DNA, 24 bp, Human herpesvirus 7
atctccttgataagatttccattt

SEQ ID NO: 12736 - DNA, 23 bp, Homo sapiens
atctttattgaccttttccattt

SEQ ID NO: 12737 - DNA, 17 bp, Homo sapiens
tctccaggatttccatt

SEQ ID NO: 12738 - DNA, 18 bp, Homo sapiens
atcctcttgataaggttc

SEQ ID NO: 12739 - DNA, 17 bp, Homo sapiens
atcttctgataagattt

SEQ ID NO: 12740 - DNA, 16 bp, Homo sapiens
tccctcggtttccatt

SEQ ID NO: 12741 - DNA, 22 bp, Homo sapiens
tcttttgaattcctttccattt

SEQ ID NO: 12742 - DNA, 22 bp, Homo sapiens
tcctcttgcctcatttccattt

SEQ ID NO: 12743 - DNA, 19 bp, Homo sapiens
ctccttgttttttccattt

SEQ ID NO: 12744 - DNA, 21 bp, Homo sapiens
cctcttaactggtttccattt

SEQ ID NO: 12745 - DNA, 19 bp, Homo sapiens
atctccctgattttctatt

SEQ ID NO: 12746 - DNA, 20 bp, Homo sapiens
tctccttaatggagcccatc

SEQ ID NO: 12747 - DNA, 17 bp, Homo sapiens
atctccttgtgagattt

SEQ ID NO: 12748 - DNA, 15 bp, Homo sapiens
cttgagatttccatt

SEQ ID NO: 12749 - DNA, 19 bp, Homo sapiens
atctccttgagaaaccatt

SEQ ID NO: 12750 - DNA, 19 bp, Homo sapiens
tctcctttaatttccattt

SEQ ID NO: 12751 - DNA, 73 bp, Fowlpox virus
tattatgtatttttattccgctagaactatagatgctaatgtagaaacaaagaaggattaaaaatagattgta

SEQ ID NO: 12752 - DNA, 24 bp, Fowlpox virus
tatgtatttttattccgctagaac

SEQ ID NO: 12753 - DNA, 20 bp, Homo sapiens
catgttttattctgctagaa

SEQ ID NO: 12754 - DNA, 23 bp, Homo sapiens
tatgtgttttttattgccagaac

SEQ ID NO: 12755 - DNA, 20 bp, Homo sapiens
tatgtattttttatttccct

SEQ ID NO: 12756 - DNA, 18 bp, Homo sapiens
tatgtatttatattctac

SEQ ID NO: 12757 - DNA, 19 bp, Homo sapiens
tatgtaattttcactagaa

SEQ ID NO: 12758 - DNA, 18 bp, Homo sapiens
tgtatttttatttgcaag

SEQ ID NO: 12759 - DNA, 24 bp, Homo sapiens
tgtatcttttaacggtggctagaa

SEQ ID NO: 12760 - DNA, 20 bp, Homo sapiens
tatgtatttttttcctggga

SEQ ID NO: 12761 - DNA, 20 bp, Homo sapiens
tgtacttcttcctgctggaa

SEQ ID NO: 12762 - DNA, 22 bp, Homo sapiens
tatgcatttttatttaccttag

SEQ ID NO: 12763 - DNA, 17 bp, Homo sapiens
tatgttttttattcggc

SEQ ID NO: 12764 - DNA, 19 bp, Homo sapiens
atgtatttttattttctag

SEQ ID NO: 12765 - DNA, 63 bp, Fowlpox virus
ggagctaataaatacacgggtaagcggacggatatacggcgatataagtgtattggaagctct

SEQ ID NO: 12766 - DNA, 19 bp, Fowlpox virus
taagtgtattggaagctct

SEQ ID NO: 12767 - DNA, 18 bp, Homo sapiens
caagcatatggaggctct

SEQ ID NO: 12768 - DNA, 17 bp, Homo sapiens
aagccacaggaagctct

SEQ ID NO: 12769 - DNA, 17 bp, Homo sapiens
aagcaatgggaagctct

SEQ ID NO: 12770 - DNA, 16 bp, Homo sapiens
taactgtagaagctct

SEQ ID NO: 12771 - DNA, 16 bp, Homo sapiens
aagtgcaaaaagctct

SEQ ID NO: 12772 - DNA, 17 bp, Homo sapiens
caagtgccagaagctct

SEQ ID NO: 12773 - DNA, 19 bp, Homo sapiens
taagtgtatgtccaaagct

SEQ ID NO: 12774 - DNA, 21 bp, Homo sapiens
aaatatacagttggaagctct

SEQ ID NO: 12775 - DNA, 18 bp, Homo sapiens
aagtgatacctgagctct

SEQ ID NO: 12776 - DNA, 18 bp, Homo sapiens
taaatgctcatgagctct

SEQ ID NO: 12777 - DNA, 21 bp, Homo sapiens
caagtgtatatggctggttct

SEQ ID NO: 12778 - DNA, 18 bp, Homo sapiens
taagctccctggagctct

SEQ ID NO: 12779 - DNA, 18 bp, Homo sapiens
taagtgtgtggaagccct

SEQ ID NO: 12780 - DNA, 19 bp, Homo sapiens
aggtattggagcttgctct

SEQ ID NO: 12781 - DNA, 18 bp, Homo sapiens
atgctctctggaagctct

SEQ ID NO: 12782 - DNA, 17 bp, Homo sapiens
aagtgttgaaaagctct

SEQ ID NO: 12783 - DNA, 16 bp, Homo sapiens
taaatgtattagctct

SEQ ID NO: 12784 - DNA, 18 bp, Homo sapiens
taagtgtatgggggccct

SEQ ID NO: 12785 - DNA, 19 bp, Homo sapiens
taagtgcttaaaaagctct

SEQ ID NO: 12786 - DNA, 19 bp, Homo sapiens
taagtattattaaagctct

SEQ ID NO: 12787 - DNA, 19 bp, Homo sapiens
taagctgtcctaaagctct

SEQ ID NO: 12788 - DNA, 17 bp, Homo sapiens
aagtgctgcaaagctct

SEQ ID NO: 12789 - DNA, 16 bp, Homo sapiens
taaatgggaaagctct

SEQ ID NO: 12790 - DNA, 17 bp, Homo sapiens
aagtatagagaagctct

SEQ ID NO: 12791 - DNA, 16 bp, Homo sapiens
taaggcagaaagctct

SEQ ID NO: 12792 - DNA, 18 bp, Homo sapiens
aaggtcactggaagctct

SEQ ID NO: 12793 - DNA, 19 bp, Homo sapiens
taaatgtagtaccagctct

SEQ ID NO: 12794 - DNA, 18 bp, Homo sapiens
aagttgtagtgaagctct

SEQ ID NO: 12795 - DNA, 19 bp, Homo sapiens
aaatgagtttggaagctct

SEQ ID NO: 12796 - DNA, 19 bp, Homo sapiens
taaatgtatggtcagctct

SEQ ID NO: 12797 - DNA, 131 bp, Human herpesvirus 7
gttctgatctttcttgtacatgttcaagttttcggcggttaagatgctttagagatagttcaagattttagattcaaaacatcacttatctccacagatcatttccaagcaattgtacagaaagatagaat

SEQ ID NO: 12798 - DNA, 24 bp, Human herpesvirus 7
ttcaagttttcggcggttaagatg

SEQ ID NO: 12799 - DNA, 24 bp, Homo sapiens
ttcaagttgttggttttccagatg

SEQ ID NO: 12800 - DNA, 71 bp, Human herpesvirus 7
ttccagttgaatgaggactgcagtattcttatgccaggtttttcaaagacgcagtctaaaagtaaagggaa

SEQ ID NO: 12801 - DNA, 24 bp, Human herpesvirus 7
agttgaatgaggactgcagtattc

SEQ ID NO: 12802 - DNA, 15 bp, Homo sapiens
agttaaaactgcagt

SEQ ID NO: 12803 - DNA, 17 bp, Homo sapiens
gttggaagaacagtatt

SEQ ID NO: 12804 - DNA, 18 bp, Homo sapiens
agtgagtgaggactgggc

SEQ ID NO: 12805 - DNA, 20 bp, Homo sapiens
aggtggatgagggctgcagc

SEQ ID NO: 12806 - DNA, 69 bp, Human herpesvirus 7
ggatatcctgtagtttttgatggttttttggttgatgacttacacaagatcaaaagttactggtaatcc

SEQ ID NO: 12807 - DNA, 24 bp, Human herpesvirus 7
atcctgtagtttttgatggttttt

SEQ ID NO: 12808 - DNA, 18 bp, Homo sapiens
tgtagtttttttgttttt

SEQ ID NO: 12809 - DNA, 21 bp, Homo sapiens
tcctgcagttttgtgcttttt

SEQ ID NO: 12810 - DNA, 17 bp, Homo sapiens
cctgtaaagatggtttt

SEQ ID NO: 12811 - DNA, 19 bp, Homo sapiens
tgagattttgatggttttt

SEQ ID NO: 12812 - DNA, 21 bp, Homo sapiens
atcctgagccaagtggttttt

SEQ ID NO: 12813 - DNA, 18 bp, Homo sapiens
ctgtatctggtggttttt

SEQ ID NO: 12814 - DNA, 26 bp, Homo sapiens
cctgtagtttttgaataaatgttttt

SEQ ID NO: 12815 - DNA, 19 bp, Homo sapiens
ctgtagttttattattttt

SEQ ID NO: 12816 - DNA, 20 bp, Homo sapiens
tcctgtagttttgtgatttt

SEQ ID NO: 12817 - DNA, 19 bp, Homo sapiens
ctgtaatttaggggttttt

SEQ ID NO: 12818 - DNA, 21 bp, Homo sapiens
ccgtttcttttgatggttttt

SEQ ID NO: 12819 - DNA, 17 bp, Homo sapiens
ctgtgtttttggctttt

SEQ ID NO: 12820 - DNA, 17 bp, Homo sapiens
ctgtagttgtggttttt

SEQ ID NO: 12821 - DNA, 15 bp, Homo sapiens
ctgtagtttgtggcc

SEQ ID NO: 12822 - DNA, 101 bp, Fowlpox virus
tcatagatatgatacaacacaacactacaaattatatgagttaaaaaatatagaatatctaataaataatttatgtaatactagctagtgtttatttatga

SEQ ID NO: 12823 - DNA, 24 bp, Fowlpox virus
tgagttaaaaaatatagaatatct

SEQ ID NO: 12824 - DNA, 23 bp, Homo sapiens
tgagttcaaaagcatgaatatct

SEQ ID NO: 12825 - DNA, 18 bp, Homo sapiens
tgagttaaatgaatatag

SEQ ID NO: 12826 - DNA, 23 bp, Homo sapiens
tgaggtaaacacatagaatatct

SEQ ID NO: 12827 - DNA, 19 bp, Homo sapiens
tgagttaaaaaatgtgaat

SEQ ID NO: 12828 - DNA, 18 bp, Homo sapiens
tgagttaaaaatatataa

SEQ ID NO: 12829 - DNA, 16 bp, Homo sapiens
tgagttagagaacatc

SEQ ID NO: 12830 - DNA, 65 bp, Equine foamy virus
gtctgagggatggctcgtccaacaaaccacacatcgaggaatgtaatacctgtcctctctcagat

SEQ ID NO: 12831 - DNA, 24 bp, Equine foamy virus
tgagggatggctcgtccaacaaac

SEQ ID NO: 12832 - DNA, 20 bp, Homo sapiens
gagggatgaacccgacggac

SEQ ID NO: 12833 - DNA, 17 bp, Homo sapiens
tggggagatgcccaaca

SEQ ID NO: 12834 - DNA, 17 bp, Homo sapiens
gagggatatctgacaaa

SEQ ID NO: 12835 - DNA, 21 bp, Homo sapiens
tggggatggttctaattacaa

SEQ ID NO: 12836 - DNA, 21 bp, Homo sapiens
tgagggacgagtggctgttca

SEQ ID NO: 12837 - DNA, 17 bp, Homo sapiens
tggggatggccgagcaa

SEQ ID NO: 12838 - DNA, 18 bp, Homo sapiens
tgagggatgtcagacaaa

SEQ ID NO: 12839 - DNA, 17 bp, Homo sapiens
tgaaggatctccaacaa

SEQ ID NO: 12840 - DNA, 16 bp, Homo sapiens
aaggggtggctcccaa

SEQ ID NO: 12841 - DNA, 21 bp, Homo sapiens
tgagggatgttctcaggacaa

SEQ ID NO: 12842 - DNA, 23 bp, Homo sapiens
tggggcatggctcgtggccacaa

SEQ ID NO: 12843 - DNA, 21 bp, Homo sapiens
gggtgtggctgttcaataaac

SEQ ID NO: 12844 - DNA, 18 bp, Homo sapiens
tgagggatggctcgaacc

SEQ ID NO: 12845 - DNA, 87 bp, Canine adenovirus
tacagtttgcccaatgtaaacgataagcaataaaggtcataaacagatgaacttttaagattttatttttcatacactcgagctgta

SEQ ID NO: 12846 - DNA, 24 bp, Canine adenovirus
taaacgataagcaataaaggtcat

SEQ ID NO: 12847 - DNA, 15 bp, Homo sapiens
acgacagtaaaggtc

SEQ ID NO: 12848 - DNA, 21 bp, Homo sapiens
taaacgataaacaaaaatcat

SEQ ID NO: 12849 - DNA, 19 bp, Homo sapiens
taaattataagcaataaaa

SEQ ID NO: 12850 - DNA, 66 bp, Equine foamy virus
ggattatggggctagctcagctcgctaatgcataatagcattcaactgacagcaaccccatagtct

SEQ ID NO: 12851 - DNA, 24 bp, Equine foamy virus
tagctcagctcgctaatgcataat

SEQ ID NO: 12852 - DNA, 21 bp, Homo sapiens
gcttatttcacttcgcataat

SEQ ID NO: 12853 - DNA, 21 bp, Homo sapiens
gctcagcttgttaattctaat

SEQ ID NO: 12854 - DNA, 22 bp, Homo sapiens
tagctcagttccctgaagacat

SEQ ID NO: 12855 - DNA, 20 bp, Homo sapiens
ctcaacgtctaatgcataat

SEQ ID NO: 12856 - DNA, 24 bp, Homo sapiens
tagtctagctgagaaatgcataat

SEQ ID NO: 12857 - DNA, 64 bp, Equine foamy virus
ggagccgggaggatagctcaacctgttaagaactcagaaggttatgtatattcttccttgctcc

SEQ ID NO: 12858 - DNA, 23 bp, Equine foamy virus
ttatgtatattcttccttgctcc

SEQ ID NO: 12859 - DNA, 16 bp, Homo sapiens
atgcacttccttgctc

SEQ ID NO: 12860 - DNA, 20 bp, Homo sapiens
ctatgtactcttcttgttcc

SEQ ID NO: 12861 - DNA, 20 bp, Homo sapiens
tcatgtatatcttccttgct

SEQ ID NO: 12862 - DNA, 18 bp, Homo sapiens
ttatctaagctccttgct

SEQ ID NO: 12863 - DNA, 20 bp, Homo sapiens
ttatgtatttctcttttgct

SEQ ID NO: 12864 - DNA, 19 bp, Homo sapiens
atgagaattcttccttgct

SEQ ID NO: 12865 - DNA, 21 bp, Homo sapiens
ttatgtattttttccttcctt

SEQ ID NO: 12866 - DNA, 17 bp, Homo sapiens
ttatgcatattgtgctc

SEQ ID NO: 12867 - DNA, 19 bp, Homo sapiens
tcatgtatatctttctttg

SEQ ID NO: 12868 - DNA, 17 bp, Homo sapiens
tgtaattcttccgggct

SEQ ID NO: 12869 - DNA, 17 bp, Homo sapiens
gtacgtcttccttgttc

SEQ ID NO: 12870 - DNA, 19 bp, Homo sapiens
tgtgtctccccccttgttc

SEQ ID NO: 12871 - DNA, 18 bp, Homo sapiens
tgtatattcttccatacc

SEQ ID NO: 12872 - DNA, 21 bp, Homo sapiens
ttatttatattcttatgtgct

SEQ ID NO: 12873 - DNA, 19 bp, Homo sapiens
ctatggtgattcttccttg

SEQ ID NO: 12874 - DNA, 18 bp, Homo sapiens
gtccatttttccttgctc

SEQ ID NO: 12875 - DNA, 21 bp, Homo sapiens
ttatgtgggtgcttttgctcc

SEQ ID NO: 12876 - DNA, 23 bp, Homo sapiens
ttatgtattggaaagccttgctc

SEQ ID NO: 12877 - DNA, 17 bp, Homo sapiens
atgttaatttccttgct

SEQ ID NO: 12878 - DNA, 20 bp, Homo sapiens
tgtaacacattccttgctcc

SEQ ID NO: 12879 - DNA, 17 bp, Homo sapiens
tgtatattctagttgct

SEQ ID NO: 12880 - DNA, 102 bp, Equine foamy virus
taaaatataaataagatcagattgtgagggccactcactcacatattcggctgcgtccggagtgagtcgagcaggccacagactgggtaagaatatatttta

SEQ ID NO: 12881 - DNA, 24 bp, Equine foamy virus
tgagtcgagcaggccacagactgg

SEQ ID NO: 12882 - DNA, 23 bp, Homo sapiens
tgagtcgaggggtagccgattgg

SEQ ID NO: 12883 - DNA, 21 bp, Homo sapiens
tgagtcgagtggtttacacag

SEQ ID NO: 12884 - DNA, 19 bp, Homo sapiens
gagcagggttgcagactgg

SEQ ID NO: 12885 - DNA, 22 bp, Homo sapiens
tgagtcagtcgcaacagactgg

SEQ ID NO: 12886 - DNA, 24 bp, Homo sapiens
tgagcgacgacggctgcagactgg

SEQ ID NO: 12887 - DNA, 24 bp, Homo sapiens
tgagatgctgaggccacaggctgg

SEQ ID NO: 12888 - DNA, 19 bp, Homo sapiens
aagctgggccacaggctgg

SEQ ID NO: 12889 - DNA, 21 bp, Homo sapiens
tgagttggccaggccactctg

SEQ ID NO: 12890 - DNA, 123 bp, Canine adenovirus
tagtggccacaacctccccaaccttgaccttcgcctatccattaattaagaataacaaccatataactctaagtgctgggagtggcttaagagtatccggaggtagccttactgtggccactg

SEQ ID NO: 12891 - DNA, 24 bp, Canine adenovirus
taagtgctgggagtggcttaagag

SEQ ID NO: 12892 - DNA, 19 bp, Homo sapiens
gtgctggaatggaccttag

SEQ ID NO: 12893 - DNA, 20 bp, Homo sapiens
aggctggggtgatctgagag

SEQ ID NO: 12894 - DNA, 19 bp, Homo sapiens
gtgctgggagttcctggag

SEQ ID NO: 12895 - DNA, 16 bp, Homo sapiens
taagtgctgcgttaag

SEQ ID NO: 12896 - DNA, 16 bp, Homo sapiens
taagggctgggagaag

SEQ ID NO: 12897 - DNA, 18 bp, Homo sapiens
gtgctgggggtgcgagag

SEQ ID NO: 12898 - DNA, 20 bp, Homo sapiens
gtgctgggggaagcggagag

SEQ ID NO: 12899 - DNA, 20 bp, Homo sapiens
agggctgggagagccaagag

SEQ ID NO: 12900 - DNA, 22 bp, Homo sapiens
agggctgggggtgggtgaggag

SEQ ID NO: 12901 - DNA, 17 bp, Homo sapiens
aagtgttggggggaaga

SEQ ID NO: 12902 - DNA, 22 bp, Homo sapiens
gtgctgggggtgctggcaggag

SEQ ID NO: 12903 - DNA, 22 bp, Homo sapiens
agtgtctcccatggcttaggag

SEQ ID NO: 12904 - DNA, 18 bp, Homo sapiens
gtggagagtggtttggga

SEQ ID NO: 12905 - DNA, 17 bp, Homo sapiens
agtgctgggagtgatca

SEQ ID NO: 12906 - DNA, 17 bp, Homo sapiens
gtgctgggagaccagag

SEQ ID NO: 12907 - DNA, 23 bp, Homo sapiens
gtgctgggatgggggtttaagag

SEQ ID NO: 12908 - DNA, 21 bp, Homo sapiens
aagttattagtggcttgggag

SEQ ID NO: 12909 - DNA, 23 bp, Homo sapiens
aagtgctgggagcacacaaagag

SEQ ID NO: 12910 - DNA, 19 bp, Homo sapiens
gtgctgaggacactgagag

SEQ ID NO: 12911 - DNA, 22 bp, Homo sapiens
agggctgagccaggcttaagag

SEQ ID NO: 12912 - DNA, 21 bp, Homo sapiens
taagtgctgggattcatagag

SEQ ID NO: 12913 - DNA, 19 bp, Homo sapiens
caagccaaggggtggctta

SEQ ID NO: 12914 - DNA, 15 bp, Homo sapiens
gtgcctggcttaaga

SEQ ID NO: 12915 - DNA, 18 bp, Homo sapiens
gtgctgggggtcctggag

SEQ ID NO: 12916 - DNA, 17 bp, Homo sapiens
tgctgggggctcgggag

SEQ ID NO: 12917 - DNA, 66 bp, Human adenovirus E
tggaccgcatggtgaccgacgtgcgcgaggccgtggcccagcgcgagcggttccaccgcgagtcca

SEQ ID NO: 12918 - DNA, 24 bp, Human adenovirus E
ccagcgcgagcggttccaccgcga

SEQ ID NO: 12919 - DNA, 21 bp, Homo sapiens
ccggcccgagcgcggctgcga

SEQ ID NO: 12920 - DNA, 17 bp, Homo sapiens
gcggcggccccgccgcg

SEQ ID NO: 12921 - DNA, 15 bp, Homo sapiens
ccgcgcgaccaccgc

SEQ ID NO: 12922 - DNA, 15 bp, Homo sapiens
cagcgcgacggctgc

SEQ ID NO: 12923 - DNA, 16 bp, Homo sapiens
gcgcggcggctccgcg

SEQ ID NO: 12924 - DNA, 19 bp, Homo sapiens
ccagcgcggcgaggctgcg

SEQ ID NO: 12925 - DNA, 17 bp, Homo sapiens
caggtgagcggcccgcg

SEQ ID NO: 12926 - DNA, 18 bp, Homo sapiens
ccggcgcggggcggcgcg

SEQ ID NO: 12927 - DNA, 20 bp, Homo sapiens
cagcgcgagaggccgccgcg

SEQ ID NO: 12928 - DNA, 16 bp, Homo sapiens
gccgcgagcagccgcg

SEQ ID NO: 12929 - DNA, 20 bp, Homo sapiens
ccgggcgggcagctccaccg

SEQ ID NO: 12930 - DNA, 25 bp, Homo sapiens
cagagcgagcgggcgaacgtcgcga

SEQ ID NO: 12931 - DNA, 19 bp, Homo sapiens
ccagcgcggcgggggcgcg

SEQ ID NO: 12932 - DNA, 21 bp, Homo sapiens
cagcgcgactggtcagctgcg

SEQ ID NO: 12933 - DNA, 19 bp, Homo sapiens
ccgcgcgagcgccgccgcg

SEQ ID NO: 12934 - DNA, 20 bp, Homo sapiens
agcgcgggcttgcggtcgcg

SEQ ID NO: 12935 - DNA, 22 bp, Homo sapiens
cagcgcggctcccgaggctgcg

SEQ ID NO: 12936 - DNA, 16 bp, Homo sapiens
cagcccgagcagccgc

SEQ ID NO: 12937 - DNA, 18 bp, Homo sapiens
ccagcacgggccctgccg

SEQ ID NO: 12938 - DNA, 20 bp, Homo sapiens
ccagcgcgtgcggcggtgcg

SEQ ID NO: 12939 - DNA, 22 bp, Homo sapiens
gcggtgcggtgactccaccgcg

SEQ ID NO: 12940 - DNA, 24 bp, Homo sapiens
cagcgcggggccacctcaccgcga

SEQ ID NO: 12941 - DNA, 18 bp, Homo sapiens
ccagcgcaggcgccaccg

SEQ ID NO: 12942 - DNA, 18 bp, Homo sapiens
ccggcgcgcagcaccgcg

SEQ ID NO: 12943 - DNA, 21 bp, Homo sapiens
ccagtgcggcgagcgccgcga

SEQ ID NO: 12944 - DNA, 19 bp, Homo sapiens
gcgcgcggtgcccaccgcg

SEQ ID NO: 12945 - DNA, 18 bp, Homo sapiens
ccggctcgggcggccgcg

SEQ ID NO: 12946 - DNA, 17 bp, Homo sapiens
cgcgcgcctccaccgcg

SEQ ID NO: 12947 - DNA, 19 bp, Homo sapiens
gcgcgagcgggaagccgcg

SEQ ID NO: 12948 - DNA, 16 bp, Homo sapiens
ccagtgcgggtcccac

SEQ ID NO: 12949 - DNA, 21 bp, Homo sapiens
ccgcgcgtgcatccaccgcga

SEQ ID NO: 12950 - DNA, 22 bp, Homo sapiens
gcgagcagattttccgccgtga

SEQ ID NO: 12951 - DNA, 23 bp, Homo sapiens
ccggtgcgagcctcggcgccgcg

SEQ ID NO: 12952 - DNA, 102 bp, Human adenovirus E
gccatcctgaatccccactggctcccgccgccggggttctacacgggcgagtacgacatgcccgaccccaatgacgggttcctgtgggacgatgtggacagc

SEQ ID NO: 12953 - DNA, 24 bp, Human adenovirus E
accccaatgacgggttcctgtggg

SEQ ID NO: 12954 - DNA, 20 bp, Homo sapiens
tgactgaactaacctgtggg

SEQ ID NO: 12955 - DNA, 25 bp, Homo sapiens
acccctgtggtgggcagggggtggg

SEQ ID NO: 12956 - DNA, 23 bp, Homo sapiens
accccaatgatgaagggcgtggg

SEQ ID NO: 12957 - DNA, 17 bp, Homo sapiens
cccccagtgtcctgtgg

SEQ ID NO: 12958 - DNA, 23 bp, Homo sapiens
ccccgatgccctctgcctgtggg

SEQ ID NO: 12959 - DNA, 22 bp, Homo sapiens
ccacagtgggaagttctgtggg

SEQ ID NO: 12960 - DNA, 21 bp, Homo sapiens
accctgtgatgggcaggtggg

SEQ ID NO: 12961 - DNA, 22 bp, Homo sapiens
cccctgtggtcaggcctgtggg

SEQ ID NO: 12962 - DNA, 21 bp, Homo sapiens
cctacctctggttcctgtggg

SEQ ID NO: 12963 - DNA, 22 bp, Homo sapiens
actccactgaggctcctgtggg

SEQ ID NO: 12964 - DNA, 18 bp, Homo sapiens
cctcgagggtccctgtgg

SEQ ID NO: 12965 - DNA, 18 bp, Homo sapiens
acctcagagttcctgtgg

SEQ ID NO: 12966 - DNA, 20 bp, Homo sapiens
ccctgtgacaggcctgtggg

SEQ ID NO: 12967 - DNA, 21 bp, Homo sapiens
ccccatggtggcaggggtggg

SEQ ID NO: 12968 - DNA, 21 bp, Homo sapiens
accccaaaggcagcctgtggg

SEQ ID NO: 12969 - DNA, 16 bp, Homo sapiens
ccaaatgatcctgtgg

SEQ ID NO: 12970 - DNA, 18 bp, Homo sapiens
ccctgagggggcctgtgg

SEQ ID NO: 12971 - DNA, 22 bp, Homo sapiens
ccatggtgggccctggtgtggg

SEQ ID NO: 12972 - DNA, 19 bp, Homo sapiens
accctgtgatgggtttatg

SEQ ID NO: 12973 - DNA, 20 bp, Homo sapiens
cccatggctctggttgtggg

SEQ ID NO: 12974 - DNA, 18 bp, Homo sapiens
accctgagacgggtttgg

SEQ ID NO: 12975 - DNA, 21 bp, Homo sapiens
ccctgtgaaaagtcctgtggg

SEQ ID NO: 12976 - DNA, 19 bp, Homo sapiens
accccaatcatgtttgtgg

SEQ ID NO: 12977 - DNA, 15 bp, Homo sapiens
ccctgaggtcctgtg

SEQ ID NO: 12978 - DNA, 17 bp, Homo sapiens
actccaatgacggctgg

SEQ ID NO: 12979 - DNA, 21 bp, Homo sapiens
ccccactggtgggtccctggg

SEQ ID NO: 12980 - DNA, 16 bp, Homo sapiens
ccagtgaggcctgtgg

SEQ ID NO: 12981 - DNA, 92 bp, Human herpesvirus 5
tcggcgcgctgccggtgcgttccacggtccttgcctgtgtcgtttcggcgctgcgcttgtcgggggttttcgagcgttctggccgccggcga

SEQ ID NO: 12982 - DNA, 24 bp, Human herpesvirus 5
gtgcgttccacggtccttgcctgt

SEQ ID NO: 12983 - DNA, 18 bp, Homo sapiens
gtgtgttccacgtcgctg

SEQ ID NO: 12984 - DNA, 21 bp, Homo sapiens
gtgcgtgttcgctctgcctgt

SEQ ID NO: 12985 - DNA, 21 bp, Homo sapiens
gtgccttccgcccgtgtttgt

SEQ ID NO: 12986 - DNA, 19 bp, Homo sapiens
gtgcgttcatttctgcttg

SEQ ID NO: 12987 - DNA, 78 bp, Planococcus citri densovirus
gcgtatcccacctttgaaagcacctcctaacgaaagacctaattgggaaaggttaaacgaaggacaaagacgatacgc

SEQ ID NO: 12988 - DNA, 24 bp, Planococcus citri densovirus
cacctttgaaagcacctcctaacg

SEQ ID NO: 12989 - DNA, 20 bp, Homo sapiens
cacctttggaagcctaaaac

SEQ ID NO: 12990 - DNA, 20 bp, Homo sapiens
cacctttgaaggactcaccc

SEQ ID NO: 12991 - DNA, 17 bp, Homo sapiens
cacctttgaaagcctcc

SEQ ID NO: 12992 - DNA, 21 bp, Homo sapiens
cccttgaagggcttcttctaa

SEQ ID NO: 12993 - DNA, 18 bp, Homo sapiens
accgacaaggcacctcct

SEQ ID NO: 12994 - DNA, 23 bp, Homo sapiens
caactttctaacacttcctaacg

SEQ ID NO: 12995 - DNA, 17 bp, Homo sapiens
ctttgaaaatgtcctaa

SEQ ID NO: 12996 - DNA, 15 bp, Homo sapiens
caccttgaaatccta

SEQ ID NO: 12997 - DNA, 19 bp, Homo sapiens
cttgaaaactcaacttcct

SEQ ID NO: 12998 - DNA, 109 bp, Planococcus citri densovirus
tatttcagaacaacaatctgctcccactgctcctatcgaacatccggttaataacgcagacgatagtgacgacgaagtaggtgggcctatagaagtacaagccgaagta

SEQ ID NO: 12999 - DNA, 24 bp, Planococcus citri densovirus
agacgatagtgacgacgaagtagg

SEQ ID NO: 13000 - DNA, 16 bp, Homo sapiens
gatggtggagaagtag

SEQ ID NO: 13001 - DNA, 21 bp, Homo sapiens
gatagtgaaaacatgggtggg

SEQ ID NO: 13002 - DNA, 21 bp, Homo sapiens
gacgaagtgatgaggagtggg

SEQ ID NO: 13003 - DNA, 22 bp, Homo sapiens
gatatggtgacgactattcagg

SEQ ID NO: 13004 - DNA, 23 bp, Homo sapiens
gacgttagtgacaatggagtggg

SEQ ID NO: 13005 - DNA, 25 bp, Homo sapiens
gatgataatgatgtttcagagtagg

SEQ ID NO: 13006 - DNA, 65 bp, Planococcus citri densovirus
atttcacgtggcttagaatcgaatacttggactgacgtatttatgactacacctttagctgaaat

SEQ ID NO: 13007 - DNA, 22 bp, Planococcus citri densovirus
tgactacacctttagctgaaat

SEQ ID NO: 13008 - DNA, 16 bp, Homo sapiens
taattacaccttgctg

SEQ ID NO: 13009 - DNA, 22 bp, Homo sapiens
tgatacatcagctaaagctgaa

SEQ ID NO: 13010 - DNA, 16 bp, Homo sapiens
tgacacacctttttga

SEQ ID NO: 13011 - DNA, 16 bp, Homo sapiens
tacaccttcatgaaat

SEQ ID NO: 13012 - DNA, 19 bp, Homo sapiens
tgactacatttttatgcca

SEQ ID NO: 13013 - DNA, 18 bp, Homo sapiens
tgactacatatttgctga

SEQ ID NO: 13014 - DNA, 19 bp, Homo sapiens
tgatggtacctttagtgaa

SEQ ID NO: 13015 - DNA, 17 bp, Homo sapiens
tggccacatcttagctg

SEQ ID NO: 13016 - DNA, 16 bp, Homo sapiens
tgactcactgctgaaa

SEQ ID NO: 13017 - DNA, 18 bp, Homo sapiens
tgactctgcctttagcca

SEQ ID NO: 13018 - DNA, 18 bp, Homo sapiens
tggctacacctcctgcca

SEQ ID NO: 13019 - DNA, 19 bp, Homo sapiens
actgcacctttaagcataa

SEQ ID NO: 13020 - DNA, 18 bp, Homo sapiens
actgcaggccttagctga

SEQ ID NO: 13021 - DNA, 18 bp, Homo sapiens
tgactacatcctcaggaa

SEQ ID NO: 13022 - DNA, 15 bp, Homo sapiens
actacacctcaggaa

SEQ ID NO: 13023 - DNA, 18 bp, Homo sapiens
tgtactacaatcagctga

SEQ ID NO: 13024 - DNA, 21 bp, Homo sapiens
tgactacacctattagaggga

SEQ ID NO: 13025 - DNA, 18 bp, Homo sapiens
taactacatttttcctga

SEQ ID NO: 13026 - DNA, 15 bp, Homo sapiens
taactacactcctga

SEQ ID NO: 13027 - DNA, 17 bp, Homo sapiens
tgactcacctttacaga

SEQ ID NO: 13028 - DNA, 19 bp, Homo sapiens
ctacaaaattggctgaaat

SEQ ID NO: 13029 - DNA, 16 bp, Homo sapiens
tggccacaccctgaaa

SEQ ID NO: 13030 - DNA, 21 bp, Homo sapiens
gactccatttttagctgaaat

SEQ ID NO: 13031 - DNA, 16 bp, Homo sapiens
gactacaccaagctga

SEQ ID NO: 13032 - DNA, 19 bp, Homo sapiens
tggctacacccctggctga

SEQ ID NO: 13033 - DNA, 19 bp, Homo sapiens
tgaccacacttttttcagc

SEQ ID NO: 13034 - DNA, 16 bp, Homo sapiens
tgactcactcagatga

SEQ ID NO: 13035 - DNA, 18 bp, Homo sapiens
tgactacaccatttattg

SEQ ID NO: 13036 - DNA, 17 bp, Homo sapiens
ctgcacacagctgaaat

SEQ ID NO: 13037 - DNA, 16 bp, Homo sapiens
tgaccacactgctgaa

SEQ ID NO: 13038 - DNA, 16 bp, Homo sapiens
tgctacacctttgctg

SEQ ID NO: 13039 - DNA, 22 bp, Homo sapiens
tgactacctgggcagctgaaat

SEQ ID NO: 13040 - DNA, 20 bp, Homo sapiens
tgactccactttgctgaaat

SEQ ID NO: 13041 - DNA, 98 bp, Zaire Ebola virus
tgctaaactaatgatgaagattaatgcggaggtctgataagaataaaccttattattcagattaggccccaagaggcattcttcatctccttttagca

SEQ ID NO: 13042 - DNA, 24 bp, Zaire Ebola virus
atgaagattaatgcggaggtctga

SEQ ID NO: 13043 - DNA, 20 bp, Homo sapiens
taaggattaatgcaaatctg

SEQ ID NO: 13044 - DNA, 18 bp, Homo sapiens
atgaagattaatgtggtc

SEQ ID NO: 13045 - DNA, 19 bp, Homo sapiens
atgaagatgcccaggtctg

SEQ ID NO: 13046 - DNA, 19 bp, Homo sapiens
tggagctgtgggaggtctg

SEQ ID NO: 13047 - DNA, 20 bp, Homo sapiens
atgaaggttaatgcagcagg

SEQ ID NO: 13048 - DNA, 18 bp, Homo sapiens
atgagatgaggaggtctg

SEQ ID NO: 13049 - DNA, 19 bp, Homo sapiens
aagggaatgtggaggtctg

SEQ ID NO: 13050 - DNA, 20 bp, Homo sapiens
atgaagatgatgctattctg

SEQ ID NO: 13051 - DNA, 69 bp, Planococcus citri densovirus
acaagtataccttctacttctattgataatcagtttactgatactcaatgttattgggaagttatttgt

SEQ ID NO: 13052 - DNA, 24 bp, Planococcus citri densovirus
taccttctacttctattgataatc

SEQ ID NO: 13053 - DNA, 24 bp, Homo sapiens
taccttcctacttttgctaaggat

SEQ ID NO: 13054 - DNA, 21 bp, Homo sapiens
ccttctatttctagcaaaatc

SEQ ID NO: 13055 - DNA, 22 bp, Homo sapiens
taccttctacttcatataaata

SEQ ID NO: 13056 - DNA, 18 bp, Homo sapiens
cttctactcttggcaatc

SEQ ID NO: 13057 - DNA, 18 bp, Homo sapiens
ctccgattattgataatc

SEQ ID NO: 13058 - DNA, 18 bp, Homo sapiens
tactttctacttctgctg

SEQ ID NO: 13059 - DNA, 18 bp, Homo sapiens
cttctacttctaaaagat

SEQ ID NO: 13060 - DNA, 28 bp, Homo sapiens
taccttctacttccatgtggatataatc

SEQ ID NO: 13061 - DNA, 19 bp, Homo sapiens
tactttctacattgataat

SEQ ID NO: 13062 - DNA, 22 bp, Homo sapiens
cctttcatttctattggtaatc

SEQ ID NO: 13063 - DNA, 18 bp, Homo sapiens
cttctacttcttgtacaa

SEQ ID NO: 13064 - DNA, 18 bp, Homo sapiens
taccttccatttctgtga

SEQ ID NO: 13065 - DNA, 19 bp, Homo sapiens
cttctacttctttaaaatc

SEQ ID NO: 13066 - DNA, 20 bp, Homo sapiens
taccttttcttccacttgat

SEQ ID NO: 13067 - DNA, 17 bp, Homo sapiens
taccttctgctacactg

SEQ ID NO: 13068 - DNA, 66 bp, Acyrthosiphon pisum virus
gctgcgtttatgggtggaggtctcctgtctggattaggacaggggattggcgcttatgcacaaggc

SEQ ID NO: 13069 - DNA, 24 bp, Acyrthosiphon pisum virus
tttatgggtggaggtctcctgtct

SEQ ID NO: 13070 - DNA, 21 bp, Homo sapiens
ttcatgggtgctatcttgtct

SEQ ID NO: 13071 - DNA, 20 bp, Homo sapiens
tagccagaggtcttctgtct

SEQ ID NO: 13072 - DNA, 21 bp, Homo sapiens
tttatgggtggaatcacttgt

SEQ ID NO: 13073 - DNA, 81 bp, Acyrthosiphon pisum virus
ctattattctaaactaaaataaccatttatacttttattccataacgtagtatatagatttattttattcttttataatgg

SEQ ID NO: 13074 - DNA, 24 bp, Acyrthosiphon pisum virus
actaaaataaccatttatactttt

SEQ ID NO: 13075 - DNA, 21 bp, Homo sapiens
actaaaatagtctatactttt

SEQ ID NO: 13076 - DNA, 22 bp, Homo sapiens
taaaatattcatttatactttt

SEQ ID NO: 13077 - DNA, 23 bp, Homo sapiens
acttaaataacaaatatactttt

SEQ ID NO: 13078 - DNA, 21 bp, Homo sapiens
taaaataaccaccatcctttt

SEQ ID NO: 13079 - DNA, 27 bp, Homo sapiens
actaaaattgccaatatgaatactttt

SEQ ID NO: 13080 - DNA, 22 bp, Homo sapiens
taaaataaccatttcggctctt

SEQ ID NO: 13081 - DNA, 25 bp, Homo sapiens
ctaaataaccataaaaaatactttt

SEQ ID NO: 13082 - DNA, 21 bp, Homo sapiens
taaaatgaccatctatacttt

SEQ ID NO: 13083 - DNA, 130 bp, Fowlpox virus
aacttttttatcgagagctcgagttatagaaaaactttttatcgagagctcgagatttcgaaaagcttttttatcgagagctcgagttatagaaaaactttttatcgagagctcgagttatagaaaaact

SEQ ID NO: 13084 - DNA, 24 bp, Fowlpox virus
tagaaaaactttttatcgagagct

SEQ ID NO: 13085 - DNA, 20 bp, Homo sapiens
gagagactttccatggagct

SEQ ID NO: 13086 - DNA, 19 bp, Homo sapiens
gaaaaacttttggtgagct

SEQ ID NO: 13087 - DNA, 15 bp, Homo sapiens
aaaaaactttttgag

SEQ ID NO: 13088 - DNA, 18 bp, Homo sapiens
gaggaaactcctcgagag

SEQ ID NO: 13089 - DNA, 20 bp, Homo sapiens
gaaaaacttttattagaact

SEQ ID NO: 13090 - DNA, 20 bp, Homo sapiens
gaaaagctccttcgagagct

SEQ ID NO: 13091 - DNA, 21 bp, Homo sapiens
tagaaaaaccttttaaatgaa

SEQ ID NO: 13092 - DNA, 23 bp, Homo sapiens
tagaaaaaactggaatgagagct

SEQ ID NO: 13093 - DNA, 17 bp, Homo sapiens
gaaaatcttttatcgag

SEQ ID NO: 13094 - DNA, 22 bp, Homo sapiens
gaaaaacttttgagtcagagct

SEQ ID NO: 13095 - DNA, 80 bp, Swinepox virus
tgaacatgtctacaccatcttttgacagtagtgataaatgattttttatcaaccattcaaaaaaatagttagacatttca

SEQ ID NO: 13096 - DNA, 24 bp, Swinepox virus
tctacaccatcttttgacagtagt

SEQ ID NO: 13097 - DNA, 23 bp, Homo sapiens
tctaaattgtctactacagtagt

SEQ ID NO: 13098 - DNA, 25 bp, Homo sapiens
tctagccatcttcctaggcagtagt

SEQ ID NO: 13099 - DNA, 18 bp, Homo sapiens
catcttaaagacagtagt

SEQ ID NO: 13100 - DNA, 18 bp, Homo sapiens
catgctaatgacagtagt

SEQ ID NO: 13101 - DNA, 17 bp, Homo sapiens
ccatctttagaagtagt

SEQ ID NO: 13102 - DNA, 18 bp, Homo sapiens
tctgcaacatctttcaca

SEQ ID NO: 13103 - DNA, 20 bp, Homo sapiens
catcattttaacaatgcagt

SEQ ID NO: 13104 - DNA, 20 bp, Homo sapiens
accatcactacaacagtagt

SEQ ID NO: 13105 - DNA, 19 bp, Homo sapiens
tctgcacatcttttaaaag

SEQ ID NO: 13106 - DNA, 18 bp, Homo sapiens
tacacaatcttttgaaca

SEQ ID NO: 13107 - DNA, 15 bp, Homo sapiens
tacaccttaacagtg

SEQ ID NO: 13108 - DNA, 17 bp, Homo sapiens
tctacccatctttccac

SEQ ID NO: 13109 - DNA, 18 bp, Homo sapiens
tctgcacctctggaacag

SEQ ID NO: 13110 - DNA, 20 bp, Homo sapiens
tacactatgttgacagtagt

SEQ ID NO: 13111 - DNA, 18 bp, Homo sapiens
tctacaccatgtttgtca

SEQ ID NO: 13112 - DNA, 20 bp, Homo sapiens
tctacaccgtttctttggca

SEQ ID NO: 13113 - DNA, 22 bp, Homo sapiens
cacattgggttttgacagtagt

SEQ ID NO: 13114 - DNA, 21 bp, Homo sapiens
tctgcacctcctcgaagtagt

SEQ ID NO: 13115 - DNA, 20 bp, Homo sapiens
tctgtatcatctcttgcagt

SEQ ID NO: 13116 - DNA, 22 bp, Homo sapiens
tctacaccctcttttaaagagt

SEQ ID NO: 13117 - DNA, 18 bp, Homo sapiens
ctatgccatcttttcagt

SEQ ID NO: 13118 - DNA, 16 bp, Homo sapiens
tcttcaccatccagta

SEQ ID NO: 13119 - DNA, 21 bp, Homo sapiens
tcaatactatcctacagtagt

SEQ ID NO: 13120 - DNA, 130 bp, Fowlpox virus
cgagttatagaaaaacttttttatcgagagctcgagttatagaaaaacttttttatcgagagctcgagttatagaaaaacttttttatcgagagctcgaatgttagaaaaacttttttatcgagagctcg

SEQ ID NO: 13121 - DNA, 24 bp, Fowlpox virus
acttttttatcgagagctcgagtt

SEQ ID NO: 13122 - DNA, 23 bp, Homo sapiens
actttttcattgagttactagtt

SEQ ID NO: 13123 - DNA, 126 bp, Fowlpox virus
ttttttatcgagagctcgagttatagaaaaacttttttatcgagagctcgagttatagaaaaacttttttatcgagagctcgagttatagaaaaacttttttatcgagagctcgagttatagaaaa

SEQ ID NO: 13124 - DNA, 125 bp, Fowlpox virus
gagctctcgataaaaaagtttttctataactcgagctctcgataaaaaagtttttcgaaatctcgataaaaactttttctataactcgagctctcgataaaaaactttttctataactcgagctc

SEQ ID NO: 13125 - DNA, 24 bp, Fowlpox virus
gataaaaaagtttttcgaaatctc

SEQ ID NO: 13126 - DNA, 23 bp, Homo sapiens
aataaaaaagtccccaaagtctc

SEQ ID NO: 13127 - DNA, 22 bp, Homo sapiens
gaggaaaacacgtcgaaatctc

SEQ ID NO: 13128 - DNA, 22 bp, Homo sapiens
gataaaaatgttttctcatctc

SEQ ID NO: 13129 - DNA, 19 bp, Homo sapiens
aaaaagttttttggaaatc

SEQ ID NO: 13130 - DNA, 129 bp, Fowlpox virus
aaaagcttttcgaaatctcgataaaaactttttctataactcgagctctcgataaaaaagtttttctaacattcgagctctcgataaaaaagtttttctataactcgagctctcgataaaaaagttttt

SEQ ID NO: 13131 - DNA, 24 bp, Fowlpox virus
aagcttttcgaaatctcgataaaa

SEQ ID NO: 13132 - DNA, 17 bp, Homo sapiens
agctttccgatcaagac

SEQ ID NO: 13133 - DNA, 23 bp, Homo sapiens
aaggttttcctattctcgataaa

SEQ ID NO: 13134 - DNA, 18 bp, Homo sapiens
aactttttgaaatcctga

SEQ ID NO: 13135 - DNA, 24 bp, Homo sapiens
aagctttttcaaaaagtcataaaa

SEQ ID NO: 13136 - DNA, 21 bp, Homo sapiens
aagctttttgaagcttgataa

SEQ ID NO: 13137 - DNA, 18 bp, Homo sapiens
gcttctcggaatttctcg

SEQ ID NO: 13138 - DNA, 126 bp, Fowlpox virus
gagctctcgataaaaaagtttttctataactcgagctctcgataaaaaagcttttcgaaatctcgataaaaaagtttttctataactcgagctctcgataaaaaagtttttctataactcgagctc

SEQ ID NO: 13139 - DNA, 24 bp, Fowlpox virus
gataaaaaagcttttcgaaatctc

SEQ ID NO: 13140 - DNA, 20 bp, Homo sapiens
gatgggaaagctcttcatct

SEQ ID NO: 13141 - DNA, 21 bp, Homo sapiens
gatgaaagagctctccatctc

SEQ ID NO: 13142 - DNA, 18 bp, Homo sapiens
aaaacacgtcgaaatctc

SEQ ID NO: 13143 - DNA, 18 bp, Homo sapiens
gataaaaaggctttttct

SEQ ID NO: 13144 - DNA, 23 bp, Homo sapiens
gattggaaagctcccaaaatctc

SEQ ID NO: 13145 - DNA, 21 bp, Homo sapiens
ataaagaagcttttaacatct

SEQ ID NO: 13146 - DNA, 131 bp, Fowlpox virus
agtttttctataactcgagctctcgataaaaaagcttttcgaaatctcgagctctcgataaaaagtttttctataactcgagctctcgataaaaaagtttttctataactcgagctctcgataaaaaagct

SEQ ID NO: 13147 - DNA, 24 bp, Fowlpox virus
taactcgagctctcgataaaaaag

SEQ ID NO: 13148 - DNA, 23 bp, Homo sapiens
taactttagctcttataaaaaag

SEQ ID NO: 13149 - DNA, 21 bp, Homo sapiens
acttaaacagggataaaaaag

SEQ ID NO: 13150 - DNA, 21 bp, Homo sapiens
ctcgggctcttggtaaaaaag

SEQ ID NO: 13151 - DNA, 20 bp, Homo sapiens
taactcaagctttataaaaa

SEQ ID NO: 13152 - DNA, 130 bp, Fowlpox virus
gtttttctataactcgagctctcgataaaaaagtttttctataactcgagctctcgataaaaaagtttttctataactcgagctctcgataaaaaagtttttctataactcgagctctcgataaaaaagc

SEQ ID NO: 13153 - DNA, 70 bp, Human herpesvirus 5
gtttcggggattgtgaaccgtggctgagggtgtagatgggacaggaaaaagcgtgtgatctgaccgaggc

SEQ ID NO: 13154 - DNA, 24 bp, Human herpesvirus 5
ggggattgtgaaccgtggctgagg

SEQ ID NO: 13155 - DNA, 23 bp, Homo sapiens
ggagattgttcatgtggctgagg

SEQ ID NO: 13156 - DNA, 16 bp, Homo sapiens
ggggattgtagccgga

SEQ ID NO: 13157 - DNA, 19 bp, Homo sapiens
ggatgtcttgtggctgagg

SEQ ID NO: 13158 - DNA, 19 bp, Homo sapiens
gggggtgctggtggctgag

SEQ ID NO: 13159 - DNA, 18 bp, Homo sapiens
ggtgattgtgggccgtgg

SEQ ID NO: 13160 - DNA, 21 bp, Homo sapiens
gggagttctctgtggctgagg

SEQ ID NO: 13161 - DNA, 18 bp, Homo sapiens
ggggatttgagggctgag

SEQ ID NO: 13162 - DNA, 19 bp, Homo sapiens
gggggagccgtggctgagg

SEQ ID NO: 13163 - DNA, 19 bp, Homo sapiens
ggggttgtgaaccagctaa

SEQ ID NO: 13164 - DNA, 23 bp, Homo sapiens
ggggattgggagccccagggagg

SEQ ID NO: 13165 - DNA, 15 bp, Homo sapiens
ggggctgtgaactga

SEQ ID NO: 13166 - DNA, 21 bp, Homo sapiens
ggggattgggactggcctggg

SEQ ID NO: 13167 - DNA, 19 bp, Homo sapiens
ggggactgtgggtttcgag

SEQ ID NO: 13168 - DNA, 130 bp, African swine fever virus
tagtaataattttaatctttgacgcctacagcagtagtaataattttaatgtttaacgcctacaacagtagtaataattttaatgtttaacgcctacagcagtagtaataattttaatgtttaacgccta

SEQ ID NO: 13169 - DNA, 24 bp, African swine fever virus
tctttgacgcctacagcagtagta

SEQ ID NO: 13170 - DNA, 22 bp, Homo sapiens
tttgcactttgcagcagtagta

SEQ ID NO: 13171 - DNA, 19 bp, Homo sapiens
tctttgaagcctacagggc

SEQ ID NO: 13172 - DNA, 21 bp, Homo sapiens
tctttgaccctaattcttagt

SEQ ID NO: 13173 - DNA, 23 bp, Homo sapiens
tctttgacagcttatggacagta

SEQ ID NO: 13174 - DNA, 19 bp, Homo sapiens
tctctgagacagtagtagt

SEQ ID NO: 13175 - DNA, 21 bp, Homo sapiens
tccttgactagaagcagtagt

SEQ ID NO: 13176 - DNA, 20 bp, Homo sapiens
tctgtaccgactgcagtagt

SEQ ID NO: 13177 - DNA, 23 bp, Homo sapiens
tctttgactcctgtggaagcagt

SEQ ID NO: 13178 - DNA, 64 bp, African swine fever virus
gtagtaataattttaatgtttaacgcctacaacagtagtaataattttaatgtttaacgcctac

SEQ ID NO: 13179 - DNA, 24 bp, African swine fever virus
ttaatgtttaacgcctacaacagt

SEQ ID NO: 13180 - DNA, 22 bp, Homo sapiens
ttaatggtgaacctataacagt

SEQ ID NO: 13181 - DNA, 20 bp, Homo sapiens
aatgtttactgcataacagt

SEQ ID NO: 13182 - DNA, 63 bp, Human herpesvirus 5
ggggtgatccggatgcgtggcaagaggcctcgagcttgggcttctcccgcggatggacgttct

SEQ ID NO: 13183 - DNA, 19 bp, Human herpesvirus 5
tcccgcggatggacgttct

SEQ ID NO: 13184 - DNA, 17 bp, Homo sapiens
tcccacaactgtgttct

SEQ ID NO: 13185 - DNA, 19 bp, Homo sapiens
tcccatggacacctgttct

SEQ ID NO: 13186 - DNA, 18 bp, Homo sapiens
tcccgcgggagagcctct

SEQ ID NO: 13187 - DNA, 18 bp, Homo sapiens
tcctgcggggtggattct

SEQ ID NO: 13188 - DNA, 19 bp, Homo sapiens
tctccatcagcgacgttct

SEQ ID NO: 13189 - DNA, 18 bp, Homo sapiens
tcccgcagatgtgccatt

SEQ ID NO: 13190 - DNA, 18 bp, Homo sapiens
ccttaaagtggacgttct

SEQ ID NO: 13191 - DNA, 17 bp, Homo sapiens
cccgcagtggacgttct

SEQ ID NO: 13192 - DNA, 16 bp, Homo sapiens
tcccgcagaacattct

SEQ ID NO: 13193 - DNA, 18 bp, Homo sapiens
tcccgcagcgtaagttct

SEQ ID NO: 13194 - DNA, 18 bp, Homo sapiens
tctcctggatgacatcct

SEQ ID NO: 13195 - DNA, 18 bp, Homo sapiens
tccttcactagacgttct

SEQ ID NO: 13196 - DNA, 17 bp, Homo sapiens
tcccgcggacgcgatct

SEQ ID NO: 13197 - DNA, 16 bp, Homo sapiens
tcccgctgatcattct

SEQ ID NO: 13198 - DNA, 20 bp, Homo sapiens
tcccgcggttgcgcgcatct

SEQ ID NO: 13199 - DNA, 17 bp, Homo sapiens
ccccgcgggtagcttct

SEQ ID NO: 13200 - DNA, 16 bp, Homo sapiens
tcctgcaggacattct

SEQ ID NO: 13201 - DNA, 18 bp, Homo sapiens
tcctgcgaatggagcact

SEQ ID NO: 13202 - DNA, 18 bp, Homo sapiens
tcccgcaggagactttct

SEQ ID NO: 13203 - DNA, 17 bp, Homo sapiens
ccccgcggcggcgttct

SEQ ID NO: 13204 - DNA, 18 bp, Homo sapiens
tccagtggaaaacattct

SEQ ID NO: 13205 - DNA, 18 bp, Homo sapiens
tcccgcaggatggaagtt

SEQ ID NO: 13206 - DNA, 18 bp, Homo sapiens
tcccgcggggcccacatc

SEQ ID NO: 13207 - DNA, 19 bp, Homo sapiens
tcccgcaggatgtacctct

SEQ ID NO: 13208 - DNA, 19 bp, Homo sapiens
tcccgcaggtgggcggcct

SEQ ID NO: 13209 - DNA, 19 bp, Homo sapiens
tcctgcagatgagggttct

SEQ ID NO: 13210 - DNA, 19 bp, Homo sapiens
tcctcgggagagacgttct

SEQ ID NO: 13211 - DNA, 18 bp, Homo sapiens
tcccacggggatcattct

SEQ ID NO: 13212 - DNA, 16 bp, Homo sapiens
tcccgctggacattct

SEQ ID NO: 13213 - DNA, 19 bp, Homo sapiens
tcccgcgggggtcacttct

SEQ ID NO: 13214 - DNA, 19 bp, Homo sapiens
ccccgcggatggagcgact

SEQ ID NO: 13215 - DNA, 18 bp, Homo sapiens
tcccgcggctggtgccct

SEQ ID NO: 13216 - DNA, 17 bp, Homo sapiens
tcccacagccacgttct

SEQ ID NO: 13217 - DNA, 16 bp, Homo sapiens
tcccgcaggactttct

SEQ ID NO: 13218 - DNA, 19 bp, Homo sapiens
tcgccgcctgcaacgttct

SEQ ID NO: 13219 - DNA, 18 bp, Homo sapiens
tcctgcagaaaacattct

SEQ ID NO: 13220 - DNA, 80 bp, African swine fever virus
ctacagcagtagtaataattttaatgtttaacgcctacaacagtagtaataattttaatgtttaacgcctacagcagtag

SEQ ID NO: 13221 - DNA, 24 bp, African swine fever virus
cagcagtagtaataattttaatgt

SEQ ID NO: 13222 - DNA, 22 bp, Homo sapiens
agcagtataataatccctgtgt

SEQ ID NO: 13223 - DNA, 20 bp, Homo sapiens
aacagtagttaatttagtgt

SEQ ID NO: 13224 - DNA, 18 bp, Homo sapiens
tagtaatgcattttaatg

SEQ ID NO: 13225 - DNA, 19 bp, Homo sapiens
cagcagtagtaaacacatg

SEQ ID NO: 13226 - DNA, 22 bp, Homo sapiens
agcagtagaaacatcttagtgt

SEQ ID NO: 13227 - DNA, 18 bp, Homo sapiens
acagtagtgataattcca

SEQ ID NO: 13228 - DNA, 19 bp, Homo sapiens
cagcagagtatttttaatg

SEQ ID NO: 13229 - DNA, 22 bp, Homo sapiens
gtagtcaactgaattttaatgt

SEQ ID NO: 13230 - DNA, 22 bp, Homo sapiens
cagtagtagtaacaaaaactgt

SEQ ID NO: 13231 - DNA, 22 bp, Homo sapiens
cagtatgaggtaattttaatgt

SEQ ID NO: 13232 - DNA, 19 bp, Homo sapiens
cagcagttagtgataactt

SEQ ID NO: 13233 - DNA, 76 bp, African swine fever virus
aaacattaaaatttagctacgcctacagcagtaataatgtttaacgcctacagcagtagtaataattttaatgttt

SEQ ID NO: 13234 - DNA, 87 bp, African swine fever virus
ggcgaaaaaataattattccggcccgccaaattctgcatcttgtgaaactacaaaatgctttccggcgaaaaaataattattccgcc

SEQ ID NO: 13235 - DNA, 24 bp, African swine fever virus
aaaatgctttccggcgaaaaaata

SEQ ID NO: 13236 - DNA, 20 bp, Homo sapiens
tgctttccagttgggaaaaa

SEQ ID NO: 13237 - DNA, 19 bp, Homo sapiens
atgctttccgtgacaaaaa

SEQ ID NO: 13238 - DNA, 16 bp, Homo sapiens
aaatgctttctgaaaa

SEQ ID NO: 13239 - DNA, 18 bp, Homo sapiens
aaaacgctttctccaaaa

SEQ ID NO: 13240 - DNA, 18 bp, Homo sapiens
ctttccagactaaaaata

SEQ ID NO: 13241 - DNA, 19 bp, Homo sapiens
aaaatgcttcctacaaaaa

SEQ ID NO: 13242 - DNA, 18 bp, Homo sapiens
aaatgcttccaagagaaa

SEQ ID NO: 13243 - DNA, 18 bp, Homo sapiens
aaaacgcttgggggaaaa

SEQ ID NO: 13244 - DNA, 18 bp, Homo sapiens
aaatgctttcaggctgaa

SEQ ID NO: 13245 - DNA, 20 bp, Homo sapiens
aaatacttttattgcaaaaa

SEQ ID NO: 13246 - DNA, 19 bp, Homo sapiens
tgctttccaagaggaaata

SEQ ID NO: 13247 - DNA, 20 bp, Homo sapiens
aaaatgctttccttgagaaa

SEQ ID NO: 13248 - DNA, 26 bp, Homo sapiens
aaaatgctgttcttaacacaaaaata

SEQ ID NO: 13249 - DNA, 19 bp, Homo sapiens
aaaatgctttaccctagaa

SEQ ID NO: 13250 - DNA, 21 bp, Homo sapiens
aaaatgctttccctatgaaaa

SEQ ID NO: 13251 - DNA, 19 bp, Homo sapiens
aaatgctttcttaaaaaaa

SEQ ID NO: 13252 - DNA, 17 bp, Homo sapiens
aaaatgcttccataaaa

SEQ ID NO: 13253 - DNA, 20 bp, Homo sapiens
gctttccgttttaaaaaata

SEQ ID NO: 13254 - DNA, 21 bp, Homo sapiens
aaaatgctctcctcttaggga

SEQ ID NO: 13255 - DNA, 24 bp, Homo sapiens
aaaatgctttattgctaaaaaaat

SEQ ID NO: 13256 - DNA, 18 bp, Homo sapiens
tgctttcctcaccaaaaa

SEQ ID NO: 13257 - DNA, 101 bp, Himetobi P virus
gtgcacttaattacgtgcttgctactatgttaagtccgtgcgcctgttgttaaccgcagcacgtacgtcctttacttgtagcacatgtttttaatgtgggc

SEQ ID NO: 13258 - DNA, 24 bp, Himetobi P virus
tactatgttaagtccgtgcgcctg

SEQ ID NO: 13259 - DNA, 17 bp, Homo sapiens
tacttgttaagtcccac

SEQ ID NO: 13260 - DNA, 21 bp, Homo sapiens
tactatgttaactggtgttgc

SEQ ID NO: 13261 - DNA, 71 bp, Fowlpox virus
ctttagataaagtagttttttgatatcgaatggtaaagtatttatatcatctatactataatcatctagag

SEQ ID NO: 13262 - DNA, 24 bp, Fowlpox virus
aagtagttttttgatatcgaatgg

SEQ ID NO: 13263 - DNA, 22 bp, Homo sapiens
aggggttttttgcggggaatgg

SEQ ID NO: 13264 - DNA, 19 bp, Homo sapiens
gtagttttatgactaatgg

SEQ ID NO: 13265 - DNA, 17 bp, Homo sapiens
agtagtttgttgaaatg

SEQ ID NO: 13266 - DNA, 23 bp, Homo sapiens
aagtagtttcttctagggaatgg

SEQ ID NO: 13267 - DNA, 21 bp, Homo sapiens
agagttttttgatagctttgg

SEQ ID NO: 13268 - DNA, 61 bp, Fowlpox virus
tgtatcgttaaaatctgaataaaccgtagctaataggtatacgttaacaggtttcgaaaca

SEQ ID NO: 13269 - DNA, 22 bp, Fowlpox virus
tacgttaacaggtttcgaaaca

SEQ ID NO: 13270 - DNA, 17 bp, Homo sapiens
cgttacacaccgaaaca

SEQ ID NO: 13271 - DNA, 20 bp, Homo sapiens
tacattaacaggaagaaaca

SEQ ID NO: 13272 - DNA, 18 bp, Homo sapiens
gttaacaggtaaaaaaca

SEQ ID NO: 13273 - DNA, 19 bp, Homo sapiens
tacgttaactggtggtcaa

SEQ ID NO: 13274 - DNA, 18 bp, Homo sapiens
gttaacaaaagagaaaca

SEQ ID NO: 13275 - DNA, 16 bp, Homo sapiens
tacttaacaggtcaac

SEQ ID NO: 13276 - DNA, 18 bp, Homo sapiens
gttggcaaggtcgaaaca

SEQ ID NO: 13277 - DNA, 17 bp, Homo sapiens
cgttaacaagggaaaca

SEQ ID NO: 13278 - DNA, 18 bp, Homo sapiens
gtaaacaggtttaaaaca

SEQ ID NO: 13279 - DNA, 108 bp, Himetobi P virus
ttaaaagggcatataagttttcaagaagaataccttttatgtagttgatagatttatctgtcatacgtttataggtttcttcaagaataatttagataccccttttgg

SEQ ID NO: 13280 - DNA, 24 bp, Himetobi P virus
tataagttttcaagaagaatacct

SEQ ID NO: 13281 - DNA, 17 bp, Homo sapiens
taagaaaagaagaatac

SEQ ID NO: 13282 - DNA, 18 bp, Homo sapiens
tacaagttttcaagaacc

SEQ ID NO: 13283 - DNA, 19 bp, Homo sapiens
tataagtttctcaagggaa

SEQ ID NO: 13284 - DNA, 18 bp, Homo sapiens
ccttcaaggggagtacct

SEQ ID NO: 13285 - DNA, 24 bp, Homo sapiens
tgaagtcttccttttaggaagaat

SEQ ID NO: 13286 - DNA, 21 bp, Homo sapiens
taaagttttcttttaatacct

SEQ ID NO: 13287 - DNA, 19 bp, Homo sapiens
gtttttgaggaaaatacct

SEQ ID NO: 13288 - DNA, 21 bp, Homo sapiens
tataagctatgagaagaatac

SEQ ID NO: 13289 - DNA, 23 bp, Homo sapiens
cataagttttcaattatatgcct

SEQ ID NO: 13290 - DNA, 19 bp, Homo sapiens
tataagttttacaagagga

SEQ ID NO: 13291 - DNA, 17 bp, Homo sapiens
agttgtcaggaatacct

SEQ ID NO: 13292 - DNA, 19 bp, Homo sapiens
tataaatttttaagaagaa

SEQ ID NO: 13293 - DNA, 103 bp, Himetobi P virus
ttgtatttggcgcgagtaagcctatgaaaaacttccttctatgctatatgtgtagaaataggaagcagaagtagtagcagcgagaccgccatccgtaatacaa

SEQ ID NO: 13294 - DNA, 24 bp, Himetobi P virus
tatttggcgcgagtaagcctatga

SEQ ID NO: 13295 - DNA, 22 bp, Homo sapiens
tatttgacaaactaagtttatg

SEQ ID NO: 13296 - DNA, 21 bp, Homo sapiens
tatttggcacccaggtctatg

SEQ ID NO: 13297 - DNA, 68 bp, Human herpesvirus 8
gttgctatggctgctgttcaacggacccgcctctttttgtcgggccgactgttgcctgtacaagcagc

SEQ ID NO: 13298 - DNA, 24 bp, Human herpesvirus 8
tggctgctgttcaacggacccgcc

SEQ ID NO: 13299 - DNA, 18 bp, Homo sapiens
tacccgcggcggacccgc

SEQ ID NO: 13300 - DNA, 18 bp, Homo sapiens
ggctgctgtgaggtccgc

SEQ ID NO: 13301 - DNA, 18 bp, Homo sapiens
tggtggctgttcaatgaa

SEQ ID NO: 13302 - DNA, 18 bp, Homo sapiens
tgggctgagcggacccgc

SEQ ID NO: 13303 - DNA, 28 bp, Homo sapiens
tagctgctgttcactgctggcgggtccg

SEQ ID NO: 13304 - DNA, 19 bp, Homo sapiens
tggtctgccgcggacccgc

SEQ ID NO: 13305 - DNA, 19 bp, Homo sapiens
ggctccgcgacggacccgc

SEQ ID NO: 13306 - DNA, 20 bp, Homo sapiens
tggctgctgctccggactcg

SEQ ID NO: 13307 - DNA, 21 bp, Homo sapiens
tggctgctttcacctcctgcc

SEQ ID NO: 13308 - DNA, 27 bp, Homo sapiens
tggctgctgcttcgtacttggcttgcc

SEQ ID NO: 13309 - DNA, 20 bp, Homo sapiens
gcctgctccctgggcctgcc

SEQ ID NO: 13310 - DNA, 17 bp, Homo sapiens
ggctgctccgggcccgc

SEQ ID NO: 13311 - DNA, 27 bp, Homo sapiens
tggctgctgtccttgctggcgggtccg

SEQ ID NO: 13312 - DNA, 18 bp, Homo sapiens
tggttgctgttctgaacc

SEQ ID NO: 13313 - DNA, 16 bp, Homo sapiens
tggctgctgctctccc

SEQ ID NO: 13314 - DNA, 18 bp, Homo sapiens
tggctgctggtcctccgc

SEQ ID NO: 13315 - DNA, 22 bp, Homo sapiens
ggttgctgggcttggacccgcc

SEQ ID NO: 13316 - DNA, 20 bp, Homo sapiens
tggttgctgttcaaaggtac

SEQ ID NO: 13317 - DNA, 24 bp, Homo sapiens
tgcctgacctccagtgggtctgcc

SEQ ID NO: 13318 - DNA, 21 bp, Homo sapiens
tgcctgtccgcgtggacccgc

SEQ ID NO: 13319 - DNA, 21 bp, Homo sapiens
tgggtgctgtttggcatggcc

SEQ ID NO: 13320 - DNA, 23 bp, Homo sapiens
tggttgctgttcaagtgaatgcc

SEQ ID NO: 13321 - DNA, 23 bp, Homo sapiens
ggctgctgaaggctggacctgcc

SEQ ID NO: 13322 - DNA, 17 bp, Homo sapiens
tggcagcctcaacggac

SEQ ID NO: 13323 - DNA, 18 bp, Homo sapiens
tggctgctgtctgactgc

SEQ ID NO: 13324 - DNA, 18 bp, Homo sapiens
ggctgctggcggggcccg

SEQ ID NO: 13325 - DNA, 22 bp, Homo sapiens
gctgctgtttggaggctcccgc

SEQ ID NO: 13326 - DNA, 20 bp, Homo sapiens
tggctgcctgttcagtggga

SEQ ID NO: 13327 - DNA, 63 bp, Human foamy virus
ctgcttacgttttactttaataaagttaagttttaagttttaacaggaaatgctcttaggcag

SEQ ID NO: 13328 - DNA, 23 bp, Human foamy virus
taacaggaaatgctcttaggcag

SEQ ID NO: 13329 - DNA, 21 bp, Homo sapiens
taacagaaaattacaaggcag

SEQ ID NO: 13330 - DNA, 16 bp, Homo sapiens
aacaggaagtgcagca

SEQ ID NO: 13331 - DNA, 15 bp, Homo sapiens
acaggaaatgcagca

SEQ ID NO: 13332 - DNA, 22 bp, Homo sapiens
taacaagaggaaaaataggcag

SEQ ID NO: 13333 - DNA, 17 bp, Homo sapiens
aggaaatgagctggcag

SEQ ID NO: 13334 - DNA, 22 bp, Homo sapiens
caacaggaagtgttctcttcag

SEQ ID NO: 13335 - DNA, 17 bp, Homo sapiens
aacaggaaatgcagtag

SEQ ID NO: 13336 - DNA, 16 bp, Homo sapiens
aggaagtgctagacag

SEQ ID NO: 13337 - DNA, 19 bp, Homo sapiens
taacagaagatgcgggtag

SEQ ID NO: 13338 - DNA, 17 bp, Homo sapiens
aggaaaaacctaggcag

SEQ ID NO: 13339 - DNA, 20 bp, Homo sapiens
caggaaatgcttccctccgg

SEQ ID NO: 13340 - DNA, 21 bp, Homo sapiens
caacaggaaggaagtaggcag

SEQ ID NO: 13341 - DNA, 19 bp, Homo sapiens
taacaggaagctgttttag

SEQ ID NO: 13342 - DNA, 19 bp, Homo sapiens
acagaaaagccttgggcag

SEQ ID NO: 13343 - DNA, 20 bp, Homo sapiens
taacagaaatgccactgtgg

SEQ ID NO: 13344 - DNA, 20 bp, Homo sapiens
acagggtatgtatcaggcag

SEQ ID NO: 13345 - DNA, 17 bp, Homo sapiens
taacagaaatgctttta

SEQ ID NO: 13346 - DNA, 19 bp, Homo sapiens
taacaagaaatgttttcag

SEQ ID NO: 13347 - DNA, 18 bp, Homo sapiens
acagaccttcttaggcag

SEQ ID NO: 13348 - DNA, 22 bp, Homo sapiens
taacaggatgtcagcagggcag

SEQ ID NO: 13349 - DNA, 19 bp, Homo sapiens
taacaggaagggctcccag

SEQ ID NO: 13350 - DNA, 19 bp, Homo sapiens
caggaaatacggagggcag

SEQ ID NO: 13351 - DNA, 18 bp, Homo sapiens
taacaggaaattcttaaa

SEQ ID NO: 13352 - DNA, 17 bp, Homo sapiens
agagtgcttttaggcag

SEQ ID NO: 13353 - DNA, 19 bp, Homo sapiens
taacgggaaaggttctcag

SEQ ID NO: 13354 - DNA, 18 bp, Homo sapiens
caggaaattgccctgtgg

SEQ ID NO: 13355 - DNA, 15 bp, Homo sapiens
caggaaatgttagac

SEQ ID NO: 13356 - DNA, 19 bp, Homo sapiens
caggtaatgagccaggcag

SEQ ID NO: 13357 - DNA, 20 bp, Homo sapiens
taaaaggaaatggagatagg

SEQ ID NO: 13358 - DNA, 18 bp, Homo sapiens
caggagatgctctctgca

SEQ ID NO: 13359 - DNA, 23 bp, Homo sapiens
caacgggaggaggtattaggcag

SEQ ID NO: 13360 - DNA, 24 bp, Homo sapiens
taacaggaaatgtcacaatggcag

SEQ ID NO: 13361 - DNA, 17 bp, Homo sapiens
taacaagagatgctgac

SEQ ID NO: 13362 - DNA, 22 bp, Homo sapiens
taacaggaagtttacaccacag

SEQ ID NO: 13363 - DNA, 19 bp, Homo sapiens
caggaaatgccacgggcag

SEQ ID NO: 13364 - DNA, 19 bp, Homo sapiens
taacaggaaagcatggtag

SEQ ID NO: 13365 - DNA, 19 bp, Homo sapiens
ggaaatgctcccacatcag

SEQ ID NO: 13366 - DNA, 18 bp, Homo sapiens
acaggaggtcccaggcag

SEQ ID NO: 13367 - DNA, 19 bp, Homo sapiens
acaggaaagggttaggcag

SEQ ID NO: 13368 - DNA, 22 bp, Homo sapiens
aggaaacactgctcttaggcag

SEQ ID NO: 13369 - DNA, 20 bp, Homo sapiens
caggaaatgttgagtcccag

SEQ ID NO: 13370 - DNA, 21 bp, Homo sapiens
caacaggaaatgcagtggcag

SEQ ID NO: 13371 - DNA, 19 bp, Homo sapiens
taacatgaaatgctcatgg

SEQ ID NO: 13372 - DNA, 18 bp, Homo sapiens
taacatgaagtggaggca

SEQ ID NO: 13373 - DNA, 70 bp, Human herpesvirus 5
gacacgctctgggccgcgccgctcctcgtctgccgtgatcaagcggcgcggcgcggacctttcaagtgtt

SEQ ID NO: 13374 - DNA, 24 bp, Human herpesvirus 5
gcgcggcgcggacctttcaagtgt

SEQ ID NO: 13375 - DNA, 19 bp, Homo sapiens
gcgcagcgcggtttgggtg

SEQ ID NO: 13376 - DNA, 104 bp, Macaca mulatta rhadinovirus
gtggatcctttaccgctcatatggcttctgttttacggttcccggtcgttctgtcgggaaccagagtgcctatatgaacgcaattttggtatgaagggacccat

SEQ ID NO: 13377 - DNA, 24 bp, Macaca mulatta rhadinovirus
tcctttaccgctcatatggcttct

SEQ ID NO: 13378 - DNA, 23 bp, Homo sapiens
tcctatgtaaaaatatggcttct

SEQ ID NO: 13379 - DNA, 21 bp, Homo sapiens
cttttaactgtgctggcttct

SEQ ID NO: 13380 - DNA, 22 bp, Homo sapiens
tcctttacagcttgtgacacct

SEQ ID NO: 13381 - DNA, 20 bp, Homo sapiens
ccacagcttgtatggtttct

SEQ ID NO: 13382 - DNA, 21 bp, Homo sapiens
tccttgctgctgatggcttct

SEQ ID NO: 13383 - DNA, 22 bp, Homo sapiens
tcctctacctatcatggtttct

SEQ ID NO: 13384 - DNA, 21 bp, Homo sapiens
tcctttagctgcctggcttct

SEQ ID NO: 13385 - DNA, 18 bp, Homo sapiens
tcctttgtgactggcttc

SEQ ID NO: 13386 - DNA, 20 bp, Homo sapiens
cttacatttatatggcttct

SEQ ID NO: 13387 - DNA, 22 bp, Homo sapiens
tccttacattcatatggcttct

SEQ ID NO: 13388 - DNA, 22 bp, Homo sapiens
tccttacactcatatggcttct

SEQ ID NO: 13389 - DNA, 21 bp, Homo sapiens
tcctttctggctatggcttct

SEQ ID NO: 13390 - DNA, 22 bp, Homo sapiens
tccatttgctgatctggcttct

SEQ ID NO: 13391 - DNA, 21 bp, Homo sapiens
ctttacattcatatggtttct

SEQ ID NO: 13392 - DNA, 22 bp, Homo sapiens
tccttacattcatgtggcttct

SEQ ID NO: 13393 - DNA, 21 bp, Homo sapiens
ctttaactggtcatggcttct

SEQ ID NO: 13394 - DNA, 22 bp, Homo sapiens
ctttaccagttcagatgtttct

SEQ ID NO: 13395 - DNA, 19 bp, Homo sapiens
tccattagaaatatggctt

SEQ ID NO: 13396 - DNA, 22 bp, Homo sapiens
tcctttactgcatatggattct

SEQ ID NO: 13397 - DNA, 22 bp, Homo sapiens
tcctttgccttttccagcttct

SEQ ID NO: 13398 - DNA, 22 bp, Homo sapiens
tcctttgccttttctagcttct

SEQ ID NO: 13399 - DNA, 18 bp, Homo sapiens
ttcaccagtatggcttct

SEQ ID NO: 13400 - DNA, 22 bp, Homo sapiens
tcattacattcatatggtttct

SEQ ID NO: 13401 - DNA, 22 bp, Homo sapiens
tccttacattcatatggtttct

SEQ ID NO: 13402 - DNA, 22 bp, Homo sapiens
tcctttgcctttcccagcttct

SEQ ID NO: 13403 - DNA, 22 bp, Homo sapiens
ctctttgttacacatggcttct

SEQ ID NO: 13404 - DNA, 20 bp, Homo sapiens
ccctttactgcttgtgtctt

SEQ ID NO: 13405 - DNA, 16 bp, Homo sapiens
tcctttgctggcttct

SEQ ID NO: 13406 - DNA, 77 bp, Human herpesvirus 5
gcgtggtgaacagcagcttgtcgcgctcataagccagcggttcggccgccacgtacaagcggatgtgcttgccgcgc

SEQ ID NO: 13407 - DNA, 24 bp, Human herpesvirus 5
tgaacagcagcttgtcgcgctcat

SEQ ID NO: 13408 - DNA, 19 bp, Homo sapiens
tgattagcagcttatttca

SEQ ID NO: 13409 - DNA, 20 bp, Homo sapiens
gaacagcaggccggtgtgct

SEQ ID NO: 13410 - DNA, 18 bp, Homo sapiens
taaacagcaggtgcttat

SEQ ID NO: 13411 - DNA, 20 bp, Homo sapiens
gagcagcagcttgtggcagc

SEQ ID NO: 13412 - DNA, 23 bp, Homo sapiens
taaacagcagcttgatacttcat

SEQ ID NO: 13413 - DNA, 19 bp, Homo sapiens
tgagcagcagctcgtaacg

SEQ ID NO: 13414 - DNA, 78 bp, Macaca mulatta rhadinovirus
ttcctcgaattcacagggtgccttgttttatctgccgtatggacaggacgaatggaattgggcgctcacgttaaggaa

SEQ ID NO: 13415 - DNA, 24 bp, Macaca mulatta rhadinovirus
gtgccttgttttatctgccgtatg

SEQ ID NO: 13416 - DNA, 23 bp, Homo sapiens
gtgccttgtttctgtgctgctgt

SEQ ID NO: 13417 - DNA, 16 bp, Homo sapiens
gtgcctgtttctgtgt

SEQ ID NO: 13418 - DNA, 20 bp, Homo sapiens
ccttgttttatttgggctgt

SEQ ID NO: 13419 - DNA, 19 bp, Homo sapiens
gtgccttgttgaatgccgt

SEQ ID NO: 13420 - DNA, 67 bp, Human herpesvirus 5
tgcgcctccagccgctccgagcgcaccttcttgaagacgcgtacctcgggcgcgttggctacgcgca

SEQ ID NO: 13421 - DNA, 24 bp, Human herpesvirus 5
acgcgtacctcgggcgcgttggct

SEQ ID NO: 13422 - DNA, 19 bp, Homo sapiens
acgtctgcctcgggcgcat

SEQ ID NO: 13423 - DNA, 18 bp, Homo sapiens
cgcgcgcctcgggccggc

SEQ ID NO: 13424 - DNA, 20 bp, Homo sapiens
cgcggtctcgggcggaggct

SEQ ID NO: 13425 - DNA, 16 bp, Homo sapiens
gctacctggcgttggc

SEQ ID NO: 13426 - DNA, 21 bp, Homo sapiens
gcgttctcgggcaaagaagct

SEQ ID NO: 13427 - DNA, 21 bp, Homo sapiens
cgcggcctcgggcggggggct

SEQ ID NO: 13428 - DNA, 24 bp, Homo sapiens
cgcgtgtcccgggctggactggct

SEQ ID NO: 13429 - DNA, 21 bp, Homo sapiens
acgtgatcttgggcgctggct

SEQ ID NO: 13430 - DNA, 80 bp, Human herpesvirus 5
cgctcggcttggtcttcacgtccagcagcggtaccagtcccaccgttacgcaccaatccacgtagagaccatagtcgtcg

SEQ ID NO: 13431 - DNA, 24 bp, Human herpesvirus 5
tacgcaccaatccacgtagagacc

SEQ ID NO: 13432 - DNA, 22 bp, Homo sapiens
tactgtcaatccacaaaaggcc

SEQ ID NO: 13433 - DNA, 17 bp, Homo sapiens
cgtcccaatccagagac

SEQ ID NO: 13434 - DNA, 18 bp, Homo sapiens
gccaccaacagtagagac

SEQ ID NO: 13435 - DNA, 18 bp, Homo sapiens
gcaccaatccacacctga

SEQ ID NO: 13436 - DNA, 24 bp, Homo sapiens
taccactatttgggtgtagagacc

SEQ ID NO: 13437 - DNA, 15 bp, Homo sapiens
tacgcaccagcgaga

SEQ ID NO: 13438 - DNA, 21 bp, Homo sapiens
tactgccaatccataatgacc

SEQ ID NO: 13439 - DNA, 79 bp, Feline foamy virus
tcctcaacagcagggaccaccaccaaaccgagggcctgatcaaggacctcggccaggaggcaatcccagaggaggagga

SEQ ID NO: 13440 - DNA, 24 bp, Feline foamy virus
ggccaggaggcaatcccagaggag

SEQ ID NO: 13441 - DNA, 19 bp, Homo sapiens
ggccaggaggaaatctcag

SEQ ID NO: 13442 - DNA, 24 bp, Homo sapiens
ggccagaggcagtcttcagaggag

SEQ ID NO: 13443 - DNA, 24 bp, Homo sapiens
ggccagaagcatccctcccggagg

SEQ ID NO: 13444 - DNA, 18 bp, Homo sapiens
ggccaggaggcgtggagg

SEQ ID NO: 13445 - DNA, 22 bp, Homo sapiens
ggtcagcaggtcagcagaggag

SEQ ID NO: 13446 - DNA, 20 bp, Homo sapiens
ggctggaggcaattccttgg

SEQ ID NO: 13447 - DNA, 20 bp, Homo sapiens
gggaaggcctctcagaggag

SEQ ID NO: 13448 - DNA, 18 bp, Homo sapiens
ggcctggggaccagagga

SEQ ID NO: 13449 - DNA, 19 bp, Homo sapiens
ggccaggaggcagtgtgga

SEQ ID NO: 13450 - DNA, 21 bp, Homo sapiens
ggccaggaaggcacggaggag

SEQ ID NO: 13451 - DNA, 26 bp, Homo sapiens
ggccaggagcatggcggctggaggag

SEQ ID NO: 13452 - DNA, 18 bp, Homo sapiens
gaccgggaggtcagagga

SEQ ID NO: 13453 - DNA, 23 bp, Homo sapiens
ggctggtgggcagggcagaggag

SEQ ID NO: 13454 - DNA, 19 bp, Homo sapiens
ggcaggaggcggcagggga

SEQ ID NO: 13455 - DNA, 18 bp, Homo sapiens
ggccaggaggcacattcc

SEQ ID NO: 13456 - DNA, 23 bp, Homo sapiens
ggccggggggctccgcagaggag

SEQ ID NO: 13457 - DNA, 18 bp, Homo sapiens
ggccaggaggctgcaggg

SEQ ID NO: 13458 - DNA, 21 bp, Homo sapiens
ggccaagaggtccaggaggag

SEQ ID NO: 13459 - DNA, 19 bp, Homo sapiens
gctcagggggacccagagg

SEQ ID NO: 13460 - DNA, 19 bp, Homo sapiens
agctgggaggcaatcctgg

SEQ ID NO: 13461 - DNA, 16 bp, Homo sapiens
ggccagagcccagagg

SEQ ID NO: 13462 - DNA, 15 bp, Homo sapiens
ggccaggagcagagg

SEQ ID NO: 13463 - DNA, 21 bp, Homo sapiens
ggccaagacctcccagaggag

SEQ ID NO: 13464 - DNA, 21 bp, Homo sapiens
ggctggtggggcagtgaggag

SEQ ID NO: 13465 - DNA, 25 bp, Homo sapiens
ggccaggaggcactgagcaagggag

SEQ ID NO: 13466 - DNA, 20 bp, Homo sapiens
ggcaggaggcagacagggag

SEQ ID NO: 13467 - DNA, 28 bp, Homo sapiens
ggccagaaggcgatggggctcctctggg

SEQ ID NO: 13468 - DNA, 21 bp, Homo sapiens
ggacagggggccccagaggag

SEQ ID NO: 13469 - DNA, 19 bp, Homo sapiens
ggccaggaggggttcccag

SEQ ID NO: 13470 - DNA, 21 bp, Homo sapiens
ggccaggagggtggggaggag

SEQ ID NO: 13471 - DNA, 22 bp, Homo sapiens
ggcaaggaggagcccagaggag

SEQ ID NO: 13472 - DNA, 19 bp, Homo sapiens
ggccaggagtcaatgtagg

SEQ ID NO: 13473 - DNA, 22 bp, Homo sapiens
caggcacaaaatctcagaggag

SEQ ID NO: 13474 - DNA, 23 bp, Homo sapiens
ggccaggcacaccctcagaggag

SEQ ID NO: 13475 - DNA, 23 bp, Homo sapiens
ggcaggaggcaaccagagaggag

SEQ ID NO: 13476 - DNA, 18 bp, Homo sapiens
ggcaggcttcccagagga

SEQ ID NO: 13477 - DNA, 28 bp, Homo sapiens
ggccaggaagtgggggagctcctctggg

SEQ ID NO: 13478 - DNA, 17 bp, Homo sapiens
agccaggagtcagggga

SEQ ID NO: 13479 - DNA, 16 bp, Homo sapiens
ggcaggaggcagcagg

SEQ ID NO: 13480 - DNA, 20 bp, Homo sapiens
ggccaggagggagtccctgg

SEQ ID NO: 13481 - DNA, 20 bp, Homo sapiens
ggctggggacgccccagagg

SEQ ID NO: 13482 - DNA, 24 bp, Homo sapiens
ggcagggaaggcttcctgggggag

SEQ ID NO: 13483 - DNA, 18 bp, Homo sapiens
ggccagaaactccagagg

SEQ ID NO: 13484 - DNA, 22 bp, Homo sapiens
ggccagggaacactcagaggag

SEQ ID NO: 13485 - DNA, 23 bp, Homo sapiens
ggtcagaaggcaggcgggaggag

SEQ ID NO: 13486 - DNA, 18 bp, Homo sapiens
ggccaggaggtgtcccag

SEQ ID NO: 13487 - DNA, 19 bp, Homo sapiens
gaccaggaggcaggaagga

SEQ ID NO: 13488 - DNA, 19 bp, Homo sapiens
agccaggaggcagctgagg

SEQ ID NO: 13489 - DNA, 19 bp, Homo sapiens
ggccaggaggcacaggtgg

SEQ ID NO: 13490 - DNA, 17 bp, Homo sapiens
ggcaggctcccagagga

SEQ ID NO: 13491 - DNA, 21 bp, Homo sapiens
ggccagaaggtgatcccacag

SEQ ID NO: 13492 - DNA, 17 bp, Homo sapiens
ggcaggaatccagagga

SEQ ID NO: 13493 - DNA, 15 bp, Homo sapiens
ggccaggaggaatgg

SEQ ID NO: 13494 - DNA, 24 bp, Homo sapiens
gcccaggaggttctgccgggggag

SEQ ID NO: 13495 - DNA, 19 bp, Homo sapiens
ccaggaccacccccagagg

SEQ ID NO: 13496 - DNA, 24 bp, Homo sapiens
ggccaggcagaataatcgggggag

SEQ ID NO: 13497 - DNA, 20 bp, Homo sapiens
ggccaggagccagccaaggg

SEQ ID NO: 13498 - DNA, 15 bp, Homo sapiens
ggccagaggcaaggg

SEQ ID NO: 13499 - DNA, 20 bp, Homo sapiens
ggccaggagccgatccctgg

SEQ ID NO: 13500 - DNA, 19 bp, Homo sapiens
ggtggcagtcccagaggag

SEQ ID NO: 13501 - DNA, 20 bp, Homo sapiens
gccaggaggtgggagaggag

SEQ ID NO: 13502 - DNA, 20 bp, Homo sapiens
ggccagaggacccttagagg

SEQ ID NO: 13503 - DNA, 22 bp, Homo sapiens
ggctggggtgaactcagaggag

SEQ ID NO: 13504 - DNA, 18 bp, Homo sapiens
ggccaggaggtggcagag

SEQ ID NO: 13505 - DNA, 19 bp, Homo sapiens
ggccagaaggtaaaaagga

SEQ ID NO: 13506 - DNA, 30 bp, Homo sapiens
ggctgaggaggctttagattccaggggagc

SEQ ID NO: 13507 - DNA, 23 bp, Homo sapiens
agccaggagcaagcccaggggag

SEQ ID NO: 13508 - DNA, 20 bp, Homo sapiens
ccaggaggccagaagaggag

SEQ ID NO: 13509 - DNA, 28 bp, Homo sapiens
ggccaggaggcaggctggctcctctggg

SEQ ID NO: 13510 - DNA, 22 bp, Homo sapiens
ggttaggaagcaattcccatag

SEQ ID NO: 13511 - DNA, 18 bp, Homo sapiens
ggccaggaagctggagga

SEQ ID NO: 13512 - DNA, 19 bp, Homo sapiens
ggccaggagtaatgaagga

SEQ ID NO: 13513 - DNA, 16 bp, Homo sapiens
ggccagaggcaagagg

SEQ ID NO: 13514 - DNA, 22 bp, Homo sapiens
gggaagggcgattccggaggag

SEQ ID NO: 13515 - DNA, 27 bp, Homo sapiens
ggccaggaggtagggggctcctctggg

SEQ ID NO: 13516 - DNA, 23 bp, Homo sapiens
ggccaggaggacgatccgaccag

SEQ ID NO: 13517 - DNA, 18 bp, Homo sapiens
ggtcaggaggcaggagga

SEQ ID NO: 13518 - DNA, 17 bp, Homo sapiens
ggccaagaggccggagg

SEQ ID NO: 13519 - DNA, 19 bp, Homo sapiens
ggccaggagtcagggaagg

SEQ ID NO: 13520 - DNA, 23 bp, Homo sapiens
ggccaggagcagggggccgggag

SEQ ID NO: 13521 - DNA, 22 bp, Homo sapiens
ggcatgaaaagtcccagaggag

SEQ ID NO: 13522 - DNA, 19 bp, Homo sapiens
agccagggtctcccagagg

SEQ ID NO: 13523 - DNA, 22 bp, Homo sapiens
agccgggggcacatcagaggag

SEQ ID NO: 13524 - DNA, 27 bp, Homo sapiens
ggccaggaggggtggggctcctctggg

SEQ ID NO: 13525 - DNA, 22 bp, Homo sapiens
ggccggggagatgtcagaggag

SEQ ID NO: 13526 - DNA, 23 bp, Homo sapiens
ggcaggaggattggccagaggag

SEQ ID NO: 13527 - DNA, 24 bp, Homo sapiens
agccaggaggtggagggagaggag

SEQ ID NO: 13528 - DNA, 22 bp, Homo sapiens
ggtcaggagacggggcagggag

SEQ ID NO: 13529 - DNA, 19 bp, Homo sapiens
gaccagggagcccagagga

SEQ ID NO: 13530 - DNA, 20 bp, Homo sapiens
ggccaggaggtgctccaggg

SEQ ID NO: 13531 - DNA, 21 bp, Homo sapiens
ggccaggagcggggcagggag

SEQ ID NO: 13532 - DNA, 22 bp, Homo sapiens
ggcgggaggcaaggttggggag

SEQ ID NO: 13533 - DNA, 16 bp, Homo sapiens
ggccaggaggcggagg

SEQ ID NO: 13534 - DNA, 17 bp, Homo sapiens
ggccaggagtccagggg

SEQ ID NO: 13535 - DNA, 23 bp, Homo sapiens
gaccgggaggacctccagaggag

SEQ ID NO: 13536 - DNA, 28 bp, Homo sapiens
agccaggaggcaggggggctcctctggg

SEQ ID NO: 13537 - DNA, 19 bp, Homo sapiens
ggccagaggagccagggga

SEQ ID NO: 13538 - DNA, 22 bp, Homo sapiens
ggcgtgaaaagtcccagaggag

SEQ ID NO: 13539 - DNA, 17 bp, Homo sapiens
gccaggaggcgagagga

SEQ ID NO: 13540 - DNA, 22 bp, Homo sapiens
ggccagaaggcagggatgggag

SEQ ID NO: 13541 - DNA, 24 bp, Homo sapiens
ggccaggaggggtctccttggagg

SEQ ID NO: 13542 - DNA, 19 bp, Homo sapiens
ggccaggaaggcaatggga

SEQ ID NO: 13543 - DNA, 18 bp, Homo sapiens
ggctgcggaggcagagga

SEQ ID NO: 13544 - DNA, 23 bp, Homo sapiens
agccgcaggcgatcctggaggag

SEQ ID NO: 13545 - DNA, 16 bp, Homo sapiens
ggagggcacagaggag

SEQ ID NO: 13546 - DNA, 28 bp, Homo sapiens
ggccaggaggagttcttgctcctctggg

SEQ ID NO: 13547 - DNA, 88 bp, Cocksfoot mottle virus
gcgtgtccggtgctccccgatggagatttgaaggaggtgagcttttgctcccatctcatctctaagggtcgagcagagctggagacgt

SEQ ID NO: 13548 - DNA, 24 bp, Cocksfoot mottle virus
tctaagggtcgagcagagctggag

SEQ ID NO: 13549 - DNA, 22 bp, Homo sapiens
ggcatacggagcagagctggag

SEQ ID NO: 13550 - DNA, 19 bp, Homo sapiens
tctgggggcaccagctgga

SEQ ID NO: 13551 - DNA, 19 bp, Homo sapiens
tctagggctttaagctgga

SEQ ID NO: 13552 - DNA, 21 bp, Homo sapiens
cctagaggagcagagttggag

SEQ ID NO: 13553 - DNA, 18 bp, Homo sapiens
gggctggcggagctggag

SEQ ID NO: 13554 - DNA, 23 bp, Homo sapiens
cctgggggcacagggagctggag

SEQ ID NO: 13555 - DNA, 17 bp, Homo sapiens
aagcagcagagctggag

SEQ ID NO: 13556 - DNA, 21 bp, Homo sapiens
caaaggtaatcagagctggag

SEQ ID NO: 13557 - DNA, 19 bp, Homo sapiens
aggccaggcagagctggag

SEQ ID NO: 13558 - DNA, 18 bp, Homo sapiens
ctgagggccagagctgga

SEQ ID NO: 13559 - DNA, 22 bp, Homo sapiens
tctgaggatttgccagctggag

SEQ ID NO: 13560 - DNA, 15 bp, Homo sapiens
gggagcagagctgga

SEQ ID NO: 13561 - DNA, 22 bp, Homo sapiens
aggacataaagtagagctggag

SEQ ID NO: 13562 - DNA, 19 bp, Homo sapiens
ggcttcagcagagctggag

SEQ ID NO: 13563 - DNA, 20 bp, Homo sapiens
tctaagggccgggtaagggg

SEQ ID NO: 13564 - DNA, 22 bp, Homo sapiens
tctcgggattgcagagctggag

SEQ ID NO: 13565 - DNA, 21 bp, Homo sapiens
tctaagggctgatgtttggag

SEQ ID NO: 13566 - DNA, 21 bp, Homo sapiens
ctgagggttctgaagctggag

SEQ ID NO: 13567 - DNA, 19 bp, Homo sapiens
caagtgtcggcagagctgg

SEQ ID NO: 13568 - DNA, 21 bp, Homo sapiens
ggcacctgggcagagctggag

SEQ ID NO: 13569 - DNA, 20 bp, Homo sapiens
taaggaaagtagagctggag

SEQ ID NO: 13570 - DNA, 17 bp, Homo sapiens
taagagtcccagttgga

SEQ ID NO: 13571 - DNA, 19 bp, Homo sapiens
tccggggttcggagctgga

SEQ ID NO: 13572 - DNA, 18 bp, Homo sapiens
ggggacacagagctggag

SEQ ID NO: 13573 - DNA, 18 bp, Homo sapiens
ctagggacccagagctgg

SEQ ID NO: 13574 - DNA, 19 bp, Homo sapiens
tctggggttgggagctgga

SEQ ID NO: 13575 - DNA, 19 bp, Homo sapiens
tctgggagtcctagctgga

SEQ ID NO: 13576 - DNA, 16 bp, Homo sapiens
aggggcaggagctgga

SEQ ID NO: 13577 - DNA, 18 bp, Homo sapiens
cctaagaggcggggctgg

SEQ ID NO: 13578 - DNA, 17 bp, Homo sapiens
tctaaggcagagctgga

SEQ ID NO: 13579 - DNA, 18 bp, Homo sapiens
tcctctgggcagagctgg

SEQ ID NO: 13580 - DNA, 16 bp, Homo sapiens
taagaggcagagctgg

SEQ ID NO: 13581 - DNA, 19 bp, Homo sapiens
aggagtcatgcagctggag

SEQ ID NO: 13582 - DNA, 15 bp, Homo sapiens
aggcgcagagctgga

SEQ ID NO: 13583 - DNA, 82 bp, Cocksfoot mottle virus
acccgggatgggtctgtcgaaagctagccaagtcgcgctgttatgggaggatttggcgcgtacgaaccagacccacccgggt

SEQ ID NO: 13584 - DNA, 24 bp, Cocksfoot mottle virus
tcgaaagctagccaagtcgcgctg

SEQ ID NO: 13585 - DNA, 22 bp, Homo sapiens
tcgaaagcggccaggcgcggtg

SEQ ID NO: 13586 - DNA, 22 bp, Homo sapiens
ccggggctcccgagtcgcgctg

SEQ ID NO: 13587 - DNA, 21 bp, Homo sapiens
tcggaggcggcggccgcgctg

SEQ ID NO: 13588 - DNA, 18 bp, Homo sapiens
gctagccaggcagccctg

SEQ ID NO: 13589 - DNA, 24 bp, Homo sapiens
tcgaaagcttggcccacggtgctg

SEQ ID NO: 13590 - DNA, 20 bp, Homo sapiens
gaaagtcagccacacagctg

SEQ ID NO: 13591 - DNA, 21 bp, Homo sapiens
gagggccagctccccacgctg

SEQ ID NO: 13592 - DNA, 65 bp, Cocksfoot mottle virus
cgttgatggcgaaggcagctatatcgcggttttactgcttgatgaatgctaccttccaattaacg

SEQ ID NO: 13593 - DNA, 24 bp, Cocksfoot mottle virus
gcgaaggcagctatatcgcggttt

SEQ ID NO: 13594 - DNA, 23 bp, Homo sapiens
gaagacagctgtaggcattgttt

SEQ ID NO: 13595 - DNA, 16 bp, Homo sapiens
aggcggcttccggttt

SEQ ID NO: 13596 - DNA, 24 bp, Homo sapiens
gcggagggcggcgcgccgcggttt

SEQ ID NO: 13597 - DNA, 20 bp, Homo sapiens
gagggcagttctgctggttt

SEQ ID NO: 13598 - DNA, 90 bp, Cocksfoot mottle virus
cctccagctccaactcccgcattcgctgccttatggctgagctcatcggctcgccttggtgtatcgcaatgggagatgattctgttgagg

SEQ ID NO: 13599 - DNA, 24 bp, Cocksfoot mottle virus
ctcgccttggtgtatcgcaatggg

SEQ ID NO: 13600 - DNA, 24 bp, Homo sapiens
ctcgcccttggtgtattgcctaag

SEQ ID NO: 13601 - DNA, 19 bp, Homo sapiens
ctcctcttgggagcaatgg

SEQ ID NO: 13602 - DNA, 19 bp, Homo sapiens
gccttggtggttagcatgg

SEQ ID NO: 13603 - DNA, 18 bp, Homo sapiens
ctctccttggggcagtgg

SEQ ID NO: 13604 - DNA, 16 bp, Homo sapiens
gccttggtgtatatgg

SEQ ID NO: 13605 - DNA, 20 bp, Homo sapiens
cgtcttggcactgcagtggg

SEQ ID NO: 13606 - DNA, 25 bp, Homo sapiens
ctcgccttggtgctgggcaagtggg

SEQ ID NO: 13607 - DNA, 21 bp, Homo sapiens
ctcccttggtgtgcccttggg

SEQ ID NO: 13608 - DNA, 18 bp, Homo sapiens
tcgtctttgctgcaatgg

SEQ ID NO: 13609 - DNA, 19 bp, Homo sapiens
accttggtggcggggtggg

SEQ ID NO: 13610 - DNA, 17 bp, Homo sapiens
tcgccctggtgagatgg

SEQ ID NO: 13611 - DNA, 121 bp, Feline foamy virus
gccctagtaaccaatgctcagtcacaatttgacctaatgggagatgatatacaacgagcagaaaatttccccagggtcattaacaatctatacactatgctgggtctcaatatacatgggc

SEQ ID NO: 13612 - DNA, 24 bp, Feline foamy virus
tccccagggtcattaacaatctat

SEQ ID NO: 13613 - DNA, 24 bp, Homo sapiens
ccccagggtcccagcctgatctat

SEQ ID NO: 13614 - DNA, 16 bp, Homo sapiens
gggtcattcattctat

SEQ ID NO: 13615 - DNA, 19 bp, Homo sapiens
tccccaggtccccaagtct

SEQ ID NO: 13616 - DNA, 18 bp, Homo sapiens
tcctcagggccattatct

SEQ ID NO: 13617 - DNA, 20 bp, Homo sapiens
cccagggtcattcggtccca

SEQ ID NO: 13618 - DNA, 20 bp, Homo sapiens
tccttaaggttattaacaat

SEQ ID NO: 13619 - DNA, 18 bp, Homo sapiens
tccccaggtcattgaaca

SEQ ID NO: 13620 - DNA, 18 bp, Homo sapiens
aaggccatggcagtctat

SEQ ID NO: 13621 - DNA, 19 bp, Homo sapiens
ccccagggtagcaatctat

SEQ ID NO: 13622 - DNA, 15 bp, Homo sapiens
cagggtcaccatcta

SEQ ID NO: 13623 - DNA, 19 bp, Homo sapiens
cctccggggtcaccatcta

SEQ ID NO: 13624 - DNA, 70 bp, Human herpesvirus 1
ggcggccgggggcccgcggcgcgtcaggcgccataggtgccgaccgagtccgcggtccaccatacccgcc

SEQ ID NO: 13625 - DNA, 22 bp, Human herpesvirus 1
tccgcggtccaccatacccgcc

SEQ ID NO: 13626 - DNA, 24 bp, Homo sapiens
cctgcaccccccatcatgtctgcc

SEQ ID NO: 13627 - DNA, 21 bp, Homo sapiens
tccgcggcccactcgtgcgcc

SEQ ID NO: 13628 - DNA, 23 bp, Homo sapiens
tccgcggtcaccttctagccgcc

SEQ ID NO: 13629 - DNA, 21 bp, Homo sapiens
ccggctgcctgccatacccgc

SEQ ID NO: 13630 - DNA, 21 bp, Homo sapiens
tcctggtcccctttacccgcc

SEQ ID NO: 13631 - DNA, 19 bp, Homo sapiens
gcgcgtcacaacacccgcc

SEQ ID NO: 13632 - DNA, 17 bp, Homo sapiens
tcctcggtccacaccgc

SEQ ID NO: 13633 - DNA, 18 bp, Homo sapiens
cccgcggtccgccggcgc

SEQ ID NO: 13634 - DNA, 21 bp, Homo sapiens
acgatccataccatatctgcc

SEQ ID NO: 13635 - DNA, 20 bp, Homo sapiens
tccgcggcccaggtctcgcc

SEQ ID NO: 13636 - DNA, 18 bp, Homo sapiens
gctaggtaccatacctgc

SEQ ID NO: 13637 - DNA, 16 bp, Homo sapiens
tcccggtccactccgc

SEQ ID NO: 13638 - DNA, 20 bp, Homo sapiens
tccgcagttccgcctccgcc

SEQ ID NO: 13639 - DNA, 22 bp, Homo sapiens
ccgcgagcctgccgtacccgcc

SEQ ID NO: 13640 - DNA, 17 bp, Homo sapiens
tccgcggtccacacccg

SEQ ID NO: 13641 - DNA, 19 bp, Homo sapiens
gcgtgagccaccatacccg

SEQ ID NO: 13642 - DNA, 19 bp, Homo sapiens
tccgcggccgccccgcgcc

SEQ ID NO: 13643 - DNA, 22 bp, Homo sapiens
tccaccaccaccatacccgccg

SEQ ID NO: 13644 - DNA, 17 bp, Homo sapiens
cgcggtccgcctccgcc

SEQ ID NO: 13645 - DNA, 19 bp, Homo sapiens
tccttggtccaccagcgcc

SEQ ID NO: 13646 - DNA, 22 bp, Homo sapiens
tccgcgcttcagcagccctgcc

SEQ ID NO: 13647 - DNA, 19 bp, Homo sapiens
cgcccaccaccatgcccgc

SEQ ID NO: 13648 - DNA, 16 bp, Homo sapiens
tccgcggccgacccgc

SEQ ID NO: 13649 - DNA, 22 bp, Homo sapiens
tccagccacccaccatatctgc

SEQ ID NO: 13650 - DNA, 16 bp, Homo sapiens
tccgcggtcaccccgc

SEQ ID NO: 13651 - DNA, 17 bp, Homo sapiens
cccgcggtccgcccccg

SEQ ID NO: 13652 - DNA, 20 bp, Homo sapiens
tccacggtctgctgcccgcc

SEQ ID NO: 13653 - DNA, 21 bp, Homo sapiens
ccgcggtccgtcccgcccgcc

SEQ ID NO: 13654 - DNA, 20 bp, Homo sapiens
tccgcggccgttaacccgcc

SEQ ID NO: 13655 - DNA, 19 bp, Homo sapiens
cccgcggtcctagcctgcc

SEQ ID NO: 13656 - DNA, 19 bp, Homo sapiens
tccacggtcctctcctgcc

SEQ ID NO: 13657 - DNA, 97 bp, Human herpesvirus 1
cggtgcgtcccggcggacatgctgggcctaccgtggactccatttccgagacgacgtggggggagcggtggttgagcgcgccgccgggtgaacgctg

SEQ ID NO: 13658 - DNA, 24 bp, Human herpesvirus 1
acatgctgggcctaccgtggactc

SEQ ID NO: 13659 - DNA, 20 bp, Homo sapiens
acatgctgggtgcacctgga

SEQ ID NO: 13660 - DNA, 17 bp, Homo sapiens
catgctgggctatgtag

SEQ ID NO: 13661 - DNA, 22 bp, Homo sapiens
acagttgggcctggatgaactc

SEQ ID NO: 13662 - DNA, 23 bp, Homo sapiens
acatgtttcagaactgtggactc

SEQ ID NO: 13663 - DNA, 20 bp, Homo sapiens
tgctgggccgggatggactc

SEQ ID NO: 13664 - DNA, 22 bp, Homo sapiens
acatgctgggcactgcacactc

SEQ ID NO: 13665 - DNA, 20 bp, Homo sapiens
tgctgggcctgaaggggctc

SEQ ID NO: 13666 - DNA, 16 bp, Homo sapiens
gctgggcctggtggct

SEQ ID NO: 13667 - DNA, 15 bp, Homo sapiens
cagctgggcctaaac

SEQ ID NO: 13668 - DNA, 23 bp, Homo sapiens
acgctgggcagcactgtgggctc

SEQ ID NO: 13669 - DNA, 18 bp, Homo sapiens
catgccgggtctgagact

SEQ ID NO: 13670 - DNA, 19 bp, Homo sapiens
atgctgggccgcagaactc

SEQ ID NO: 13671 - DNA, 17 bp, Homo sapiens
gctgggcctggtggctc

SEQ ID NO: 13672 - DNA, 20 bp, Homo sapiens
catgctgggcagaggggctc

SEQ ID NO: 13673 - DNA, 19 bp, Homo sapiens
atgctggttttacagactc

SEQ ID NO: 13674 - DNA, 15 bp, Homo sapiens
cagctgggcctggac

SEQ ID NO: 13675 - DNA, 19 bp, Homo sapiens
gctgggcctgacaaggctc

SEQ ID NO: 13676 - DNA, 18 bp, Homo sapiens
acaagctgggcctgccgc

SEQ ID NO: 13677 - DNA, 20 bp, Homo sapiens
atgctgggcctgctctaact

SEQ ID NO: 13678 - DNA, 25 bp, Homo sapiens
catgctggtcttgtccaagtagctc

SEQ ID NO: 13679 - DNA, 15 bp, Homo sapiens
acatctgggcctggc

SEQ ID NO: 13680 - DNA, 22 bp, Homo sapiens
acaggctgcccaccgtgggctc

SEQ ID NO: 13681 - DNA, 21 bp, Homo sapiens
cagctgcacacgccgtggact

SEQ ID NO: 13682 - DNA, 18 bp, Homo sapiens
catgctgagcctgtgtct

SEQ ID NO: 13683 - DNA, 18 bp, Homo sapiens
acctgctgggcctgaact

SEQ ID NO: 13684 - DNA, 25 bp, Homo sapiens
tgctgggcattggttagatgggctc

SEQ ID NO: 13685 - DNA, 17 bp, Homo sapiens
acatgctagggctggat

SEQ ID NO: 13686 - DNA, 19 bp, Homo sapiens
catgctgggcttggtgcct

SEQ ID NO: 13687 - DNA, 17 bp, Homo sapiens
tgctgggcccacgggct

SEQ ID NO: 13688 - DNA, 16 bp, Homo sapiens
tgctgggcctgtgcga

SEQ ID NO: 13689 - DNA, 16 bp, Homo sapiens
tgctgggcctgtggct

SEQ ID NO: 13690 - DNA, 17 bp, Homo sapiens
tgcaggcctgtgggctc

SEQ ID NO: 13691 - DNA, 22 bp, Homo sapiens
gccgtggctctgtcgtggactc

SEQ ID NO: 13692 - DNA, 17 bp, Homo sapiens
atgctgggccctgggct

SEQ ID NO: 13693 - DNA, 16 bp, Homo sapiens
acatgctgggccacgt

SEQ ID NO: 13694 - DNA, 17 bp, Homo sapiens
ctgggcctccggggctc

SEQ ID NO: 13695 - DNA, 21 bp, Homo sapiens
tgctgggcctgtgtgggactc

SEQ ID NO: 13696 - DNA, 20 bp, Homo sapiens
gctgggcctggcccaggctc

SEQ ID NO: 13697 - DNA, 16 bp, Homo sapiens
tgctgggcctaaaact

SEQ ID NO: 13698 - DNA, 21 bp, Homo sapiens
acagctgggtttagcaaactc

SEQ ID NO: 13699 - DNA, 19 bp, Homo sapiens
ggatgctgggtcctgggct

SEQ ID NO: 13700 - DNA, 61 bp, Human herpesvirus 1
ggccttatagatctccggatcgatgcggacgggggtaatgatcagggcgatcggaacggcc

SEQ ID NO: 13701 - DNA, 24 bp, Human herpesvirus 1
tagatctccggatcgatgcggacg

SEQ ID NO: 13702 - DNA, 20 bp, Homo sapiens
tagatctctgagctcctggg

SEQ ID NO: 13703 - DNA, 23 bp, Homo sapiens
tagatctctgcggtcatagggcg

SEQ ID NO: 13704 - DNA, 18 bp, Homo sapiens
tagatttccagatcacag

SEQ ID NO: 13705 - DNA, 116 bp, Human herpesvirus 1
ggggcagtcggggaagtggctgtcgagcacgtagccctgcaccaagatctgcttaaagttcgggtgacgggggttcgcgaagacgggctcgcggcggaccagatccccggagctcc

SEQ ID NO: 13706 - DNA, 24 bp, Human herpesvirus 1
tgacgggggttcgcgaagacgggc

SEQ ID NO: 13707 - DNA, 19 bp, Homo sapiens
ggtgagcgcggagacgggc

SEQ ID NO: 13708 - DNA, 19 bp, Homo sapiens
tgacgggggcggaggtggg

SEQ ID NO: 13709 - DNA, 18 bp, Homo sapiens
ggaggggcgggagacggg

SEQ ID NO: 13710 - DNA, 16 bp, Homo sapiens
cgggggctaaggcggg

SEQ ID NO: 13711 - DNA, 17 bp, Homo sapiens
gggggttcgcggccagg

SEQ ID NO: 13712 - DNA, 20 bp, Homo sapiens
ggtgggccagggagacgggc

SEQ ID NO: 13713 - DNA, 18 bp, Homo sapiens
tggcaggggtcaggtggg

SEQ ID NO: 13714 - DNA, 22 bp, Homo sapiens
tgatggaggaggggagacgggc

SEQ ID NO: 13715 - DNA, 20 bp, Homo sapiens
gacggggggaagggacgggc

SEQ ID NO: 13716 - DNA, 22 bp, Homo sapiens
gacgggggcccatgggggtggg

SEQ ID NO: 13717 - DNA, 20 bp, Homo sapiens
tggcgggggttgcggggggg

SEQ ID NO: 13718 - DNA, 24 bp, Homo sapiens
gacgggggtggatgcggaggtggg

SEQ ID NO: 13719 - DNA, 18 bp, Homo sapiens
gggacagcgaagacgggc

SEQ ID NO: 13720 - DNA, 19 bp, Homo sapiens
tggcgggggccggggcggg

SEQ ID NO: 13721 - DNA, 20 bp, Homo sapiens
tgcgggggtcctggggcggg

SEQ ID NO: 13722 - DNA, 21 bp, Homo sapiens
tgacaggggtaagaaggtggg

SEQ ID NO: 13723 - DNA, 23 bp, Homo sapiens
tgcgggggctggggaaggtgggc

SEQ ID NO: 13724 - DNA, 15 bp, Homo sapiens
tgacgggggtcacgg

SEQ ID NO: 13725 - DNA, 22 bp, Homo sapiens
tgaggggggcccgggaggtggg

SEQ ID NO: 13726 - DNA, 21 bp, Homo sapiens
tggcgggggtcactcatgggc

SEQ ID NO: 13727 - DNA, 23 bp, Homo sapiens
gggcggcggctgtggaggcgggc

SEQ ID NO: 13728 - DNA, 61 bp, Bovine herpesvirus 4
tttttaccttttgaagagcagcgcttaaagcgggcactagagctgttagaagaagtagaaa

SEQ ID NO: 13729 - DNA, 24 bp, Bovine herpesvirus 4
taccttttgaagagcagcgcttaa

SEQ ID NO: 13730 - DNA, 21 bp, Homo sapiens
ccgagcagagagcagcgctta

SEQ ID NO: 13731 - DNA, 16 bp, Homo sapiens
tacctttttaggcagc

SEQ ID NO: 13732 - DNA, 20 bp, Homo sapiens
ccttttaagacatatgctta

SEQ ID NO: 13733 - DNA, 19 bp, Homo sapiens
taccttttgaggggaccag

SEQ ID NO: 13734 - DNA, 19 bp, Homo sapiens
caccttttggggagtaaca

SEQ ID NO: 13735 - DNA, 19 bp, Homo sapiens
ttttgaagagtagtcctaa

SEQ ID NO: 13736 - DNA, 21 bp, Homo sapiens
taccttttgagagcacttctt

SEQ ID NO: 13737 - DNA, 90 bp, Human papillomavirus type 19
atataagggcacttctactgatgataggcaaaatgtatcatttgaccctaaacagctacaaatgtttattataggctgtgctccctgtat

SEQ ID NO: 13738 - DNA, 24 bp, Human papillomavirus type 19
aagggcacttctactgatgatagg

SEQ ID NO: 13739 - DNA, 21 bp, Homo sapiens
aagggcactgtttaaagtagg

SEQ ID NO: 13740 - DNA, 23 bp, Homo sapiens
aagtgcacttttagaacaatagg

SEQ ID NO: 13741 - DNA, 22 bp, Homo sapiens
aagggcacttctgcaggaactg

SEQ ID NO: 13742 - DNA, 22 bp, Homo sapiens
aagggcacttgggaatgatggg

SEQ ID NO: 13743 - DNA, 17 bp, Homo sapiens
aaaggcagctgatgatg

SEQ ID NO: 13744 - DNA, 23 bp, Homo sapiens
agggcagtttctgttggtctagg

SEQ ID NO: 13745 - DNA, 18 bp, Homo sapiens
aagggcacttcactgatg

SEQ ID NO: 13746 - DNA, 19 bp, Homo sapiens
agggcacctttattgtctg

SEQ ID NO: 13747 - DNA, 21 bp, Homo sapiens
aagggcacttctgtcctaatg

SEQ ID NO: 13748 - DNA, 73 bp, Human papillomavirus type 19
gcgcgcacaaggtcataacaatggcatatgctggtttaatcagctatttgtcacagtagtagacaacacgcgt

SEQ ID NO: 13749 - DNA, 24 bp, Human papillomavirus type 19
tttgtcacagtagtagacaacacg

SEQ ID NO: 13750 - DNA, 16 bp, Homo sapiens
tttgccatagtagaca

SEQ ID NO: 13751 - DNA, 19 bp, Homo sapiens
tttgtcacagaagtggaca

SEQ ID NO: 13752 - DNA, 21 bp, Homo sapiens
gtccaagtagtaggtgacacg

SEQ ID NO: 13753 - DNA, 19 bp, Homo sapiens
tttgccacaggtccagcag

SEQ ID NO: 13754 - DNA, 20 bp, Homo sapiens
tcaggtaagtggtagacaac

SEQ ID NO: 13755 - DNA, 18 bp, Homo sapiens
gtactggtagacaacacg

SEQ ID NO: 13756 - DNA, 123 bp, Human papillomavirus type 19
acttgtaaatatccagatttcttaaagatgcaaaatgatgtgtatggtgattcctgctttttttatgcaaggcgagagcaatgttatgctagacatttttttgttcgtggaggcaagacaggt

SEQ ID NO: 13757 - DNA, 24 bp, Human papillomavirus type 19
cgagagcaatgttatgctagacat

SEQ ID NO: 13758 - DNA, 21 bp, Homo sapiens
cgagagcaatattatatacat

SEQ ID NO: 13759 - DNA, 17 bp, Homo sapiens
gagacaatgttacatta

SEQ ID NO: 13760 - DNA, 21 bp, Homo sapiens
cgagagcactactctaggcat

SEQ ID NO: 13761 - DNA, 22 bp, Homo sapiens
gagtagttcccatgctagacat

SEQ ID NO: 13762 - DNA, 19 bp, Homo sapiens
gagagcattagtgctagac

SEQ ID NO: 13763 - DNA, 16 bp, Homo sapiens
gccatgtgccagacat

SEQ ID NO: 13764 - DNA, 60 bp, Ectromelia virus
agaccaagaacaagatcgtgaacacgatgatatagaatcatcggttggcgtgattggttt

SEQ ID NO: 13765 - DNA, 20 bp, Ectromelia virus
tcggttggcgtgattggttt

SEQ ID NO: 13766 - DNA, 17 bp, Homo sapiens
tcgtggttgattggttt

SEQ ID NO: 13767 - DNA, 18 bp, Homo sapiens
tcagttggtaaatggttt

SEQ ID NO: 13768 - DNA, 20 bp, Homo sapiens
tcggttggcatggggagctt

SEQ ID NO: 13769 - DNA, 19 bp, Homo sapiens
ggatggcgtgacatggttt

SEQ ID NO: 13770 - DNA, 18 bp, Homo sapiens
cggttttgtcattggttt

SEQ ID NO: 13771 - DNA, 18 bp, Homo sapiens
gatgaagctgattggttt

SEQ ID NO: 13772 - DNA, 19 bp, Homo sapiens
ggttggcacaagttggttt

SEQ ID NO: 13773 - DNA, 17 bp, Homo sapiens
ggttgattggttggttt

SEQ ID NO: 13774 - DNA, 19 bp, Homo sapiens
tcagtttgtgaattggttt

SEQ ID NO: 13775 - DNA, 18 bp, Homo sapiens
gtaaacattgattggttt

SEQ ID NO: 13776 - DNA, 17 bp, Homo sapiens
ggttcccagattggttt

SEQ ID NO: 13777 - DNA, 18 bp, Homo sapiens
ttggctgttgattggttt

SEQ ID NO: 13778 - DNA, 15 bp, Homo sapiens
ggaactgattggttt

SEQ ID NO: 13779 - DNA, 19 bp, Homo sapiens
tcggttggtttgactactt

SEQ ID NO: 13780 - DNA, 15 bp, Homo sapiens
ggttggaactggttt

SEQ ID NO: 13781 - DNA, 91 bp, Euprosterna elaeasa virus
tcttgattgcagacatgaggaatgctgaaatatccgattcatctctagatgaggtagctcggtctttcaacaattatgtcggcgagattga

SEQ ID NO: 13782 - DNA, 24 bp, Euprosterna elaeasa virus
tgaaatatccgattcatctctaga

SEQ ID NO: 13783 - DNA, 23 bp, Homo sapiens
tgaggtatcagtcaatctctaga

SEQ ID NO: 13784 - DNA, 19 bp, Homo sapiens
tgaaataccctctctttag

SEQ ID NO: 13785 - DNA, 21 bp, Homo sapiens
tgaaggccattcatctttaga

SEQ ID NO: 13786 - DNA, 22 bp, Homo sapiens
tgaaaacgaaattcatctctag

SEQ ID NO: 13787 - DNA, 15 bp, Homo sapiens
tgaaatatccatcta

SEQ ID NO: 13788 - DNA, 21 bp, Homo sapiens
tgagctatgaccatctctgga

SEQ ID NO: 13789 - DNA, 60 bp, Euprosterna elaeasa virus
tctggcacttcaacggcttctggggtgggtttcatcctagaaggtgatgttttggccgga

SEQ ID NO: 13790 - DNA, 24 bp, Euprosterna elaeasa virus
ctagaaggtgatgttttggccgga

SEQ ID NO: 13791 - DNA, 22 bp, Homo sapiens
ccagaaggtgggccagggccgg

SEQ ID NO: 13792 - DNA, 17 bp, Homo sapiens
ggttgatgttttacaga

SEQ ID NO: 13793 - DNA, 21 bp, Homo sapiens
ctagaaggtgagtgtttaagg

SEQ ID NO: 13794 - DNA, 22 bp, Homo sapiens
ccaggaggtgataggatgctgg

SEQ ID NO: 13795 - DNA, 24 bp, Homo sapiens
ctggaatgtgatgttttgctttgg

SEQ ID NO: 13796 - DNA, 23 bp, Homo sapiens
taaacattgatgttttggttgga

SEQ ID NO: 13797 - DNA, 19 bp, Homo sapiens
ggaggaggctttggctgga

SEQ ID NO: 13798 - DNA, 19 bp, Homo sapiens
gagggtggccgcggccgga

SEQ ID NO: 13799 - DNA, 20 bp, Homo sapiens
aggtgacgctggtgggctgg

SEQ ID NO: 13800 - DNA, 15 bp, Homo sapiens
ctagaagatgaggcg

SEQ ID NO: 13801 - DNA, 21 bp, Homo sapiens
ctggaagatgatgacagctgg

SEQ ID NO: 13802 - DNA, 21 bp, Homo sapiens
gagggtccggcgtttggccgg

SEQ ID NO: 13803 - DNA, 20 bp, Homo sapiens
tagaggtgatgggctgtcgg

SEQ ID NO: 13804 - DNA, 19 bp, Homo sapiens
taggaggtggggtctttgg

SEQ ID NO: 13805 - DNA, 20 bp, Homo sapiens
taggaggtggggcctttgga

SEQ ID NO: 13806 - DNA, 22 bp, Homo sapiens
ctagatggttgatttggctgga

SEQ ID NO: 13807 - DNA, 18 bp, Homo sapiens
taaaaggtgaagggctgg

SEQ ID NO: 13808 - DNA, 19 bp, Homo sapiens
ctagaaggcgaggggctgg

SEQ ID NO: 13809 - DNA, 24 bp, Homo sapiens
taaaaggtgatgggtaggggttgg

SEQ ID NO: 13810 - DNA, 21 bp, Homo sapiens
gagggtgacagcacggctgga

SEQ ID NO: 13811 - DNA, 18 bp, Homo sapiens
ctggaaggtaatgtgtgg

SEQ ID NO: 13812 - DNA, 23 bp, Homo sapiens
ctggagggtgggggcagcccgga

SEQ ID NO: 13813 - DNA, 21 bp, Homo sapiens
ctagggtgtggggagggtcgg

SEQ ID NO: 13814 - DNA, 17 bp, Homo sapiens
caggaggtgacggctgg

SEQ ID NO: 13815 - DNA, 18 bp, Homo sapiens
ctagagggcgctggccgg

SEQ ID NO: 13816 - DNA, 18 bp, Homo sapiens
cagagggtggtgtttcgg

SEQ ID NO: 13817 - DNA, 18 bp, Homo sapiens
ctaggggagtttggccgg

SEQ ID NO: 13818 - DNA, 22 bp, Homo sapiens
caggaggtgatgttcagagtgg

SEQ ID NO: 13819 - DNA, 19 bp, Homo sapiens
ctggaaagtgatgatctgg

SEQ ID NO: 13820 - DNA, 22 bp, Homo sapiens
tagaaggttgcacagcggccgg

SEQ ID NO: 13821 - DNA, 19 bp, Homo sapiens
ctggaagatgatgttttcc

SEQ ID NO: 13822 - DNA, 24 bp, Homo sapiens
ctagaaggtggggacggtctcgga

SEQ ID NO: 13823 - DNA, 20 bp, Homo sapiens
tagaaggtggtgtgacttgg

SEQ ID NO: 13824 - DNA, 20 bp, Homo sapiens
ctggaaggagatgggtctgg

SEQ ID NO: 13825 - DNA, 19 bp, Homo sapiens
gaaggtgatggggtcccgg

SEQ ID NO: 13826 - DNA, 20 bp, Homo sapiens
aaaagcagggttttggccgg

SEQ ID NO: 13827 - DNA, 73 bp, Euprosterna elaeasa virus
accgccctttacccagtctgatctgatgcaacagaccccaaagacgtgtgtgttccagatcaaagagggtggt

SEQ ID NO: 13828 - DNA, 21 bp, Euprosterna elaeasa virus
ttccagatcaaagagggtggt

SEQ ID NO: 13829 - DNA, 21 bp, Homo sapiens
ttccagatgaggagccctggt

SEQ ID NO: 13830 - DNA, 19 bp, Homo sapiens
ttccagatctgaaggaagc

SEQ ID NO: 13831 - DNA, 16 bp, Homo sapiens
ttccgatcaagacggt

SEQ ID NO: 13832 - DNA, 22 bp, Homo sapiens
ttccatgtcaaaaataggtggt

SEQ ID NO: 13833 - DNA, 18 bp, Homo sapiens
ttctgaatcagaaaaggt

SEQ ID NO: 13834 - DNA, 15 bp, Homo sapiens
ttccagaccagggtg

SEQ ID NO: 13835 - DNA, 18 bp, Homo sapiens
ttccagataggaattggt

SEQ ID NO: 13836 - DNA, 20 bp, Homo sapiens
ttctagacagagaaagcagt

SEQ ID NO: 13837 - DNA, 17 bp, Homo sapiens
tcccaggaaagggtggt

SEQ ID NO: 13838 - DNA, 17 bp, Homo sapiens
ttctagataagagggca

SEQ ID NO: 13839 - DNA, 15 bp, Homo sapiens
ttccaaatcgagggt

SEQ ID NO: 13840 - DNA, 17 bp, Homo sapiens
ttctaatcaaagagaat

SEQ ID NO: 13841 - DNA, 16 bp, Homo sapiens
tcccggatcaaaggat

SEQ ID NO: 13842 - DNA, 16 bp, Homo sapiens
ttccagaccggagaat

SEQ ID NO: 13843 - DNA, 18 bp, Homo sapiens
ctccagatctatggtggt

SEQ ID NO: 13844 - DNA, 15 bp, Homo sapiens
ttccagtcaaagggc

SEQ ID NO: 13845 - DNA, 18 bp, Homo sapiens
ttccagaacaaagaaatg

SEQ ID NO: 13846 - DNA, 20 bp, Homo sapiens
ctccagggaaagagggtggt

SEQ ID NO: 13847 - DNA, 18 bp, Homo sapiens
ttccagatcaagagccgt

SEQ ID NO: 13848 - DNA, 19 bp, Homo sapiens
tctcaggttagagagtggt

SEQ ID NO: 13849 - DNA, 20 bp, Homo sapiens
ttccagacaaaattggtggt

SEQ ID NO: 13850 - DNA, 20 bp, Homo sapiens
ttccagattaaaaaaatggt

SEQ ID NO: 13851 - DNA, 18 bp, Homo sapiens
ttccagatatgaagtggt

SEQ ID NO: 13852 - DNA, 15 bp, Homo sapiens
ctccagatcaaggtg

SEQ ID NO: 13853 - DNA, 18 bp, Homo sapiens
ttccagggtaaagatagt

SEQ ID NO: 13854 - DNA, 16 bp, Homo sapiens
tcccagattaggatgg

SEQ ID NO: 13855 - DNA, 20 bp, Homo sapiens
ttccagatcagagcaggggt

SEQ ID NO: 13856 - DNA, 23 bp, Homo sapiens
ttccaggccaaagtgaccgtggt

SEQ ID NO: 13857 - DNA, 21 bp, Homo sapiens
tccgggtgacaggagggtggt

SEQ ID NO: 13858 - DNA, 20 bp, Homo sapiens
ttccacaggaagagggtggt

SEQ ID NO: 13859 - DNA, 21 bp, Homo sapiens
ctccaggaactcgagggtggt

SEQ ID NO: 13860 - DNA, 19 bp, Homo sapiens
ttccagatcatagtcaagt

SEQ ID NO: 13861 - DNA, 19 bp, Homo sapiens
ttccagttcaaaggcaagc

SEQ ID NO: 13862 - DNA, 16 bp, Homo sapiens
tcccagagagggtggt

SEQ ID NO: 13863 - DNA, 17 bp, Homo sapiens
ttccagataaggaagca

SEQ ID NO: 13864 - DNA, 19 bp, Homo sapiens
ttccagactcagttgtggt

SEQ ID NO: 13865 - DNA, 21 bp, Homo sapiens
ttctggataattaaaggtggt

SEQ ID NO: 13866 - DNA, 19 bp, Homo sapiens
ttccagatagaataaaggt

SEQ ID NO: 13867 - DNA, 18 bp, Homo sapiens
ttccagatgaatcacggt

SEQ ID NO: 13868 - DNA, 18 bp, Homo sapiens
ttccagatctacaatggt

SEQ ID NO: 13869 - DNA, 18 bp, Homo sapiens
tcccagcaggagggtggt

SEQ ID NO: 13870 - DNA, 16 bp, Homo sapiens
ttccaatcaaaggagc

SEQ ID NO: 13871 - DNA, 17 bp, Homo sapiens
ttcaggaccagggtggt

SEQ ID NO: 13872 - DNA, 17 bp, Homo sapiens
ttccggaccgagagggt

SEQ ID NO: 13873 - DNA, 21 bp, Homo sapiens
cagaccaaggaggcagctggt

SEQ ID NO: 13874 - DNA, 16 bp, Homo sapiens
ctccagattgaggaga

SEQ ID NO: 13875 - DNA, 16 bp, Homo sapiens
ttccagtcaaaagggt

SEQ ID NO: 13876 - DNA, 19 bp, Homo sapiens
ctctagaagggagggtggt

SEQ ID NO: 13877 - DNA, 16 bp, Homo sapiens
ttccagaccagactgg

SEQ ID NO: 13878 - DNA, 18 bp, Homo sapiens
ttccagatagagagaagt

SEQ ID NO: 13879 - DNA, 17 bp, Homo sapiens
caaatcaagaaattggt

SEQ ID NO: 13880 - DNA, 18 bp, Homo sapiens
ttccagatgggatctggt

SEQ ID NO: 13881 - DNA, 21 bp, Homo sapiens
ttccagacaagggccgacggt

SEQ ID NO: 13882 - DNA, 21 bp, Homo sapiens
ttccagacacattagggtggt

SEQ ID NO: 13883 - DNA, 16 bp, Homo sapiens
ctccaggtcagagagc

SEQ ID NO: 13884 - DNA, 16 bp, Homo sapiens
ttccagcatcagatgg

SEQ ID NO: 13885 - DNA, 18 bp, Homo sapiens
ttccagataagatttggt

SEQ ID NO: 13886 - DNA, 21 bp, Homo sapiens
ttccagataaaaacatgtggt

SEQ ID NO: 13887 - DNA, 16 bp, Homo sapiens
ttccagattaagaata

SEQ ID NO: 13888 - DNA, 17 bp, Homo sapiens
tccagatcaaggacaac

SEQ ID NO: 13889 - DNA, 18 bp, Homo sapiens
ctctagtctgagggtggt

SEQ ID NO: 13890 - DNA, 16 bp, Homo sapiens
ttccagatcacaggtg

SEQ ID NO: 13891 - DNA, 17 bp, Homo sapiens
ttccaatcaaagaaaat

SEQ ID NO: 13892 - DNA, 18 bp, Homo sapiens
ttccagatgaggcttggt

SEQ ID NO: 13893 - DNA, 19 bp, Homo sapiens
tccctggaaagagggtggt

SEQ ID NO: 13894 - DNA, 19 bp, Homo sapiens
ttccagataaaaacgtggt

SEQ ID NO: 13895 - DNA, 18 bp, Homo sapiens
ccccagggagagggtggt

SEQ ID NO: 13896 - DNA, 23 bp, Homo sapiens
ttccagatgtggaaactcatggt

SEQ ID NO: 13897 - DNA, 16 bp, Homo sapiens
ttctaatcaaaagggt

SEQ ID NO: 13898 - DNA, 15 bp, Homo sapiens
ctccagacagggtgg

SEQ ID NO: 13899 - DNA, 18 bp, Homo sapiens
ttccatggacagggtggt

SEQ ID NO: 13900 - DNA, 15 bp, Homo sapiens
ttccagatgaagatg

SEQ ID NO: 13901 - DNA, 21 bp, Homo sapiens
tccaggttcccagagggtggt

SEQ ID NO: 13902 - DNA, 20 bp, Homo sapiens
ctctggatcagggagggtgg

SEQ ID NO: 13903 - DNA, 21 bp, Homo sapiens
ttcggcgatgcagagggtggt

SEQ ID NO: 13904 - DNA, 18 bp, Homo sapiens
ttccagtttgagggtggt

SEQ ID NO: 13905 - DNA, 20 bp, Homo sapiens
ttccaaatcagagtcaactg

SEQ ID NO: 13906 - DNA, 18 bp, Homo sapiens
tccgacccagagggtggt

SEQ ID NO: 13907 - DNA, 16 bp, Homo sapiens
ttccaatcaaaggaat

SEQ ID NO: 13908 - DNA, 15 bp, Homo sapiens
ttccagtcagagtag

SEQ ID NO: 13909 - DNA, 19 bp, Homo sapiens
tcccagatggaggggtggt

SEQ ID NO: 13910 - DNA, 22 bp, Homo sapiens
ttccagatgagatttgggtggt

SEQ ID NO: 13911 - DNA, 16 bp, Homo sapiens
tcccaggtcagagggc

SEQ ID NO: 13912 - DNA, 66 bp, Euprosterna elaeasa virus
ggtcggaactctccctgggggctttttgccacctccactccccccaaggatgaagttgcgttgacc

SEQ ID NO: 13913 - DNA, 24 bp, Euprosterna elaeasa virus
tcggaactctccctgggggctttt

SEQ ID NO: 13914 - DNA, 20 bp, Homo sapiens
ggggctcttcctgggcagct

SEQ ID NO: 13915 - DNA, 18 bp, Homo sapiens
ggaactcccggggctttt

SEQ ID NO: 13916 - DNA, 19 bp, Homo sapiens
ggaaccctttctgcgcttt

SEQ ID NO: 13917 - DNA, 25 bp, Homo sapiens
tcggaggctctctggtactgctttt

SEQ ID NO: 13918 - DNA, 21 bp, Homo sapiens
ggggctccccctctgtctttt

SEQ ID NO: 13919 - DNA, 20 bp, Homo sapiens
ggaattttccctaggcactt

SEQ ID NO: 13920 - DNA, 20 bp, Homo sapiens
ctccttccttgggggctttt

SEQ ID NO: 13921 - DNA, 24 bp, Homo sapiens
gaactttctcccactggggttttt

SEQ ID NO: 13922 - DNA, 22 bp, Homo sapiens
tcggaccccgctgggggctttt

SEQ ID NO: 13923 - DNA, 72 bp, Euprosterna elaeasa virus
gcggcgtcggcgtagaaccgttaaaggcacgggaaatcccaatcagccttttgcggttaccgctggcgccgc

SEQ ID NO: 13924 - DNA, 24 bp, Euprosterna elaeasa virus
tcagccttttgcggttaccgctgg

SEQ ID NO: 13925 - DNA, 21 bp, Homo sapiens
tcggctctttgcggctgctgg

SEQ ID NO: 13926 - DNA, 19 bp, Homo sapiens
tcagctttctgaattgctg

SEQ ID NO: 13927 - DNA, 19 bp, Homo sapiens
gccttttggggtactttgg

SEQ ID NO: 13928 - DNA, 21 bp, Homo sapiens
cttttgcactcccaccgctgg

SEQ ID NO: 13929 - DNA, 22 bp, Homo sapiens
tcagttttgtgtgcctcgctgg

SEQ ID NO: 13930 - DNA, 17 bp, Homo sapiens
cagcctttctgctgctg

SEQ ID NO: 13931 - DNA, 20 bp, Homo sapiens
cagccttttagggctgctgg

SEQ ID NO: 13932 - DNA, 22 bp, Homo sapiens
cagtgaggacggttactgctgg

SEQ ID NO: 13933 - DNA, 19 bp, Homo sapiens
tcagcctctcttgccgttg

SEQ ID NO: 13934 - DNA, 74 bp, Paramecium bursaria Chlorella virus 1
tgccttttctgagaggtttcaaacgattgtttaccttttgtttccaaatttttgcaacttttctcactacggca

SEQ ID NO: 13935 - DNA, 24 bp, Paramecium bursaria Chlorella virus 1
tgagaggtttcaaacgattgttta

SEQ ID NO: 13936 - DNA, 19 bp, Homo sapiens
tgagaagtttctgttgttt

SEQ ID NO: 13937 - DNA, 15 bp, Homo sapiens
tggaggtttattgtt

SEQ ID NO: 13938 - DNA, 18 bp, Homo sapiens
tgggaggttccagatgct

SEQ ID NO: 13939 - DNA, 21 bp, Homo sapiens
tgagaggtttgtaaattactt

SEQ ID NO: 13940 - DNA, 15 bp, Homo sapiens
tgagaggtttttgtt

SEQ ID NO: 13941 - DNA, 20 bp, Homo sapiens
gaagtaaaaaacgattgttt

SEQ ID NO: 13942 - DNA, 21 bp, Homo sapiens
tgagaggttcaagtgactctc

SEQ ID NO: 13943 - DNA, 19 bp, Homo sapiens
tggtaggttttgattgttt

SEQ ID NO: 13944 - DNA, 17 bp, Homo sapiens
gagaggttttgaatgct

SEQ ID NO: 13945 - DNA, 20 bp, Homo sapiens
gaggtttcagggaggattta

SEQ ID NO: 13946 - DNA, 21 bp, Homo sapiens
tgagaggttattaaatgatca

SEQ ID NO: 13947 - DNA, 21 bp, Homo sapiens
tgagaggttttaacatgaatg

SEQ ID NO: 13948 - DNA, 22 bp, Homo sapiens
tgagaggttcagggaggagttt

SEQ ID NO: 13949 - DNA, 18 bp, Homo sapiens
tgagaggttacaaattgt

SEQ ID NO: 13950 - DNA, 18 bp, Homo sapiens
tgagagatctggttgttt

SEQ ID NO: 13951 - DNA, 109 bp, Paramecium bursaria Chlorella virus 1
tgttttgaacgggtgggatgacaggttcgcgtatgatttcgcgtttggtttcgattttaggcgtgaatagtttcttcacgtatatctttttatcccctggtttgacata

SEQ ID NO: 13952 - DNA, 17 bp, Paramecium bursaria Chlorella virus 1
tcccctggtttgacata

SEQ ID NO: 13953 - DNA, 19 bp, Homo sapiens
tctcctagctcagtacata

SEQ ID NO: 13954 - DNA, 18 bp, Homo sapiens
cctcctggtccccaacat

SEQ ID NO: 13955 - DNA, 18 bp, Homo sapiens
tccccttggttttccata

SEQ ID NO: 13956 - DNA, 19 bp, Homo sapiens
ccctctgttggtctgacat

SEQ ID NO: 13957 - DNA, 18 bp, Homo sapiens
tcctttagtccgaacata

SEQ ID NO: 13958 - DNA, 66 bp, Paramecium bursaria Chlorella virus 1
cgggattttctttccagttggcccgataacgtacttacccccacgcggtcctgtaagaatctctcg

SEQ ID NO: 13959 - DNA, 24 bp, Paramecium bursaria Chlorella virus 1
ttccagttggcccgataacgtact

SEQ ID NO: 13960 - DNA, 19 bp, Homo sapiens
ttccagttggtatggtacc

SEQ ID NO: 13961 - DNA, 18 bp, Homo sapiens
cagttggcctgacaacac

SEQ ID NO: 13962 - DNA, 73 bp, Human herpesvirus 5
tccatttttatcctcgcacttcttcgctctcaaagccgcctttaaagttgaaatgaaaggatggaaacatgga

SEQ ID NO: 13963 - DNA, 24 bp, Human herpesvirus 5
tgaaatgaaaggatggaaacatgg

SEQ ID NO: 13964 - DNA, 21 bp, Homo sapiens
gaatggaaaggtggaaccagg

SEQ ID NO: 13965 - DNA, 22 bp, Homo sapiens
tgaagggggcagggaaacatgg

SEQ ID NO: 13966 - DNA, 21 bp, Homo sapiens
tgacaggagatggaaacatgg

SEQ ID NO: 13967 - DNA, 22 bp, Homo sapiens
tgaaagggaaggggcgacatgg

SEQ ID NO: 13968 - DNA, 22 bp, Homo sapiens
tgagaatgaaaattgggcatgg

SEQ ID NO: 13969 - DNA, 21 bp, Homo sapiens
tgaaatggaagggttgacatg

SEQ ID NO: 13970 - DNA, 18 bp, Homo sapiens
tgaaaggaggatgacatg

SEQ ID NO: 13971 - DNA, 18 bp, Homo sapiens
tgccgggtggaaacatgg

SEQ ID NO: 13972 - DNA, 19 bp, Homo sapiens
atgaaagatgagaatatgg

SEQ ID NO: 13973 - DNA, 21 bp, Homo sapiens
tgatgtgaaagatggatatgg

SEQ ID NO: 13974 - DNA, 26 bp, Homo sapiens
gaaaaaaattagggatgggaatatgg

SEQ ID NO: 13975 - DNA, 22 bp, Homo sapiens
tgaaataaagggatgggtctgg

SEQ ID NO: 13976 - DNA, 23 bp, Homo sapiens
tgcaatgaaaggcaggaacgtgg

SEQ ID NO: 13977 - DNA, 18 bp, Homo sapiens
gaaatgggaaaggacatg

SEQ ID NO: 13978 - DNA, 25 bp, Homo sapiens
tgagaatgaagggacagcagcatgg

SEQ ID NO: 13979 - DNA, 22 bp, Homo sapiens
tgaaaagaaagggctctcatgg

SEQ ID NO: 13980 - DNA, 20 bp, Homo sapiens
tggaaggatgggcagcatgg

SEQ ID NO: 13981 - DNA, 21 bp, Homo sapiens
tgaagagggggaaaggcatgg

SEQ ID NO: 13982 - DNA, 24 bp, Homo sapiens
tgaagtgaaaagataactacgtgg

SEQ ID NO: 13983 - DNA, 24 bp, Homo sapiens
taaagtgaacaataggaaatatgg

SEQ ID NO: 13984 - DNA, 23 bp, Homo sapiens
tgcaatgaaagggtccgtcatgg

SEQ ID NO: 13985 - DNA, 23 bp, Homo sapiens
tggaaggaggtaagaaaacatgg

SEQ ID NO: 13986 - DNA, 21 bp, Homo sapiens
tgaaataaaagatggatatgg

SEQ ID NO: 13987 - DNA, 23 bp, Homo sapiens
tgaaatggaagggagtaacatgg

SEQ ID NO: 13988 - DNA, 23 bp, Homo sapiens
tgaaaagaacagaggaaatgtgg

SEQ ID NO: 13989 - DNA, 19 bp, Homo sapiens
atgaaggacggagatatgg

SEQ ID NO: 13990 - DNA, 21 bp, Homo sapiens
tgaaaatggaaggaatcatgg

SEQ ID NO: 13991 - DNA, 19 bp, Homo sapiens
tgaaatgataggcagcatg

SEQ ID NO: 13992 - DNA, 19 bp, Homo sapiens
tgaaatggataaaaatgtg

SEQ ID NO: 13993 - DNA, 24 bp, Homo sapiens
tgacgtgaggggctggaggcatgg

SEQ ID NO: 13994 - DNA, 20 bp, Homo sapiens
aatgaaaggaagaaaggatg

SEQ ID NO: 13995 - DNA, 22 bp, Homo sapiens
gaaatggcacatggaaacatgg

SEQ ID NO: 13996 - DNA, 18 bp, Homo sapiens
tgaaagaagagaaatatg

SEQ ID NO: 13997 - DNA, 106 bp, Canine oral papillomavirus
gacttcacagaagagggcaaaacaaaaacattgtgtgtagtgttagataacagtcatattttagctaccatagtcttatttttttttctctgttttgttttaagtc

SEQ ID NO: 13998 - DNA, 24 bp, Canine oral papillomavirus
taccatagtcttatttttttttct

SEQ ID NO: 13999 - DNA, 23 bp, Homo sapiens
catagtctctgagttttttttct

SEQ ID NO: 14000 - DNA, 20 bp, Homo sapiens
taccaggtcttattcattct

SEQ ID NO: 14001 - DNA, 22 bp, Homo sapiens
cctgtttcttatttttttttct

SEQ ID NO: 14002 - DNA, 19 bp, Homo sapiens
acagcttatttttttttct

SEQ ID NO: 14003 - DNA, 18 bp, Homo sapiens
agttttatttttttttct

SEQ ID NO: 14004 - DNA, 22 bp, Homo sapiens
catagtcttgtcttatatttct

SEQ ID NO: 14005 - DNA, 23 bp, Homo sapiens
taccataaaacatttttttttct

SEQ ID NO: 14006 - DNA, 19 bp, Homo sapiens
catagtcttattcattttt

SEQ ID NO: 14007 - DNA, 19 bp, Homo sapiens
tacttagtcttactttttt

SEQ ID NO: 14008 - DNA, 23 bp, Homo sapiens
accatgcccggctattttttttt

SEQ ID NO: 14009 - DNA, 22 bp, Homo sapiens
taccacagtgtaattttttttt

SEQ ID NO: 14010 - DNA, 19 bp, Homo sapiens
ccatagtcttcacattttt

SEQ ID NO: 14011 - DNA, 20 bp, Homo sapiens
gccctttgatttttttttct

SEQ ID NO: 14012 - DNA, 21 bp, Homo sapiens
atagtcttgtttccattttct

SEQ ID NO: 14013 - DNA, 18 bp, Homo sapiens
catagtcttttttttttt

SEQ ID NO: 14014 - DNA, 20 bp, Homo sapiens
taccatggctttatttttct

SEQ ID NO: 14015 - DNA, 19 bp, Homo sapiens
ccatagttatattttttct

SEQ ID NO: 14016 - DNA, 20 bp, Homo sapiens
ccacgtccttgttttttttt

SEQ ID NO: 14017 - DNA, 17 bp, Homo sapiens
accactatttttttttc

SEQ ID NO: 14018 - DNA, 17 bp, Homo sapiens
agcttatttttttttct

SEQ ID NO: 14019 - DNA, 18 bp, Homo sapiens
catagtcttgcttttttt

SEQ ID NO: 14020 - DNA, 19 bp, Homo sapiens
ccaaggtcatatttttttt

SEQ ID NO: 14021 - DNA, 21 bp, Homo sapiens
caccagtctatttttttttct

SEQ ID NO: 14022 - DNA, 17 bp, Homo sapiens
ccatagttactttttct

SEQ ID NO: 14023 - DNA, 18 bp, Homo sapiens
gtcttatttatactttct

SEQ ID NO: 14024 - DNA, 18 bp, Homo sapiens
ccatagtaattttttttt

SEQ ID NO: 14025 - DNA, 22 bp, Homo sapiens
ccatatccctttattttttttt

SEQ ID NO: 14026 - DNA, 17 bp, Homo sapiens
taccatagtttattttt

SEQ ID NO: 14027 - DNA, 23 bp, Homo sapiens
ccacagtcattgcattttttttt

SEQ ID NO: 14028 - DNA, 18 bp, Homo sapiens
atctttatttttttttct

SEQ ID NO: 14029 - DNA, 18 bp, Homo sapiens
caccatatttttttttct

SEQ ID NO: 14030 - DNA, 21 bp, Homo sapiens
ccatagtactgcttttttttt

SEQ ID NO: 14031 - DNA, 22 bp, Homo sapiens
ccatgaagtgatttttttttct

SEQ ID NO: 14032 - DNA, 19 bp, Homo sapiens
catagtcctatacacttct

SEQ ID NO: 14033 - DNA, 87 bp, Canine oral papillomavirus
cagatatatcgatatccaattaggcaagtgaaacttcaatatgtttattgcagtctccaaatttagtttagtttgatatgttgtctg

SEQ ID NO: 14034 - DNA, 24 bp, Canine oral papillomavirus
tatccaattaggcaagtgaaactt

SEQ ID NO: 14035 - DNA, 17 bp, Homo sapiens
caatacaggtgaaactt

SEQ ID NO: 14036 - DNA, 20 bp, Homo sapiens
tatccaataaggtaattaaa

SEQ ID NO: 14037 - DNA, 22 bp, Homo sapiens
tatccacttaggtacaaaactt

SEQ ID NO: 14038 - DNA, 21 bp, Homo sapiens
aatttagcccaggtgaaactt

SEQ ID NO: 14039 - DNA, 18 bp, Homo sapiens
catccaattgggtgatga

SEQ ID NO: 14040 - DNA, 17 bp, Homo sapiens
tccaattagctttgaaa

SEQ ID NO: 14041 - DNA, 21 bp, Homo sapiens
tatcggttagaccagaaactt

SEQ ID NO: 14042 - DNA, 19 bp, Homo sapiens
tccaattaaaatgagactt

SEQ ID NO: 14043 - DNA, 22 bp, Homo sapiens
tatccaacttaacatgaaactt

SEQ ID NO: 14044 - DNA, 21 bp, Homo sapiens
tatccaattagatttctaagt

SEQ ID NO: 14045 - DNA, 17 bp, Homo sapiens
tccaattacaaatgaaa

SEQ ID NO: 14046 - DNA, 104 bp, Human herpesvirus 2
cctgccgaggaacgtcaccaggtgcggttgcagggggcagtcgggaaagtggctgtcgaggacgtatccctgcaccaagatctgtttgaagttcgggtggcggg

SEQ ID NO: 14047 - DNA, 24 bp, Human herpesvirus 2
tgtcgaggacgtatccctgcacca

SEQ ID NO: 14048 - DNA, 19 bp, Homo sapiens
gaggacaggggctgcacca

SEQ ID NO: 14049 - DNA, 21 bp, Homo sapiens
tcgaggggttgcccctgcacc

SEQ ID NO: 14050 - DNA, 22 bp, Homo sapiens
tgccgaggattcgcctgcgcca

SEQ ID NO: 14051 - DNA, 19 bp, Homo sapiens
tgtctagggcttcctgcac

SEQ ID NO: 14052 - DNA, 22 bp, Homo sapiens
tcgggtagccatttctgcacca

SEQ ID NO: 14053 - DNA, 18 bp, Homo sapiens
tgtctgagctccctgcac

SEQ ID NO: 14054 - DNA, 26 bp, Homo sapiens
tgttgagagaattctcctctgtgcca

SEQ ID NO: 14055 - DNA, 18 bp, Homo sapiens
tgccgaggagcctgtgcc

SEQ ID NO: 14056 - DNA, 21 bp, Homo sapiens
tgtcagttagtccctgcatca

SEQ ID NO: 14057 - DNA, 18 bp, Homo sapiens
tgtgaggacgtgtcctgc

SEQ ID NO: 14058 - DNA, 106 bp, Little cherry virus
agtaccagcggattatactactcggcagagaatttatatgagatcaattgttaatcttttgggaattcctgtccgacgtattataaatgaaccctctgctgctgct

SEQ ID NO: 14059 - DNA, 24 bp, Little cherry virus
tatactactcggcagagaatttat

SEQ ID NO: 14060 - DNA, 19 bp, Homo sapiens
ctatgagggcagagaattt

SEQ ID NO: 14061 - DNA, 19 bp, Homo sapiens
tatacagcttggcagagaa

SEQ ID NO: 14062 - DNA, 22 bp, Homo sapiens
tatactagcatggggaatttat

SEQ ID NO: 14063 - DNA, 21 bp, Homo sapiens
tataccactagcagaatttat

SEQ ID NO: 14064 - DNA, 70 bp, Reston Ebola virus
gatgaagattaattgcggaggaatcaggaattcaactttagttccttaaggcctcgtccgaatcttcatc

SEQ ID NO: 14065 - DNA, 24 bp, Reston Ebola virus
ttccttaaggcctcgtccgaatct

SEQ ID NO: 14066 - DNA, 19 bp, Homo sapiens
ttcttcaaggccttctgtc

SEQ ID NO: 14067 - DNA, 22 bp, Homo sapiens
ttccctaaggtctggagagtct

SEQ ID NO: 14068 - DNA, 19 bp, Homo sapiens
ttccttaagattctgagtc

SEQ ID NO: 14069 - DNA, 18 bp, Homo sapiens
ttaaggccttgaaaatct

SEQ ID NO: 14070 - DNA, 21 bp, Homo sapiens
ttcctaaggccttgtgtatct

SEQ ID NO: 14071 - DNA, 22 bp, Homo sapiens
ttcctagggcctcgtcgatcct

SEQ ID NO: 14072 - DNA, 21 bp, Homo sapiens
ttccttaaaggcttccttcca

SEQ ID NO: 14073 - DNA, 100 bp, Reston Ebola virus
ttagcttctaaggtgattatattttagtattaaattttgctaattgcttgctataaagttgaaatgtctaatgcttaaatgaacacttttttgaagctga

SEQ ID NO: 14074 - DNA, 24 bp, Reston Ebola virus
taaggtgattatattttagtatta

SEQ ID NO: 14075 - DNA, 21 bp, Homo sapiens
aggtgattttattcttccatt

SEQ ID NO: 14076 - DNA, 22 bp, Homo sapiens
agcgagacatattttagtatta

SEQ ID NO: 14077 - DNA, 21 bp, Homo sapiens
taaggtgttatatatgtatta

SEQ ID NO: 14078 - DNA, 23 bp, Homo sapiens
tgagtgattatattagatcatta

SEQ ID NO: 14079 - DNA, 62 bp, Equine herpesvirus 4
gtctactagagccttgctgttaacggtatctgatacagcacccgtagacaacgaggcgggac

SEQ ID NO: 14080 - DNA, 24 bp, Equine herpesvirus 4
cacccgtagacaacgaggcgggac

SEQ ID NO: 14081 - DNA, 17 bp, Homo sapiens
cagccgagcgaggcggg

SEQ ID NO: 14082 - DNA, 19 bp, Homo sapiens
cacccgtagtggaaagggg

SEQ ID NO: 14083 - DNA, 21 bp, Homo sapiens
cccgcagatgacccgggggac

SEQ ID NO: 14084 - DNA, 18 bp, Homo sapiens
cacctgtgggagacggga

SEQ ID NO: 14085 - DNA, 23 bp, Homo sapiens
cacccgtagatgggaaggaggga

SEQ ID NO: 14086 - DNA, 24 bp, Homo sapiens
cacccggaggctcctcggcgggac

SEQ ID NO: 14087 - DNA, 20 bp, Homo sapiens
cccgaagacaggtgcgggac

SEQ ID NO: 14088 - DNA, 20 bp, Homo sapiens
cacccgtaggcagccagggc

SEQ ID NO: 14089 - DNA, 17 bp, Homo sapiens
ccctggaacaggcggga

SEQ ID NO: 14090 - DNA, 20 bp, Homo sapiens
cactgcacacggggcgggac

SEQ ID NO: 14091 - DNA, 20 bp, Homo sapiens
cgccccaggcggggcgggac

SEQ ID NO: 14092 - DNA, 19 bp, Homo sapiens
cctcgtggataacgggaag

SEQ ID NO: 14093 - DNA, 17 bp, Homo sapiens
cccctacagaggcggga

SEQ ID NO: 14094 - DNA, 21 bp, Homo sapiens
cactcttaggctaggcgggac

SEQ ID NO: 14095 - DNA, 19 bp, Homo sapiens
cactcgtgcatgagacagg

SEQ ID NO: 14096 - DNA, 17 bp, Homo sapiens
cacctgtaggaggcggg

SEQ ID NO: 14097 - DNA, 16 bp, Homo sapiens
cccgtggacgaggcga

SEQ ID NO: 14098 - DNA, 16 bp, Homo sapiens
ccgtagacaatggcag

SEQ ID NO: 14099 - DNA, 16 bp, Homo sapiens
cccagagcgaggcggg

SEQ ID NO: 14100 - DNA, 20 bp, Homo sapiens
cacccgcgccgggaggcggg

SEQ ID NO: 14101 - DNA, 19 bp, Homo sapiens
cccttagaagacgggcggg

SEQ ID NO: 14102 - DNA, 24 bp, Homo sapiens
cccgtagatggaaaggggcgggac

SEQ ID NO: 14103 - DNA, 26 bp, Homo sapiens
cacccgcaggtagctaagcagcggga

SEQ ID NO: 14104 - DNA, 19 bp, Homo sapiens
cacctgtggacaaagcaga

SEQ ID NO: 14105 - DNA, 77 bp, Equine herpesvirus 4
gacgtatcagatttttacacccaaaccaactgcgtgcgcagcgtttattaaggacgcgggactgctactgaggcgtc

SEQ ID NO: 14106 - DNA, 24 bp, Equine herpesvirus 4
tatcagatttttacacccaaacca

SEQ ID NO: 14107 - DNA, 19 bp, Homo sapiens
tcagatctcccccaagcca

SEQ ID NO: 14108 - DNA, 22 bp, Homo sapiens
tatcagatttttttttccaaac

SEQ ID NO: 14109 - DNA, 16 bp, Homo sapiens
tagcagacacccaaac

SEQ ID NO: 14110 - DNA, 23 bp, Homo sapiens
cagattttgagtacttcaaacca

SEQ ID NO: 14111 - DNA, 22 bp, Homo sapiens
tatcagacttggaccctgtcca

SEQ ID NO: 14112 - DNA, 21 bp, Homo sapiens
tcagattttatacatgggcca

SEQ ID NO: 14113 - DNA, 17 bp, Homo sapiens
tcagccacacccaagcc

SEQ ID NO: 14114 - DNA, 19 bp, Homo sapiens
tcaggccccacccaaacca

SEQ ID NO: 14115 - DNA, 19 bp, Homo sapiens
tcggaaaacatccaaacca

SEQ ID NO: 14116 - DNA, 21 bp, Homo sapiens
tcacatgctccacccaaacca

SEQ ID NO: 14117 - DNA, 19 bp, Homo sapiens
agatttttgcacctttcca

SEQ ID NO: 14118 - DNA, 21 bp, Homo sapiens
tcagattttcatgccaaatca

SEQ ID NO: 14119 - DNA, 21 bp, Homo sapiens
tatcagatttttgaacagaca

SEQ ID NO: 14120 - DNA, 19 bp, Homo sapiens
taccaatatgcccaaacca

SEQ ID NO: 14121 - DNA, 23 bp, Homo sapiens
atcagacctacttgcacccaaac

SEQ ID NO: 14122 - DNA, 17 bp, Homo sapiens
tcagactcacccagacc

SEQ ID NO: 14123 - DNA, 61 bp, Chimpanzee cytomegalovirus
gacgttgtttgtagtgacggtggcgttccttttggttcgtttctgcgtcttaggtaacgtt

SEQ ID NO: 14124 - DNA, 24 bp, Chimpanzee cytomegalovirus
tttgtagtgacggtggcgttcctt

SEQ ID NO: 14125 - DNA, 23 bp, Homo sapiens
tttgtaatggtaataagttcctt

SEQ ID NO: 14126 - DNA, 21 bp, Homo sapiens
tttgtggtggtggtggcacct

SEQ ID NO: 14127 - DNA, 19 bp, Homo sapiens
tttgcagtggtgggccttc

SEQ ID NO: 14128 - DNA, 23 bp, Homo sapiens
tttgtagtaaacatgtgttcctt

SEQ ID NO: 14129 - DNA, 17 bp, Homo sapiens
tttgtagtggtggtgtt

SEQ ID NO: 14130 - DNA, 72 bp, Chimpanzee cytomegalovirus
ggggaacttgggcatgggggctacggtcacgttgttgaggatcagcggggcgtagtctgtgctattgtccct

SEQ ID NO: 14131 - DNA, 24 bp, Chimpanzee cytomegalovirus
gggcatgggggctacggtcacgtt

SEQ ID NO: 14132 - DNA, 21 bp, Homo sapiens
gagcccggctgcggtcacgtt

SEQ ID NO: 14133 - DNA, 18 bp, Homo sapiens
gggtgtgggggccacggt

SEQ ID NO: 14134 - DNA, 20 bp, Homo sapiens
gggtgtgggggctctggacc

SEQ ID NO: 14135 - DNA, 71 bp, Human foamy virus
ctccacctctggaattcaggacctgcagactctgagtgagcttgttggccctgaaaatgccggagagggag

SEQ ID NO: 14136 - DNA, 24 bp, Human foamy virus
tcaggacctgcagactctgagtga

SEQ ID NO: 14137 - DNA, 24 bp, Homo sapiens
tcgggactgcagactcagacggtg

SEQ ID NO: 14138 - DNA, 17 bp, Homo sapiens
ggccagcagctgagtga

SEQ ID NO: 14139 - DNA, 20 bp, Homo sapiens
ggctgccagattctgagtga

SEQ ID NO: 14140 - DNA, 19 bp, Homo sapiens
tcagggcctggcccgagtg

SEQ ID NO: 14141 - DNA, 25 bp, Homo sapiens
tcaggacctcagactcctcagggtg

SEQ ID NO: 14142 - DNA, 17 bp, Homo sapiens
tcaggacctcagactcc

SEQ ID NO: 14143 - DNA, 19 bp, Homo sapiens
caggatctagatctgagtg

SEQ ID NO: 14144 - DNA, 20 bp, Homo sapiens
tcagggcctgcagaagggtg

SEQ ID NO: 14145 - DNA, 18 bp, Homo sapiens
ccaggacctgcagaggtg

SEQ ID NO: 14146 - DNA, 20 bp, Homo sapiens
ccaggacctgcaggggggtg

SEQ ID NO: 14147 - DNA, 19 bp, Homo sapiens
tcagggcctgcagatgcgc

SEQ ID NO: 14148 - DNA, 18 bp, Homo sapiens
tcgggacctgctgcggtg

SEQ ID NO: 14149 - DNA, 25 bp, Homo sapiens
caggacctcagccaggctctgggtg

SEQ ID NO: 14150 - DNA, 16 bp, Homo sapiens
ggaccctctctgagtg

SEQ ID NO: 14151 - DNA, 21 bp, Homo sapiens
tcaggacctggaggcctggtg

SEQ ID NO: 14152 - DNA, 19 bp, Homo sapiens
tcaggaccttcagtgagtg

SEQ ID NO: 14153 - DNA, 22 bp, Homo sapiens
caggactggggactctgagtga

SEQ ID NO: 14154 - DNA, 19 bp, Homo sapiens
caggcccgggctctgagtg

SEQ ID NO: 14155 - DNA, 22 bp, Homo sapiens
tcaggaccggcggctggggtga

SEQ ID NO: 14156 - DNA, 21 bp, Homo sapiens
tcaggacaaacctctgagtga

SEQ ID NO: 14157 - DNA, 16 bp, Homo sapiens
gggcctgcagagagtg

SEQ ID NO: 14158 - DNA, 21 bp, Homo sapiens
tcagggcctgcaaactcaaag

SEQ ID NO: 14159 - DNA, 19 bp, Homo sapiens
tcagagcctgctctgagtg

SEQ ID NO: 14160 - DNA, 21 bp, Homo sapiens
tcaggacctgggacggtgtga

SEQ ID NO: 14161 - DNA, 20 bp, Homo sapiens
ccaggaggagactctgggtg

SEQ ID NO: 14162 - DNA, 19 bp, Homo sapiens
tcaggacctgggtccagtg

SEQ ID NO: 14163 - DNA, 18 bp, Homo sapiens
ccaggacctgcagcggtg

SEQ ID NO: 14164 - DNA, 17 bp, Homo sapiens
agcgacttgcctgagtg

SEQ ID NO: 14165 - DNA, 18 bp, Homo sapiens
agacctgcagttggggtg

SEQ ID NO: 14166 - DNA, 20 bp, Homo sapiens
ggatttggagcttctgagtg

SEQ ID NO: 14167 - DNA, 18 bp, Homo sapiens
tcaggacctgcagaactg

SEQ ID NO: 14168 - DNA, 20 bp, Homo sapiens
tgagacccagactctgagtg

SEQ ID NO: 14169 - DNA, 16 bp, Homo sapiens
ccaggaccctctgggt

SEQ ID NO: 14170 - DNA, 62 bp, Bovine adenovirus D
atttcagtctaaatgctaaatcaacagaatcaagttctgtaaatggagtatttatctgagat

SEQ ID NO: 14171 - DNA, 24 bp, Bovine adenovirus D
tgtaaatggagtatttatctgaga

SEQ ID NO: 14172 - DNA, 19 bp, Homo sapiens
tgcaaatggggaatctgag

SEQ ID NO: 14173 - DNA, 20 bp, Homo sapiens
tgtaaatggagggaggtgag

SEQ ID NO: 14174 - DNA, 21 bp, Homo sapiens
tgtaagaggccatatctgaga

SEQ ID NO: 14175 - DNA, 19 bp, Homo sapiens
tgcaaatggaatatttgag

SEQ ID NO: 14176 - DNA, 18 bp, Homo sapiens
tataaatgggaatctgag

SEQ ID NO: 14177 - DNA, 20 bp, Homo sapiens
gtaaatggggtgaaatgaga

SEQ ID NO: 14178 - DNA, 21 bp, Homo sapiens
gtagatggagggtatctgaga

SEQ ID NO: 14179 - DNA, 17 bp, Homo sapiens
gtagatgggcatctgag

SEQ ID NO: 14180 - DNA, 21 bp, Homo sapiens
tgaaatggagtattggccaga

SEQ ID NO: 14181 - DNA, 22 bp, Homo sapiens
tgtaaatgtactgtatttgaga

SEQ ID NO: 14182 - DNA, 22 bp, Homo sapiens
tgtaatggagctcagttttgag

SEQ ID NO: 14183 - DNA, 17 bp, Homo sapiens
tgtaaatagattatctg

SEQ ID NO: 14184 - DNA, 21 bp, Homo sapiens
tgtaaatggaatgtgtggaga

SEQ ID NO: 14185 - DNA, 76 bp, Bovine adenovirus D
cagccacttatgaattaattcttctgatagctcatttcggttataatatccaattaataattcaaaaaagtctctg

SEQ ID NO: 14186 - DNA, 24 bp, Bovine adenovirus D
tgaattaattcttctgatagctca

SEQ ID NO: 14187 - DNA, 19 bp, Homo sapiens
aattaattcttccatctca

SEQ ID NO: 14188 - DNA, 22 bp, Homo sapiens
tgaataattctttaacatctca

SEQ ID NO: 14189 - DNA, 18 bp, Homo sapiens
tgagttaattctttagac

SEQ ID NO: 14190 - DNA, 20 bp, Homo sapiens
gaatgattcttctactctca

SEQ ID NO: 14191 - DNA, 22 bp, Homo sapiens
taaattaatactcttgatagct

SEQ ID NO: 14192 - DNA, 18 bp, Homo sapiens
tgcattaattcttcactc

SEQ ID NO: 14193 - DNA, 17 bp, Homo sapiens
ttaattctatgatagct

SEQ ID NO: 14194 - DNA, 21 bp, Homo sapiens
tgaagtgattcttctgcctca

SEQ ID NO: 14195 - DNA, 20 bp, Homo sapiens
tgaatgaatgaatctgatag

SEQ ID NO: 14196 - DNA, 17 bp, Homo sapiens
tgaataattcttcaaac

SEQ ID NO: 14197 - DNA, 83 bp, Human foamy virus
cattcagttttataagaattatcagattctaacttgctgtcaggctgtagacccatttgctaatatttttcatggtactgatg

SEQ ID NO: 14198 - DNA, 24 bp, Human foamy virus
tataagaattatcagattctaact

SEQ ID NO: 14199 - DNA, 18 bp, Homo sapiens
taagaatccagcattcta

SEQ ID NO: 14200 - DNA, 19 bp, Homo sapiens
taagaattgccatgtctaa

SEQ ID NO: 14201 - DNA, 20 bp, Homo sapiens
tataagaattaacagaccct

SEQ ID NO: 14202 - DNA, 20 bp, Homo sapiens
tataggagttagcagattct

SEQ ID NO: 14203 - DNA, 21 bp, Homo sapiens
cataagaattatgatctaact

SEQ ID NO: 14204 - DNA, 24 bp, Homo sapiens
taaagaattatgtttagtctaact

SEQ ID NO: 14205 - DNA, 20 bp, Homo sapiens
tataagaattaacaggccct

SEQ ID NO: 14206 - DNA, 21 bp, Homo sapiens
cataggaattatcagcactaa

SEQ ID NO: 14207 - DNA, 20 bp, Homo sapiens
tataagaattaacagatcct

SEQ ID NO: 14208 - DNA, 78 bp, Human foamy virus
gtgtgtcttatcatgcatataaagaaattgaggacaaacatcctcaacatattaaactgcaggattggatccccacac

SEQ ID NO: 14209 - DNA, 24 bp, Human foamy virus
tcaacatattaaactgcaggattg

SEQ ID NO: 14210 - DNA, 19 bp, Homo sapiens
acatattaaacgtgaattg

SEQ ID NO: 14211 - DNA, 18 bp, Homo sapiens
acatattaaacatgattg

SEQ ID NO: 14212 - DNA, 24 bp, Homo sapiens
tcagcatattaagctgcacaattg

SEQ ID NO: 14213 - DNA, 20 bp, Homo sapiens
taataaactatgcaggattg

SEQ ID NO: 14214 - DNA, 20 bp, Homo sapiens
acatttagagaacaggattg

SEQ ID NO: 14215 - DNA, 64 bp, Bovine adenovirus D
aagttaaaactgttgctagatcttttaatgagatattataatcatttctaggtagttccaattt

SEQ ID NO: 14216 - DNA, 24 bp, Bovine adenovirus D
tgctagatcttttaatgagatatt

SEQ ID NO: 14217 - DNA, 17 bp, Homo sapiens
tgctagatttttatgag

SEQ ID NO: 14218 - DNA, 18 bp, Homo sapiens
gctggatcttttggtgag

SEQ ID NO: 14219 - DNA, 19 bp, Homo sapiens
tgctaaattttttaatgag

SEQ ID NO: 14220 - DNA, 15 bp, Homo sapiens
tgctagacttaagag

SEQ ID NO: 14221 - DNA, 18 bp, Homo sapiens
gctttttaatgagatatt

SEQ ID NO: 14222 - DNA, 18 bp, Homo sapiens
ctagatcttggaggatat

SEQ ID NO: 14223 - DNA, 101 bp, Human herpesvirus 1
gccagcatttcctcgtggcgaaccgatacctcgagacccggtcgatttcacccatcgactggtcggtttgaaaggcatcgacgtccggggtttttgtcggt

SEQ ID NO: 14224 - DNA, 24 bp, Human herpesvirus 1
ttcctcgtggcgaaccgatacctc

SEQ ID NO: 14225 - DNA, 20 bp, Homo sapiens
ttcctcgtgtaagaatgcct

SEQ ID NO: 14226 - DNA, 21 bp, Homo sapiens
ttcttcagtggtaaatacctc

SEQ ID NO: 14227 - DNA, 19 bp, Homo sapiens
ttcatcatgaccgatacct

SEQ ID NO: 14228 - DNA, 19 bp, Homo sapiens
cctcataaactgatacctc

SEQ ID NO: 14229 - DNA, 60 bp, Mouse mammary tumor virus
cccattagagttctgacaaatcaaaccatgtatttgggtggttcgcctgactttcatggg

SEQ ID NO: 14230 - DNA, 24 bp, Mouse mammary tumor virus
ttagagttctgacaaatcaaacca

SEQ ID NO: 14231 - DNA, 20 bp, Homo sapiens
gagctctgagccctaaacca

SEQ ID NO: 14232 - DNA, 18 bp, Homo sapiens
ttagggtcctgacgatca

SEQ ID NO: 14233 - DNA, 19 bp, Homo sapiens
ttagagtctgatagcatca

SEQ ID NO: 14234 - DNA, 23 bp, Homo sapiens
ttaaagttttctccctcaaacca

SEQ ID NO: 14235 - DNA, 17 bp, Homo sapiens
gagccgagatcaaacca

SEQ ID NO: 14236 - DNA, 21 bp, Homo sapiens
ttaaagttttgaaacaaatca

SEQ ID NO: 14237 - DNA, 21 bp, Homo sapiens
cagtgaactgagatcaaacca

SEQ ID NO: 14238 - DNA, 18 bp, Homo sapiens
ttaaagttctgatgacca

SEQ ID NO: 14239 - DNA, 16 bp, Homo sapiens
ttaggttctgacccaa

SEQ ID NO: 14240 - DNA, 19 bp, Homo sapiens
ttagagtttatgacactca

SEQ ID NO: 14241 - DNA, 19 bp, Homo sapiens
gagcaggtctgaatcaaac

SEQ ID NO: 14242 - DNA, 18 bp, Homo sapiens
ttagagttggaaaatcaa

SEQ ID NO: 14243 - DNA, 17 bp, Homo sapiens
ttagagttctaaaatca

SEQ ID NO: 14244 - DNA, 22 bp, Homo sapiens
ttaaagttctactattagacca

SEQ ID NO: 14245 - DNA, 19 bp, Homo sapiens
gagttctgagccaaagtca

SEQ ID NO: 14246 - DNA, 17 bp, Homo sapiens
tagagttctgcagacca

SEQ ID NO: 14247 - DNA, 19 bp, Homo sapiens
ttagagtctccttaaatca

SEQ ID NO: 14248 - DNA, 19 bp, Homo sapiens
ttagagctcttcaagtcaa

SEQ ID NO: 14249 - DNA, 22 bp, Homo sapiens
ttagagttatgcccccaaatca

SEQ ID NO: 14250 - DNA, 16 bp, Homo sapiens
agcaacaaattaaacc

SEQ ID NO: 14251 - DNA, 73 bp, Human herpesvirus 1
gccgcctcccccgagtcttcggaatgtcttggcggccgtcaagaactgttatcccgaggcacggatgagcggc

SEQ ID NO: 14252 - DNA, 24 bp, Human herpesvirus 1
caagaactgttatcccgaggcacg

SEQ ID NO: 14253 - DNA, 19 bp, Homo sapiens
tgagaactgttttcaccaa

SEQ ID NO: 14254 - DNA, 18 bp, Homo sapiens
caagaacagcctctgagg

SEQ ID NO: 14255 - DNA, 18 bp, Homo sapiens
aagaattgttatccatag

SEQ ID NO: 14256 - DNA, 17 bp, Homo sapiens
caagaactgagaggccg

SEQ ID NO: 14257 - DNA, 23 bp, Homo sapiens
tgagaaatgttatcctttctaca

SEQ ID NO: 14258 - DNA, 19 bp, Homo sapiens
agaactctagcccgaggca

SEQ ID NO: 14259 - DNA, 22 bp, Homo sapiens
caagaactgttgattgaaagac

SEQ ID NO: 14260 - DNA, 20 bp, Homo sapiens
caggaactgttctctctgca

SEQ ID NO: 14261 - DNA, 22 bp, Homo sapiens
cgaggaccgcccccgaggcgcg

SEQ ID NO: 14262 - DNA, 21 bp, Homo sapiens
agaaatccgtcccgaggcgcg

SEQ ID NO: 14263 - DNA, 63 bp, Human herpesvirus 1
gtgctgccgccgcgggaggatgtgttttcgtggactcgttattgcacccccgacgaggtgcgc

SEQ ID NO: 14264 - DNA, 24 bp, Human herpesvirus 1
ttattgcacccccgacgaggtgcg

SEQ ID NO: 14265 - DNA, 19 bp, Homo sapiens
ttgcacccagtaaggtgcg

SEQ ID NO: 14266 - DNA, 66 bp, Mouse mammary tumor virus
ctacatctgcctgtgttacttacccttatgccatattattaggattacctcagttaatagatatag

SEQ ID NO: 14267 - DNA, 21 bp, Mouse mammary tumor virus
tacctcagttaatagatatag

SEQ ID NO: 14268 - DNA, 17 bp, Homo sapiens
cccctgaatagatatag

SEQ ID NO: 14269 - DNA, 17 bp, Homo sapiens
tacctagttaataaata

SEQ ID NO: 14270 - DNA, 15 bp, Homo sapiens
ctcaaatagatatag

SEQ ID NO: 14271 - DNA, 20 bp, Homo sapiens
cctcagttgattaaacatag

SEQ ID NO: 14272 - DNA, 18 bp, Homo sapiens
ctcagtcaatttacatag

SEQ ID NO: 14273 - DNA, 17 bp, Homo sapiens
cctcagctgaggtatag

SEQ ID NO: 14274 - DNA, 15 bp, Homo sapiens
tacccaacagatata

SEQ ID NO: 14275 - DNA, 18 bp, Homo sapiens
ctagcataatagatatag

SEQ ID NO: 14276 - DNA, 18 bp, Homo sapiens
ctcttttactagatatag

SEQ ID NO: 14277 - DNA, 18 bp, Homo sapiens
taccttggtaatagatat

SEQ ID NO: 14278 - DNA, 130 bp, Equine herpesvirus 4
gaggccacacccacatggaggccacacccacatggaggccacacccacatggaggccacacccacatggaggccacacccacatggaggccacacccacatggaggccacacccacatggaggccacacc

SEQ ID NO: 14279 - DNA, 24 bp, Equine herpesvirus 4
aggccacacccacatggaggccac

SEQ ID NO: 14280 - DNA, 20 bp, Homo sapiens
ggccgttgtcccgaggccac

SEQ ID NO: 14281 - DNA, 17 bp, Homo sapiens
ggccacacccggtgcca

SEQ ID NO: 14282 - DNA, 18 bp, Homo sapiens
ggccacacttgcatggag

SEQ ID NO: 14283 - DNA, 19 bp, Homo sapiens
aggctgcagtccaccaggg

SEQ ID NO: 14284 - DNA, 22 bp, Homo sapiens
aggccagttcacacagagtcac

SEQ ID NO: 14285 - DNA, 16 bp, Homo sapiens
ggccacgacggaggcc

SEQ ID NO: 14286 - DNA, 21 bp, Homo sapiens
ggccccacccacagcagctgc

SEQ ID NO: 14287 - DNA, 20 bp, Homo sapiens
agatcacacccacccggggc

SEQ ID NO: 14288 - DNA, 20 bp, Homo sapiens
agccacacccgggcggccac

SEQ ID NO: 14289 - DNA, 21 bp, Homo sapiens
agctgcacagttcggaggcca

SEQ ID NO: 14290 - DNA, 22 bp, Homo sapiens
aggcctcacccacaacctccca

SEQ ID NO: 14291 - DNA, 19 bp, Homo sapiens
aggccacacccagtgaggc

SEQ ID NO: 14292 - DNA, 21 bp, Homo sapiens
aggtcacacccacagtgatgc

SEQ ID NO: 14293 - DNA, 18 bp, Homo sapiens
aggccagcctgggggcca

SEQ ID NO: 14294 - DNA, 18 bp, Homo sapiens
aggccacatcctcatgcc

SEQ ID NO: 14295 - DNA, 18 bp, Homo sapiens
ggccacacccagtgcaga

SEQ ID NO: 14296 - DNA, 22 bp, Homo sapiens
ggccacggtcacacaaagccac

SEQ ID NO: 14297 - DNA, 18 bp, Homo sapiens
agggcacacccatgctca

SEQ ID NO: 14298 - DNA, 23 bp, Homo sapiens
aggtctcatctcctagaggccac

SEQ ID NO: 14299 - DNA, 18 bp, Homo sapiens
aggccacaccatcagcca

SEQ ID NO: 14300 - DNA, 19 bp, Homo sapiens
ggccacaccaacacagcca

SEQ ID NO: 14301 - DNA, 21 bp, Homo sapiens
aggccacacccatgtgactgc

SEQ ID NO: 14302 - DNA, 20 bp, Homo sapiens
ggccacactcggcagtccca

SEQ ID NO: 14303 - DNA, 21 bp, Homo sapiens
aggccacacctggacaatcac

SEQ ID NO: 14304 - DNA, 23 bp, Homo sapiens
agccacacctgggtgcaggccac

SEQ ID NO: 14305 - DNA, 18 bp, Homo sapiens
agaccacacccatgtggc

SEQ ID NO: 14306 - DNA, 18 bp, Homo sapiens
aggccccacccacaccca

SEQ ID NO: 14307 - DNA, 19 bp, Homo sapiens
gccacacccatgtgcccac

SEQ ID NO: 14308 - DNA, 21 bp, Homo sapiens
aggctgagctcataaggccac

SEQ ID NO: 14309 - DNA, 18 bp, Homo sapiens
aagccacacccatgaggc

SEQ ID NO: 14310 - DNA, 20 bp, Homo sapiens
aggacacacagaggaggtca

SEQ ID NO: 14311 - DNA, 17 bp, Homo sapiens
ggccggccaggaggcca

SEQ ID NO: 14312 - DNA, 21 bp, Homo sapiens
ggcccacacccatgaattcac

SEQ ID NO: 14313 - DNA, 21 bp, Homo sapiens
ggtcactacccacgaggccac

SEQ ID NO: 14314 - DNA, 19 bp, Homo sapiens
aggccagtgccctgggcca

SEQ ID NO: 14315 - DNA, 26 bp, Homo sapiens
ggccacaccctcgctatgtggcctcc

SEQ ID NO: 14316 - DNA, 19 bp, Homo sapiens
ggccacaccccatgcctgc

SEQ ID NO: 14317 - DNA, 23 bp, Homo sapiens
ggccacacgcagcttcggaggcc

SEQ ID NO: 14318 - DNA, 21 bp, Homo sapiens
ggccacacatgccatggccac

SEQ ID NO: 14319 - DNA, 27 bp, Homo sapiens
aggccatttctacaccatgtggcctcc

SEQ ID NO: 14320 - DNA, 20 bp, Homo sapiens
ggctgaactcgtgaagccac

SEQ ID NO: 14321 - DNA, 25 bp, Homo sapiens
agccacagaggcctatgggggccac

SEQ ID NO: 14322 - DNA, 20 bp, Homo sapiens
ggccacacgctggcggtcac

SEQ ID NO: 14323 - DNA, 18 bp, Homo sapiens
ggcctgcacccacagacc

SEQ ID NO: 14324 - DNA, 17 bp, Homo sapiens
ggccacacccgtgtggc

SEQ ID NO: 14325 - DNA, 15 bp, Homo sapiens
agccacacccacggc

SEQ ID NO: 14326 - DNA, 18 bp, Homo sapiens
ggccacatccacgggggc

SEQ ID NO: 14327 - DNA, 19 bp, Homo sapiens
aggccagacctgcagcacc

SEQ ID NO: 14328 - DNA, 21 bp, Homo sapiens
ggttgccctgcatgaagccac

SEQ ID NO: 14329 - DNA, 20 bp, Homo sapiens
ggccacacccaaggaggcca

SEQ ID NO: 14330 - DNA, 28 bp, Homo sapiens
ggccacacccacaactgtgtggcctcca

SEQ ID NO: 14331 - DNA, 19 bp, Homo sapiens
aggtcgccccacatggaag

SEQ ID NO: 14332 - DNA, 22 bp, Homo sapiens
ggacacacccaccggcggtcac

SEQ ID NO: 14333 - DNA, 22 bp, Homo sapiens
aggtccataccacggaggccac

SEQ ID NO: 14334 - DNA, 22 bp, Homo sapiens
aggtccataccacagaggccac

SEQ ID NO: 14335 - DNA, 19 bp, Homo sapiens
aggtcatacccacacgcag

SEQ ID NO: 14336 - DNA, 27 bp, Homo sapiens
aagccacgcccgtattgtgtggcctcc

SEQ ID NO: 14337 - DNA, 23 bp, Homo sapiens
agatcatacttacatgaaagggc

SEQ ID NO: 14338 - DNA, 19 bp, Homo sapiens
aggccacacacgcgccggc

SEQ ID NO: 14339 - DNA, 18 bp, Homo sapiens
aggcccacactggaggcc

SEQ ID NO: 14340 - DNA, 21 bp, Homo sapiens
aggccacaccaggctggaggc

SEQ ID NO: 14341 - DNA, 21 bp, Homo sapiens
aggcgtgcccatgaaggctac

SEQ ID NO: 14342 - DNA, 21 bp, Homo sapiens
aggccacagcctgcactctgc

SEQ ID NO: 14343 - DNA, 17 bp, Homo sapiens
aggccacatccctggag

SEQ ID NO: 14344 - DNA, 23 bp, Homo sapiens
cctagcacccacatggaggccac

SEQ ID NO: 14345 - DNA, 22 bp, Homo sapiens
aggctgccccctgagaggccac

SEQ ID NO: 14346 - DNA, 21 bp, Homo sapiens
ggcacacccacgatgtgctgc

SEQ ID NO: 14347 - DNA, 19 bp, Homo sapiens
aagccgcccatggaggcca

SEQ ID NO: 14348 - DNA, 18 bp, Homo sapiens
aggccaggcccaggtggc

SEQ ID NO: 14349 - DNA, 18 bp, Homo sapiens
aggctccatccacatgga

SEQ ID NO: 14350 - DNA, 20 bp, Homo sapiens
ggctccggactgtggaggcc

SEQ ID NO: 14351 - DNA, 16 bp, Homo sapiens
gacccacacatggagg

SEQ ID NO: 14352 - DNA, 21 bp, Homo sapiens
aggtcacgcacacagagccac

SEQ ID NO: 14353 - DNA, 24 bp, Homo sapiens
agaccgcacccacaggtctgccac

SEQ ID NO: 14354 - DNA, 22 bp, Homo sapiens
aggtcacacccataattgttgc

SEQ ID NO: 14355 - DNA, 16 bp, Homo sapiens
ggctcacacccacgcc

SEQ ID NO: 14356 - DNA, 15 bp, Homo sapiens
aggccacaccaggcc

SEQ ID NO: 14357 - DNA, 19 bp, Homo sapiens
aggccagccagagaggtca

SEQ ID NO: 14358 - DNA, 24 bp, Homo sapiens
aggcatgcactcacgggaggccac

SEQ ID NO: 14359 - DNA, 22 bp, Homo sapiens
aggccgcagcctgcataggcca

SEQ ID NO: 14360 - DNA, 24 bp, Homo sapiens
aggctgaatccagggtgaggccac

SEQ ID NO: 14361 - DNA, 19 bp, Homo sapiens
aggccacacccacctggcc

SEQ ID NO: 14362 - DNA, 23 bp, Homo sapiens
aggccacactccttccaagccac

SEQ ID NO: 14363 - DNA, 18 bp, Homo sapiens
agccatatccacagaagc

SEQ ID NO: 14364 - DNA, 28 bp, Homo sapiens
ggccacacccatgactgtgtggcctcca

SEQ ID NO: 14365 - DNA, 21 bp, Homo sapiens
aggccacattcagacatttgc

SEQ ID NO: 14366 - DNA, 16 bp, Homo sapiens
aggtcacacccaaacc

SEQ ID NO: 14367 - DNA, 19 bp, Homo sapiens
ggctacgtctggaggccac

SEQ ID NO: 14368 - DNA, 22 bp, Homo sapiens
agctgcacccacagaactgggc

SEQ ID NO: 14369 - DNA, 20 bp, Homo sapiens
aagccacaccttcaggtcac

SEQ ID NO: 14370 - DNA, 21 bp, Homo sapiens
aggccacgatccgggcgggcc

SEQ ID NO: 14371 - DNA, 18 bp, Homo sapiens
aggttacacccactgagc

SEQ ID NO: 14372 - DNA, 22 bp, Homo sapiens
aggctgcactcaatcatgggcc

SEQ ID NO: 14373 - DNA, 20 bp, Homo sapiens
aggccacatcagcaaggggg

SEQ ID NO: 14374 - DNA, 15 bp, Homo sapiens
aggccacacccagcc

SEQ ID NO: 14375 - DNA, 15 bp, Homo sapiens
agccacacccgccac

SEQ ID NO: 14376 - DNA, 15 bp, Homo sapiens
agccacacccaggcc

SEQ ID NO: 14377 - DNA, 25 bp, Homo sapiens
ggccacacctgctgctccgagtcac

SEQ ID NO: 14378 - DNA, 24 bp, Homo sapiens
aggcaacatttgttaaaaggccac

SEQ ID NO: 14379 - DNA, 23 bp, Homo sapiens
aggccacagcacgctggggccac

SEQ ID NO: 14380 - DNA, 27 bp, Homo sapiens
aggtcacacccaatctgcgtggcctcc

SEQ ID NO: 14381 - DNA, 18 bp, Homo sapiens
aagccacactcatgacca

SEQ ID NO: 14382 - DNA, 20 bp, Homo sapiens
agtcacactcatacaagcca

SEQ ID NO: 14383 - DNA, 22 bp, Homo sapiens
aggacacaaatgtggaggccac

SEQ ID NO: 14384 - DNA, 18 bp, Homo sapiens
aggccacgtcatatgagg

SEQ ID NO: 14385 - DNA, 17 bp, Homo sapiens
ggccacacccgcgggcc

SEQ ID NO: 14386 - DNA, 23 bp, Homo sapiens
agaccccactgtatggaggctac

SEQ ID NO: 14387 - DNA, 18 bp, Homo sapiens
ggctgcacccacagggaa

SEQ ID NO: 14388 - DNA, 19 bp, Homo sapiens
aggccacatccacggtggc

SEQ ID NO: 14389 - DNA, 19 bp, Homo sapiens
aggtcacacccgtgggtac

SEQ ID NO: 14390 - DNA, 16 bp, Homo sapiens
agccacacccacgacc

SEQ ID NO: 14391 - DNA, 19 bp, Homo sapiens
ggccacatccacatgaaga

SEQ ID NO: 14392 - DNA, 21 bp, Homo sapiens
gactgcatccacacaagctac

SEQ ID NO: 14393 - DNA, 20 bp, Homo sapiens
ggccacactcactcggccac

SEQ ID NO: 14394 - DNA, 16 bp, Homo sapiens
aggccacacctgggcc

SEQ ID NO: 14395 - DNA, 23 bp, Homo sapiens
ggctgcacccacagacataccac

SEQ ID NO: 14396 - DNA, 17 bp, Homo sapiens
ggccacactccagccca

SEQ ID NO: 14397 - DNA, 18 bp, Homo sapiens
ggccacacctgatggaag

SEQ ID NO: 14398 - DNA, 21 bp, Homo sapiens
aggcctacccgcacgagtcgc

SEQ ID NO: 14399 - DNA, 19 bp, Homo sapiens
aagttacacccactgctgc

SEQ ID NO: 14400 - DNA, 19 bp, Homo sapiens
ggccacaccgtgcatggcc

SEQ ID NO: 14401 - DNA, 20 bp, Homo sapiens
ggccgcagtccatggaaggc

SEQ ID NO: 14402 - DNA, 24 bp, Homo sapiens
aggccacatccatcatctttccca

SEQ ID NO: 14403 - DNA, 20 bp, Homo sapiens
aggccaacccgctgggctgc

SEQ ID NO: 14404 - DNA, 24 bp, Homo sapiens
aggacacacccaggcggaggccac

SEQ ID NO: 14405 - DNA, 17 bp, Homo sapiens
agccacacctgcagccc

SEQ ID NO: 14406 - DNA, 20 bp, Homo sapiens
agggtgcacctccagaggcc

SEQ ID NO: 14407 - DNA, 19 bp, Homo sapiens
aggctcatgctggaggcca

SEQ ID NO: 14408 - DNA, 21 bp, Homo sapiens
aggccacatctttaaggccac

SEQ ID NO: 14409 - DNA, 18 bp, Homo sapiens
aggccactcccagggcca

SEQ ID NO: 14410 - DNA, 20 bp, Homo sapiens
aggccatgcgtagagggcca

SEQ ID NO: 14411 - DNA, 19 bp, Homo sapiens
agccacacccatgaactgc

SEQ ID NO: 14412 - DNA, 21 bp, Homo sapiens
agccacatccttgaaggtcac

SEQ ID NO: 14413 - DNA, 20 bp, Homo sapiens
aggccctgggatggaggcca

SEQ ID NO: 14414 - DNA, 21 bp, Homo sapiens
aggcagcatccacatggaggc

SEQ ID NO: 14415 - DNA, 22 bp, Homo sapiens
ggccgggtaagcaggaggccac

SEQ ID NO: 14416 - DNA, 20 bp, Homo sapiens
ggctccactcacgcagtcac

SEQ ID NO: 14417 - DNA, 16 bp, Homo sapiens
gccacacctgcaggcc

SEQ ID NO: 14418 - DNA, 22 bp, Homo sapiens
gggtgcacccacatgctttgag

SEQ ID NO: 14419 - DNA, 20 bp, Homo sapiens
aggccgggcctgtagaggcc

SEQ ID NO: 14420 - DNA, 15 bp, Homo sapiens
ggccacacactgggc

SEQ ID NO: 14421 - DNA, 23 bp, Homo sapiens
ggtagcacccaggccgaggccac

SEQ ID NO: 14422 - DNA, 16 bp, Homo sapiens
ggccacacctgcaggc

SEQ ID NO: 14423 - DNA, 19 bp, Homo sapiens
ggccagacccacacgctgc

SEQ ID NO: 14424 - DNA, 21 bp, Homo sapiens
aggccacagggggatggaggc

SEQ ID NO: 14425 - DNA, 18 bp, Homo sapiens
aggctgcactggaggcca

SEQ ID NO: 14426 - DNA, 23 bp, Homo sapiens
aggccacactgtggcccagccac

SEQ ID NO: 14427 - DNA, 16 bp, Homo sapiens
aggcacacccacaccc

SEQ ID NO: 14428 - DNA, 29 bp, Homo sapiens
aagccacattcacagttacgtggcctcca

SEQ ID NO: 14429 - DNA, 20 bp, Homo sapiens
aagccacacttggaacaggc

SEQ ID NO: 14430 - DNA, 21 bp, Homo sapiens
aggccacaccctggcagtcac

SEQ ID NO: 14431 - DNA, 62 bp, Equine herpesvirus 4
agtgcgggttacacagtgcgtgttacacaccgggtatacacaattgttcctgctcgttaact

SEQ ID NO: 14432 - DNA, 24 bp, Equine herpesvirus 4
tacacaattgttcctgctcgttaa

SEQ ID NO: 14433 - DNA, 21 bp, Homo sapiens
acaattgtccttgtatgctaa

SEQ ID NO: 14434 - DNA, 16 bp, Homo sapiens
caattcttccccatta

SEQ ID NO: 14435 - DNA, 17 bp, Homo sapiens
attgttccaacggttaa

SEQ ID NO: 14436 - DNA, 19 bp, Homo sapiens
aattgttcctctggtgtta

SEQ ID NO: 14437 - DNA, 67 bp, Equine herpesvirus 4
taagcttttcctttggagctcctccctaaatgccttggctatttagccttccgctcctgtctgctta

SEQ ID NO: 14438 - DNA, 24 bp, Equine herpesvirus 4
ttggagctcctccctaaatgcctt

SEQ ID NO: 14439 - DNA, 19 bp, Homo sapiens
ttggagcttttccacacct

SEQ ID NO: 14440 - DNA, 22 bp, Homo sapiens
ttggagcttttgccttatcctt

SEQ ID NO: 14441 - DNA, 21 bp, Homo sapiens
ttggagctgttcttgagcctt

SEQ ID NO: 14442 - DNA, 21 bp, Homo sapiens
agcctctttcctaaatgcctt

SEQ ID NO: 14443 - DNA, 19 bp, Homo sapiens
ttggagctgtcataaatgc

SEQ ID NO: 14444 - DNA, 18 bp, Homo sapiens
ctggggctcctccttccc

SEQ ID NO: 14445 - DNA, 21 bp, Homo sapiens
tcggggctccttcccctcctt

SEQ ID NO: 14446 - DNA, 19 bp, Homo sapiens
ttggggcttctccctcagc

SEQ ID NO: 14447 - DNA, 19 bp, Homo sapiens
ttgtggctcctgaatgcct

SEQ ID NO: 14448 - DNA, 19 bp, Homo sapiens
ttggagctccccttggcct

SEQ ID NO: 14449 - DNA, 24 bp, Homo sapiens
ctggagcttcgggtaaaatgcctt

SEQ ID NO: 14450 - DNA, 75 bp, Chimpanzee cytomegalovirus
gcaggaacttcatgatggacttcttggcgtcgctaccgcggtcgtgcttctccatcatctccaccatcttcttgc

SEQ ID NO: 14451 - DNA, 24 bp, Chimpanzee cytomegalovirus
tgatggacttcttggcgtcgctac

SEQ ID NO: 14452 - DNA, 24 bp, Homo sapiens
tggtgtgcttcttgacgacttgct

SEQ ID NO: 14453 - DNA, 22 bp, Homo sapiens
tggtggacttctaggcccctac

SEQ ID NO: 14454 - DNA, 21 bp, Homo sapiens
tgatggacttcctgagacacc

SEQ ID NO: 14455 - DNA, 20 bp, Homo sapiens
tggtgaatttcttggctcac

SEQ ID NO: 14456 - DNA, 18 bp, Homo sapiens
tgaggggcttcttggtgt

SEQ ID NO: 14457 - DNA, 20 bp, Homo sapiens
tgatgggttcttggcctcac

SEQ ID NO: 14458 - DNA, 20 bp, Homo sapiens
taatgggcttttagtgttac

SEQ ID NO: 14459 - DNA, 21 bp, Homo sapiens
gatggactttttatcagctgc

SEQ ID NO: 14460 - DNA, 19 bp, Homo sapiens
tgatggactacttggccta

SEQ ID NO: 14461 - DNA, 19 bp, Homo sapiens
tgatggactgctgtgttac

SEQ ID NO: 14462 - DNA, 21 bp, Homo sapiens
tgatgggcttcttggtgatgc

SEQ ID NO: 14463 - DNA, 18 bp, Homo sapiens
tgaggatttcttggcaca

SEQ ID NO: 14464 - DNA, 102 bp, Chimpanzee cytomegalovirus
agctgttggccaccagccggttgtcctccacgggcagcgcgcggaacggcgtcgcctcctgcgccttgcgcaccgcctcggtcaccggcaggtggtacagct

SEQ ID NO: 14465 - DNA, 24 bp, Chimpanzee cytomegalovirus
agccggttgtcctccacgggcagc

SEQ ID NO: 14466 - DNA, 21 bp, Homo sapiens
ccggttgctggcgcgggcggc

SEQ ID NO: 14467 - DNA, 24 bp, Homo sapiens
aactgaaaggcctctacgggcagc

SEQ ID NO: 14468 - DNA, 21 bp, Homo sapiens
agccagcctgtccatgggcag

SEQ ID NO: 14469 - DNA, 23 bp, Homo sapiens
gccctcgctcttccgcgggtagc

SEQ ID NO: 14470 - DNA, 21 bp, Homo sapiens
agcggttgtccttcttccagc

SEQ ID NO: 14471 - DNA, 19 bp, Homo sapiens
agctgtctcccgcgggcag

SEQ ID NO: 14472 - DNA, 20 bp, Homo sapiens
gcctgccctctgtgggcagc

SEQ ID NO: 14473 - DNA, 24 bp, Homo sapiens
agcaggtggaactctgtgggcagc

SEQ ID NO: 14474 - DNA, 26 bp, Homo sapiens
gctgcttgtccccagcctgtgggcag

SEQ ID NO: 14475 - DNA, 18 bp, Homo sapiens
agctgggtgtcctccagg

SEQ ID NO: 14476 - DNA, 22 bp, Homo sapiens
agccggttgtgcttaacatggc

SEQ ID NO: 14477 - DNA, 22 bp, Homo sapiens
agctggttatccactgggcggc

SEQ ID NO: 14478 - DNA, 22 bp, Homo sapiens
gctgccctagcttcatgggcag

SEQ ID NO: 14479 - DNA, 18 bp, Homo sapiens
gccaggttgtacgggcag

SEQ ID NO: 14480 - DNA, 24 bp, Homo sapiens
gcccgagccgttctccgtgggcag

SEQ ID NO: 14481 - DNA, 20 bp, Homo sapiens
agctggtttcctccacgagc

SEQ ID NO: 14482 - DNA, 20 bp, Homo sapiens
agctgttgtcctttcaaagc

SEQ ID NO: 14483 - DNA, 21 bp, Homo sapiens
agccaggactccgtgggcagc

SEQ ID NO: 14484 - DNA, 21 bp, Homo sapiens
ggttgtcctgcgttggggcag

SEQ ID NO: 14485 - DNA, 19 bp, Homo sapiens
agtcagttgtccttgacag

SEQ ID NO: 14486 - DNA, 21 bp, Homo sapiens
cagtcggtgatcacgggcagc

SEQ ID NO: 14487 - DNA, 18 bp, Homo sapiens
agccgcttgtcctccagc

SEQ ID NO: 14488 - DNA, 18 bp, Homo sapiens
ggccatctctacgggcag

SEQ ID NO: 14489 - DNA, 16 bp, Homo sapiens
agccggtgcacgggca

SEQ ID NO: 14490 - DNA, 20 bp, Homo sapiens
acctggtatctcacgggcag

SEQ ID NO: 14491 - DNA, 22 bp, Homo sapiens
agccggctgtcctcgtcatagc

SEQ ID NO: 14492 - DNA, 22 bp, Homo sapiens
agccggctgttaaaggggcagc

SEQ ID NO: 14493 - DNA, 22 bp, Homo sapiens
gcccggtccgaccgcgggcagc

SEQ ID NO: 14494 - DNA, 22 bp, Homo sapiens
ggtctgggaatccgcgggcagc

SEQ ID NO: 14495 - DNA, 24 bp, Homo sapiens
ggctgatctcaggctgcgggcagc

SEQ ID NO: 14496 - DNA, 18 bp, Homo sapiens
agcctgttgtcctctggc

SEQ ID NO: 14497 - DNA, 61 bp, Sesbania mosaic virus
agctcgcagcttgtttggcgacttgagagttaaacactctcgttgccctgctgctgaggct

SEQ ID NO: 14498 - DNA, 24 bp, Sesbania mosaic virus
tctcgttgccctgctgctgaggct

SEQ ID NO: 14499 - DNA, 24 bp, Homo sapiens
tctccactggctgttgctgaggct

SEQ ID NO: 14500 - DNA, 17 bp, Homo sapiens
tctcgttgactctaggg

SEQ ID NO: 14501 - DNA, 19 bp, Homo sapiens
tcgttgccttccagaggct

SEQ ID NO: 14502 - DNA, 19 bp, Homo sapiens
gctgggtgctgctggggct

SEQ ID NO: 14503 - DNA, 26 bp, Homo sapiens
tctccttgccctgcctggtgggggct

SEQ ID NO: 14504 - DNA, 17 bp, Homo sapiens
attgtgtgctgctgagg

SEQ ID NO: 14505 - DNA, 23 bp, Homo sapiens
tcgttgctcttgctgctggggct

SEQ ID NO: 14506 - DNA, 19 bp, Homo sapiens
tctcgttgctctctgcagc

SEQ ID NO: 14507 - DNA, 17 bp, Homo sapiens
cctcgtttttgctgagg

SEQ ID NO: 14508 - DNA, 22 bp, Homo sapiens
tccttgcctctaaactgaggct

SEQ ID NO: 14509 - DNA, 20 bp, Homo sapiens
tctcttgccctgctccttag

SEQ ID NO: 14510 - DNA, 64 bp, Sesbania mosaic virus
attgattgagcaactgcagccgggaataatgaagtctggatcttactgcacctcctcaaccaat

SEQ ID NO: 14511 - DNA, 21 bp, Sesbania mosaic virus
tactgcacctcctcaaccaat

SEQ ID NO: 14512 - DNA, 20 bp, Homo sapiens
ctgcaccccgggcagccaat

SEQ ID NO: 14513 - DNA, 17 bp, Homo sapiens
ctgcacctcttccccaa

SEQ ID NO: 14514 - DNA, 18 bp, Homo sapiens
tactgtacctcctcccca

SEQ ID NO: 14515 - DNA, 18 bp, Homo sapiens
ctgtgaccttcaaccaat

SEQ ID NO: 14516 - DNA, 22 bp, Homo sapiens
cactgcacccagccaggccaat

SEQ ID NO: 14517 - DNA, 21 bp, Homo sapiens
tactgaagagcctcaaccaat

SEQ ID NO: 14518 - DNA, 20 bp, Homo sapiens
tactggcattgccaaccaat

SEQ ID NO: 14519 - DNA, 19 bp, Homo sapiens
ctgcagctcctcaagggcc

SEQ ID NO: 14520 - DNA, 19 bp, Homo sapiens
tactgcactttcccctcaa

SEQ ID NO: 14521 - DNA, 20 bp, Homo sapiens
tactgcaccttaagaccaat

SEQ ID NO: 14522 - DNA, 19 bp, Homo sapiens
tactgcacctgcacctacc

SEQ ID NO: 14523 - DNA, 21 bp, Homo sapiens
tactgaacacagccaaccaat

SEQ ID NO: 14524 - DNA, 18 bp, Homo sapiens
actgcaccccatgccaat

SEQ ID NO: 14525 - DNA, 17 bp, Homo sapiens
tactgacttcccaacca

SEQ ID NO: 14526 - DNA, 17 bp, Homo sapiens
cactgcacctcttcccc

SEQ ID NO: 14527 - DNA, 77 bp, Sesbania mosaic virus
gccacgactcctgaaggcgacctatacgaggtagagttctgctcacacgttattagggctaacaggtgttggttggc

SEQ ID NO: 14528 - DNA, 24 bp, Sesbania mosaic virus
cacacgttattagggctaacaggt

SEQ ID NO: 14529 - DNA, 21 bp, Homo sapiens
cacggttattagggcagtggt

SEQ ID NO: 14530 - DNA, 22 bp, Homo sapiens
caggcaagcagggctggcaggt

SEQ ID NO: 14531 - DNA, 18 bp, Homo sapiens
acacttattaaaaacagg

SEQ ID NO: 14532 - DNA, 25 bp, Homo sapiens
acacgtcaggatatggctaacaggt

SEQ ID NO: 14533 - DNA, 16 bp, Homo sapiens
cagttattaggcaagg

SEQ ID NO: 14534 - DNA, 21 bp, Homo sapiens
cgggccccagggctggcaggt

SEQ ID NO: 14535 - DNA, 19 bp, Homo sapiens
gttatattagctaacaggt

SEQ ID NO: 14536 - DNA, 87 bp, Meleagrid herpesvirus 1
gccaggtggctagaatcccgcggacaacgtagctgctaacgactacaggcagctacgctcaccggagaaaatacgcccaagcctggc

SEQ ID NO: 14537 - DNA, 24 bp, Meleagrid herpesvirus 1
caccggagaaaatacgcccaagcc

SEQ ID NO: 14538 - DNA, 19 bp, Homo sapiens
cggagaaaagagacctaag

SEQ ID NO: 14539 - DNA, 19 bp, Homo sapiens
caccaggaggatcccaagc

SEQ ID NO: 14540 - DNA, 16 bp, Homo sapiens
ccggagaaccccgagc

SEQ ID NO: 14541 - DNA, 20 bp, Homo sapiens
caccggaaggatcacagagc

SEQ ID NO: 14542 - DNA, 21 bp, Homo sapiens
caacggggccatgcccaagcc

SEQ ID NO: 14543 - DNA, 19 bp, Homo sapiens
ccggagaaaccctcaagcc

SEQ ID NO: 14544 - DNA, 19 bp, Homo sapiens
cctggggcactgcccaagc

SEQ ID NO: 14545 - DNA, 16 bp, Homo sapiens
caccggaggcaccaag

SEQ ID NO: 14546 - DNA, 21 bp, Homo sapiens
cactggaaattgccccaagcc

SEQ ID NO: 14547 - DNA, 20 bp, Homo sapiens
caccagagaaaaaatacaag

SEQ ID NO: 14548 - DNA, 19 bp, Homo sapiens
ggagaccatagcccaagcc

SEQ ID NO: 14549 - DNA, 17 bp, Homo sapiens
ggagataaagcccaagc

SEQ ID NO: 14550 - DNA, 23 bp, Homo sapiens
cggagaaagtgtgggcagaagcc

SEQ ID NO: 14551 - DNA, 18 bp, Homo sapiens
ggagaaaataaccgagcc

SEQ ID NO: 14552 - DNA, 21 bp, Homo sapiens
ccggagggaggggcccaagcc

SEQ ID NO: 14553 - DNA, 17 bp, Homo sapiens
ccggagaaagcccgggc

SEQ ID NO: 14554 - DNA, 19 bp, Homo sapiens
ccgaggagccgcccaagcc

SEQ ID NO: 14555 - DNA, 22 bp, Homo sapiens
cggagaaagatgctcctgggcc

SEQ ID NO: 14556 - DNA, 27 bp, Homo sapiens
cactggagaaaaaaatataatcaagcc

SEQ ID NO: 14557 - DNA, 15 bp, Homo sapiens
ccggagaaagccaag

SEQ ID NO: 14558 - DNA, 22 bp, Homo sapiens
caccggaaagtagacctgggcc

SEQ ID NO: 14559 - DNA, 27 bp, Homo sapiens
caccgaaggggtccacatgcttaagcc

SEQ ID NO: 14560 - DNA, 21 bp, Homo sapiens
cactgggaaaggacacaccca

SEQ ID NO: 14561 - DNA, 22 bp, Homo sapiens
cactgaggaaatggcccaagcc

SEQ ID NO: 14562 - DNA, 18 bp, Homo sapiens
ggaaaaaatatactagcc

SEQ ID NO: 14563 - DNA, 19 bp, Homo sapiens
caccgaagacggtccaggc

SEQ ID NO: 14564 - DNA, 21 bp, Homo sapiens
gagaaaataataatgccgagc

SEQ ID NO: 14565 - DNA, 16 bp, Homo sapiens
ccggagaaggccaacc

SEQ ID NO: 14566 - DNA, 15 bp, Homo sapiens
cggagaagcccaagc

SEQ ID NO: 14567 - DNA, 23 bp, Homo sapiens
caccagaggaaattcggggagcc

SEQ ID NO: 14568 - DNA, 19 bp, Homo sapiens
caccggagagtttccaagc

SEQ ID NO: 14569 - DNA, 22 bp, Homo sapiens
cctggggatttgtgcccaagcc

SEQ ID NO: 14570 - DNA, 20 bp, Homo sapiens
aaagaaaatatgttcaagcc

SEQ ID NO: 14571 - DNA, 18 bp, Homo sapiens
ggagaaaacccacgggcc

SEQ ID NO: 14572 - DNA, 73 bp, Fowlpox virus
tacgatttaaatattatgtaactctgtatttattcgacactattaatctagtacatacagaatttctttcgta

SEQ ID NO: 14573 - DNA, 24 bp, Fowlpox virus
tagtacatacagaatttctttcgt

SEQ ID NO: 14574 - DNA, 21 bp, Homo sapiens
tagtacataagcatcttttgt

SEQ ID NO: 14575 - DNA, 16 bp, Homo sapiens
tgatacagtttctttc

SEQ ID NO: 14576 - DNA, 93 bp, Meleagrid herpesvirus 1
ctcgccctcttggtcggcgtctcattgccgggtactcgaatcctgcggattacatagctgttaatgaatacacacgcctacgcaccccgcgag

SEQ ID NO: 14577 - DNA, 24 bp, Meleagrid herpesvirus 1
tcttggtcggcgtctcattgccgg

SEQ ID NO: 14578 - DNA, 21 bp, Homo sapiens
tcctggccttctcattgctgg

SEQ ID NO: 14579 - DNA, 19 bp, Homo sapiens
tcctgggcttttattgccg

SEQ ID NO: 14580 - DNA, 23 bp, Homo sapiens
tcttggtttggatccattgccgg

SEQ ID NO: 14581 - DNA, 21 bp, Homo sapiens
tcttggtaggtgtgatgctgg

SEQ ID NO: 14582 - DNA, 78 bp, Meleagrid herpesvirus 1
tgggtgcctacgacctcatggacggcctagctgttaacgaatagacacacctcggcggtccataagaaagtatgccca

SEQ ID NO: 14583 - DNA, 24 bp, Meleagrid herpesvirus 1
cacacctcggcggtccataagaaa

SEQ ID NO: 14584 - DNA, 21 bp, Homo sapiens
cacagttcacatccataagaa

SEQ ID NO: 14585 - DNA, 17 bp, Homo sapiens
tcaacagccataagaaa

SEQ ID NO: 14586 - DNA, 23 bp, Homo sapiens
ctcattttttgtgccataagaaa

SEQ ID NO: 14587 - DNA, 24 bp, Homo sapiens
cacaccacaaaaatccatgagaaa

SEQ ID NO: 14588 - DNA, 20 bp, Homo sapiens
catctcggcgggtggagaaa

SEQ ID NO: 14589 - DNA, 20 bp, Homo sapiens
cccgagcggtccatgagaaa

SEQ ID NO: 14590 - DNA, 18 bp, Homo sapiens
acctcagcggtttacaaa

SEQ ID NO: 14591 - DNA, 19 bp, Homo sapiens
acctatttcctataagaaa

SEQ ID NO: 14592 - DNA, 22 bp, Homo sapiens
catatcatttcatccataagaa

SEQ ID NO: 14593 - DNA, 21 bp, Homo sapiens
caccttggaataaataagaaa

SEQ ID NO: 14594 - DNA, 17 bp, Homo sapiens
acaccccagcccataag

SEQ ID NO: 14595 - DNA, 21 bp, Homo sapiens
cacctcggccggtgccggaag

SEQ ID NO: 14596 - DNA, 26 bp, Homo sapiens
cacacctctgcggttcctactggaaa

SEQ ID NO: 14597 - DNA, 19 bp, Homo sapiens
ctctttggccactaagaaa

SEQ ID NO: 14598 - DNA, 21 bp, Homo sapiens
cacctccaggtttataagaaa

SEQ ID NO: 14599 - DNA, 17 bp, Homo sapiens
tcaactgtcataagaaa

SEQ ID NO: 14600 - DNA, 22 bp, Homo sapiens
acacctcggtgccagacataag

SEQ ID NO: 14601 - DNA, 23 bp, Homo sapiens
catctcttggcctcaataagaaa

SEQ ID NO: 14602 - DNA, 19 bp, Homo sapiens
cctttgcaatccatgggaa

SEQ ID NO: 14603 - DNA, 20 bp, Homo sapiens
acctcgaccgttgtgagaaa

SEQ ID NO: 14604 - DNA, 123 bp, Fowlpox virus
gattagatatctcttaaccccaatactcatctccttcaatgaaattatagctacgtctatctacagacgcacgaattacataacttaaacggaaagatagtgcggttactagatatccccatc

SEQ ID NO: 14605 - DNA, 24 bp, Fowlpox virus
aatgaaattatagctacgtctatc

SEQ ID NO: 14606 - DNA, 17 bp, Homo sapiens
atgcaattatagctcat

SEQ ID NO: 14607 - DNA, 19 bp, Homo sapiens
tgatatttagcacgtctat

SEQ ID NO: 14608 - DNA, 22 bp, Homo sapiens
taactataatagctatgtctat

SEQ ID NO: 14609 - DNA, 70 bp, Meleagrid herpesvirus 1
gcccgcccgtcgttacctcaatgtgatatttccagacttcttcaagctaggtcacgcgccaaggttcggc

SEQ ID NO: 14610 - DNA, 19 bp, Meleagrid herpesvirus 1
tcacgcgccaaggttcggc

SEQ ID NO: 14611 - DNA, 17 bp, Homo sapiens
ccgcgcgcccaggtggc

SEQ ID NO: 14612 - DNA, 16 bp, Homo sapiens
tcacacgcccagccgg

SEQ ID NO: 14613 - DNA, 19 bp, Homo sapiens
cgcgcagcaggggttcggc

SEQ ID NO: 14614 - DNA, 19 bp, Homo sapiens
ccacgcgccgcagctcggc

SEQ ID NO: 14615 - DNA, 16 bp, Homo sapiens
ccacgcgccaaaaggc

SEQ ID NO: 14616 - DNA, 16 bp, Homo sapiens
tcacgcgccgccccgc

SEQ ID NO: 14617 - DNA, 20 bp, Homo sapiens
ccacgcgctgtccccttggc

SEQ ID NO: 14618 - DNA, 16 bp, Homo sapiens
tcaccgccaaagaagc

SEQ ID NO: 14619 - DNA, 17 bp, Homo sapiens
tcacgttccagcccagc

SEQ ID NO: 14620 - DNA, 17 bp, Homo sapiens
tcccgcgccggcccggc

SEQ ID NO: 14621 - DNA, 20 bp, Homo sapiens
tcacgcgctcgagagttggc

SEQ ID NO: 14622 - DNA, 18 bp, Homo sapiens
tcccgtgccgaggttcag

SEQ ID NO: 14623 - DNA, 17 bp, Homo sapiens
tcaccgccatgagcggc

SEQ ID NO: 14624 - DNA, 16 bp, Homo sapiens
tcaccgctggttcagc

SEQ ID NO: 14625 - DNA, 16 bp, Homo sapiens
tcagcgctggcccagc

SEQ ID NO: 14626 - DNA, 15 bp, Homo sapiens
tcacacaggttcggc

SEQ ID NO: 14627 - DNA, 18 bp, Homo sapiens
tcatgcaccaaggctggc

SEQ ID NO: 14628 - DNA, 16 bp, Homo sapiens
tcaccgccggctcggc

SEQ ID NO: 14629 - DNA, 17 bp, Homo sapiens
tcacgcgccaacatggc

SEQ ID NO: 14630 - DNA, 21 bp, Homo sapiens
tcacgcgccggtctccacggc

SEQ ID NO: 14631 - DNA, 17 bp, Homo sapiens
tcacgggcccagctcgg

SEQ ID NO: 14632 - DNA, 17 bp, Homo sapiens
tcacgcaccggccgggc

SEQ ID NO: 14633 - DNA, 16 bp, Homo sapiens
tccgtgccaaagtggc

SEQ ID NO: 14634 - DNA, 17 bp, Homo sapiens
tcacgcgcctgtcccgc

SEQ ID NO: 14635 - DNA, 18 bp, Homo sapiens
ccacgcgcgcaggtttgg

SEQ ID NO: 14636 - DNA, 18 bp, Homo sapiens
tctcgtgccgaattcggc

SEQ ID NO: 14637 - DNA, 20 bp, Homo sapiens
ccacgcgccgcgggttcggc

SEQ ID NO: 14638 - DNA, 17 bp, Homo sapiens
tctcgcgccaaggcggc

SEQ ID NO: 14639 - DNA, 16 bp, Homo sapiens
tccgcgccagcccagc

SEQ ID NO: 14640 - DNA, 19 bp, Homo sapiens
tcacgcgcggcgcttcggc

SEQ ID NO: 14641 - DNA, 19 bp, Homo sapiens
tcacacgccggggcgtggc

SEQ ID NO: 14642 - DNA, 18 bp, Homo sapiens
ccacgcgctgaaggaggc

SEQ ID NO: 14643 - DNA, 18 bp, Homo sapiens
tcacgtgccaagactcgg

SEQ ID NO: 14644 - DNA, 17 bp, Homo sapiens
tcactgcgggattcggc

SEQ ID NO: 14645 - DNA, 19 bp, Homo sapiens
tcacagccctgggttcggc

SEQ ID NO: 14646 - DNA, 17 bp, Homo sapiens
tcacgcgccgcgccggc

SEQ ID NO: 14647 - DNA, 17 bp, Homo sapiens
tctcgtcgcggttcggc

SEQ ID NO: 14648 - DNA, 16 bp, Homo sapiens
tcacgcgcggcccggc

SEQ ID NO: 14649 - DNA, 19 bp, Homo sapiens
tcacgcgccagctccaggc

SEQ ID NO: 14650 - DNA, 16 bp, Homo sapiens
tcacgcgcctaggtgg

SEQ ID NO: 14651 - DNA, 18 bp, Homo sapiens
cacgcgccggcatgcggc

SEQ ID NO: 14652 - DNA, 67 bp, Equine herpesvirus 2
gaacaagagcctgctgtccctgatgttcggaccaatgacctaccagcaggtgacgcacctcaggttc

SEQ ID NO: 14653 - DNA, 24 bp, Equine herpesvirus 2
taccagcaggtgacgcacctcagg

SEQ ID NO: 14654 - DNA, 19 bp, Homo sapiens
gcaagtgaattgcctcagg

SEQ ID NO: 14655 - DNA, 15 bp, Homo sapiens
agcaggtgacgtcag

SEQ ID NO: 14656 - DNA, 20 bp, Homo sapiens
accagcaggtgactatcagg

SEQ ID NO: 14657 - DNA, 17 bp, Homo sapiens
ccaacagaacacttcag

SEQ ID NO: 14658 - DNA, 21 bp, Homo sapiens
ccagtgggcaccaacctcagg

SEQ ID NO: 14659 - DNA, 21 bp, Homo sapiens
actggtgggtcacatctcggg

SEQ ID NO: 14660 - DNA, 18 bp, Homo sapiens
cactaggtaaacctcagg

SEQ ID NO: 14661 - DNA, 23 bp, Homo sapiens
gctggcggagtgggcacctcagg

SEQ ID NO: 14662 - DNA, 21 bp, Homo sapiens
ccagcaggcacttgtctcagg

SEQ ID NO: 14663 - DNA, 19 bp, Homo sapiens
agtaacacagcacttcagg

SEQ ID NO: 14664 - DNA, 19 bp, Homo sapiens
ccagcaaatgcatttcggg

SEQ ID NO: 14665 - DNA, 22 bp, Homo sapiens
cagcaaatactacgtgctttgg

SEQ ID NO: 14666 - DNA, 19 bp, Homo sapiens
ccagcaggtgcgcctcggg

SEQ ID NO: 14667 - DNA, 17 bp, Homo sapiens
cagcaggtggctcttag

SEQ ID NO: 14668 - DNA, 24 bp, Homo sapiens
caccagcaggcttgcagtcttggg

SEQ ID NO: 14669 - DNA, 15 bp, Homo sapiens
cagcggacacctcag

SEQ ID NO: 14670 - DNA, 19 bp, Homo sapiens
ccagcaggtggggctcctc

SEQ ID NO: 14671 - DNA, 18 bp, Homo sapiens
gctagcatgagacctcag

SEQ ID NO: 14672 - DNA, 22 bp, Homo sapiens
taccagcagatattgccttagg

SEQ ID NO: 14673 - DNA, 16 bp, Homo sapiens
caccagcaggttctca

SEQ ID NO: 14674 - DNA, 18 bp, Homo sapiens
accagcagaacacttcag

SEQ ID NO: 14675 - DNA, 25 bp, Homo sapiens
ccagcaggtggtagaactcctcggg

SEQ ID NO: 14676 - DNA, 22 bp, Homo sapiens
ccaagatctgacgcaccttggg

SEQ ID NO: 14677 - DNA, 19 bp, Homo sapiens
ccagcaggagcagcttggg

SEQ ID NO: 14678 - DNA, 16 bp, Homo sapiens
agcaggtgacatcaga

SEQ ID NO: 14679 - DNA, 19 bp, Homo sapiens
cagcaggtggcacattagg

SEQ ID NO: 14680 - DNA, 78 bp, Meleagrid herpesvirus 1
cgggcatggatctctcgcggggtgcgtaggcgtgtgtattcattaacagctatgtaatccgcaggattcgagtacccg

SEQ ID NO: 14681 - DNA, 24 bp, Meleagrid herpesvirus 1
catggatctctcgcggggtgcgta

SEQ ID NO: 14682 - DNA, 18 bp, Homo sapiens
catggatctctcgggata

SEQ ID NO: 14683 - DNA, 16 bp, Homo sapiens
ggatctccaggtgcgt

SEQ ID NO: 14684 - DNA, 19 bp, Homo sapiens
atggatctttcgtggtgtg

SEQ ID NO: 14685 - DNA, 17 bp, Homo sapiens
catggatcctcgcggga

SEQ ID NO: 14686 - DNA, 18 bp, Homo sapiens
atggattctctgatgtgt

SEQ ID NO: 14687 - DNA, 16 bp, Homo sapiens
ggttcctggggtgcgt

SEQ ID NO: 14688 - DNA, 17 bp, Homo sapiens
catggatctcacatgtg

SEQ ID NO: 14689 - DNA, 19 bp, Homo sapiens
tggatgaacggggtgcgta

SEQ ID NO: 14690 - DNA, 18 bp, Homo sapiens
ggatctcttgctccacgt

SEQ ID NO: 14691 - DNA, 77 bp, Meleagrid herpesvirus 1
ggggcatactttctcatggacccccgagttgtgtctattcgttaacagctaggccgtccatgaggtcgtaggcaccc

SEQ ID NO: 14692 - DNA, 17 bp, Meleagrid herpesvirus 1
tgaggtcgtaggcaccc

SEQ ID NO: 14693 - DNA, 18 bp, Homo sapiens
tggggtcacagggcaccc

SEQ ID NO: 14694 - DNA, 18 bp, Homo sapiens
tgaggccgttggcagccc

SEQ ID NO: 14695 - DNA, 19 bp, Homo sapiens
tgggtcgcagcaggtgccc

SEQ ID NO: 14696 - DNA, 19 bp, Homo sapiens
tgaggtcatagcaaagccc

SEQ ID NO: 14697 - DNA, 18 bp, Homo sapiens
tgaagtcatgcagcatcc

SEQ ID NO: 14698 - DNA, 19 bp, Homo sapiens
tgaggtcagaggcaggcac

SEQ ID NO: 14699 - DNA, 18 bp, Homo sapiens
tggggtcacagagcatcc

SEQ ID NO: 14700 - DNA, 19 bp, Homo sapiens
taaggtcactttaggtacc

SEQ ID NO: 14701 - DNA, 19 bp, Homo sapiens
tgagattgtggaaggcacc

SEQ ID NO: 14702 - DNA, 20 bp, Homo sapiens
gaggtcatgaaaaggcgccc

SEQ ID NO: 14703 - DNA, 19 bp, Homo sapiens
tgaggtcagcaggtcatcc

SEQ ID NO: 14704 - DNA, 21 bp, Homo sapiens
tgaggtcagtgagaggtgccc

SEQ ID NO: 14705 - DNA, 19 bp, Homo sapiens
tgagatcgcaccactgccc

SEQ ID NO: 14706 - DNA, 90 bp, Equine herpesvirus 2
gccccaactcctcgccctacctcaagatctatgtggccacgaccgctatctcgcccgtgttcaagccagatgtgggagggcgagggcggc

SEQ ID NO: 14707 - DNA, 18 bp, Equine herpesvirus 2
tgggagggcgagggcggc

SEQ ID NO: 14708 - DNA, 21 bp, Homo sapiens
tgggaggagctcagaggcggc

SEQ ID NO: 14709 - DNA, 17 bp, Homo sapiens
tggggaggcgaggaggc

SEQ ID NO: 14710 - DNA, 16 bp, Homo sapiens
tgggagggggtgcggc

SEQ ID NO: 14711 - DNA, 18 bp, Homo sapiens
tgggagggacacaagggc

SEQ ID NO: 14712 - DNA, 19 bp, Homo sapiens
tgggagggcggccggcggc

SEQ ID NO: 14713 - DNA, 19 bp, Homo sapiens
gggagggtgggagggcggc

SEQ ID NO: 14714 - DNA, 17 bp, Homo sapiens
tgggaggtggagacggc

SEQ ID NO: 14715 - DNA, 18 bp, Homo sapiens
tgggagggagaaggaggc

SEQ ID NO: 14716 - DNA, 16 bp, Homo sapiens
tgggagggagggagac

SEQ ID NO: 14717 - DNA, 17 bp, Homo sapiens
tgggagaggagggtggc

SEQ ID NO: 14718 - DNA, 18 bp, Homo sapiens
gggaggaggcagggtggc

SEQ ID NO: 14719 - DNA, 15 bp, Homo sapiens
tgggagaacagcggc

SEQ ID NO: 14720 - DNA, 16 bp, Homo sapiens
tgggaaggcgggaggc

SEQ ID NO: 14721 - DNA, 16 bp, Homo sapiens
tggggggcgaggatgc

SEQ ID NO: 14722 - DNA, 20 bp, Homo sapiens
tgggagagaagaggggtggc

SEQ ID NO: 14723 - DNA, 19 bp, Homo sapiens
tggaaggggaaacaggtgg

SEQ ID NO: 14724 - DNA, 20 bp, Homo sapiens
tgggtggcgcggagggtggc

SEQ ID NO: 14725 - DNA, 16 bp, Homo sapiens
tgggagggcagggggc

SEQ ID NO: 14726 - DNA, 17 bp, Homo sapiens
tgggaggggggcccggc

SEQ ID NO: 14727 - DNA, 15 bp, Homo sapiens
tgggagggagggaac

SEQ ID NO: 14728 - DNA, 22 bp, Homo sapiens
ggagggcgagaaggaggcggcg

SEQ ID NO: 14729 - DNA, 18 bp, Homo sapiens
tgcgagggaaagggcggc

SEQ ID NO: 14730 - DNA, 19 bp, Homo sapiens
tgggaggggatgaagtggc

SEQ ID NO: 14731 - DNA, 19 bp, Homo sapiens
gggagggcgtgtgggtggc

SEQ ID NO: 14732 - DNA, 25 bp, Homo sapiens
tgggagggatgacaccggggtggcg

SEQ ID NO: 14733 - DNA, 16 bp, Homo sapiens
tgggagaggaggtggc

SEQ ID NO: 14734 - DNA, 21 bp, Homo sapiens
tgggagaggtgagattgcggc

SEQ ID NO: 14735 - DNA, 16 bp, Homo sapiens
tgggaggtcggggggc

SEQ ID NO: 14736 - DNA, 19 bp, Homo sapiens
tggcgagggcgggaggcgg

SEQ ID NO: 14737 - DNA, 17 bp, Homo sapiens
tgggaggagcgaacagc

SEQ ID NO: 14738 - DNA, 19 bp, Homo sapiens
gggagggcgcgagagcggc

SEQ ID NO: 14739 - DNA, 15 bp, Homo sapiens
tggaagggcagcggc

SEQ ID NO: 14740 - DNA, 18 bp, Homo sapiens
tgggaggatcatcacggc

SEQ ID NO: 14741 - DNA, 19 bp, Homo sapiens
tgggaggccgaaagagagc

SEQ ID NO: 14742 - DNA, 17 bp, Homo sapiens
taggagcccagggcggc

SEQ ID NO: 14743 - DNA, 21 bp, Homo sapiens
tgggaagggcatcctggtggc

SEQ ID NO: 14744 - DNA, 18 bp, Homo sapiens
tgagggggcaagggtggc

SEQ ID NO: 14745 - DNA, 19 bp, Homo sapiens
gggagggcgtgcgggcggc

SEQ ID NO: 14746 - DNA, 17 bp, Homo sapiens
tgagagggcgggagagc

SEQ ID NO: 14747 - DNA, 18 bp, Homo sapiens
tgaggagggcgggggtgg

SEQ ID NO: 14748 - DNA, 20 bp, Homo sapiens
taggaggaggcatgggtggc

SEQ ID NO: 14749 - DNA, 15 bp, Homo sapiens
tgggagagcagcggc

SEQ ID NO: 14750 - DNA, 17 bp, Homo sapiens
tgggggagcgagagggc

SEQ ID NO: 14751 - DNA, 17 bp, Homo sapiens
tggagagggcggggggc

SEQ ID NO: 14752 - DNA, 19 bp, Homo sapiens
agggggcagtgggggcggc

SEQ ID NO: 14753 - DNA, 15 bp, Homo sapiens
tgggagggagggagc

SEQ ID NO: 14754 - DNA, 16 bp, Homo sapiens
tgggagacgaggcggc

SEQ ID NO: 14755 - DNA, 20 bp, Homo sapiens
gggagggcgccccgggtggc

SEQ ID NO: 14756 - DNA, 21 bp, Homo sapiens
tgggaagggaagaggggcggc

SEQ ID NO: 14757 - DNA, 17 bp, Homo sapiens
tgggacgagagggcggc

SEQ ID NO: 14758 - DNA, 18 bp, Homo sapiens
tgggaggggaggggcggc

SEQ ID NO: 14759 - DNA, 17 bp, Homo sapiens
tgggaggacgacggggc

SEQ ID NO: 14760 - DNA, 20 bp, Homo sapiens
gggacaggacgcgggggcgg

SEQ ID NO: 14761 - DNA, 20 bp, Homo sapiens
gggagaaagaagagggtggc

SEQ ID NO: 14762 - DNA, 19 bp, Homo sapiens
tgggagggatgagaggagc

SEQ ID NO: 14763 - DNA, 17 bp, Homo sapiens
tggcgaggggaagcggc

SEQ ID NO: 14764 - DNA, 20 bp, Homo sapiens
tgggaagggaaggagggcgg

SEQ ID NO: 14765 - DNA, 15 bp, Homo sapiens
tgggaggggggcggc

SEQ ID NO: 14766 - DNA, 18 bp, Homo sapiens
tgggagggagaggagggc

SEQ ID NO: 14767 - DNA, 18 bp, Homo sapiens
tgggaagggccgggtggc

SEQ ID NO: 14768 - DNA, 20 bp, Homo sapiens
tgaggggcaagaggggcggc

SEQ ID NO: 14769 - DNA, 18 bp, Homo sapiens
gggcgggccgggggcggc

SEQ ID NO: 14770 - DNA, 19 bp, Homo sapiens
tgggaggagtccaaggtgg

SEQ ID NO: 14771 - DNA, 18 bp, Homo sapiens
gggctggctgagggcggc

SEQ ID NO: 14772 - DNA, 18 bp, Homo sapiens
gggaagacagggggcggc

SEQ ID NO: 14773 - DNA, 18 bp, Homo sapiens
ggcaagggcgagggcggc

SEQ ID NO: 14774 - DNA, 17 bp, Homo sapiens
tgggagggcagcccagc

SEQ ID NO: 14775 - DNA, 17 bp, Homo sapiens
tgtgaggcgagggtggc

SEQ ID NO: 14776 - DNA, 17 bp, Homo sapiens
tgggagggggaggcggc

SEQ ID NO: 14777 - DNA, 16 bp, Homo sapiens
tgggagggctgggggc

SEQ ID NO: 14778 - DNA, 17 bp, Homo sapiens
tgggagggtggacaggc

SEQ ID NO: 14779 - DNA, 19 bp, Homo sapiens
tgggcctgacgagggcggc

SEQ ID NO: 14780 - DNA, 17 bp, Homo sapiens
tgggggagcggacaggc

SEQ ID NO: 14781 - DNA, 18 bp, Homo sapiens
gggagggcggggaagggc

SEQ ID NO: 14782 - DNA, 18 bp, Homo sapiens
tgggagggcgactacggc

SEQ ID NO: 14783 - DNA, 17 bp, Homo sapiens
tggggaagaagggcggc

SEQ ID NO: 14784 - DNA, 17 bp, Homo sapiens
tgggagaggcgggagac

SEQ ID NO: 14785 - DNA, 16 bp, Homo sapiens
tgggagaggacacggc

SEQ ID NO: 14786 - DNA, 19 bp, Homo sapiens
tggtgagggcgtgacaggc

SEQ ID NO: 14787 - DNA, 17 bp, Homo sapiens
tgggagggaggacaagc

SEQ ID NO: 14788 - DNA, 20 bp, Homo sapiens
gggagggggctgcgggcggc

SEQ ID NO: 14789 - DNA, 17 bp, Homo sapiens
tgggagggcgacgcggc

SEQ ID NO: 14790 - DNA, 15 bp, Homo sapiens
tggaagggaagcggc

SEQ ID NO: 14791 - DNA, 20 bp, Homo sapiens
tgggaggctagaaaggtggc

SEQ ID NO: 14792 - DNA, 17 bp, Homo sapiens
tggcagggcgagatggc

SEQ ID NO: 14793 - DNA, 19 bp, Homo sapiens
tgggagggccaaggaaggc

SEQ ID NO: 14794 - DNA, 15 bp, Homo sapiens
tgggaagggggcggc

SEQ ID NO: 14795 - DNA, 20 bp, Homo sapiens
tgggagggcctagctgtggc

SEQ ID NO: 14796 - DNA, 17 bp, Homo sapiens
tggggagagaaagcggc

SEQ ID NO: 14797 - DNA, 19 bp, Homo sapiens
tggcagggcgagggcaagc

SEQ ID NO: 14798 - DNA, 17 bp, Homo sapiens
taggaggaaggggcggc

SEQ ID NO: 14799 - DNA, 19 bp, Homo sapiens
ggggggcgaggcgggcggc

SEQ ID NO: 14800 - DNA, 17 bp, Homo sapiens
tgggagagccaagcggc

SEQ ID NO: 14801 - DNA, 19 bp, Homo sapiens
tgggaggggggagactggc

SEQ ID NO: 14802 - DNA, 19 bp, Homo sapiens
tgggaggggtgagagaagc

SEQ ID NO: 14803 - DNA, 18 bp, Homo sapiens
gggactggagagggcggc

SEQ ID NO: 14804 - DNA, 18 bp, Homo sapiens
tgggcgggcgagaagagc

SEQ ID NO: 14805 - DNA, 18 bp, Homo sapiens
gggagaggagagggcggc

SEQ ID NO: 14806 - DNA, 17 bp, Homo sapiens
tgggagggagggctggc

SEQ ID NO: 14807 - DNA, 18 bp, Homo sapiens
tgagagcgggaggggcgg

SEQ ID NO: 14808 - DNA, 16 bp, Homo sapiens
tggggggcagaacggc

SEQ ID NO: 14809 - DNA, 18 bp, Homo sapiens
tggggcggcgaggacggc

SEQ ID NO: 14810 - DNA, 19 bp, Homo sapiens
tgggagaacacggggcggc

SEQ ID NO: 14811 - DNA, 18 bp, Homo sapiens
tgggagggtgaggccggc

SEQ ID NO: 14812 - DNA, 17 bp, Homo sapiens
tgggagagcgacggggc

SEQ ID NO: 14813 - DNA, 18 bp, Homo sapiens
tgggcggcacggggtggc

SEQ ID NO: 14814 - DNA, 20 bp, Homo sapiens
tgagaggggctgtgggcggc

SEQ ID NO: 14815 - DNA, 20 bp, Homo sapiens
tgggagggctgcagacaggc

SEQ ID NO: 14816 - DNA, 18 bp, Homo sapiens
tgggagcgcgggcgcggc

SEQ ID NO: 14817 - DNA, 18 bp, Homo sapiens
gggagcctcgagggcggc

SEQ ID NO: 14818 - DNA, 18 bp, Homo sapiens
tgggaaggagagggtggc

SEQ ID NO: 14819 - DNA, 17 bp, Homo sapiens
tgggaaggggaggtggc

SEQ ID NO: 14820 - DNA, 15 bp, Homo sapiens
tgggagggaggggac

SEQ ID NO: 14821 - DNA, 19 bp, Homo sapiens
tggcagcgaggagggtggc

SEQ ID NO: 14822 - DNA, 19 bp, Homo sapiens
tggcgagggcggggctcgg

SEQ ID NO: 14823 - DNA, 15 bp, Homo sapiens
tgggaagggagcggc

SEQ ID NO: 14824 - DNA, 16 bp, Homo sapiens
taggagagaaggtggc

SEQ ID NO: 14825 - DNA, 16 bp, Homo sapiens
tgggagagagggtggc

SEQ ID NO: 14826 - DNA, 18 bp, Homo sapiens
tggatcaaggagggcggc

SEQ ID NO: 14827 - DNA, 25 bp, Homo sapiens
tgggcagggcagcagaggggcggcg

SEQ ID NO: 14828 - DNA, 18 bp, Homo sapiens
gggaggggagagggtggc

SEQ ID NO: 14829 - DNA, 18 bp, Homo sapiens
agacggggcgggggcggc

SEQ ID NO: 14830 - DNA, 15 bp, Homo sapiens
taggaagggggcggc

SEQ ID NO: 14831 - DNA, 18 bp, Homo sapiens
tgggagggtgagagtggc

SEQ ID NO: 14832 - DNA, 18 bp, Homo sapiens
tggcgggacgagggcggc

SEQ ID NO: 14833 - DNA, 19 bp, Homo sapiens
tgggagggcagggactggc

SEQ ID NO: 14834 - DNA, 18 bp, Homo sapiens
tgggagagtggaaggggc

SEQ ID NO: 14835 - DNA, 18 bp, Homo sapiens
tggaagggactaggtggc

SEQ ID NO: 14836 - DNA, 16 bp, Homo sapiens
tgagaggaagggtggc

SEQ ID NO: 14837 - DNA, 19 bp, Homo sapiens
tgggaaggcgctaggtggc

SEQ ID NO: 14838 - DNA, 15 bp, Homo sapiens
tgagaaaggggcggc

SEQ ID NO: 14839 - DNA, 20 bp, Homo sapiens
tgggggggcgaggtagtggc

SEQ ID NO: 14840 - DNA, 21 bp, Homo sapiens
tgggaaggaaaagggggcggc

SEQ ID NO: 14841 - DNA, 19 bp, Homo sapiens
tgggagagcatcagttggc

SEQ ID NO: 14842 - DNA, 21 bp, Homo sapiens
tgcgagggcgcgtccggcggc

SEQ ID NO: 14843 - DNA, 18 bp, Homo sapiens
gggcagggtgagggcggc

SEQ ID NO: 14844 - DNA, 18 bp, Homo sapiens
gggagggcggagggcggc

SEQ ID NO: 14845 - DNA, 19 bp, Homo sapiens
tgggagggtgagactcggc

SEQ ID NO: 14846 - DNA, 23 bp, Homo sapiens
gggaagatgaggtgggggtggcg

SEQ ID NO: 14847 - DNA, 17 bp, Homo sapiens
tgggaggaggacccggc

SEQ ID NO: 14848 - DNA, 17 bp, Homo sapiens
tgggggagtgaaggggc

SEQ ID NO: 14849 - DNA, 20 bp, Homo sapiens
taggagggaaagcaggtggc

SEQ ID NO: 14850 - DNA, 18 bp, Homo sapiens
tgggaggatggagaagag

SEQ ID NO: 14851 - DNA, 17 bp, Homo sapiens
tgggtgcagagggcggc

SEQ ID NO: 14852 - DNA, 15 bp, Homo sapiens
tgggagggaggaggc

SEQ ID NO: 14853 - DNA, 22 bp, Homo sapiens
tgggagggggcttgtgggtggc

SEQ ID NO: 14854 - DNA, 17 bp, Homo sapiens
tgggaggactgggtggc

SEQ ID NO: 14855 - DNA, 20 bp, Homo sapiens
taggaggcccagagggtggc

SEQ ID NO: 14856 - DNA, 21 bp, Homo sapiens
tgggagggctcaggaggtggc

SEQ ID NO: 14857 - DNA, 15 bp, Homo sapiens
tgggagggggacagc

SEQ ID NO: 14858 - DNA, 20 bp, Homo sapiens
gggaggggtgacggggtggc

SEQ ID NO: 14859 - DNA, 17 bp, Homo sapiens
tgggaaggggtcgcggc

SEQ ID NO: 14860 - DNA, 19 bp, Homo sapiens
tgggagggctggaacgagc

SEQ ID NO: 14861 - DNA, 20 bp, Homo sapiens
gggagagggggcgggggcgg

SEQ ID NO: 14862 - DNA, 22 bp, Homo sapiens
taggagggcgaggggaggcggc

SEQ ID NO: 14863 - DNA, 21 bp, Homo sapiens
tgggagagcgggcagggtggc

SEQ ID NO: 14864 - DNA, 19 bp, Homo sapiens
tgggagggtgtagactggc

SEQ ID NO: 14865 - DNA, 20 bp, Homo sapiens
tgggaggacgggagggcggc

SEQ ID NO: 14866 - DNA, 18 bp, Homo sapiens
ggccgaggcgagggcggc

SEQ ID NO: 14867 - DNA, 17 bp, Homo sapiens
tgggagagagaagcggc

SEQ ID NO: 14868 - DNA, 18 bp, Homo sapiens
gggagaaggcggggcggc

SEQ ID NO: 14869 - DNA, 17 bp, Homo sapiens
tgagagagcggggtggc

SEQ ID NO: 14870 - DNA, 17 bp, Homo sapiens
gggaggacagggtggcg

SEQ ID NO: 14871 - DNA, 15 bp, Homo sapiens
tgggagggaggagac

SEQ ID NO: 14872 - DNA, 15 bp, Homo sapiens
tgggagggcagcagc

SEQ ID NO: 14873 - DNA, 18 bp, Homo sapiens
tgggagggcgaggcaggc

SEQ ID NO: 14874 - DNA, 17 bp, Homo sapiens
taggagaggtgggcggc

SEQ ID NO: 14875 - DNA, 16 bp, Homo sapiens
tggagaagggggcggc

SEQ ID NO: 14876 - DNA, 17 bp, Homo sapiens
tgggagtagagggcggc

SEQ ID NO: 14877 - DNA, 21 bp, Homo sapiens
tgggagaggcgccgctgcggc

SEQ ID NO: 14878 - DNA, 16 bp, Homo sapiens
tgagaggaaaggcggc

SEQ ID NO: 14879 - DNA, 18 bp, Homo sapiens
tgggagaggcgccaaagc

SEQ ID NO: 14880 - DNA, 16 bp, Homo sapiens
tgggagggagcacagc

SEQ ID NO: 14881 - DNA, 21 bp, Homo sapiens
gggagggtcgggcagggtggc

SEQ ID NO: 14882 - DNA, 16 bp, Homo sapiens
tggggagtagggcggc

SEQ ID NO: 14883 - DNA, 17 bp, Homo sapiens
tgggaggcgccagcggc

SEQ ID NO: 14884 - DNA, 16 bp, Homo sapiens
tgggagggaggggggc

SEQ ID NO: 14885 - DNA, 18 bp, Homo sapiens
tgggagaggcgatggggc

SEQ ID NO: 14886 - DNA, 18 bp, Homo sapiens
tggggacccgagggtggc

SEQ ID NO: 14887 - DNA, 20 bp, Homo sapiens
tgggagggtcccaaactggc

SEQ ID NO: 14888 - DNA, 18 bp, Homo sapiens
ggaaaggcgggggcggcg

SEQ ID NO: 14889 - DNA, 20 bp, Homo sapiens
tggaaggggagctgggtggc

SEQ ID NO: 14890 - DNA, 19 bp, Homo sapiens
tgggagggttgaattacgg

SEQ ID NO: 14891 - DNA, 17 bp, Homo sapiens
tgggagggaggactcgc

SEQ ID NO: 14892 - DNA, 19 bp, Homo sapiens
taggaaagcgaagggtggc

SEQ ID NO: 14893 - DNA, 15 bp, Homo sapiens
tgggagggagggggc

SEQ ID NO: 14894 - DNA, 16 bp, Homo sapiens
tggaagggtgaacagc

SEQ ID NO: 14895 - DNA, 18 bp, Homo sapiens
gggaggggatggggtggc

SEQ ID NO: 14896 - DNA, 19 bp, Homo sapiens
gggagggcctggaggcggc

SEQ ID NO: 14897 - DNA, 16 bp, Homo sapiens
tgggaggcagggcggc

SEQ ID NO: 14898 - DNA, 18 bp, Homo sapiens
tgggagggaggaccaggc

SEQ ID NO: 14899 - DNA, 18 bp, Homo sapiens
tggaagggccaaagcggc

SEQ ID NO: 14900 - DNA, 18 bp, Homo sapiens
tgggaggatgcacagagc

SEQ ID NO: 14901 - DNA, 18 bp, Homo sapiens
tggcagggacagggcggc

SEQ ID NO: 14902 - DNA, 21 bp, Homo sapiens
tgggcagggcagctccgcggc

SEQ ID NO: 14903 - DNA, 19 bp, Homo sapiens
tggaaagaagaagggtggc

SEQ ID NO: 14904 - DNA, 18 bp, Homo sapiens
tgggagagcgggaggggc

SEQ ID NO: 14905 - DNA, 17 bp, Homo sapiens
tgggaggaacgcgcggc

SEQ ID NO: 14906 - DNA, 18 bp, Homo sapiens
tgggagggccagcccggc

SEQ ID NO: 14907 - DNA, 19 bp, Homo sapiens
tgggagggcaaggactggc

SEQ ID NO: 14908 - DNA, 18 bp, Homo sapiens
tgggagggccaggatggc

SEQ ID NO: 14909 - DNA, 18 bp, Homo sapiens
tggcgagggctaaaaggc

SEQ ID NO: 14910 - DNA, 19 bp, Homo sapiens
tgggagggagagcagtggc

SEQ ID NO: 14911 - DNA, 17 bp, Homo sapiens
tgggagggagacagagc

SEQ ID NO: 14912 - DNA, 74 bp, Equine herpesvirus 2
aggatccaggacattatctctggcgtcacggagacgggggaccgagtggatgtcagggacggcacctggaacct

SEQ ID NO: 14913 - DNA, 24 bp, Equine herpesvirus 2
tgtcagggacggcacctggaacct

SEQ ID NO: 14914 - DNA, 15 bp, Homo sapiens
tgtcaggaacgggga

SEQ ID NO: 14915 - DNA, 21 bp, Homo sapiens
tgtagtaagtacctggggcct

SEQ ID NO: 14916 - DNA, 26 bp, Homo sapiens
gtcagggatggtacctagagatgcct

SEQ ID NO: 14917 - DNA, 22 bp, Homo sapiens
tgttaggagaaaactggaacct

SEQ ID NO: 14918 - DNA, 19 bp, Homo sapiens
tgtcaggggcggcgtgcct

SEQ ID NO: 14919 - DNA, 16 bp, Homo sapiens
gcaaagtggcacctgg

SEQ ID NO: 14920 - DNA, 19 bp, Homo sapiens
agaaaaatacttggaacct

SEQ ID NO: 14921 - DNA, 18 bp, Homo sapiens
tgtcaggggcagcggctg

SEQ ID NO: 14922 - DNA, 18 bp, Homo sapiens
tgtcagggtggcagggcc

SEQ ID NO: 14923 - DNA, 23 bp, Homo sapiens
gtaagaaatggtacctggaacct

SEQ ID NO: 14924 - DNA, 22 bp, Homo sapiens
tgtcagggatggcccggcccct

SEQ ID NO: 14925 - DNA, 22 bp, Homo sapiens
tgttggagacggcaggaggcct

SEQ ID NO: 14926 - DNA, 17 bp, Homo sapiens
tgacagggagcacctgg

SEQ ID NO: 14927 - DNA, 21 bp, Homo sapiens
agggtatggcacctggaacct

SEQ ID NO: 14928 - DNA, 25 bp, Homo sapiens
tgtcaggaggtgacggctggagcct

SEQ ID NO: 14929 - DNA, 23 bp, Homo sapiens
tgcggtagcggcacctggagcct

SEQ ID NO: 14930 - DNA, 15 bp, Homo sapiens
tgccagggcctggaa

SEQ ID NO: 14931 - DNA, 23 bp, Homo sapiens
tgtcagggatgtgcatggaccct

SEQ ID NO: 14932 - DNA, 22 bp, Homo sapiens
tgccagttactacttggaacct

SEQ ID NO: 14933 - DNA, 16 bp, Homo sapiens
tgtcaggatctggaac

SEQ ID NO: 14934 - DNA, 20 bp, Homo sapiens
tgtcaggggcaggcacttga

SEQ ID NO: 14935 - DNA, 15 bp, Homo sapiens
tgtcagggagaggaa

SEQ ID NO: 14936 - DNA, 18 bp, Homo sapiens
tgtcagggatggggagcc

SEQ ID NO: 14937 - DNA, 21 bp, Homo sapiens
tgtctggggctcatggaacct

SEQ ID NO: 14938 - DNA, 19 bp, Homo sapiens
tgtcagggactggtgctgg

SEQ ID NO: 14939 - DNA, 24 bp, Homo sapiens
tgtcagggctgtgccctggggcct

SEQ ID NO: 14940 - DNA, 89 bp, Meleagrid herpesvirus 1
cagtttgggcatactttcttatggaccgccgaggtgtgtctattcgttaacagctaggccgtccatgaggtcgtaggcacccagtaatg

SEQ ID NO: 14941 - DNA, 24 bp, Meleagrid herpesvirus 1
tgaggtcgtaggcacccagtaatg

SEQ ID NO: 14942 - DNA, 19 bp, Homo sapiens
tgaggtcgtgggcgccgca

SEQ ID NO: 14943 - DNA, 19 bp, Homo sapiens
gaggcagcaggcacctagt

SEQ ID NO: 14944 - DNA, 22 bp, Homo sapiens
tggggtgatacacccagtaatg

SEQ ID NO: 14945 - DNA, 19 bp, Homo sapiens
gggtatatacccagtaatg

SEQ ID NO: 14946 - DNA, 25 bp, Homo sapiens
tgaggtcgtggctgccgtgcattat

SEQ ID NO: 14947 - DNA, 19 bp, Homo sapiens
aggtatacacccagtaatg

SEQ ID NO: 14948 - DNA, 20 bp, Homo sapiens
tgggtacatacccagtaatg

SEQ ID NO: 14949 - DNA, 20 bp, Homo sapiens
tgggtcgtaggcacaggagt

SEQ ID NO: 14950 - DNA, 23 bp, Homo sapiens
aaatacgtgggtactcagtaatg

SEQ ID NO: 14951 - DNA, 87 bp, Meleagrid herpesvirus 1
gccaggcttgggcgtattttctccggtgagcgtagctgcctgtagtcgttagcagctacgttgtccgcgggattctagccacctggc

SEQ ID NO: 14952 - DNA, 24 bp, Meleagrid herpesvirus 1
tacgttgtccgcgggattctagcc

SEQ ID NO: 14953 - DNA, 18 bp, Homo sapiens
gttgtccagaattctggc

SEQ ID NO: 14954 - DNA, 18 bp, Homo sapiens
gttgctgcaagactctag

SEQ ID NO: 14955 - DNA, 25 bp, Homo sapiens
tacattgtttattatggttctagcc

SEQ ID NO: 14956 - DNA, 21 bp, Homo sapiens
ttgttccacagcattctagcc

SEQ ID NO: 14957 - DNA, 18 bp, Homo sapiens
cacgttcggggttctagc

SEQ ID NO: 14958 - DNA, 60 bp, Saimiriine herpesvirus 2
tagtggaattgtactcccagtgcctttagcaaatgctatattcaacttgctgtctcactg

SEQ ID NO: 14959 - DNA, 20 bp, Saimiriine herpesvirus 2
ttcaacttgctgtctcactg

SEQ ID NO: 14960 - DNA, 17 bp, Homo sapiens
ttcagcttgtctcactg

SEQ ID NO: 14961 - DNA, 21 bp, Homo sapiens
ttcaacctgctgagcaggctg

SEQ ID NO: 14962 - DNA, 17 bp, Homo sapiens
ttcactgcgcttcactg

SEQ ID NO: 14963 - DNA, 17 bp, Homo sapiens
ctcaacttgtagtactg

SEQ ID NO: 14964 - DNA, 18 bp, Homo sapiens
ctcagcttgaccccactg

SEQ ID NO: 14965 - DNA, 20 bp, Homo sapiens
ctcaacttgttcccttactg

SEQ ID NO: 14966 - DNA, 20 bp, Homo sapiens
ttcacttttcaacctcactg

SEQ ID NO: 14967 - DNA, 20 bp, Homo sapiens
ttcaacctgcatgagggctg

SEQ ID NO: 14968 - DNA, 17 bp, Homo sapiens
ttctgttgctctcactg

SEQ ID NO: 14969 - DNA, 19 bp, Homo sapiens
ttcacctgccagctcgctg

SEQ ID NO: 14970 - DNA, 19 bp, Homo sapiens
ttcaactctggccttgctg

SEQ ID NO: 14971 - DNA, 19 bp, Homo sapiens
ttctactaacatctcactg

SEQ ID NO: 14972 - DNA, 18 bp, Homo sapiens
ttcacccaggtctcactg

SEQ ID NO: 14973 - DNA, 19 bp, Homo sapiens
ttcaatcttggcctcactg

SEQ ID NO: 14974 - DNA, 21 bp, Homo sapiens
ctcagctgccacctctcactg

SEQ ID NO: 14975 - DNA, 15 bp, Homo sapiens
ctcaactttctcact

SEQ ID NO: 14976 - DNA, 18 bp, Homo sapiens
cttaactgaatctcactg

SEQ ID NO: 14977 - DNA, 21 bp, Homo sapiens
tccgacttgctggaagtcctg

SEQ ID NO: 14978 - DNA, 17 bp, Homo sapiens
tcagttacccctcactg

SEQ ID NO: 14979 - DNA, 17 bp, Homo sapiens
tcagttatatctcactg

SEQ ID NO: 14980 - DNA, 20 bp, Homo sapiens
tccaacttgctgaacttctg

SEQ ID NO: 14981 - DNA, 19 bp, Homo sapiens
ttcagtctggctcccactg

SEQ ID NO: 14982 - DNA, 20 bp, Homo sapiens
ttcaatttactcccacactg

SEQ ID NO: 14983 - DNA, 18 bp, Homo sapiens
ttcattgcattctcactg

SEQ ID NO: 14984 - DNA, 20 bp, Homo sapiens
ttcaacttttgggtctactg

SEQ ID NO: 14985 - DNA, 19 bp, Homo sapiens
ttcaaatgcaccctcactg

SEQ ID NO: 14986 - DNA, 18 bp, Homo sapiens
ctcagcttgctgccgctg

SEQ ID NO: 14987 - DNA, 19 bp, Homo sapiens
ttcagcttctcccccactg

SEQ ID NO: 14988 - DNA, 19 bp, Homo sapiens
ttcagctctcttctcactg

SEQ ID NO: 14989 - DNA, 18 bp, Homo sapiens
ttcacttaccactcactg

SEQ ID NO: 14990 - DNA, 19 bp, Homo sapiens
ttcattcatactctcactg

SEQ ID NO: 14991 - DNA, 20 bp, Homo sapiens
ttcaacctcccaccttgctg

SEQ ID NO: 14992 - DNA, 18 bp, Homo sapiens
tcacctgctgtctcactg

SEQ ID NO: 14993 - DNA, 22 bp, Homo sapiens
tccggcttgctgtcatcatctg

SEQ ID NO: 14994 - DNA, 19 bp, Homo sapiens
tcaaagccatgtctcactg

SEQ ID NO: 14995 - DNA, 20 bp, Homo sapiens
ttcaacatgcctgcttgctg

SEQ ID NO: 14996 - DNA, 18 bp, Homo sapiens
ttcacctccacctcactg

SEQ ID NO: 14997 - DNA, 15 bp, Homo sapiens
tcaatgatctcactg

SEQ ID NO: 14998 - DNA, 19 bp, Homo sapiens
caacttgctattttcactg

SEQ ID NO: 14999 - DNA, 20 bp, Homo sapiens
tcaatcctgttgtctcactg

SEQ ID NO: 15000 - DNA, 19 bp, Homo sapiens
tccatagcagctctcactg

SEQ ID NO: 15001 - DNA, 17 bp, Homo sapiens
tcaacttgtacccactg

SEQ ID NO: 15002 - DNA, 19 bp, Homo sapiens
ttcagctttgctgctactg

SEQ ID NO: 15003 - DNA, 19 bp, Homo sapiens
ttcaatcaccatcttactg

SEQ ID NO: 15004 - DNA, 20 bp, Homo sapiens
tccggcttgcgtgatcactg

SEQ ID NO: 15005 - DNA, 21 bp, Homo sapiens
tccaacttgaactggttactg

SEQ ID NO: 15006 - DNA, 17 bp, Homo sapiens
ttcaactgctgccacct

SEQ ID NO: 15007 - DNA, 21 bp, Homo sapiens
ctcagcttgctgctcccactg

SEQ ID NO: 15008 - DNA, 15 bp, Homo sapiens
caacttgtcccactg

SEQ ID NO: 15009 - DNA, 18 bp, Homo sapiens
ttcatactgtctttactg

SEQ ID NO: 15010 - DNA, 80 bp, Saimiriine herpesvirus 2
aatgaatctggaatagtatctacaacattagcagcatttataaaactgtcttttcctactatatctattccaaatttgtt

SEQ ID NO: 15011 - DNA, 24 bp, Saimiriine herpesvirus 2
tctggaatagtatctacaacatta

SEQ ID NO: 15012 - DNA, 22 bp, Homo sapiens
ctggaatagtggtgtggcatta

SEQ ID NO: 15013 - DNA, 22 bp, Homo sapiens
tctgagtagctctataacatta

SEQ ID NO: 15014 - DNA, 18 bp, Homo sapiens
tctggaatggtgactaca

SEQ ID NO: 15015 - DNA, 21 bp, Homo sapiens
ctggaacatattacaatatta

SEQ ID NO: 15016 - DNA, 25 bp, Homo sapiens
tggaacagtatccaaacagacatta

SEQ ID NO: 15017 - DNA, 18 bp, Homo sapiens
tctggaatagcatctaca

SEQ ID NO: 15018 - DNA, 21 bp, Homo sapiens
tctagaatgcaagtgacatta

SEQ ID NO: 15019 - DNA, 24 bp, Homo sapiens
tctggggtactccacttgacatta

SEQ ID NO: 15020 - DNA, 70 bp, Sulfolobus virus SIRV-2
atagaacttgatttatttgttgatttgcagttccaataaagcccgcgatataaattggatcttgttctgt

SEQ ID NO: 15021 - DNA, 20 bp, Sulfolobus virus SIRV-2
taaattggatcttgttctgt

SEQ ID NO: 15022 - DNA, 18 bp, Homo sapiens
taagttggagtgttctgt

SEQ ID NO: 15023 - DNA, 23 bp, Homo sapiens
taaattggaaaccaatgttctgt

SEQ ID NO: 15024 - DNA, 18 bp, Homo sapiens
tagattgccttgttctgt

SEQ ID NO: 15025 - DNA, 21 bp, Homo sapiens
taaattgaattgtagctctgt

SEQ ID NO: 15026 - DNA, 24 bp, Homo sapiens
taaattgaggattaactgttctgt

SEQ ID NO: 15027 - DNA, 17 bp, Homo sapiens
taaattacctgttctgt

SEQ ID NO: 15028 - DNA, 21 bp, Homo sapiens
taaattgaaaagatgttctgt

SEQ ID NO: 15029 - DNA, 18 bp, Homo sapiens
ttgatatgcttgttctgt

SEQ ID NO: 15030 - DNA, 17 bp, Homo sapiens
aaattgggccattctgt

SEQ ID NO: 15031 - DNA, 21 bp, Homo sapiens
aattggaaaccaatgttctgt

SEQ ID NO: 15032 - DNA, 18 bp, Homo sapiens
aaattgaggttgttctgt

SEQ ID NO: 15033 - DNA, 18 bp, Homo sapiens
ttggaggccttgttctgt

SEQ ID NO: 15034 - DNA, 18 bp, Homo sapiens
aatctaattttgttctgt

SEQ ID NO: 15035 - DNA, 18 bp, Homo sapiens
aattgagtcgtattctgt

SEQ ID NO: 15036 - DNA, 20 bp, Homo sapiens
aaatggatcttttgttctgt

SEQ ID NO: 15037 - DNA, 18 bp, Homo sapiens
taaattggcattgtctgt

SEQ ID NO: 15038 - DNA, 17 bp, Homo sapiens
taaattagaggttctgt

SEQ ID NO: 15039 - DNA, 17 bp, Homo sapiens
taaattagatatcctgt

SEQ ID NO: 15040 - DNA, 18 bp, Homo sapiens
taaattggatattcctgt

SEQ ID NO: 15041 - DNA, 16 bp, Homo sapiens
aattgagctgttctgt

SEQ ID NO: 15042 - DNA, 18 bp, Homo sapiens
taagttggaccttcccgt

SEQ ID NO: 15043 - DNA, 87 bp, Sulfolobus virus SIRV-2
ataattcatataataaatataatgtatatagtttgttctcatttagatcatttaaaattaaaatatgtcttattgtttatgaattat

SEQ ID NO: 15044 - DNA, 24 bp, Sulfolobus virus SIRV-2
taatgtatatagtttgttctcatt

SEQ ID NO: 15045 - DNA, 20 bp, Homo sapiens
aatgtgtaaatgttctcatt

SEQ ID NO: 15046 - DNA, 21 bp, Homo sapiens
tgtatatagttctgtgtcatt

SEQ ID NO: 15047 - DNA, 18 bp, Homo sapiens
tgagacatggtttgttct

SEQ ID NO: 15048 - DNA, 27 bp, Homo sapiens
taatatatatatatatatgttctcatt

SEQ ID NO: 15049 - DNA, 23 bp, Homo sapiens
taattataatttctgttctcatt

SEQ ID NO: 15050 - DNA, 20 bp, Homo sapiens
taatgtatatcagtttctct

SEQ ID NO: 15051 - DNA, 20 bp, Homo sapiens
gtatatatacctttctcatt

SEQ ID NO: 15052 - DNA, 20 bp, Homo sapiens
taatgtatacagtttgggct

SEQ ID NO: 15053 - DNA, 21 bp, Homo sapiens
taatgtgtaagtgccctcatt

SEQ ID NO: 15054 - DNA, 24 bp, Homo sapiens
taatatatatatgactatttcatt

SEQ ID NO: 15055 - DNA, 22 bp, Homo sapiens
taatatatataaagttctcatt

SEQ ID NO: 15056 - DNA, 22 bp, Homo sapiens
atgttgtgtctttgttctcatt

SEQ ID NO: 15057 - DNA, 20 bp, Homo sapiens
caatgtgatacttttgttct

SEQ ID NO: 15058 - DNA, 22 bp, Homo sapiens
atgtatatatcacattttcatt

SEQ ID NO: 15059 - DNA, 118 bp, Saimiriine herpesvirus 2
attgttacctgctgcaagtgtgacgccagccctagaaagcttgttttcacctactcacttcccttgtatgtctgatgaaagcattgcttctacttctcatgttccgctagataacaat

SEQ ID NO: 15060 - DNA, 24 bp, Saimiriine herpesvirus 2
cagccctagaaagcttgttttcac

SEQ ID NO: 15061 - DNA, 23 bp, Homo sapiens
cagccccagggggctctagccac

SEQ ID NO: 15062 - DNA, 20 bp, Homo sapiens
cagttgctagaacgttttca

SEQ ID NO: 15063 - DNA, 21 bp, Homo sapiens
cagcctagaaagttctagcac

SEQ ID NO: 15064 - DNA, 23 bp, Homo sapiens
caagtctctgagcttgttttcac

SEQ ID NO: 15065 - DNA, 22 bp, Homo sapiens
gcactggaatgtctgttttcac

SEQ ID NO: 15066 - DNA, 19 bp, Homo sapiens
cagccttataaactgtttc

SEQ ID NO: 15067 - DNA, 20 bp, Homo sapiens
aactttagaaagcgaatttt

SEQ ID NO: 15068 - DNA, 22 bp, Homo sapiens
cctggaaggctggcaggttcac

SEQ ID NO: 15069 - DNA, 19 bp, Homo sapiens
cagccctagtaaaagtttt

SEQ ID NO: 15070 - DNA, 17 bp, Homo sapiens
cagctctggaaacttgt

SEQ ID NO: 15071 - DNA, 18 bp, Homo sapiens
cagccctaggcgctttca

SEQ ID NO: 15072 - DNA, 18 bp, Homo sapiens
cagtcctgcaggctttca

SEQ ID NO: 15073 - DNA, 19 bp, Homo sapiens
agctctagtccttgttttc

SEQ ID NO: 15074 - DNA, 22 bp, Homo sapiens
agttctagaagcccgcactcac

SEQ ID NO: 15075 - DNA, 18 bp, Homo sapiens
ccggagagtcgtcctcac

SEQ ID NO: 15076 - DNA, 19 bp, Homo sapiens
tagatctgacttgttttca

SEQ ID NO: 15077 - DNA, 18 bp, Homo sapiens
agccctagaaacaatgtt

SEQ ID NO: 15078 - DNA, 20 bp, Homo sapiens
gctcctggagagctgaccac

SEQ ID NO: 15079 - DNA, 17 bp, Homo sapiens
gcactagtttgttttca

SEQ ID NO: 15080 - DNA, 22 bp, Homo sapiens
gcctctggggctcggttttcac

SEQ ID NO: 15081 - DNA, 19 bp, Homo sapiens
cagccctatgaggtaatca

SEQ ID NO: 15082 - DNA, 23 bp, Homo sapiens
gccctgcctgcgtttgttttcac

SEQ ID NO: 15083 - DNA, 20 bp, Homo sapiens
cagtcctaaaaagcagcttt

SEQ ID NO: 15084 - DNA, 22 bp, Homo sapiens
acccttagagagctatcagcac

SEQ ID NO: 15085 - DNA, 18 bp, Homo sapiens
taaaaagctacccctcac

SEQ ID NO: 15086 - DNA, 18 bp, Homo sapiens
cagccccagggagtattt

SEQ ID NO: 15087 - DNA, 24 bp, Homo sapiens
cagctcaggagggcttgttcctca

SEQ ID NO: 15088 - DNA, 23 bp, Homo sapiens
tgaccctgggcctccgttttcac

SEQ ID NO: 15089 - DNA, 17 bp, Homo sapiens
agtcctgagcttgtttt

SEQ ID NO: 15090 - DNA, 18 bp, Homo sapiens
gcccttaggaagctgtct

SEQ ID NO: 15091 - DNA, 16 bp, Homo sapiens
gccctgattgttttca

SEQ ID NO: 15092 - DNA, 19 bp, Homo sapiens
cagctcagaaagatatttc

SEQ ID NO: 15093 - DNA, 18 bp, Homo sapiens
gaattgagcttgttttca

SEQ ID NO: 15094 - DNA, 16 bp, Homo sapiens
cagccctagaggctgc

SEQ ID NO: 15095 - DNA, 17 bp, Homo sapiens
cagcctccccttgtttt

SEQ ID NO: 15096 - DNA, 20 bp, Homo sapiens
agtcctaaaagcttccccac

SEQ ID NO: 15097 - DNA, 23 bp, Homo sapiens
cagctatagaaactagtttttca

SEQ ID NO: 15098 - DNA, 17 bp, Homo sapiens
accctagaagtcatttt

SEQ ID NO: 15099 - DNA, 18 bp, Homo sapiens
cagccctgcatgttttca

SEQ ID NO: 15100 - DNA, 19 bp, Homo sapiens
cagctctgaaagctcagct

SEQ ID NO: 15101 - DNA, 17 bp, Homo sapiens
cagcccagaaagctgct

SEQ ID NO: 15102 - DNA, 20 bp, Homo sapiens
accctagagagtactttcac

SEQ ID NO: 15103 - DNA, 18 bp, Homo sapiens
caggcctagaaagctcac

SEQ ID NO: 15104 - DNA, 19 bp, Homo sapiens
caactacagcttgttttca

SEQ ID NO: 15105 - DNA, 25 bp, Homo sapiens
cagtcctaaaaagactagattttca

SEQ ID NO: 15106 - DNA, 15 bp, Homo sapiens
aacccagcttgtttt

SEQ ID NO: 15107 - DNA, 17 bp, Homo sapiens
cagtccagaaagctgcc

SEQ ID NO: 15108 - DNA, 23 bp, Homo sapiens
cagccctggggggattgtcctca

SEQ ID NO: 15109 - DNA, 19 bp, Homo sapiens
gccctagaaactgcatctt

SEQ ID NO: 15110 - DNA, 18 bp, Homo sapiens
agccttagaaagctaagc

SEQ ID NO: 15111 - DNA, 15 bp, Homo sapiens
cagccctaacgtttt

SEQ ID NO: 15112 - DNA, 22 bp, Homo sapiens
cagcttcattaagtttgttttc

SEQ ID NO: 15113 - DNA, 21 bp, Homo sapiens
cagcccttagaaccattttca

SEQ ID NO: 15114 - DNA, 20 bp, Homo sapiens
gctcagagagctatccccac

SEQ ID NO: 15115 - DNA, 23 bp, Homo sapiens
cagcccttgaaatgggttttcac

SEQ ID NO: 15116 - DNA, 22 bp, Homo sapiens
cagccactggagtagttttcac

SEQ ID NO: 15117 - DNA, 20 bp, Homo sapiens
cagctcctggagcattttca

SEQ ID NO: 15118 - DNA, 18 bp, Homo sapiens
cagctcagaaggctctca

SEQ ID NO: 15119 - DNA, 16 bp, Homo sapiens
cagcctccttgttttc

SEQ ID NO: 15120 - DNA, 24 bp, Homo sapiens
cagttctaaaaagctctgaactca

SEQ ID NO: 15121 - DNA, 16 bp, Homo sapiens
gccctaattgttttca

SEQ ID NO: 15122 - DNA, 19 bp, Homo sapiens
actttagaaagcttctctt

SEQ ID NO: 15123 - DNA, 69 bp, Sulfolobus virus SIRV-2
tgggctagctaaaagtgaagaaattgaagtataagttacactcatatatttttaataagtaactgccca

SEQ ID NO: 15124 - DNA, 24 bp, Sulfolobus virus SIRV-2
aaagtgaagaaattgaagtataag

SEQ ID NO: 15125 - DNA, 22 bp, Homo sapiens
aaaatgaagagataaatataag

SEQ ID NO: 15126 - DNA, 19 bp, Homo sapiens
aaaggaagaaatggatgta

SEQ ID NO: 15127 - DNA, 17 bp, Homo sapiens
aaatgaagaagttgagt

SEQ ID NO: 15128 - DNA, 20 bp, Homo sapiens
atgaagaaattgtgtctaag

SEQ ID NO: 15129 - DNA, 18 bp, Homo sapiens
aagtgaagaagactgtag

SEQ ID NO: 15130 - DNA, 16 bp, Homo sapiens
ggaggaaggaagtata

SEQ ID NO: 15131 - DNA, 20 bp, Homo sapiens
aaaatgaagaaaacaggtat

SEQ ID NO: 15132 - DNA, 20 bp, Homo sapiens
aaagttaaatctgaagtata

SEQ ID NO: 15133 - DNA, 19 bp, Homo sapiens
gtgaggaaattgagtcaca

SEQ ID NO: 15134 - DNA, 17 bp, Homo sapiens
aagtgaagagttgaaat

SEQ ID NO: 15135 - DNA, 20 bp, Homo sapiens
agtgaaaaagaaaatataag

SEQ ID NO: 15136 - DNA, 15 bp, Homo sapiens
aaagtgaagagaagt

SEQ ID NO: 15137 - DNA, 21 bp, Homo sapiens
aaagtgaagaggttcaactat

SEQ ID NO: 15138 - DNA, 21 bp, Homo sapiens
aaagtgagagattgacccaag

SEQ ID NO: 15139 - DNA, 15 bp, Homo sapiens
aaagtgaaggtataa

SEQ ID NO: 15140 - DNA, 24 bp, Homo sapiens
aaaatgaagaaactgaagtgtaag

SEQ ID NO: 15141 - DNA, 24 bp, Homo sapiens
aaagttaagaaattgggttataag

SEQ ID NO: 15142 - DNA, 23 bp, Homo sapiens
aaagatgaggaaattgagacaca

SEQ ID NO: 15143 - DNA, 68 bp, Saimiriine herpesvirus 2
caaggcggccaagaggcagacctaagggctctaaaactaaaaagcgccctacatgctctcctgctttg

SEQ ID NO: 15144 - DNA, 24 bp, Saimiriine herpesvirus 2
agaggcagacctaagggctctaaa

SEQ ID NO: 15145 - DNA, 22 bp, Homo sapiens
agaggtagactcgattatctaa

SEQ ID NO: 15146 - DNA, 18 bp, Homo sapiens
agaggcaggctcagctcc

SEQ ID NO: 15147 - DNA, 17 bp, Homo sapiens
agaggcagactcaggac

SEQ ID NO: 15148 - DNA, 17 bp, Homo sapiens
gagggcaggagggctct

SEQ ID NO: 15149 - DNA, 17 bp, Homo sapiens
agaggcaatctaagctc

SEQ ID NO: 15150 - DNA, 20 bp, Homo sapiens
agaggcaagccctcagctct

SEQ ID NO: 15151 - DNA, 18 bp, Homo sapiens
gaggcgggcctaagagtc

SEQ ID NO: 15152 - DNA, 22 bp, Homo sapiens
agaggcagccttggggatatct

SEQ ID NO: 15153 - DNA, 18 bp, Homo sapiens
agatggcacaagggctct

SEQ ID NO: 15154 - DNA, 19 bp, Homo sapiens
gaggcagagactggctcta

SEQ ID NO: 15155 - DNA, 21 bp, Homo sapiens
gatgcggacccaccgggctct

SEQ ID NO: 15156 - DNA, 19 bp, Homo sapiens
agaggcagacctatctggg

SEQ ID NO: 15157 - DNA, 20 bp, Homo sapiens
agggccagcgctgggctcta

SEQ ID NO: 15158 - DNA, 20 bp, Homo sapiens
gaggcagacgctggagggct

SEQ ID NO: 15159 - DNA, 18 bp, Homo sapiens
aaaggcagatttaggatc

SEQ ID NO: 15160 - DNA, 19 bp, Homo sapiens
agaggcaggtcctgggagc

SEQ ID NO: 15161 - DNA, 23 bp, Homo sapiens
agaggcaggactgggacgccaaa

SEQ ID NO: 15162 - DNA, 19 bp, Homo sapiens
gaggcaggtccaggcccca

SEQ ID NO: 15163 - DNA, 18 bp, Homo sapiens
ggcagagccctgggttct

SEQ ID NO: 15164 - DNA, 21 bp, Homo sapiens
agaggcagacttgaggtctaa

SEQ ID NO: 15165 - DNA, 22 bp, Homo sapiens
agacggcagagaacaggttcta

SEQ ID NO: 15166 - DNA, 21 bp, Homo sapiens
agaggagacagtcggctctaa

SEQ ID NO: 15167 - DNA, 17 bp, Homo sapiens
aggggcaggccaagaac

SEQ ID NO: 15168 - DNA, 18 bp, Homo sapiens
agaggcagagctgggact

SEQ ID NO: 15169 - DNA, 18 bp, Homo sapiens
agaggcaggcccggggct

SEQ ID NO: 15170 - DNA, 20 bp, Homo sapiens
gaagcaggctccactctcta

SEQ ID NO: 15171 - DNA, 17 bp, Homo sapiens
aggggcagacctggacc

SEQ ID NO: 15172 - DNA, 16 bp, Homo sapiens
aaggtaccagggctct

SEQ ID NO: 15173 - DNA, 18 bp, Homo sapiens
gagggaggccagggctct

SEQ ID NO: 15174 - DNA, 16 bp, Homo sapiens
agaggcagaacctcta

SEQ ID NO: 15175 - DNA, 18 bp, Homo sapiens
agaggcagactcactagg

SEQ ID NO: 15176 - DNA, 17 bp, Homo sapiens
gacaggcccagggctct

SEQ ID NO: 15177 - DNA, 15 bp, Homo sapiens
agaggcagaccagct

SEQ ID NO: 15178 - DNA, 21 bp, Homo sapiens
aggggtgagcctggccctaaa

SEQ ID NO: 15179 - DNA, 20 bp, Homo sapiens
gaggcagggctagccctaaa

SEQ ID NO: 15180 - DNA, 21 bp, Homo sapiens
agagacaggctgtctcctcta

SEQ ID NO: 15181 - DNA, 23 bp, Homo sapiens
agaggccgacttgaggaagttct

SEQ ID NO: 15182 - DNA, 22 bp, Homo sapiens
aggggcaaacctaagggttcta

SEQ ID NO: 15183 - DNA, 20 bp, Homo sapiens
gaggcagggcttagggctct

SEQ ID NO: 15184 - DNA, 15 bp, Homo sapiens
gaggcagagggctct

SEQ ID NO: 15185 - DNA, 22 bp, Homo sapiens
agaggtaggagctgggctctaa

SEQ ID NO: 15186 - DNA, 22 bp, Homo sapiens
agagggccctgctgggggctct

SEQ ID NO: 15187 - DNA, 20 bp, Homo sapiens
gaggcaggcctaaaggtcca

SEQ ID NO: 15188 - DNA, 22 bp, Homo sapiens
agagacagactttcaatctaaa

SEQ ID NO: 15189 - DNA, 19 bp, Homo sapiens
agaggcagacactggtgct

SEQ ID NO: 15190 - DNA, 18 bp, Homo sapiens
agaagcaggcttgagctc

SEQ ID NO: 15191 - DNA, 17 bp, Homo sapiens
agaggcagatatgagcc

SEQ ID NO: 15192 - DNA, 19 bp, Homo sapiens
agaggccagaccctttggg

SEQ ID NO: 15193 - DNA, 19 bp, Homo sapiens
agagccgcagggggctcta

SEQ ID NO: 15194 - DNA, 20 bp, Homo sapiens
gaggaagcccagagggctct

SEQ ID NO: 15195 - DNA, 15 bp, Homo sapiens
agaagcagaggctct

SEQ ID NO: 15196 - DNA, 18 bp, Homo sapiens
agaggcagtgcctgagct

SEQ ID NO: 15197 - DNA, 16 bp, Homo sapiens
aaaggcaggcttccaa

SEQ ID NO: 15198 - DNA, 16 bp, Homo sapiens
gaggcaaaaagaggct

SEQ ID NO: 15199 - DNA, 20 bp, Homo sapiens
gagtcagaggtcagggctct

SEQ ID NO: 15200 - DNA, 16 bp, Homo sapiens
agaggcaggaggctct

SEQ ID NO: 15201 - DNA, 18 bp, Homo sapiens
agaggcaggacttgaact

SEQ ID NO: 15202 - DNA, 18 bp, Homo sapiens
agaggcagggcctaagga

SEQ ID NO: 15203 - DNA, 19 bp, Homo sapiens
agaggtggatcaggcccca

SEQ ID NO: 15204 - DNA, 22 bp, Homo sapiens
gaggggccctcgggggctctaa

SEQ ID NO: 15205 - DNA, 17 bp, Homo sapiens
agcagacctgtagctct

SEQ ID NO: 15206 - DNA, 17 bp, Homo sapiens
agagcaataagggctct

SEQ ID NO: 15207 - DNA, 19 bp, Homo sapiens
gagggaaagcggggctcta

SEQ ID NO: 15208 - DNA, 22 bp, Homo sapiens
agggctggagcctgggctctaa

SEQ ID NO: 15209 - DNA, 15 bp, Homo sapiens
agagcaggggctcta

SEQ ID NO: 15210 - DNA, 16 bp, Homo sapiens
agagatgaagggctct

SEQ ID NO: 15211 - DNA, 20 bp, Homo sapiens
aggggtacatctaagggctc

SEQ ID NO: 15212 - DNA, 19 bp, Homo sapiens
agaggcagactcacaccct

SEQ ID NO: 15213 - DNA, 20 bp, Homo sapiens
gaggcagtgagcagggctct

SEQ ID NO: 15214 - DNA, 20 bp, Homo sapiens
agaggcagaccacagcctaa

SEQ ID NO: 15215 - DNA, 19 bp, Homo sapiens
aggaatacctaagggttct

SEQ ID NO: 15216 - DNA, 18 bp, Homo sapiens
aggggcagatctcagact

SEQ ID NO: 15217 - DNA, 19 bp, Homo sapiens
agcaggtggacgaggctct

SEQ ID NO: 15218 - DNA, 16 bp, Homo sapiens
aaaggcagtgggctct

SEQ ID NO: 15219 - DNA, 22 bp, Homo sapiens
gaggcagacctggataatctct

SEQ ID NO: 15220 - DNA, 21 bp, Homo sapiens
agaggcagactggtcactaaa

SEQ ID NO: 15221 - DNA, 23 bp, Homo sapiens
agaggcagaatttaaatagtgct

SEQ ID NO: 15222 - DNA, 18 bp, Homo sapiens
agaggcagagctggggct

SEQ ID NO: 15223 - DNA, 19 bp, Homo sapiens
agaggcagacctggggttc

SEQ ID NO: 15224 - DNA, 18 bp, Homo sapiens
aaggtggactccagctct

SEQ ID NO: 15225 - DNA, 20 bp, Homo sapiens
agaggcagacgtgggggccc

SEQ ID NO: 15226 - DNA, 16 bp, Homo sapiens
aaggcagcagggctct

SEQ ID NO: 15227 - DNA, 22 bp, Homo sapiens
gagacagaagacctggctttaa

SEQ ID NO: 15228 - DNA, 18 bp, Homo sapiens
agagacagacctggccct

SEQ ID NO: 15229 - DNA, 18 bp, Homo sapiens
agaggcagacctatgacc

SEQ ID NO: 15230 - DNA, 17 bp, Homo sapiens
agggcagacctgggttc

SEQ ID NO: 15231 - DNA, 18 bp, Homo sapiens
gagtcagacctaaatggg

SEQ ID NO: 15232 - DNA, 75 bp, Turkey adenovirus 3
gatatataaattttttatactttctggatgtggaattccttctttaatctgtgaaagtatttcacttttattatt

SEQ ID NO: 15233 - DNA, 24 bp, Turkey adenovirus 3
tttaatctgtgaaagtatttcact

SEQ ID NO: 15234 - DNA, 17 bp, Homo sapiens
tttaatctgtaagtatt

SEQ ID NO: 15235 - DNA, 20 bp, Homo sapiens
tttattctgtgaaatgcact

SEQ ID NO: 15236 - DNA, 18 bp, Homo sapiens
tgtataaagtatttcact

SEQ ID NO: 15237 - DNA, 18 bp, Homo sapiens
tctaatctgtgaggtatt

SEQ ID NO: 15238 - DNA, 22 bp, Homo sapiens
cttaatttgtgaaagccacacc

SEQ ID NO: 15239 - DNA, 21 bp, Homo sapiens
ttaagtctgtgaaagacattt

SEQ ID NO: 15240 - DNA, 23 bp, Homo sapiens
ttcagggaaaaaagtatttcact

SEQ ID NO: 15241 - DNA, 108 bp, Turkey adenovirus 3
gtgttgctaatagaatttcatcgaatgactgaatgttgtgtccgatgatgtaaaattctatgaaaattggtttaactttcagactcattatgaggttagtatgttcac

SEQ ID NO: 15242 - DNA, 24 bp, Turkey adenovirus 3
tgactgaatgttgtgtccgatgat

SEQ ID NO: 15243 - DNA, 19 bp, Homo sapiens
actgagtgtgtacgatgat

SEQ ID NO: 15244 - DNA, 21 bp, Homo sapiens
tgactgaatctttctgatgat

SEQ ID NO: 15245 - DNA, 21 bp, Homo sapiens
tgagtgaatgttggttatgat

SEQ ID NO: 15246 - DNA, 78 bp, Turkey adenovirus 3
gataaggaagagtttttttgtgttttcattttctcctataggttgaaatggtatagtttcccagaattttcttgtgtc

SEQ ID NO: 15247 - DNA, 24 bp, Turkey adenovirus 3
taaggaagagtttttttgtgtttt

SEQ ID NO: 15248 - DNA, 25 bp, Homo sapiens
agaagagtggttttttttgtgtttt

SEQ ID NO: 15249 - DNA, 17 bp, Homo sapiens
aggtaagagctgtgttt

SEQ ID NO: 15250 - DNA, 15 bp, Homo sapiens
ggaagagttttgctt

SEQ ID NO: 15251 - DNA, 17 bp, Homo sapiens
agggagagttttgctct

SEQ ID NO: 15252 - DNA, 21 bp, Homo sapiens
taaggtgagtttttgtgtttt

SEQ ID NO: 15253 - DNA, 18 bp, Homo sapiens
ggaaaaattttgtgtttt

SEQ ID NO: 15254 - DNA, 20 bp, Homo sapiens
ggagaaggcacttgtgtttt

SEQ ID NO: 15255 - DNA, 18 bp, Homo sapiens
aggggaaagtttttttat

SEQ ID NO: 15256 - DNA, 19 bp, Homo sapiens
aggaagagtttattgaatc

SEQ ID NO: 15257 - DNA, 22 bp, Homo sapiens
ggaagagttttcagactgtttt

SEQ ID NO: 15258 - DNA, 22 bp, Homo sapiens
aggaaggatctggctgtgtttt

SEQ ID NO: 15259 - DNA, 16 bp, Homo sapiens
ggaagggttttgtgtt

SEQ ID NO: 15260 - DNA, 17 bp, Homo sapiens
taaggagagttttttca

SEQ ID NO: 15261 - DNA, 124 bp, Turkey adenovirus 3
atttctcggttttctggtgttaaaattaattttgtgaagtaatctgtgagtgcaaataggatgttatttcttaattttctgaactccgtactaatgaagtttttaactttagaaaaccagaagt

SEQ ID NO: 15262 - DNA, 24 bp, Turkey adenovirus 3
tgagtgcaaataggatgttatttc

SEQ ID NO: 15263 - DNA, 18 bp, Homo sapiens
tgagtgcgtatgttattt

SEQ ID NO: 15264 - DNA, 24 bp, Homo sapiens
gagtgcaagtaggaaagctctttc

SEQ ID NO: 15265 - DNA, 21 bp, Homo sapiens
tgagtgtggtagccgtcattt

SEQ ID NO: 15266 - DNA, 21 bp, Homo sapiens
taagtgtgaaagtgttatttc

SEQ ID NO: 15267 - DNA, 18 bp, Homo sapiens
tgggtgcaataggatctt

SEQ ID NO: 15268 - DNA, 20 bp, Homo sapiens
tgactgcaaataggtacact

SEQ ID NO: 15269 - DNA, 23 bp, Homo sapiens
taagtgcaaatgaatatatattt

SEQ ID NO: 15270 - DNA, 18 bp, Homo sapiens
gtggatgggatgttattt

SEQ ID NO: 15271 - DNA, 19 bp, Homo sapiens
tggtgcaatcgtgttattt

SEQ ID NO: 15272 - DNA, 19 bp, Homo sapiens
tgagtgtaaaggaacattt

SEQ ID NO: 15273 - DNA, 107 bp, Ictalurid herpesvirus 1
gacacatggtggagtttatggagtggtctcaggagctgtcgagcagtaaaaccctgtgtctgcttttaccgaaaattgcccgagacctcaacgtccctccgttggtc

SEQ ID NO: 15274 - DNA, 24 bp, Ictalurid herpesvirus 1
tatggagtggtctcaggagctgtc

SEQ ID NO: 15275 - DNA, 16 bp, Homo sapiens
ggggtggcggagctgt

SEQ ID NO: 15276 - DNA, 16 bp, Homo sapiens
catggggtgggggctg

SEQ ID NO: 15277 - DNA, 18 bp, Homo sapiens
atggaggataggggctgt

SEQ ID NO: 15278 - DNA, 19 bp, Homo sapiens
tggagtggttatgaaggtc

SEQ ID NO: 15279 - DNA, 19 bp, Homo sapiens
tggggacccgggagctgtc

SEQ ID NO: 15280 - DNA, 19 bp, Homo sapiens
ggggtggtctcaggggagc

SEQ ID NO: 15281 - DNA, 17 bp, Homo sapiens
ggagagatgggagctgt

SEQ ID NO: 15282 - DNA, 22 bp, Homo sapiens
tatgaagtggtctcaggtggct

SEQ ID NO: 15283 - DNA, 19 bp, Homo sapiens
tggagctggtggagctgtc

SEQ ID NO: 15284 - DNA, 16 bp, Homo sapiens
tggagtggagggctgt

SEQ ID NO: 15285 - DNA, 20 bp, Homo sapiens
tatggagtggtttacaggaa

SEQ ID NO: 15286 - DNA, 22 bp, Homo sapiens
ggagactggtttcaggagctgt

SEQ ID NO: 15287 - DNA, 117 bp, Myxoma virus
taaaccaatggatgtagttcagataacacgattgtggaagtttcgccttatacggacgcgtgcatagggacaacaccactaacttatccgtacatacgtcaaacactaattggttta

SEQ ID NO: 15288 - DNA, 24 bp, Myxoma virus
tggaagtttcgccttatacggacg

SEQ ID NO: 15289 - DNA, 21 bp, Homo sapiens
tggaagtttccgccttgtcag

SEQ ID NO: 15290 - DNA, 20 bp, Homo sapiens
ggaagttttgtcttcctacg

SEQ ID NO: 15291 - DNA, 81 bp, Myxoma virus
gaggagttaatttttctacggtggcgtgtttaaactgctcaaagtataacatctttccgtaagaaaattgtttatatcctc

SEQ ID NO: 15292 - DNA, 24 bp, Myxoma virus
tctacggtggcgtgtttaaactgc

SEQ ID NO: 15293 - DNA, 17 bp, Homo sapiens
ggtggcgctaaaactgc

SEQ ID NO: 15294 - DNA, 20 bp, Homo sapiens
ggtggtgtagtcccagctgc

SEQ ID NO: 15295 - DNA, 17 bp, Homo sapiens
gtgttgtcttaaactgc

SEQ ID NO: 15296 - DNA, 17 bp, Homo sapiens
ggtagagatttaaactg

SEQ ID NO: 15297 - DNA, 106 bp, Lumpy skin disease virus
ctttttttaccaaacacaattttatttttaaaatgttttacgggttttaaaacagattccctatttaacagtatatcttcaatagaatttccacttacgaaaaaag

SEQ ID NO: 15298 - DNA, 24 bp, Lumpy skin disease virus
tttaacagtatatcttcaatagaa

SEQ ID NO: 15299 - DNA, 17 bp, Homo sapiens
acagtgccaccaataga

SEQ ID NO: 15300 - DNA, 21 bp, Homo sapiens
cttagaagccatcttcaatag

SEQ ID NO: 15301 - DNA, 18 bp, Homo sapiens
tttaatgatatatcttca

SEQ ID NO: 15302 - DNA, 20 bp, Homo sapiens
aacagtaacccccaatagaa

SEQ ID NO: 15303 - DNA, 22 bp, Homo sapiens
tttaacagagctctcaatggaa

SEQ ID NO: 15304 - DNA, 22 bp, Homo sapiens
tttaacaatataaacaatagaa

SEQ ID NO: 15305 - DNA, 21 bp, Homo sapiens
tttaacagtatgaccaaagaa

SEQ ID NO: 15306 - DNA, 18 bp, Homo sapiens
tttaacagtcacaataga

SEQ ID NO: 15307 - DNA, 18 bp, Homo sapiens
tttatcagtatattttca

SEQ ID NO: 15308 - DNA, 17 bp, Homo sapiens
cagatgtcttcaataga

SEQ ID NO: 15309 - DNA, 65 bp, Gallid herpesvirus 3
gcacggactctcgtcgtagcacgttcaaatcggtttattaaagccctcatgctcagactccgtgt

SEQ ID NO: 15310 - DNA, 24 bp, Gallid herpesvirus 3
actctcgtcgtagcacgttcaaat

SEQ ID NO: 15311 - DNA, 20 bp, Homo sapiens
tctcttgcacatgttcaaat

SEQ ID NO: 15312 - DNA, 18 bp, Homo sapiens
accctctgcatgttcaaa

SEQ ID NO: 15313 - DNA, 22 bp, Homo sapiens
ctacgatgtagtgtgttcaaat

SEQ ID NO: 15314 - DNA, 17 bp, Homo sapiens
tctcgctagtgttcaaa

SEQ ID NO: 15315 - DNA, 19 bp, Homo sapiens
actctttccaaacgttcaa

SEQ ID NO: 15316 - DNA, 83 bp, Gallid herpesvirus 3
ctgtaccccaccccccttctaaataaatttccgatccctggaggtttccggagtatttgtcccaggagcggggtcctatgcag

SEQ ID NO: 15317 - DNA, 24 bp, Gallid herpesvirus 3
tttgtcccaggagcggggtcctat

SEQ ID NO: 15318 - DNA, 16 bp, Homo sapiens
tttatcctgggatcct

SEQ ID NO: 15319 - DNA, 18 bp, Homo sapiens
cttgtcccgggagcccct

SEQ ID NO: 15320 - DNA, 16 bp, Homo sapiens
tctgtcccggggtcct

SEQ ID NO: 15321 - DNA, 22 bp, Homo sapiens
tttgtcccatgggtaatactat

SEQ ID NO: 15322 - DNA, 19 bp, Homo sapiens
tttgcttaggaaagtccta

SEQ ID NO: 15323 - DNA, 22 bp, Homo sapiens
tttgtcccagggagatgagggt

SEQ ID NO: 15324 - DNA, 24 bp, Homo sapiens
tttgtgtttaggctcgggtcctat

SEQ ID NO: 15325 - DNA, 18 bp, Homo sapiens
tttgtcccagggagacct

SEQ ID NO: 15326 - DNA, 65 bp, Fowl adenovirus A
ttcgtgagctctttttacgactacggggctatggagcccggtagttacttggacaatatcatgag

SEQ ID NO: 15327 - DNA, 24 bp, Fowl adenovirus A
cccggtagttacttggacaatatc

SEQ ID NO: 15328 - DNA, 16 bp, Homo sapiens
cccagtaggggacaat

SEQ ID NO: 15329 - DNA, 21 bp, Homo sapiens
cctcaatacttggatgatatc

SEQ ID NO: 15330 - DNA, 18 bp, Homo sapiens
gataaacttggacagtat

SEQ ID NO: 15331 - DNA, 18 bp, Homo sapiens
gtctcacttgggcagtat

SEQ ID NO: 15332 - DNA, 20 bp, Homo sapiens
ccaggtagttacttttgcca

SEQ ID NO: 15333 - DNA, 90 bp, Ictalurid herpesvirus 1
attgtcaccgtcgatgtgttgctggtgtcgacggtcgtgaacttgacaccgggccgttttattaaagatagcacatcgtttattgacagt

SEQ ID NO: 15334 - DNA, 22 bp, Ictalurid herpesvirus 1
tagcacatcgtttattgacagt

SEQ ID NO: 15335 - DNA, 16 bp, Homo sapiens
tagcacattattgcag

SEQ ID NO: 15336 - DNA, 18 bp, Homo sapiens
gccattattattgacagt

SEQ ID NO: 15337 - DNA, 16 bp, Homo sapiens
gcacatcgttctgcag

SEQ ID NO: 15338 - DNA, 18 bp, Homo sapiens
gcatgtgttcactgcagt

SEQ ID NO: 15339 - DNA, 19 bp, Homo sapiens
gctgtcaattattgacagt

SEQ ID NO: 15340 - DNA, 21 bp, Homo sapiens
tagcacatcagtgtaaacagt

SEQ ID NO: 15341 - DNA, 17 bp, Homo sapiens
tagcatagccctgacag

SEQ ID NO: 15342 - DNA, 17 bp, Homo sapiens
gcacatcatttgacagt

SEQ ID NO: 15343 - DNA, 16 bp, Homo sapiens
gcagtccattgacagt

SEQ ID NO: 15344 - DNA, 21 bp, Homo sapiens
tagcaacagtaggttgacagt

SEQ ID NO: 15345 - DNA, 20 bp, Homo sapiens
cagcatatttggttgacagt

SEQ ID NO: 15346 - DNA, 19 bp, Homo sapiens
catcgttcacccgatcagt

SEQ ID NO: 15347 - DNA, 20 bp, Homo sapiens
tagcaattgtttactgaagt

SEQ ID NO: 15348 - DNA, 19 bp, Homo sapiens
taacacatcagatgatagt

SEQ ID NO: 15349 - DNA, 21 bp, Homo sapiens
cagcacatcacaggtgacagt

SEQ ID NO: 15350 - DNA, 17 bp, Homo sapiens
tagcatatcatctacag

SEQ ID NO: 15351 - DNA, 87 bp, Fowl adenovirus A
tcgatgattctttgttcgcaccaggtcctcagcgccgcttaaattcggccgaggaggctcaattggagcgtgacatcgaatctttga

SEQ ID NO: 15352 - DNA, 24 bp, Fowl adenovirus A
caccaggtcctcagcgccgcttaa

SEQ ID NO: 15353 - DNA, 17 bp, Homo sapiens
accgggtcccagcgccg

SEQ ID NO: 15354 - DNA, 17 bp, Homo sapiens
caccagtcctcagtcca

SEQ ID NO: 15355 - DNA, 20 bp, Homo sapiens
caccaggctttcagtgggct

SEQ ID NO: 15356 - DNA, 24 bp, Homo sapiens
caccaggcttctcagctatggctt

SEQ ID NO: 15357 - DNA, 21 bp, Homo sapiens
caccaggtcccagccccactt

SEQ ID NO: 15358 - DNA, 16 bp, Homo sapiens
caggtcctagtgctta

SEQ ID NO: 15359 - DNA, 17 bp, Homo sapiens
ccggtcctcaggcgctt

SEQ ID NO: 15360 - DNA, 15 bp, Homo sapiens
caccaggtcctgctt

SEQ ID NO: 15361 - DNA, 17 bp, Homo sapiens
ccaggtccttaagctta

SEQ ID NO: 15362 - DNA, 19 bp, Homo sapiens
caggcctcagcatcatctt

SEQ ID NO: 15363 - DNA, 19 bp, Homo sapiens
caccaggtccttgggccca

SEQ ID NO: 15364 - DNA, 20 bp, Homo sapiens
caccaggcactctgctgctt

SEQ ID NO: 15365 - DNA, 18 bp, Homo sapiens
caccacggtcttcagtgc

SEQ ID NO: 15366 - DNA, 19 bp, Homo sapiens
ccaggtccgcggccgttaa

SEQ ID NO: 15367 - DNA, 23 bp, Homo sapiens
cactgggtccccagcacagtctt

SEQ ID NO: 15368 - DNA, 23 bp, Homo sapiens
caccaggtgccttggctgccctt

SEQ ID NO: 15369 - DNA, 18 bp, Homo sapiens
ccaggtcctcaggccgct

SEQ ID NO: 15370 - DNA, 80 bp, Fowl adenovirus A
ccccccgattcccacatgcgtagccgttctagctccgtcgctagcgatcttgggctattgaacctatctgggacgggggg

SEQ ID NO: 15371 - DNA, 24 bp, Fowl adenovirus A
tagccgttctagctccgtcgctag

SEQ ID NO: 15372 - DNA, 19 bp, Homo sapiens
gccgctctgcagaatcgct

SEQ ID NO: 15373 - DNA, 22 bp, Homo sapiens
tagttgctctagctcaggggct

SEQ ID NO: 15374 - DNA, 18 bp, Homo sapiens
tagctgttctgcctcacc

SEQ ID NO: 15375 - DNA, 73 bp, Ateline herpesvirus 3
aggtaacccagaactgaaaaaaagatatagtgaaggactagatttagcaatttcaatgtctgaaaatatacct

SEQ ID NO: 15376 - DNA, 24 bp, Ateline herpesvirus 3
tgaaaaaaagatatagtgaaggac

SEQ ID NO: 15377 - DNA, 22 bp, Homo sapiens
tgaaaaagaaatagcaacggga

SEQ ID NO: 15378 - DNA, 28 bp, Homo sapiens
taaaaggaggatataactgtctgaagga

SEQ ID NO: 15379 - DNA, 24 bp, Homo sapiens
tgaaaaggaggaggtttgaaggac

SEQ ID NO: 15380 - DNA, 18 bp, Homo sapiens
gagcaaaggcagtgaagg

SEQ ID NO: 15381 - DNA, 21 bp, Homo sapiens
tgggaaaaaaataaagaagga

SEQ ID NO: 15382 - DNA, 16 bp, Homo sapiens
aaaaaagaagagaagg

SEQ ID NO: 15383 - DNA, 20 bp, Homo sapiens
tgaaaaaggatacatgagga

SEQ ID NO: 15384 - DNA, 21 bp, Homo sapiens
tgaaataaaagaccgagggac

SEQ ID NO: 15385 - DNA, 20 bp, Homo sapiens
tgaaaaaaagatatgcaaaa

SEQ ID NO: 15386 - DNA, 19 bp, Homo sapiens
gaaaaaaagatgtagcaaa

SEQ ID NO: 15387 - DNA, 19 bp, Homo sapiens
tgaaaaaaagatgcaatga

SEQ ID NO: 15388 - DNA, 23 bp, Homo sapiens
tgaaagaaagattggtgagcagg

SEQ ID NO: 15389 - DNA, 21 bp, Homo sapiens
tgaaaaaaaaaaagtgaagga

SEQ ID NO: 15390 - DNA, 20 bp, Homo sapiens
tgaaagaaagcatgtgcagg

SEQ ID NO: 15391 - DNA, 21 bp, Homo sapiens
gaaaaaaatagcaagcgaggg

SEQ ID NO: 15392 - DNA, 19 bp, Homo sapiens
aaaagatggtgagtgaagg

SEQ ID NO: 15393 - DNA, 20 bp, Homo sapiens
tggcaaaaagatgatgaaag

SEQ ID NO: 15394 - DNA, 21 bp, Homo sapiens
taaaagaaagacggtggagga

SEQ ID NO: 15395 - DNA, 23 bp, Homo sapiens
tgaacaaaagaccacagggggac

SEQ ID NO: 15396 - DNA, 18 bp, Homo sapiens
aaaaaaatacaaacagga

SEQ ID NO: 15397 - DNA, 17 bp, Homo sapiens
aaaaaaagaagggaagg

SEQ ID NO: 15398 - DNA, 22 bp, Homo sapiens
tgaaaaaaaggagtgatatagg

SEQ ID NO: 15399 - DNA, 16 bp, Homo sapiens
tgaaaaaaaatcaagg

SEQ ID NO: 15400 - DNA, 19 bp, Homo sapiens
tggaaaaaagattagtgaa

SEQ ID NO: 15401 - DNA, 17 bp, Homo sapiens
aaaaaatgggtgaagga

SEQ ID NO: 15402 - DNA, 20 bp, Homo sapiens
aaggcacagtggtgaaggac

SEQ ID NO: 15403 - DNA, 19 bp, Homo sapiens
tgaaaaaagtacaagaagg

SEQ ID NO: 15404 - DNA, 15 bp, Homo sapiens
gaaaaaaagagaagg

SEQ ID NO: 15405 - DNA, 23 bp, Homo sapiens
aaaaaaggatatccttaaaggac

SEQ ID NO: 15406 - DNA, 22 bp, Homo sapiens
gaaaaaaagatgcctgggggac

SEQ ID NO: 15407 - DNA, 20 bp, Homo sapiens
tgaaggcaagatataaaagg

SEQ ID NO: 15408 - DNA, 16 bp, Homo sapiens
aaaaagatacaaagga

SEQ ID NO: 15409 - DNA, 18 bp, Homo sapiens
gaaaaaggagagtgaagg

SEQ ID NO: 15410 - DNA, 21 bp, Homo sapiens
tgaaaagggagtcagcgaagg

SEQ ID NO: 15411 - DNA, 22 bp, Homo sapiens
tgacaaaaagacttcagaagga

SEQ ID NO: 15412 - DNA, 17 bp, Homo sapiens
aaaaaaaggaatgaagg

SEQ ID NO: 15413 - DNA, 23 bp, Homo sapiens
tgagggcagagatcctgaaggac

SEQ ID NO: 15414 - DNA, 22 bp, Homo sapiens
tgagagtgaagatctcgaagga

SEQ ID NO: 15415 - DNA, 24 bp, Homo sapiens
tgaaaaaaaaataaccgataagga

SEQ ID NO: 15416 - DNA, 22 bp, Homo sapiens
gaaagaagacataccttaggac

SEQ ID NO: 15417 - DNA, 20 bp, Homo sapiens
tgaagtaaagatatagccaa

SEQ ID NO: 15418 - DNA, 20 bp, Homo sapiens
gaaaaagggatgtgaaggac

SEQ ID NO: 15419 - DNA, 23 bp, Homo sapiens
tgaaagcaaagatatataactgg

SEQ ID NO: 15420 - DNA, 18 bp, Homo sapiens
tgagaaatatgtgaagga

SEQ ID NO: 15421 - DNA, 19 bp, Homo sapiens
tgaataagaaggtaaagga

SEQ ID NO: 15422 - DNA, 19 bp, Homo sapiens
aaaaaagatacacaccagg

SEQ ID NO: 15423 - DNA, 18 bp, Homo sapiens
aagatgccagtgaaggac

SEQ ID NO: 15424 - DNA, 20 bp, Homo sapiens
aaaaaaaggtatggtgaaaa

SEQ ID NO: 15425 - DNA, 18 bp, Homo sapiens
tgaaaaagaataggaagg

SEQ ID NO: 15426 - DNA, 19 bp, Homo sapiens
gaaaaaaagatgtgaaaga

SEQ ID NO: 15427 - DNA, 81 bp, Sheeppox virus
cgtaatatagatgtttgtctaatttagtaaaatcaagagaataaattaatccttttctttttaatacccacatcatattcg

SEQ ID NO: 15428 - DNA, 24 bp, Sheeppox virus
tagatgtttgtctaatttagtaaa

SEQ ID NO: 15429 - DNA, 18 bp, Homo sapiens
taggtgttctgtctaatc

SEQ ID NO: 15430 - DNA, 19 bp, Homo sapiens
gatgtttgtacttttagta

SEQ ID NO: 15431 - DNA, 20 bp, Homo sapiens
aatgtttgtctgattttata

SEQ ID NO: 15432 - DNA, 22 bp, Homo sapiens
agatgtttgtttagttcaagta

SEQ ID NO: 15433 - DNA, 19 bp, Homo sapiens
aatgtttgtgtttttagta

SEQ ID NO: 15434 - DNA, 27 bp, Homo sapiens
taaatgtttgtttaggaacttagtaaa

SEQ ID NO: 15435 - DNA, 20 bp, Homo sapiens
tagatgtctgtttagactaa

SEQ ID NO: 15436 - DNA, 23 bp, Homo sapiens
tagaagttcagaaatttagtaaa

SEQ ID NO: 15437 - DNA, 19 bp, Homo sapiens
aatgtttgcatttttagta

SEQ ID NO: 15438 - DNA, 19 bp, Homo sapiens
aatgtttgtatttttagta

SEQ ID NO: 15439 - DNA, 19 bp, Homo sapiens
gattttgtccattctagta

SEQ ID NO: 15440 - DNA, 19 bp, Homo sapiens
tagagtatctgatttagta

SEQ ID NO: 15441 - DNA, 21 bp, Homo sapiens
gtttgtcctttaatttggtaa

SEQ ID NO: 15442 - DNA, 21 bp, Homo sapiens
tagatggttacttttagtaaa

SEQ ID NO: 15443 - DNA, 60 bp, Ateline herpesvirus 3
aaagctagaaaccgtgcctccatatttagtatatgatacagaagaatggaaattagcttt

SEQ ID NO: 15444 - DNA, 24 bp, Ateline herpesvirus 3
tacagaagaatggaaattagcttt

SEQ ID NO: 15445 - DNA, 26 bp, Homo sapiens
cagaagaaatggaaggattcagcttt

SEQ ID NO: 15446 - DNA, 18 bp, Homo sapiens
tacggaagaatggtgatt

SEQ ID NO: 15447 - DNA, 21 bp, Homo sapiens
tacagaattcagattagcttt

SEQ ID NO: 15448 - DNA, 18 bp, Homo sapiens
gaacatggagttagcttt

SEQ ID NO: 15449 - DNA, 19 bp, Homo sapiens
cagaagaatagatggcttt

SEQ ID NO: 15450 - DNA, 18 bp, Homo sapiens
gaaaaataggttagcttt

SEQ ID NO: 15451 - DNA, 19 bp, Homo sapiens
cagaagaagccttagcttt

SEQ ID NO: 15452 - DNA, 18 bp, Homo sapiens
taagaagaatggcagctt

SEQ ID NO: 15453 - DNA, 22 bp, Homo sapiens
tacagaagaaaggaaacgtctt

SEQ ID NO: 15454 - DNA, 21 bp, Homo sapiens
tacagaagaaacattggcttt

SEQ ID NO: 15455 - DNA, 18 bp, Homo sapiens
cagaagaatgcaaatgct

SEQ ID NO: 15456 - DNA, 20 bp, Homo sapiens
tacagacgaatggaaatgag

SEQ ID NO: 15457 - DNA, 18 bp, Homo sapiens
aagaatgatactagcttt

SEQ ID NO: 15458 - DNA, 21 bp, Homo sapiens
tacagaaaaaaaattggcttt

SEQ ID NO: 15459 - DNA, 22 bp, Homo sapiens
cacaggagaatggaaacatctt

SEQ ID NO: 15460 - DNA, 21 bp, Homo sapiens
gaagaacggaaaacatacttt

SEQ ID NO: 15461 - DNA, 17 bp, Homo sapiens
agaagaattgaataact

SEQ ID NO: 15462 - DNA, 23 bp, Homo sapiens
tacagaggaatggaagtgtcctt

SEQ ID NO: 15463 - DNA, 21 bp, Homo sapiens
tacagaaggtggagggaactt

SEQ ID NO: 15464 - DNA, 71 bp, Ateline herpesvirus 3
acagaataaaagaagcagtcgaggagttaaagcaaattgatttaccggttgcccatctgtctaatttctgt

SEQ ID NO: 15465 - DNA, 24 bp, Ateline herpesvirus 3
tttaccggttgcccatctgtctaa

SEQ ID NO: 15466 - DNA, 16 bp, Homo sapiens
tttaccagttgtctgt

SEQ ID NO: 15467 - DNA, 17 bp, Homo sapiens
tttactgttgcccatcc

SEQ ID NO: 15468 - DNA, 66 bp, Sheeppox virus
tttcatttctaaaataatattcgttttctaattcttttatatggtcattaattttagaaatcgaaa

SEQ ID NO: 15469 - DNA, 24 bp, Sheeppox virus
tctaaaataatattcgttttctaa

SEQ ID NO: 15470 - DNA, 20 bp, Homo sapiens
ctaaaataatatctaactct

SEQ ID NO: 15471 - DNA, 19 bp, Homo sapiens
taaaataatactcacatct

SEQ ID NO: 15472 - DNA, 20 bp, Homo sapiens
tctaaaatattatccctttt

SEQ ID NO: 15473 - DNA, 23 bp, Homo sapiens
tctagaatcagttcattttctaa

SEQ ID NO: 15474 - DNA, 21 bp, Homo sapiens
tctaaaatactattcccccta

SEQ ID NO: 15475 - DNA, 23 bp, Homo sapiens
tctaaaatgaataaagttttcta

SEQ ID NO: 15476 - DNA, 19 bp, Homo sapiens
tctgcaataatattcattt

SEQ ID NO: 15477 - DNA, 18 bp, Homo sapiens
tctaaaataatttttcta

SEQ ID NO: 15478 - DNA, 17 bp, Homo sapiens
tctaaaatagttttcta

SEQ ID NO: 15479 - DNA, 20 bp, Homo sapiens
tctaaaacaatattttcttt

SEQ ID NO: 15480 - DNA, 127 bp, Bovine herpesvirus 1
ggggggcggcagcgccgacgtcgtgccctttgtcgaagaggccgccgccgcgctggccatcgaccggccctgcgccgtgtgtcgcacgattgatgcttaccggcgcgagttcgggctggcgcccccc

SEQ ID NO: 15481 - DNA, 24 bp, Bovine herpesvirus 1
tcgaagaggccgccgccgcgctgg

SEQ ID NO: 15482 - DNA, 20 bp, Homo sapiens
tcaggaggccgcccgcctgg

SEQ ID NO: 15483 - DNA, 24 bp, Homo sapiens
ccgccgccgccgccgccgcgctgg

SEQ ID NO: 15484 - DNA, 20 bp, Homo sapiens
gaagaggcgaggcgcgctgg

SEQ ID NO: 15485 - DNA, 19 bp, Homo sapiens
ggcgggggccgcgcgctgg

SEQ ID NO: 15486 - DNA, 16 bp, Homo sapiens
aagaggcggcgcgctg

SEQ ID NO: 15487 - DNA, 16 bp, Homo sapiens
gaagaggctgcggctg

SEQ ID NO: 15488 - DNA, 19 bp, Homo sapiens
ccggggaggactcgcgctg

SEQ ID NO: 15489 - DNA, 16 bp, Homo sapiens
gaggaggccggcgctg

SEQ ID NO: 15490 - DNA, 20 bp, Homo sapiens
agaggccagctgcctgctgg

SEQ ID NO: 15491 - DNA, 22 bp, Homo sapiens
tcggaaggcctgcccgcgctgg

SEQ ID NO: 15492 - DNA, 22 bp, Homo sapiens
gagggggccgccaggaggctgg

SEQ ID NO: 15493 - DNA, 19 bp, Homo sapiens
tcgggggcgccgccgcccg

SEQ ID NO: 15494 - DNA, 61 bp, Swinepox virus
ttgtaatatagacatataaatctcttcattaagtgattgtaacatagtatctatattataa

SEQ ID NO: 15495 - DNA, 24 bp, Swinepox virus
tgattgtaacatagtatctatatt

SEQ ID NO: 15496 - DNA, 21 bp, Homo sapiens
attgtaacacaacactatatt

SEQ ID NO: 15497 - DNA, 19 bp, Homo sapiens
tgactgtagcagtctatat

SEQ ID NO: 15498 - DNA, 63 bp, Swinepox virus
aatctattagatgatatatttcgtataaacacataatggataaaatattatctaatgtagatt

SEQ ID NO: 15499 - DNA, 24 bp, Swinepox virus
tattagatgatatatttcgtataa

SEQ ID NO: 15500 - DNA, 26 bp, Homo sapiens
tattagatgaatatatacccatataa

SEQ ID NO: 15501 - DNA, 21 bp, Homo sapiens
tattagatgttatatacagta

SEQ ID NO: 15502 - DNA, 17 bp, Homo sapiens
tattaatgatatatttc

SEQ ID NO: 15503 - DNA, 68 bp, Paramecium bursaria Chlorella virus 1
gtaggtgcttttcagacatccggtgcagattatgcagaaatgatggaatgggaagataagaatcctac

SEQ ID NO: 15504 - DNA, 24 bp, Paramecium bursaria Chlorella virus 1
tggaatgggaagataagaatccta

SEQ ID NO: 15505 - DNA, 18 bp, Homo sapiens
tgagatgggaaaattaag

SEQ ID NO: 15506 - DNA, 21 bp, Homo sapiens
tggggtaggaatagggatcct

SEQ ID NO: 15507 - DNA, 22 bp, Homo sapiens
ggaatgggctgcagagaatcct

SEQ ID NO: 15508 - DNA, 19 bp, Homo sapiens
tggaatggggcgatagcct

SEQ ID NO: 15509 - DNA, 20 bp, Homo sapiens
aaaatggggataagaatcct

SEQ ID NO: 15510 - DNA, 20 bp, Homo sapiens
tgggatgggaagatcggtcc

SEQ ID NO: 15511 - DNA, 21 bp, Homo sapiens
ggaatggggcataagagtcct

SEQ ID NO: 15512 - DNA, 20 bp, Homo sapiens
ggaatgggggactcaggttc

SEQ ID NO: 15513 - DNA, 18 bp, Homo sapiens
tggggtgggaaggaacct

SEQ ID NO: 15514 - DNA, 25 bp, Homo sapiens
gggatgggaagctgatgggatccta

SEQ ID NO: 15515 - DNA, 23 bp, Homo sapiens
ggagtaagatggtaagaattcta

SEQ ID NO: 15516 - DNA, 19 bp, Homo sapiens
ggaagggaggatgacgaac

SEQ ID NO: 15517 - DNA, 19 bp, Homo sapiens
tggagtgggaagagtgcct

SEQ ID NO: 15518 - DNA, 17 bp, Homo sapiens
tggagtgggaagaaatc

SEQ ID NO: 15519 - DNA, 19 bp, Homo sapiens
tggaatagggaagatgaaa

SEQ ID NO: 15520 - DNA, 18 bp, Homo sapiens
tgggatgggaaggaaatc

SEQ ID NO: 15521 - DNA, 21 bp, Homo sapiens
ggggtggggacaagaattcta

SEQ ID NO: 15522 - DNA, 21 bp, Homo sapiens
tggaatggcagggccatccta

SEQ ID NO: 15523 - DNA, 20 bp, Homo sapiens
tggggtgggaagaaaggcct

SEQ ID NO: 15524 - DNA, 17 bp, Homo sapiens
gagtgggaagatgacct

SEQ ID NO: 15525 - DNA, 19 bp, Homo sapiens
tgggagggaagacaatcct

SEQ ID NO: 15526 - DNA, 22 bp, Homo sapiens
tgggacggggtctcagaatcct

SEQ ID NO: 15527 - DNA, 21 bp, Homo sapiens
gaatgggatgtgaggatccta

SEQ ID NO: 15528 - DNA, 18 bp, Homo sapiens
tggtgtggagagaatcct

SEQ ID NO: 15529 - DNA, 18 bp, Homo sapiens
tggggtggggagaatccc

SEQ ID NO: 15530 - DNA, 19 bp, Homo sapiens
tgaagtgggaagattacct

SEQ ID NO: 15531 - DNA, 19 bp, Homo sapiens
ggagggggctagaatccta

SEQ ID NO: 15532 - DNA, 24 bp, Homo sapiens
tgaaatggggagaggagaatccta

SEQ ID NO: 15533 - DNA, 21 bp, Homo sapiens
tggggcgggaatgaaatccta

SEQ ID NO: 15534 - DNA, 18 bp, Homo sapiens
tggggtgggaagatgtcc

SEQ ID NO: 15535 - DNA, 24 bp, Homo sapiens
tggaggtgggaagatacaactcct

SEQ ID NO: 15536 - DNA, 79 bp, Paramecium bursaria Chlorella virus 1
agaatgaatttacacgtgtaggtcctatgacaactcctccccaaggatatttcataaagacttcgccagagtatatttt

SEQ ID NO: 15537 - DNA, 24 bp, Paramecium bursaria Chlorella virus 1
cacgtgtaggtcctatgacaactc

SEQ ID NO: 15538 - DNA, 18 bp, Homo sapiens
gtgcaggtgggacagctc

SEQ ID NO: 15539 - DNA, 23 bp, Homo sapiens
gtgtaggtcccatacgtatgaca

SEQ ID NO: 15540 - DNA, 18 bp, Homo sapiens
gtgtgtgtcctataaaca

SEQ ID NO: 15541 - DNA, 18 bp, Homo sapiens
cactgtagcgtgacaact

SEQ ID NO: 15542 - DNA, 21 bp, Homo sapiens
cacggtaggcccagacggctc

SEQ ID NO: 15543 - DNA, 25 bp, Homo sapiens
cacgtggggtgatccctggtggctc

SEQ ID NO: 15544 - DNA, 18 bp, Homo sapiens
atgtaggtccatacaact

SEQ ID NO: 15545 - DNA, 22 bp, Homo sapiens
cgtgtgaggtgagtgacaactc

SEQ ID NO: 15546 - DNA, 20 bp, Homo sapiens
gtgtaagttgcataatgact

SEQ ID NO: 15547 - DNA, 22 bp, Homo sapiens
cactgtaggtcctgcatgaact

SEQ ID NO: 15548 - DNA, 64 bp, Porcine adenovirus C
ggaactgtcaaaaattctcaagagacacaagaggagtctctggtcaggatttgacgaaaggacc

SEQ ID NO: 15549 - DNA, 21 bp, Porcine adenovirus C
tcaggatttgacgaaaggacc

SEQ ID NO: 15550 - DNA, 17 bp, Homo sapiens
caggatcccaggaggac

SEQ ID NO: 15551 - DNA, 18 bp, Homo sapiens
tcaggatttgcagcagac

SEQ ID NO: 15552 - DNA, 18 bp, Homo sapiens
tcaggtaatgaaaaggac

SEQ ID NO: 15553 - DNA, 17 bp, Homo sapiens
tcaggatttgagagtgg

SEQ ID NO: 15554 - DNA, 16 bp, Homo sapiens
aggatctagaaaggac

SEQ ID NO: 15555 - DNA, 18 bp, Homo sapiens
tcaggattagaaatggac

SEQ ID NO: 15556 - DNA, 18 bp, Homo sapiens
ggggctgacaaagggacc

SEQ ID NO: 15557 - DNA, 16 bp, Homo sapiens
tcagaacctggaaagg

SEQ ID NO: 15558 - DNA, 20 bp, Homo sapiens
tcaggatttgaacccagacc

SEQ ID NO: 15559 - DNA, 16 bp, Homo sapiens
tcaggattgaaaagga

SEQ ID NO: 15560 - DNA, 16 bp, Homo sapiens
tcaagattactaaagg

SEQ ID NO: 15561 - DNA, 20 bp, Homo sapiens
tcaggatcttgaaatcagga

SEQ ID NO: 15562 - DNA, 18 bp, Homo sapiens
tcagaatttggtggaaaa

SEQ ID NO: 15563 - DNA, 20 bp, Homo sapiens
tcaggatttgcacagagacc

SEQ ID NO: 15564 - DNA, 19 bp, Homo sapiens
tcagaagcaggaaaggacc

SEQ ID NO: 15565 - DNA, 18 bp, Homo sapiens
tcaggatttactacagac

SEQ ID NO: 15566 - DNA, 19 bp, Homo sapiens
tcaggatttgagtggaaaa

SEQ ID NO: 15567 - DNA, 16 bp, Homo sapiens
aggaatggaaaggacc

SEQ ID NO: 15568 - DNA, 17 bp, Homo sapiens
aggacttggagaggacc

SEQ ID NO: 15569 - DNA, 17 bp, Homo sapiens
tcagaattcacagagga

SEQ ID NO: 15570 - DNA, 21 bp, Homo sapiens
tcaggatttcggtgatgggcc

SEQ ID NO: 15571 - DNA, 17 bp, Homo sapiens
ggatccctcaaaggacc

SEQ ID NO: 15572 - DNA, 20 bp, Homo sapiens
tcaggatttacccccaagcc

SEQ ID NO: 15573 - DNA, 18 bp, Homo sapiens
caggatttgatgacagaa

SEQ ID NO: 15574 - DNA, 21 bp, Homo sapiens
tcaggatttacgggaggcgcc

SEQ ID NO: 15575 - DNA, 19 bp, Homo sapiens
aggatttgagcggagggac

SEQ ID NO: 15576 - DNA, 19 bp, Homo sapiens
ggagccagatgaaaggacc

SEQ ID NO: 15577 - DNA, 19 bp, Homo sapiens
ggatttgatgaaagatacc

SEQ ID NO: 15578 - DNA, 17 bp, Homo sapiens
tcaggacttgagatgac

SEQ ID NO: 15579 - DNA, 19 bp, Homo sapiens
tcagcattatcaaaaggac

SEQ ID NO: 15580 - DNA, 23 bp, Homo sapiens
tcaggatcttcacaatggggacc

SEQ ID NO: 15581 - DNA, 19 bp, Homo sapiens
tcaagaatgtgaaaggacc

SEQ ID NO: 15582 - DNA, 15 bp, Homo sapiens
tcagaattaaaggac

SEQ ID NO: 15583 - DNA, 21 bp, Homo sapiens
ccaggaatccctgaaaggacc

SEQ ID NO: 15584 - DNA, 16 bp, Homo sapiens
caggctgtgaaaggac

SEQ ID NO: 15585 - DNA, 17 bp, Homo sapiens
tcagcaatgaaaggacc

SEQ ID NO: 15586 - DNA, 16 bp, Homo sapiens
aggtttgacaacagac

SEQ ID NO: 15587 - DNA, 17 bp, Homo sapiens
tcaagatacaagaagga

SEQ ID NO: 15588 - DNA, 19 bp, Homo sapiens
caggatttatactcaggac

SEQ ID NO: 15589 - DNA, 20 bp, Homo sapiens
tcagggtttggtgaaaagac

SEQ ID NO: 15590 - DNA, 17 bp, Homo sapiens
tcagggtggaaaggacc

SEQ ID NO: 15591 - DNA, 16 bp, Homo sapiens
tcaggactgtgaggac

SEQ ID NO: 15592 - DNA, 17 bp, Homo sapiens
tcagattttaaaaggac

SEQ ID NO: 15593 - DNA, 17 bp, Homo sapiens
tcaggatcaagaaggac

SEQ ID NO: 15594 - DNA, 19 bp, Homo sapiens
ccaggatccacaagggacc

SEQ ID NO: 15595 - DNA, 19 bp, Homo sapiens
ccaggcactcggaagggcc

SEQ ID NO: 15596 - DNA, 19 bp, Homo sapiens
tcaggagttccaaaggacc

SEQ ID NO: 15597 - DNA, 18 bp, Homo sapiens
tcaggatcttccatagga

SEQ ID NO: 15598 - DNA, 15 bp, Homo sapiens
ggatttaacaggacc

SEQ ID NO: 15599 - DNA, 21 bp, Homo sapiens
tcaggatttcaacattcagga

SEQ ID NO: 15600 - DNA, 19 bp, Homo sapiens
tcaggattggacctgggac

SEQ ID NO: 15601 - DNA, 18 bp, Homo sapiens
tcaggatttcacgtgagg

SEQ ID NO: 15602 - DNA, 18 bp, Homo sapiens
agacctgatgagagggcc

SEQ ID NO: 15603 - DNA, 16 bp, Homo sapiens
aggatttgactaggcc

SEQ ID NO: 15604 - DNA, 18 bp, Homo sapiens
tcagggggttgagaggac

SEQ ID NO: 15605 - DNA, 130 bp, Infectious spleen and kidney necrosis virus
ctgtctgatggtgccgctaccctagacgtgtttgtccgccctatcatggctatagacgtcttgacatggtccggcctcttcaccgtgttgcggctcaccacgccgggtgcactgtggcccgtcgcaacgg

SEQ ID NO: 15606 - DNA, 24 bp, Infectious spleen and kidney necrosis virus
caccgtgttgcggctcaccacgcc

SEQ ID NO: 15607 - DNA, 21 bp, Homo sapiens
gctgggcccggctcactgcgc

SEQ ID NO: 15608 - DNA, 18 bp, Homo sapiens
cctgtgttgtccccgcgc

SEQ ID NO: 15609 - DNA, 15 bp, Homo sapiens
caccatgtttcacca

SEQ ID NO: 15610 - DNA, 19 bp, Homo sapiens
cacagtgttacacaccgcg

SEQ ID NO: 15611 - DNA, 17 bp, Homo sapiens
caccctgtttcaccacg

SEQ ID NO: 15612 - DNA, 16 bp, Homo sapiens
caccatgttgaccacg

SEQ ID NO: 15613 - DNA, 19 bp, Homo sapiens
caccgtgctgccctcgtgc

SEQ ID NO: 15614 - DNA, 20 bp, Homo sapiens
caccgagctacctcgccgcg

SEQ ID NO: 15615 - DNA, 18 bp, Homo sapiens
acctgtctttcaccatgc

SEQ ID NO: 15616 - DNA, 22 bp, Homo sapiens
ccatttagcggctcattgtgcc

SEQ ID NO: 15617 - DNA, 20 bp, Homo sapiens
gctgatgggctcaccgcgcc

SEQ ID NO: 15618 - DNA, 22 bp, Homo sapiens
ccgcgctctcgctcgctgcgcc

SEQ ID NO: 15619 - DNA, 27 bp, Homo sapiens
caccgtgtgcttgcgctggcgtggtgg

SEQ ID NO: 15620 - DNA, 20 bp, Homo sapiens
ccggccacggctcaccacgc

SEQ ID NO: 15621 - DNA, 23 bp, Homo sapiens
caacagactgtggctcaccgtgc

SEQ ID NO: 15622 - DNA, 21 bp, Homo sapiens
ccccgccccggctcactgcgc

SEQ ID NO: 15623 - DNA, 22 bp, Homo sapiens
ccgggccgcggctcgctgcgcc

SEQ ID NO: 15624 - DNA, 20 bp, Homo sapiens
gtgttgcacaggcccatgcc

SEQ ID NO: 15625 - DNA, 18 bp, Homo sapiens
cactgcgttacgctacgc

SEQ ID NO: 15626 - DNA, 71 bp, Amsacta moorei entomopoxvirus
ttgtgttctatgttagtatttgaaactaatttttccaataatactggattaaatgctaatctagaatataa

SEQ ID NO: 15627 - DNA, 24 bp, Amsacta moorei entomopoxvirus
tgttagtatttgaaactaattttt

SEQ ID NO: 15628 - DNA, 23 bp, Homo sapiens
tgtcagtatttggggcaattttt

SEQ ID NO: 15629 - DNA, 17 bp, Homo sapiens
tgttgtatttgaaacta

SEQ ID NO: 15630 - DNA, 19 bp, Homo sapiens
tgttagattcactaatttt

SEQ ID NO: 15631 - DNA, 63 bp, Infectious spleen and kidney necrosis virus
ggagcagtgtacacaacgccggtgccgacgggggtaatgcggctacctggcatgacactctcc

SEQ ID NO: 15632 - DNA, 21 bp, Infectious spleen and kidney necrosis virus
ctacctggcatgacactctcc

SEQ ID NO: 15633 - DNA, 18 bp, Homo sapiens
ctgtttcacacactctcc

SEQ ID NO: 15634 - DNA, 17 bp, Homo sapiens
taccggcatcactctcc

SEQ ID NO: 15635 - DNA, 18 bp, Homo sapiens
ctacctggccgacttctc

SEQ ID NO: 15636 - DNA, 18 bp, Homo sapiens
cacttacataacactttc

SEQ ID NO: 15637 - DNA, 20 bp, Homo sapiens
cttccttcatgatactttcc

SEQ ID NO: 15638 - DNA, 20 bp, Homo sapiens
taacctggcatgaagcttct

SEQ ID NO: 15639 - DNA, 19 bp, Homo sapiens
cacccggccatggcattct

SEQ ID NO: 15640 - DNA, 20 bp, Homo sapiens
ctacctgacatgtcaaatcc

SEQ ID NO: 15641 - DNA, 18 bp, Homo sapiens
ccacctggcactatctcc

SEQ ID NO: 15642 - DNA, 20 bp, Homo sapiens
ccgccctgcagacactctcc

SEQ ID NO: 15643 - DNA, 20 bp, Homo sapiens
ctagctatcacacactctcc

SEQ ID NO: 15644 - DNA, 16 bp, Homo sapiens
cctggcatccacctcc

SEQ ID NO: 15645 - DNA, 17 bp, Homo sapiens
cacctgccacactctcc

SEQ ID NO: 15646 - DNA, 20 bp, Homo sapiens
ctgtctggttgacactctcc

SEQ ID NO: 15647 - DNA, 17 bp, Homo sapiens
ccacctggcccactttc

SEQ ID NO: 15648 - DNA, 19 bp, Homo sapiens
cctggcacattttactctc

SEQ ID NO: 15649 - DNA, 16 bp, Homo sapiens
ctactgttgcactctc

SEQ ID NO: 15650 - DNA, 21 bp, Homo sapiens
ctggcataagccaatgttctc

SEQ ID NO: 15651 - DNA, 18 bp, Homo sapiens
ctacctggcaggaggact

SEQ ID NO: 15652 - DNA, 19 bp, Homo sapiens
taaccatgtttgacactct

SEQ ID NO: 15653 - DNA, 22 bp, Homo sapiens
cacctggcttgaaacattttcc

SEQ ID NO: 15654 - DNA, 18 bp, Homo sapiens
tgacctggcaccttctcc

SEQ ID NO: 15655 - DNA, 16 bp, Homo sapiens
ctactggcatacctct

SEQ ID NO: 15656 - DNA, 21 bp, Homo sapiens
cacctggcctgcctacactct

SEQ ID NO: 15657 - DNA, 19 bp, Homo sapiens
cacctgatccccactctcc

SEQ ID NO: 15658 - DNA, 17 bp, Homo sapiens
ctactggcatgtcctct

SEQ ID NO: 15659 - DNA, 19 bp, Homo sapiens
ctacctaactatgctttcc

SEQ ID NO: 15660 - DNA, 22 bp, Homo sapiens
cctggcatggccagcgctctcc

SEQ ID NO: 15661 - DNA, 18 bp, Homo sapiens
ccacctggtatgccccct

SEQ ID NO: 15662 - DNA, 15 bp, Homo sapiens
cacctggcacatctc

SEQ ID NO: 15663 - DNA, 23 bp, Homo sapiens
tgacctggcagaccttgcactct

SEQ ID NO: 15664 - DNA, 18 bp, Homo sapiens
cctgcatctgcactctcc

SEQ ID NO: 15665 - DNA, 19 bp, Homo sapiens
ctacattgactcactctcc

SEQ ID NO: 15666 - DNA, 17 bp, Homo sapiens
ctacatagaaacactct

SEQ ID NO: 15667 - DNA, 18 bp, Homo sapiens
ctatgtggcatgaactcc

SEQ ID NO: 15668 - DNA, 22 bp, Homo sapiens
ccacctggccctgtggctctcc

SEQ ID NO: 15669 - DNA, 19 bp, Homo sapiens
tacctggcctgatggctct

SEQ ID NO: 15670 - DNA, 21 bp, Homo sapiens
cacctggcatggacatgatcc

SEQ ID NO: 15671 - DNA, 20 bp, Homo sapiens
cacctgccctagacactctc

SEQ ID NO: 15672 - DNA, 16 bp, Homo sapiens
ctgcctgagacactct

SEQ ID NO: 15673 - DNA, 23 bp, Homo sapiens
ccacctggttccgcctactctcc

SEQ ID NO: 15674 - DNA, 16 bp, Homo sapiens
ccacctggacactttc

SEQ ID NO: 15675 - DNA, 20 bp, Homo sapiens
ctacctggcagtgccccctc

SEQ ID NO: 15676 - DNA, 19 bp, Homo sapiens
ctatctgcatgacagtctc

SEQ ID NO: 15677 - DNA, 19 bp, Homo sapiens
cacctggcatgcccattcc

SEQ ID NO: 15678 - DNA, 16 bp, Homo sapiens
cctccatgcactctcc

SEQ ID NO: 15679 - DNA, 18 bp, Homo sapiens
cacctggcctaaaactct

SEQ ID NO: 15680 - DNA, 17 bp, Homo sapiens
acttggcagcactctcc

SEQ ID NO: 15681 - DNA, 18 bp, Homo sapiens
cctggcacttgacctctc

SEQ ID NO: 15682 - DNA, 18 bp, Homo sapiens
ccttgcttgacattctcc

SEQ ID NO: 15683 - DNA, 18 bp, Homo sapiens
ccacctggtgtgacattc

SEQ ID NO: 15684 - DNA, 18 bp, Homo sapiens
caccgccccgacactctc

SEQ ID NO: 15685 - DNA, 21 bp, Homo sapiens
ccacctggcatctgatttctc

SEQ ID NO: 15686 - DNA, 23 bp, Homo sapiens
ctacctgggcagtgatggctttc

SEQ ID NO: 15687 - DNA, 19 bp, Homo sapiens
ctggcccaggacactctcc

SEQ ID NO: 15688 - DNA, 20 bp, Homo sapiens
ctaccctgactcacactctc

SEQ ID NO: 15689 - DNA, 16 bp, Homo sapiens
cctggcatgcatctcc

SEQ ID NO: 15690 - DNA, 19 bp, Homo sapiens
ctagctgtattcactctcc

SEQ ID NO: 15691 - DNA, 17 bp, Homo sapiens
ctacctggacagagtct

SEQ ID NO: 15692 - DNA, 15 bp, Homo sapiens
ctacctggcacctcc

SEQ ID NO: 15693 - DNA, 18 bp, Homo sapiens
ccacctgacatgctttct

SEQ ID NO: 15694 - DNA, 17 bp, Homo sapiens
cctggcatgtgacctcc

SEQ ID NO: 15695 - DNA, 18 bp, Homo sapiens
cctgcgggagcactctcc

SEQ ID NO: 15696 - DNA, 19 bp, Homo sapiens
ctacctgggatcacatctc

SEQ ID NO: 15697 - DNA, 15 bp, Homo sapiens
tacctggaacactct

SEQ ID NO: 15698 - DNA, 18 bp, Homo sapiens
taacctggcatgggctcc

SEQ ID NO: 15699 - DNA, 18 bp, Homo sapiens
ctacctggcagctcgtcc

SEQ ID NO: 15700 - DNA, 18 bp, Homo sapiens
ctaacctgcacattctcc

SEQ ID NO: 15701 - DNA, 68 bp, Amsacta moorei entomopoxvirus
agaatctctcaacgaagcatgtaaaataccatatattttattttctgtaatatcgttattaggatttt

SEQ ID NO: 15702 - DNA, 24 bp, Amsacta moorei entomopoxvirus
tctctcaacgaagcatgtaaaata

SEQ ID NO: 15703 - DNA, 19 bp, Homo sapiens
tcaacaaagtaagcgcaaa

SEQ ID NO: 15704 - DNA, 17 bp, Homo sapiens
tctctcaatgaagctgc

SEQ ID NO: 15705 - DNA, 17 bp, Homo sapiens
tctcaacaatataaaat

SEQ ID NO: 15706 - DNA, 18 bp, Homo sapiens
ctcaaaagcatgtaaaat

SEQ ID NO: 15707 - DNA, 18 bp, Homo sapiens
acaatgctatgtaaaata

SEQ ID NO: 15708 - DNA, 21 bp, Homo sapiens
tcttaacaagcatacaaaata

SEQ ID NO: 15709 - DNA, 18 bp, Homo sapiens
tctctcaatgaatgctgt

SEQ ID NO: 15710 - DNA, 17 bp, Homo sapiens
tctctcaatgaacagta

SEQ ID NO: 15711 - DNA, 17 bp, Homo sapiens
tctctcaaggaagtgta

SEQ ID NO: 15712 - DNA, 17 bp, Homo sapiens
tctctcatatgtaaaat

SEQ ID NO: 15713 - DNA, 19 bp, Homo sapiens
tctctcaacaccttaaaat

SEQ ID NO: 15714 - DNA, 18 bp, Homo sapiens
tctcaatgcatacaaaat

SEQ ID NO: 15715 - DNA, 18 bp, Homo sapiens
ctctttcacatgtaaaat

SEQ ID NO: 15716 - DNA, 20 bp, Homo sapiens
tctcaagaccatataaaata

SEQ ID NO: 15717 - DNA, 76 bp, Sulfolobus virus SIRV-2
gtttgcggtttagttttctttagttcatttgcaattttatagttctgaattatctcattaactaaactatctaaac

SEQ ID NO: 15718 - DNA, 24 bp, Sulfolobus virus SIRV-2
tttagttttctttagttcatttgc

SEQ ID NO: 15719 - DNA, 18 bp, Homo sapiens
tttagtttttctttagtt

SEQ ID NO: 15720 - DNA, 23 bp, Homo sapiens
tttagttttctttatatttattt

SEQ ID NO: 15721 - DNA, 16 bp, Homo sapiens
tttagtttcctcattt

SEQ ID NO: 15722 - DNA, 24 bp, Homo sapiens
tttagttctcttaaattcatttgc

SEQ ID NO: 15723 - DNA, 22 bp, Homo sapiens
tttagttttccttagattttgc

SEQ ID NO: 15724 - DNA, 16 bp, Homo sapiens
ttcagttttctcattt

SEQ ID NO: 15725 - DNA, 18 bp, Homo sapiens
agttttcttttcatttgc

SEQ ID NO: 15726 - DNA, 88 bp, Ectromelia virus
ataggattgtgtgcgtgtgtggtagatgtttggagaaaggagaaactgttttctagatggaaatattgtttacgagcaattaaactgt

SEQ ID NO: 15727 - DNA, 24 bp, Ectromelia virus
tgtgtgcgtgtgtggtagatgttt

SEQ ID NO: 15728 - DNA, 23 bp, Homo sapiens
tgtgtgtgtgtgtaggtatgttt

SEQ ID NO: 15729 - DNA, 18 bp, Homo sapiens
tgtgtgtgtgtgtggaag

SEQ ID NO: 15730 - DNA, 23 bp, Homo sapiens
tgtgtgtgtgtgtgggtgggtgt

SEQ ID NO: 15731 - DNA, 18 bp, Homo sapiens
tgtgtgtgtgtgtgtgca

SEQ ID NO: 15732 - DNA, 22 bp, Homo sapiens
tgtgtgtgtgtgtgtgtgagtt

SEQ ID NO: 15733 - DNA, 22 bp, Homo sapiens
tgtgtgggtgtgtgtcaagttt

SEQ ID NO: 15734 - DNA, 19 bp, Homo sapiens
tgtgtgtgtgtgtgtagat

SEQ ID NO: 15735 - DNA, 18 bp, Homo sapiens
tgtgtgtgtgtgtgtgta

SEQ ID NO: 15736 - DNA, 21 bp, Homo sapiens
tgtgtggtgtgtgttttgttt

SEQ ID NO: 15737 - DNA, 17 bp, Homo sapiens
tgtgtgtgtgtgtggag

SEQ ID NO: 15738 - DNA, 18 bp, Homo sapiens
tgtgtgtgtgtgtgtaaa

SEQ ID NO: 15739 - DNA, 18 bp, Homo sapiens
tgtgtgtgggtgtggtag

SEQ ID NO: 15740 - DNA, 23 bp, Homo sapiens
tgtgtgatgtgtggtgtgtgttt

SEQ ID NO: 15741 - DNA, 24 bp, Homo sapiens
tgtgtgcgtgtgtgcgtgtgtgtt

SEQ ID NO: 15742 - DNA, 19 bp, Homo sapiens
tgtgtgtgtgtgtgataga

SEQ ID NO: 15743 - DNA, 23 bp, Homo sapiens
tgtgtgcgtgcgtgtgtgtgttt

SEQ ID NO: 15744 - DNA, 19 bp, Homo sapiens
tgtgtgtgtgtggtggcag

SEQ ID NO: 15745 - DNA, 23 bp, Homo sapiens
tgtgtgtgtgtgtacgcatgttt

SEQ ID NO: 15746 - DNA, 23 bp, Homo sapiens
tgtgtgtgtgtgtgaagctgttt

SEQ ID NO: 15747 - DNA, 25 bp, Homo sapiens
tatgtgcgtgtgtgtgtgtgtgttt

SEQ ID NO: 15748 - DNA, 19 bp, Homo sapiens
tgtgtgtgtgtgtgttgga

SEQ ID NO: 15749 - DNA, 20 bp, Homo sapiens
tgtgtgcgagtgtgtgtggt

SEQ ID NO: 15750 - DNA, 19 bp, Homo sapiens
tgtgtgtgtgtgtgggtgc

SEQ ID NO: 15751 - DNA, 18 bp, Homo sapiens
tgtgtgtgtgtgtgtgag

SEQ ID NO: 15752 - DNA, 25 bp, Homo sapiens
tgtgtgtgtgtgtgtgtgtgtgttt

SEQ ID NO: 15753 - DNA, 24 bp, Homo sapiens
gtgtgtgtgtgtctctgtgtgttt

SEQ ID NO: 15754 - DNA, 18 bp, Homo sapiens
tgtgtgcgtgtgtgtgca

SEQ ID NO: 15755 - DNA, 23 bp, Homo sapiens
tgtgtgtgtgtgtgagtgtgttt

SEQ ID NO: 15756 - DNA, 25 bp, Homo sapiens
tgtgtgcatgtgtgtgcctgtgttt

SEQ ID NO: 15757 - DNA, 23 bp, Homo sapiens
tgtgtgcgcgtgtggctgtgttt

SEQ ID NO: 15758 - DNA, 18 bp, Homo sapiens
tgtgtgtgtgtgtgttag

SEQ ID NO: 15759 - DNA, 19 bp, Homo sapiens
tgtgtgtgtgtgtgtgcaa

SEQ ID NO: 15760 - DNA, 24 bp, Homo sapiens
tgtgtccgtgtgtacccaatgttt

SEQ ID NO: 15761 - DNA, 20 bp, Homo sapiens
tgtgtgtgtgtgtgccaaat

SEQ ID NO: 15762 - DNA, 22 bp, Homo sapiens
tgtgtgtgtgtgtgtcagtgtt

SEQ ID NO: 15763 - DNA, 18 bp, Homo sapiens
gtgtgttcttagatgttt

SEQ ID NO: 15764 - DNA, 18 bp, Homo sapiens
tgtgtgtgtaatgtgtgt

SEQ ID NO: 15765 - DNA, 23 bp, Homo sapiens
tgtgtgtgtgtaatgttgtgttt

SEQ ID NO: 15766 - DNA, 95 bp, Ectromelia virus
gaaaaatacatttgatggtctatctaccagattattatgtgttataaggtactttttctcataataaactagagatgcgtaagatagtgtttttc

SEQ ID NO: 15767 - DNA, 24 bp, Ectromelia virus
tcataataaactagagatgcgtaa

SEQ ID NO: 15768 - DNA, 19 bp, Homo sapiens
tcataatacagctaggaca

SEQ ID NO: 15769 - DNA, 24 bp, Homo sapiens
tcaaagtaaattagagatatgtaa

SEQ ID NO: 15770 - DNA, 19 bp, Homo sapiens
tcataataaaatagaaata

SEQ ID NO: 15771 - DNA, 22 bp, Homo sapiens
tcataatagatcaagtaagcgt

SEQ ID NO: 15772 - DNA, 21 bp, Homo sapiens
cataatcaaagagatgtgtaa

SEQ ID NO: 15773 - DNA, 16 bp, Homo sapiens
tcataataaacatgca

SEQ ID NO: 15774 - DNA, 17 bp, Homo sapiens
tcataatagacagagat

SEQ ID NO: 15775 - DNA, 21 bp, Homo sapiens
tcacaatgaactagagctgta

SEQ ID NO: 15776 - DNA, 18 bp, Homo sapiens
tcatattaaactaggatg

SEQ ID NO: 15777 - DNA, 86 bp, Variola virus
attatatgattatagtttctatttttacagtaccttgactaaagtctttagtcacacaatactaccaacctacactattatatgat

SEQ ID NO: 15778 - DNA, 24 bp, Variola virus
tatatgattatagtttctattttt

SEQ ID NO: 15779 - DNA, 18 bp, Homo sapiens
tatgttattatagtttct

SEQ ID NO: 15780 - DNA, 24 bp, Homo sapiens
tatatgcatacacattctattttt

SEQ ID NO: 15781 - DNA, 19 bp, Homo sapiens
tgagataatttctattttt

SEQ ID NO: 15782 - DNA, 25 bp, Homo sapiens
tatagtgattatagtttataatttt

SEQ ID NO: 15783 - DNA, 20 bp, Homo sapiens
catatgatcattctattttt

SEQ ID NO: 15784 - DNA, 64 bp, Fowlpox virus
attttaaaatctgccgtgtctagtctcgttattacaggattcctcgcagtttagaatttaaaat

SEQ ID NO: 15785 - DNA, 24 bp, Fowlpox virus
tttaaaatctgccgtgtctagtct

SEQ ID NO: 15786 - DNA, 19 bp, Homo sapiens
tttaaaatctacccagtct

SEQ ID NO: 15787 - DNA, 26 bp, Homo sapiens
tctaaaatctgttgtgtgcaaatagt

SEQ ID NO: 15788 - DNA, 18 bp, Homo sapiens
tttaaaactgctcagtct

SEQ ID NO: 15789 - DNA, 19 bp, Homo sapiens
tttaaaactgccgtcttct

SEQ ID NO: 15790 - DNA, 21 bp, Homo sapiens
cttaaaatctgctgccactgt

SEQ ID NO: 15791 - DNA, 20 bp, Homo sapiens
tttaaaatctgttgtttagt

SEQ ID NO: 15792 - DNA, 22 bp, Homo sapiens
tttaaaatgtaaattctagtct

SEQ ID NO: 15793 - DNA, 19 bp, Homo sapiens
tttaagttctgttctagtc

SEQ ID NO: 15794 - DNA, 96 bp, Rabbit fibroma virus
gtgggaagataatctaaaaaattgtaaatacgtaatggaatcgaaaataaagtttttaaacgatataaaacaaggaatagaagcgtctttatccgc

SEQ ID NO: 15795 - DNA, 24 bp, Rabbit fibroma virus
tctaaaaaattgtaaatacgtaat

SEQ ID NO: 15796 - DNA, 21 bp, Homo sapiens
tctgaaaaactgtaatccaca

SEQ ID NO: 15797 - DNA, 62 bp, Rabbit fibroma virus
gtgtgtctcatagccgttaggattattattatattaaagtacttacatgaacatggatacac

SEQ ID NO: 15798 - DNA, 19 bp, Rabbit fibroma virus
tacatgaacatggatacac

SEQ ID NO: 15799 - DNA, 16 bp, Homo sapiens
tacatgatagatacac

SEQ ID NO: 15800 - DNA, 18 bp, Homo sapiens
tacagaaacacacataca

SEQ ID NO: 15801 - DNA, 17 bp, Homo sapiens
cacatggacagatacac

SEQ ID NO: 15802 - DNA, 20 bp, Homo sapiens
tacatggaccaggatgacac

SEQ ID NO: 15803 - DNA, 16 bp, Homo sapiens
acatgaatagaaacac

SEQ ID NO: 15804 - DNA, 17 bp, Homo sapiens
acatgaacacaaaacac

SEQ ID NO: 15805 - DNA, 21 bp, Homo sapiens
tacataaatatggagtttaca

SEQ ID NO: 15806 - DNA, 19 bp, Homo sapiens
cacatgataatggatacac

SEQ ID NO: 15807 - DNA, 16 bp, Homo sapiens
tacataaacatctaca

SEQ ID NO: 15808 - DNA, 19 bp, Homo sapiens
acatgagcatggatttaca

SEQ ID NO: 15809 - DNA, 19 bp, Homo sapiens
tacatagacatagggacac

SEQ ID NO: 15810 - DNA, 19 bp, Homo sapiens
tacagaacatagaaataca

SEQ ID NO: 15811 - DNA, 16 bp, Homo sapiens
tacatacagaatacac

SEQ ID NO: 15812 - DNA, 18 bp, Homo sapiens
tacaagaacatgaaaaac

SEQ ID NO: 15813 - DNA, 18 bp, Homo sapiens
tacatggactataaatac

SEQ ID NO: 15814 - DNA, 18 bp, Homo sapiens
cacatggactacagacac

SEQ ID NO: 15815 - DNA, 18 bp, Homo sapiens
tacatataccagatacac

SEQ ID NO: 15816 - DNA, 17 bp, Homo sapiens
tacataatttgaataca

SEQ ID NO: 15817 - DNA, 18 bp, Homo sapiens
tacataaacaactgaaca

SEQ ID NO: 15818 - DNA, 19 bp, Homo sapiens
tacatgaattcaaatacac

SEQ ID NO: 15819 - DNA, 18 bp, Homo sapiens
taatgaacatggtcacac

SEQ ID NO: 15820 - DNA, 19 bp, Homo sapiens
tacataaacacaagtacac

SEQ ID NO: 15821 - DNA, 15 bp, Homo sapiens
tacataatagataca

SEQ ID NO: 15822 - DNA, 18 bp, Homo sapiens
catgagcataaaatacac

SEQ ID NO: 15823 - DNA, 18 bp, Homo sapiens
tacagatacagagataca

SEQ ID NO: 15824 - DNA, 18 bp, Homo sapiens
tacatgatcattctacac

SEQ ID NO: 15825 - DNA, 15 bp, Homo sapiens
tacataaacattaca

SEQ ID NO: 15826 - DNA, 18 bp, Homo sapiens
tacatgaatttaatacac

SEQ ID NO: 15827 - DNA, 19 bp, Homo sapiens
tacatgaagtaatgaatac

SEQ ID NO: 15828 - DNA, 17 bp, Homo sapiens
tacatgagcagatacac

SEQ ID NO: 15829 - DNA, 20 bp, Homo sapiens
tacatgaatagaaatggaca

SEQ ID NO: 15830 - DNA, 19 bp, Homo sapiens
tacgtgggcacggatacac

SEQ ID NO: 15831 - DNA, 19 bp, Homo sapiens
tacatgaaacattatatac

SEQ ID NO: 15832 - DNA, 20 bp, Homo sapiens
acatgactgcatggatacac

SEQ ID NO: 15833 - DNA, 18 bp, Homo sapiens
tacagaacatcttggata

SEQ ID NO: 15834 - DNA, 17 bp, Homo sapiens
tacataaacttaataca

SEQ ID NO: 15835 - DNA, 20 bp, Homo sapiens
tacatgaatattctaaatac

SEQ ID NO: 15836 - DNA, 19 bp, Homo sapiens
tacataaacaatttgaaca

SEQ ID NO: 15837 - DNA, 19 bp, Homo sapiens
acatgaacatctctgaata

SEQ ID NO: 15838 - DNA, 16 bp, Homo sapiens
cactgagatggataca

SEQ ID NO: 15839 - DNA, 20 bp, Homo sapiens
tacatgaaaaacaaaataca

SEQ ID NO: 15840 - DNA, 16 bp, Homo sapiens
tacaacatggatacac

SEQ ID NO: 15841 - DNA, 17 bp, Homo sapiens
acagtgaatggatacac

SEQ ID NO: 15842 - DNA, 16 bp, Homo sapiens
tacataaagaatacac

SEQ ID NO: 15843 - DNA, 19 bp, Homo sapiens
tacataaacatgataatac

SEQ ID NO: 15844 - DNA, 20 bp, Homo sapiens
tacatgaaacatgaagacac

SEQ ID NO: 15845 - DNA, 16 bp, Homo sapiens
acaccaatggatacac

SEQ ID NO: 15846 - DNA, 18 bp, Homo sapiens
cacagacatggatgcacg

SEQ ID NO: 15847 - DNA, 17 bp, Homo sapiens
tacatgaaatgaatcac

SEQ ID NO: 15848 - DNA, 20 bp, Homo sapiens
cacatgaacacctaatatac

SEQ ID NO: 15849 - DNA, 18 bp, Homo sapiens
tacatgaaatggaattac

SEQ ID NO: 15850 - DNA, 19 bp, Homo sapiens
tacatgaaagggtctacac

SEQ ID NO: 15851 - DNA, 21 bp, Homo sapiens
tacataaatgaatgaatacac

SEQ ID NO: 15852 - DNA, 18 bp, Homo sapiens
tacatgaacagccaatac

SEQ ID NO: 15853 - DNA, 17 bp, Homo sapiens
cacatgagtgaatacac

SEQ ID NO: 15854 - DNA, 18 bp, Homo sapiens
cacatggacatctggaca

SEQ ID NO: 15855 - DNA, 18 bp, Homo sapiens
tacataaacagctggcac

SEQ ID NO: 15856 - DNA, 17 bp, Homo sapiens
cacatggtcagatacac

SEQ ID NO: 15857 - DNA, 18 bp, Homo sapiens
tacatggcagaaatacac

SEQ ID NO: 15858 - DNA, 19 bp, Homo sapiens
tacatagatgatagataca

SEQ ID NO: 15859 - DNA, 18 bp, Homo sapiens
tacgatggcatagataca

SEQ ID NO: 15860 - DNA, 19 bp, Homo sapiens
tacacggaaatgaatacac

SEQ ID NO: 15861 - DNA, 20 bp, Homo sapiens
tacttgaacataagtaacac

SEQ ID NO: 15862 - DNA, 18 bp, Homo sapiens
acatgaacaacggtgtac

SEQ ID NO: 15863 - DNA, 16 bp, Homo sapiens
tacatacataaataca

SEQ ID NO: 15864 - DNA, 84 bp, Rabbit fibroma virus
cgtccaatatagctatcgacgtacgtgataaaaacaaaatttacctgttggattacggtttgtcgtatagatttatggtggatg

SEQ ID NO: 15865 - DNA, 24 bp, Rabbit fibroma virus
ttggattacggtttgtcgtataga

SEQ ID NO: 15866 - DNA, 19 bp, Homo sapiens
gattgtggtttgtcttcag

SEQ ID NO: 15867 - DNA, 63 bp, Human herpesvirus 5
agctgggtactataaaaatcaaaccacagataggttatactataattctgaatggggcccgct

SEQ ID NO: 15868 - DNA, 21 bp, Human herpesvirus 5
taattctgaatggggcccgct

SEQ ID NO: 15869 - DNA, 16 bp, Homo sapiens
taatcctgagctccgc

SEQ ID NO: 15870 - DNA, 18 bp, Homo sapiens
taatcctgagcctatgct

SEQ ID NO: 15871 - DNA, 19 bp, Homo sapiens
caattctgctcaaggcccg

SEQ ID NO: 15872 - DNA, 18 bp, Homo sapiens
taattctgaaggactgct

SEQ ID NO: 15873 - DNA, 21 bp, Homo sapiens
attctgaattctaccctcgct

SEQ ID NO: 15874 - DNA, 15 bp, Homo sapiens
tcccgggggcccgct

SEQ ID NO: 15875 - DNA, 16 bp, Homo sapiens
ttctgaataaagtgct

SEQ ID NO: 15876 - DNA, 18 bp, Homo sapiens
taattctgtgtgaatccc

SEQ ID NO: 15877 - DNA, 20 bp, Homo sapiens
ttctgaaccaaatgtccgct

SEQ ID NO: 15878 - DNA, 18 bp, Homo sapiens
attctcacagggcctgct

SEQ ID NO: 15879 - DNA, 20 bp, Homo sapiens
taattatgaatgaagctgct

SEQ ID NO: 15880 - DNA, 23 bp, Homo sapiens
taattctgaagctggttagcggc

SEQ ID NO: 15881 - DNA, 27 bp, Homo sapiens
taattctgaaatggtcattagcgggcc

SEQ ID NO: 15882 - DNA, 16 bp, Homo sapiens
taatttgaatggagac

SEQ ID NO: 15883 - DNA, 20 bp, Homo sapiens
caattctgacattacctgct

SEQ ID NO: 15884 - DNA, 16 bp, Homo sapiens
taattctggggaccgc

SEQ ID NO: 15885 - DNA, 15 bp, Homo sapiens
ttcccagggcccgct

SEQ ID NO: 15886 - DNA, 18 bp, Homo sapiens
ttctgaatgacgagtgct

SEQ ID NO: 15887 - DNA, 18 bp, Homo sapiens
taattctaatgagaagct

SEQ ID NO: 15888 - DNA, 22 bp, Homo sapiens
taattctaattttgccttcgct

SEQ ID NO: 15889 - DNA, 21 bp, Homo sapiens
taattctgggtaggtcacgct

SEQ ID NO: 15890 - DNA, 75 bp, Human herpesvirus 5
ctcgtaaataaagacgcacagacctcacgcatatagtaccatcacaccgtgtggcgtgtactttattacaacgag

SEQ ID NO: 15891 - DNA, 24 bp, Human herpesvirus 5
tggcgtgtactttattacaacgag

SEQ ID NO: 15892 - DNA, 18 bp, Homo sapiens
acgtattactttattgca

SEQ ID NO: 15893 - DNA, 21 bp, Homo sapiens
tggatgcgccttattacaacg

SEQ ID NO: 15894 - DNA, 83 bp, African swine fever virus
tgcagatcttttttgtgaaaaaaaaataattatttttttgcgcgccggaataattattttttttgcgcggaaatatttttgca

SEQ ID NO: 15895 - DNA, 24 bp, African swine fever virus
tcttttttgtgaaaaaaaaataat

SEQ ID NO: 15896 - DNA, 18 bp, Homo sapiens
tcttttttgtgaaagaaa

SEQ ID NO: 15897 - DNA, 21 bp, Homo sapiens
tcttttttgtgataagaaaat

SEQ ID NO: 15898 - DNA, 18 bp, Homo sapiens
tctttctcacgaagaaaa

SEQ ID NO: 15899 - DNA, 20 bp, Homo sapiens
ttttttgtgaaagtaaaaat

SEQ ID NO: 15900 - DNA, 19 bp, Homo sapiens
tttctcgggaaaaaaaaat

SEQ ID NO: 15901 - DNA, 24 bp, Homo sapiens
tctttcccgggtgaaaaaaaaata

SEQ ID NO: 15902 - DNA, 19 bp, Homo sapiens
ttttttgtgaaaaaccata

SEQ ID NO: 15903 - DNA, 20 bp, Homo sapiens
ctttttgaaaaaaaaataat

SEQ ID NO: 15904 - DNA, 76 bp, African swine fever virus
gaataattattttttcgccggaaagcattttgtagtttcacaagatgcagaatttggcgggccggaataattattt

SEQ ID NO: 15905 - DNA, 24 bp, African swine fever virus
tattttttcgccggaaagcatttt

SEQ ID NO: 15906 - DNA, 22 bp, Homo sapiens
ttttttccaggaaaggcatttt

SEQ ID NO: 15907 - DNA, 27 bp, Homo sapiens
tattttttcattgggaatatacatttt

SEQ ID NO: 15908 - DNA, 22 bp, Homo sapiens
tttttttgccaacaagcatttt

SEQ ID NO: 15909 - DNA, 21 bp, Homo sapiens
ttttttcacaaaaagtatttt

SEQ ID NO: 15910 - DNA, 19 bp, Homo sapiens
tattttttccttggaaggc

SEQ ID NO: 15911 - DNA, 78 bp, Human herpesvirus 4
ttttctgatctcaatcaaatctttagagattacagacaccatgtttgacatctttcaaagtgctttcggattggaaga

SEQ ID NO: 15912 - DNA, 24 bp, Human herpesvirus 4
ttgacatctttcaaagtgctttcg

SEQ ID NO: 15913 - DNA, 19 bp, Homo sapiens
cataatttcaaagtgcttt

SEQ ID NO: 15914 - DNA, 20 bp, Homo sapiens
ttgacatctttaattacttt

SEQ ID NO: 15915 - DNA, 19 bp, Homo sapiens
ttgatgtcttcaaaaatgc

SEQ ID NO: 15916 - DNA, 18 bp, Homo sapiens
ttgacatcttccaacttt

SEQ ID NO: 15917 - DNA, 20 bp, Homo sapiens
ttgacatgtttcagtgcttt

SEQ ID NO: 15918 - DNA, 21 bp, Homo sapiens
ttggtatctttcaaatgcatc

SEQ ID NO: 15919 - DNA, 21 bp, Homo sapiens
ttgacatttatctcactttcg

SEQ ID NO: 15920 - DNA, 21 bp, Homo sapiens
ttgattctttcaaagtaaatc

SEQ ID NO: 15921 - DNA, 21 bp, Homo sapiens
ttaacatcttttaaaaacttt

SEQ ID NO: 15922 - DNA, 72 bp, African swine fever virus
ttaaacttattactactgctataggcgttaaacattaaaattattactactgttgtaggcgtcaaagattaa

SEQ ID NO: 15923 - DNA, 20 bp, African swine fever virus
ttgtaggcgtcaaagattaa

SEQ ID NO: 15924 - DNA, 18 bp, Homo sapiens
tcccaattgtcaaagatt

SEQ ID NO: 15925 - DNA, 19 bp, Homo sapiens
ttgtaatatcaaaagatta

SEQ ID NO: 15926 - DNA, 20 bp, Homo sapiens
tgtcctgaatcaaagattaa

SEQ ID NO: 15927 - DNA, 18 bp, Homo sapiens
ttgcaggctcccagatta

SEQ ID NO: 15928 - DNA, 16 bp, Homo sapiens
ttgtagacaaaagatt

SEQ ID NO: 15929 - DNA, 16 bp, Homo sapiens
ttgaggcacaaagatt

SEQ ID NO: 15930 - DNA, 18 bp, Homo sapiens
ttgcatttcaaagattaa

SEQ ID NO: 15931 - DNA, 18 bp, Homo sapiens
tgtagttatgaaagatta

SEQ ID NO: 15932 - DNA, 17 bp, Homo sapiens
tgtagtgtaaagattaa

SEQ ID NO: 15933 - DNA, 19 bp, Homo sapiens
ttgtgagggacaaagatta

SEQ ID NO: 15934 - DNA, 19 bp, Homo sapiens
ctgtaaacagaaagattaa

SEQ ID NO: 15935 - DNA, 20 bp, Homo sapiens
ttataagctacaaaggttaa

SEQ ID NO: 15936 - DNA, 17 bp, Homo sapiens
ctgcaaactcaaagatt

SEQ ID NO: 15937 - DNA, 17 bp, Homo sapiens
ttgtaggaaaagattaa

SEQ ID NO: 15938 - DNA, 18 bp, Homo sapiens
taggacatcaaggattaa

SEQ ID NO: 15939 - DNA, 87 bp, African swine fever virus
gcgttaaacattaaaattattactactgctgtaggcgttaaacattattactgctgtaggcgtagctaaattttaatgttttttcgt

SEQ ID NO: 15940 - DNA, 24 bp, African swine fever virus
actgctgtaggcgttaaacattat

SEQ ID NO: 15941 - DNA, 18 bp, Homo sapiens
actattgtaggaacatta

SEQ ID NO: 15942 - DNA, 19 bp, Homo sapiens
actgttgcaggcattcatt

SEQ ID NO: 15943 - DNA, 24 bp, Homo sapiens
actgctgtagttagacctcattat

SEQ ID NO: 15944 - DNA, 22 bp, Homo sapiens
actttgtaagcataggcattat

SEQ ID NO: 15945 - DNA, 20 bp, Homo sapiens
tactgtcacttttaaacatt

SEQ ID NO: 15946 - DNA, 20 bp, Homo sapiens
ctgctatacaagaacattat

SEQ ID NO: 15947 - DNA, 21 bp, Homo sapiens
actgctgtgttgctaacgtta

SEQ ID NO: 15948 - DNA, 19 bp, Homo sapiens
tgctgtctttgaacattat

SEQ ID NO: 15949 - DNA, 81 bp, African swine fever virus
ggcattcctgatattcatgttaaagtgctatactataaccatcttatgtgggctctttatacatcttattggcaggaggcc

SEQ ID NO: 15950 - DNA, 24 bp, African swine fever virus
taaagtgctatactataaccatct

SEQ ID NO: 15951 - DNA, 19 bp, Homo sapiens
taaaatgctacaaaactat

SEQ ID NO: 15952 - DNA, 25 bp, Homo sapiens
caaagtgctgtaacagtgaccatct

SEQ ID NO: 15953 - DNA, 15 bp, Homo sapiens
aaatgctacaaccat

SEQ ID NO: 15954 - DNA, 22 bp, Homo sapiens
aagtgctatctacggactatct

SEQ ID NO: 15955 - DNA, 23 bp, Homo sapiens
agtactatattccaaccctatct

SEQ ID NO: 15956 - DNA, 20 bp, Homo sapiens
taaagtgccattaaggaacc

SEQ ID NO: 15957 - DNA, 18 bp, Homo sapiens
agtgctatcttccaatct

SEQ ID NO: 15958 - DNA, 18 bp, Homo sapiens
taaagtgctttacatata

SEQ ID NO: 15959 - DNA, 23 bp, Homo sapiens
taaagtgctggtgtcacctgtct

SEQ ID NO: 15960 - DNA, 80 bp, Human herpesvirus 2
ggtagggtagactcgagacggcggcccgcggtctctctcttgccgggttttagtctctgtctctccgggtctcctcctcc

SEQ ID NO: 15961 - DNA, 24 bp, Human herpesvirus 2
gttttagtctctgtctctccgggt

SEQ ID NO: 15962 - DNA, 18 bp, Homo sapiens
gtctctgtctctctgggt

SEQ ID NO: 15963 - DNA, 23 bp, Homo sapiens
gttttagtttctgacttaaaggt

SEQ ID NO: 15964 - DNA, 19 bp, Homo sapiens
gttttggtctctgtagagg

SEQ ID NO: 15965 - DNA, 21 bp, Homo sapiens
gtttctggtctggctccgggt

SEQ ID NO: 15966 - DNA, 19 bp, Homo sapiens
gttttagttttgttcaggg

SEQ ID NO: 15967 - DNA, 74 bp, Melanoplus sanguinipes entomopoxvirus
tggacgtgttataaaatctaaatataaatgttttatattacttactatatttatatttgttttagaatattcta

SEQ ID NO: 15968 - DNA, 24 bp, Melanoplus sanguinipes entomopoxvirus
tataaaatctaaatataaatgttt

SEQ ID NO: 15969 - DNA, 20 bp, Homo sapiens
tatataaatctaaatataaa

SEQ ID NO: 15970 - DNA, 23 bp, Homo sapiens
taaaaaatctagtataaatgttt

SEQ ID NO: 15971 - DNA, 23 bp, Homo sapiens
tataaaatttaaatataaacctt

SEQ ID NO: 15972 - DNA, 82 bp, Melanoplus sanguinipes entomopoxvirus
tggtatattatcataacgtatttgtttttgttttataatatcattttcagtacattcaatatatgttgataaatctatatca

SEQ ID NO: 15973 - DNA, 24 bp, Melanoplus sanguinipes entomopoxvirus
tcagtacattcaatatatgttgat

SEQ ID NO: 15974 - DNA, 17 bp, Homo sapiens
gtacatttacatattaa

SEQ ID NO: 15975 - DNA, 18 bp, Homo sapiens
tacattcaattgtctgat

SEQ ID NO: 15976 - DNA, 17 bp, Homo sapiens
atacattcaatgtattg

SEQ ID NO: 15977 - DNA, 19 bp, Homo sapiens
tcagaacattcaataaatg

SEQ ID NO: 15978 - DNA, 21 bp, Homo sapiens
tcagtgcaaagaaatatgttg

SEQ ID NO: 15979 - DNA, 22 bp, Homo sapiens
tcagtacatttgcatatactaa

SEQ ID NO: 15980 - DNA, 20 bp, Homo sapiens
tcagtgggttcaatatctgt

SEQ ID NO: 15981 - DNA, 18 bp, Homo sapiens
tcagtctgttcaatatac

SEQ ID NO: 15982 - DNA, 18 bp, Homo sapiens
tacattcaaaatcttgat

SEQ ID NO: 15983 - DNA, 22 bp, Homo sapiens
tcagtaattcaataatacagat

SEQ ID NO: 15984 - DNA, 17 bp, Homo sapiens
agtacattcaaatttga

SEQ ID NO: 15985 - DNA, 18 bp, Homo sapiens
tcagtgcattaatgtcga

SEQ ID NO: 15986 - DNA, 18 bp, Homo sapiens
tcagtacatttgcatatg

SEQ ID NO: 15987 - DNA, 16 bp, Homo sapiens
tcagtacatttatacg

SEQ ID NO: 15988 - DNA, 125 bp, Human papillomavirus type 41
tccctggtagctactgagcagcagctgtttaacaggcccttttggctgcagagatcccagggccataacaatggcatactgtggcacaacgaggcctttgtaacattggttgacactaccagggg

SEQ ID NO: 15989 - DNA, 24 bp, Human papillomavirus type 41
tggcacaacgaggcctttgtaaca

SEQ ID NO: 15990 - DNA, 18 bp, Homo sapiens
gcaggtgaggctgtaaca

SEQ ID NO: 15991 - DNA, 18 bp, Homo sapiens
tggcgtaacgagacttta

SEQ ID NO: 15992 - DNA, 20 bp, Homo sapiens
ggcagccggcctttgtgaca

SEQ ID NO: 15993 - DNA, 20 bp, Homo sapiens
tggcacaacagggcttcaca

SEQ ID NO: 15994 - DNA, 24 bp, Homo sapiens
tggcagggtgaggcccccaggaca

SEQ ID NO: 15995 - DNA, 24 bp, Homo sapiens
tgtacagagactttttttgtaaca

SEQ ID NO: 15996 - DNA, 17 bp, Homo sapiens
tggcactggctttgtaa

SEQ ID NO: 15997 - DNA, 22 bp, Homo sapiens
tggcacaactgggcactgggta

SEQ ID NO: 15998 - DNA, 20 bp, Homo sapiens
gcacagcaagctttgtaaca

SEQ ID NO: 15999 - DNA, 23 bp, Homo sapiens
tggcacaacgcaggcacctggca

SEQ ID NO: 16000 - DNA, 20 bp, Homo sapiens
tggccaagcctcctttgtaa

SEQ ID NO: 16001 - DNA, 22 bp, Homo sapiens
tggcacaatgtggctttctttg

SEQ ID NO: 16002 - DNA, 22 bp, Homo sapiens
tggcacatttatgactttgtaa

SEQ ID NO: 16003 - DNA, 19 bp, Homo sapiens
tggtcgaacagacctttgt

SEQ ID NO: 16004 - DNA, 20 bp, Homo sapiens
ggcacaacggggagctggca

SEQ ID NO: 16005 - DNA, 19 bp, Homo sapiens
tggtccagcgaggcccgtg

SEQ ID NO: 16006 - DNA, 19 bp, Homo sapiens
tggagcagcgaggcctagc

SEQ ID NO: 16007 - DNA, 18 bp, Homo sapiens
tagcacaccctttgtaac

SEQ ID NO: 16008 - DNA, 25 bp, Homo sapiens
tggcacaaatgaggcagcctcaaca

SEQ ID NO: 16009 - DNA, 114 bp, Fowlpox virus
gttgatcgtgttattaattctttcgctgtaaatacatcattagtagaaaaatcatctatttcaaaaatatttcccccatcgatagaataaattacacgaactatgttattcagc

SEQ ID NO: 16010 - DNA, 24 bp, Fowlpox virus
tgtaaatacatcattagtagaaaa

SEQ ID NO: 16011 - DNA, 20 bp, Homo sapiens
tgtgaaacacaaagtagaaa

SEQ ID NO: 16012 - DNA, 18 bp, Homo sapiens
tgtaaactatagtagaaa

SEQ ID NO: 16013 - DNA, 19 bp, Homo sapiens
taaatacaaattagtagaa

SEQ ID NO: 16014 - DNA, 21 bp, Homo sapiens
taaatacattgaaatagaaaa

SEQ ID NO: 16015 - DNA, 21 bp, Homo sapiens
tgtaagtacatatttagtaaa

SEQ ID NO: 16016 - DNA, 21 bp, Homo sapiens
tgaaatgcatcaccatgtaga

SEQ ID NO: 16017 - DNA, 22 bp, Homo sapiens
tgtaaatattctcaacagagaa

SEQ ID NO: 16018 - DNA, 19 bp, Homo sapiens
tgtaaaggcatcattagta

SEQ ID NO: 16019 - DNA, 19 bp, Homo sapiens
gtaaatacatcatatgaga

SEQ ID NO: 16020 - DNA, 21 bp, Homo sapiens
tataaatacatcctcaggaaa

SEQ ID NO: 16021 - DNA, 20 bp, Homo sapiens
tgtaaaacatcattataaaa

SEQ ID NO: 16022 - DNA, 20 bp, Homo sapiens
tgaaatacgtcactaatgaa

SEQ ID NO: 16023 - DNA, 20 bp, Homo sapiens
tgtagataccattagttaga

SEQ ID NO: 16024 - DNA, 21 bp, Homo sapiens
tgtaaataaatcattggtaaa

SEQ ID NO: 16025 - DNA, 20 bp, Homo sapiens
tgtaaatacacattcttgga

SEQ ID NO: 16026 - DNA, 20 bp, Homo sapiens
tgtaacatatcttagtagaa

SEQ ID NO: 16027 - DNA, 21 bp, Homo sapiens
tgtaaatatcttcatcaggaa

SEQ ID NO: 16028 - DNA, 18 bp, Homo sapiens
tgtaaatgggtcattagc

SEQ ID NO: 16029 - DNA, 105 bp, Fowlpox virus
tgtattaaacaataatactagatggttaatcgacatagatatagtactcctaggtatagaaactaaatcgaatttaaaatcatctgagaatatgttgtttttata

SEQ ID NO: 16030 - DNA, 24 bp, Fowlpox virus
tagaaactaaatcgaatttaaaat

SEQ ID NO: 16031 - DNA, 23 bp, Homo sapiens
cagctgaagatcgaatttaaaat

SEQ ID NO: 16032 - DNA, 24 bp, Homo sapiens
tagtggctaagtcaaatttaaaat

SEQ ID NO: 16033 - DNA, 18 bp, Homo sapiens
tagaaactaaatgcagaa

SEQ ID NO: 16034 - DNA, 21 bp, Homo sapiens
aaaactaaacagatttaaaat

SEQ ID NO: 16035 - DNA, 24 bp, Homo sapiens
taaaaactgaatcgtgtttaaaat

SEQ ID NO: 16036 - DNA, 102 bp, Human papillomavirus type 41
cgaattgctggtattgtggtgcggtgtcctcgacggtccatgtgtcatcttataatcacttggtcagtccagggtacaccactccattatctatttacttcg

SEQ ID NO: 16037 - DNA, 24 bp, Human papillomavirus type 41
tacaccactccattatctatttac

SEQ ID NO: 16038 - DNA, 21 bp, Homo sapiens
tgaccactccattcatattta

SEQ ID NO: 16039 - DNA, 15 bp, Homo sapiens
cacttcatctattta

SEQ ID NO: 16040 - DNA, 21 bp, Homo sapiens
caccacctgttatctgtttac

SEQ ID NO: 16041 - DNA, 21 bp, Homo sapiens
cacaccactttatttcaacct

SEQ ID NO: 16042 - DNA, 17 bp, Homo sapiens
tacaccacccgtcacct

SEQ ID NO: 16043 - DNA, 21 bp, Homo sapiens
tacattaccaccactatttac

SEQ ID NO: 16044 - DNA, 20 bp, Homo sapiens
tacagctacatcatctattt

SEQ ID NO: 16045 - DNA, 20 bp, Homo sapiens
tacaacattccattattcca

SEQ ID NO: 16046 - DNA, 28 bp, Homo sapiens
taccccactccattctgtcattatttac

SEQ ID NO: 16047 - DNA, 17 bp, Homo sapiens
ccaccaccatttattta

SEQ ID NO: 16048 - DNA, 21 bp, Homo sapiens
acaccactttacgctatttac

SEQ ID NO: 16049 - DNA, 19 bp, Homo sapiens
acctattccattgatctat

SEQ ID NO: 16050 - DNA, 18 bp, Homo sapiens
ccactcatgtctatttac

SEQ ID NO: 16051 - DNA, 20 bp, Homo sapiens
tacactctcccttctattta

SEQ ID NO: 16052 - DNA, 21 bp, Homo sapiens
acatcactccactcctattta

SEQ ID NO: 16053 - DNA, 16 bp, Homo sapiens
ccactcctacctattt

SEQ ID NO: 16054 - DNA, 73 bp, Gallid herpesvirus 2
gtaaagtttcggacggcagatatttatgaagccgatttcagtttccgtcgtgaatttgtacgccaaattttac

SEQ ID NO: 16055 - DNA, 24 bp, Gallid herpesvirus 2
agatatttatgaagccgatttcag

SEQ ID NO: 16056 - DNA, 21 bp, Homo sapiens
tattcatgaacatactttcag

SEQ ID NO: 16057 - DNA, 18 bp, Homo sapiens
tttatgaagccgattcag

SEQ ID NO: 16058 - DNA, 19 bp, Homo sapiens
aatgtttatgaagctaatc

SEQ ID NO: 16059 - DNA, 19 bp, Homo sapiens
agatatttattgagcacca

SEQ ID NO: 16060 - DNA, 27 bp, Homo sapiens
agatatttgtgaaaataaacatttcag

SEQ ID NO: 16061 - DNA, 20 bp, Homo sapiens
agatgtttatgaagatgacc

SEQ ID NO: 16062 - DNA, 21 bp, Homo sapiens
tatttatgaaggttaattcag

SEQ ID NO: 16063 - DNA, 20 bp, Homo sapiens
atatttatgggccctttcag

SEQ ID NO: 16064 - DNA, 69 bp, Rat cytomegalovirus
gccgtcaccgtgtcgcagctcttccccggcctcctcctgctggcctactgcgagagccaccgcgccggc

SEQ ID NO: 16065 - DNA, 24 bp, Rat cytomegalovirus
tcgcagctcttccccggcctcctc

SEQ ID NO: 16066 - DNA, 27 bp, Homo sapiens
cagctctttcttttcctggccttctcg

SEQ ID NO: 16067 - DNA, 17 bp, Homo sapiens
gcggctcttcctctcct

SEQ ID NO: 16068 - DNA, 23 bp, Homo sapiens
tctcagctcttccaggccttctc

SEQ ID NO: 16069 - DNA, 24 bp, Homo sapiens
tcgtggcccttcctgactctcctc

SEQ ID NO: 16070 - DNA, 19 bp, Homo sapiens
ccgcagctctttccccctc

SEQ ID NO: 16071 - DNA, 27 bp, Homo sapiens
tcgcagctcctcctccccaggctcttc

SEQ ID NO: 16072 - DNA, 19 bp, Homo sapiens
gcagctctttcctagctct

SEQ ID NO: 16073 - DNA, 21 bp, Homo sapiens
tccagctcttctgatgtcctc

SEQ ID NO: 16074 - DNA, 21 bp, Homo sapiens
tcgcagccttccagcattctc

SEQ ID NO: 16075 - DNA, 22 bp, Homo sapiens
tctggctttttgcaacctcctc

SEQ ID NO: 16076 - DNA, 17 bp, Homo sapiens
gcagcctctggcctcct

SEQ ID NO: 16077 - DNA, 23 bp, Homo sapiens
tcgatggccgagtcggcctcctc

SEQ ID NO: 16078 - DNA, 23 bp, Homo sapiens
tctcagctcttttccccatcctc

SEQ ID NO: 16079 - DNA, 23 bp, Homo sapiens
tcgctttgattcccggcctcctc

SEQ ID NO: 16080 - DNA, 18 bp, Homo sapiens
cagctcttcccccacctc

SEQ ID NO: 16081 - DNA, 18 bp, Homo sapiens
ccgcggctcttcctcctc

SEQ ID NO: 16082 - DNA, 22 bp, Homo sapiens
ccgcgtcctcctcggcctcctc

SEQ ID NO: 16083 - DNA, 19 bp, Homo sapiens
gcagctctctctgctcctc

SEQ ID NO: 16084 - DNA, 27 bp, Homo sapiens
cagctctttcttttcctggtcttctcg

SEQ ID NO: 16085 - DNA, 21 bp, Homo sapiens
ccgcgcggaccctggcctcct

SEQ ID NO: 16086 - DNA, 22 bp, Homo sapiens
gcagctccgaggcggtttcctc

SEQ ID NO: 16087 - DNA, 24 bp, Homo sapiens
tcacagctcttaaaatggtttcct

SEQ ID NO: 16088 - DNA, 21 bp, Homo sapiens
ccaagcctccctggtctcctc

SEQ ID NO: 16089 - DNA, 23 bp, Homo sapiens
tcccagttcttccccataggcct

SEQ ID NO: 16090 - DNA, 21 bp, Homo sapiens
ccggctccccgatggcctcct

SEQ ID NO: 16091 - DNA, 20 bp, Homo sapiens
gcagctctgtcctgcttcct

SEQ ID NO: 16092 - DNA, 20 bp, Homo sapiens
gcataaactcttggcctcct

SEQ ID NO: 16093 - DNA, 27 bp, Homo sapiens
tcgcagctcctcgcccggggtctcctc

SEQ ID NO: 16094 - DNA, 19 bp, Homo sapiens
gccgtttctcggcctcctc

SEQ ID NO: 16095 - DNA, 18 bp, Homo sapiens
cccgtcctcggcctcttc

SEQ ID NO: 16096 - DNA, 20 bp, Homo sapiens
tcccagtccccggcctcctc

SEQ ID NO: 16097 - DNA, 25 bp, Homo sapiens
tcgcagcttgtcttcaccgttcctc

SEQ ID NO: 16098 - DNA, 20 bp, Homo sapiens
tccagctcttcctcatcctc

SEQ ID NO: 16099 - DNA, 21 bp, Homo sapiens
gcactcctgactggcctcctc

SEQ ID NO: 16100 - DNA, 16 bp, Homo sapiens
tcacagcctggcttcc

SEQ ID NO: 16101 - DNA, 17 bp, Homo sapiens
gcagccctttacttcct

SEQ ID NO: 16102 - DNA, 25 bp, Homo sapiens
gcagctcttccagccttgtttcctc

SEQ ID NO: 16103 - DNA, 24 bp, Homo sapiens
tcatggctctatcccggcctcctc

SEQ ID NO: 16104 - DNA, 21 bp, Homo sapiens
tcggcttgggatggcctcctc

SEQ ID NO: 16105 - DNA, 23 bp, Homo sapiens
gcagctctttacaacacctcctc

SEQ ID NO: 16106 - DNA, 19 bp, Homo sapiens
tcacagctcttctctgctc

SEQ ID NO: 16107 - DNA, 20 bp, Homo sapiens
tccagctcttcccatccctc

SEQ ID NO: 16108 - DNA, 24 bp, Homo sapiens
gcagctccaggccttggcttcctc

SEQ ID NO: 16109 - DNA, 19 bp, Homo sapiens
tcggggcttttcctgcctc

SEQ ID NO: 16110 - DNA, 19 bp, Homo sapiens
tcgtagtctcgcgcctcct

SEQ ID NO: 16111 - DNA, 16 bp, Homo sapiens
gcagctccggcttcct

SEQ ID NO: 16112 - DNA, 21 bp, Homo sapiens
gcagttcttatctaacctcct

SEQ ID NO: 16113 - DNA, 21 bp, Homo sapiens
tcccagctcttccttgggctc

SEQ ID NO: 16114 - DNA, 16 bp, Homo sapiens
gcagctctggcttcct

SEQ ID NO: 16115 - DNA, 21 bp, Homo sapiens
tcctagcctcctggtctcctc

SEQ ID NO: 16116 - DNA, 20 bp, Homo sapiens
tcgcaactcttctccttctc

SEQ ID NO: 16117 - DNA, 20 bp, Homo sapiens
tccagctcttctccagattc

SEQ ID NO: 16118 - DNA, 18 bp, Homo sapiens
ccgcggctcttctctcct

SEQ ID NO: 16119 - DNA, 18 bp, Homo sapiens
accctttcctggcctcct

SEQ ID NO: 16120 - DNA, 21 bp, Homo sapiens
tcgcagctctgtctttggggc

SEQ ID NO: 16121 - DNA, 20 bp, Homo sapiens
tcgcagctctctccgaactc

SEQ ID NO: 16122 - DNA, 16 bp, Homo sapiens
gcactcttaacctcct

SEQ ID NO: 16123 - DNA, 19 bp, Homo sapiens
cagctcttctagcatcttc

SEQ ID NO: 16124 - DNA, 20 bp, Homo sapiens
agtctgtccctggcctcctc

SEQ ID NO: 16125 - DNA, 16 bp, Homo sapiens
gcaacttccggcctct

SEQ ID NO: 16126 - DNA, 22 bp, Homo sapiens
gcagctcttccccaagctcttc

SEQ ID NO: 16127 - DNA, 19 bp, Homo sapiens
agttcttccccaccttctc

SEQ ID NO: 16128 - DNA, 18 bp, Homo sapiens
tccagctctttcaactct

SEQ ID NO: 16129 - DNA, 20 bp, Homo sapiens
tcacagctgaacggcctcct

SEQ ID NO: 16130 - DNA, 19 bp, Homo sapiens
tcgccacctctggcctcct

SEQ ID NO: 16131 - DNA, 19 bp, Homo sapiens
gctcttcccacagagcctc

SEQ ID NO: 16132 - DNA, 21 bp, Homo sapiens
gcccatttccctggcctcctc

SEQ ID NO: 16133 - DNA, 19 bp, Homo sapiens
gcagctccttggtcttctc

SEQ ID NO: 16134 - DNA, 18 bp, Homo sapiens
tcgcagctccttgctcct

SEQ ID NO: 16135 - DNA, 18 bp, Homo sapiens
ccgcaccccttggcttct

SEQ ID NO: 16136 - DNA, 18 bp, Homo sapiens
gcagctctgcgcgctcct

SEQ ID NO: 16137 - DNA, 23 bp, Homo sapiens
tcatagctttttcccgtcccctc

SEQ ID NO: 16138 - DNA, 19 bp, Homo sapiens
ccgcggctcttccctgccc

SEQ ID NO: 16139 - DNA, 22 bp, Homo sapiens
tcgcgccttccccggcctcctc

SEQ ID NO: 16140 - DNA, 19 bp, Homo sapiens
tcgctgctcccggcctcct

SEQ ID NO: 16141 - DNA, 24 bp, Homo sapiens
ccgtagctcttctaacacctcttc

SEQ ID NO: 16142 - DNA, 24 bp, Homo sapiens
gcagctcttttcctccaagtcctc

SEQ ID NO: 16143 - DNA, 17 bp, Homo sapiens
gcagcactggcctcctc

SEQ ID NO: 16144 - DNA, 18 bp, Homo sapiens
ccggcgcctcggcctcct

SEQ ID NO: 16145 - DNA, 20 bp, Homo sapiens
gcagctcttctctccttctc

SEQ ID NO: 16146 - DNA, 22 bp, Homo sapiens
tccagctcttcctgtgggtctc

SEQ ID NO: 16147 - DNA, 17 bp, Homo sapiens
gcaggacccggcctcct

SEQ ID NO: 16148 - DNA, 20 bp, Homo sapiens
cgcagctgctcggcctcctc

SEQ ID NO: 16149 - DNA, 19 bp, Homo sapiens
gctcctccttggccttctc

SEQ ID NO: 16150 - DNA, 21 bp, Homo sapiens
tccaggtgtcctggcctcctc

SEQ ID NO: 16151 - DNA, 20 bp, Homo sapiens
tcacagcaggctggcctcct

SEQ ID NO: 16152 - DNA, 79 bp, Rat cytomegalovirus
gcgtctccggtcccgatcgaccggtcgccccgtcgcattgttcgacgcgggcgagcgtgcgcgggatccccggcgacgc

SEQ ID NO: 16153 - DNA, 24 bp, Rat cytomegalovirus
gcgagcgtgcgcgggatccccggc

SEQ ID NO: 16154 - DNA, 23 bp, Homo sapiens
gcggggtggcagcggtccccggc

SEQ ID NO: 16155 - DNA, 23 bp, Homo sapiens
gcgcagcgctgcggatccccggc

SEQ ID NO: 16156 - DNA, 21 bp, Homo sapiens
gctggcgtccgggtccccggc

SEQ ID NO: 16157 - DNA, 19 bp, Homo sapiens
gaggtatgaggatccctgg

SEQ ID NO: 16158 - DNA, 24 bp, Homo sapiens
cgggcgtgtgcccgcgtccccggc

SEQ ID NO: 16159 - DNA, 20 bp, Homo sapiens
gcgggcggcgcggcgaccgg

SEQ ID NO: 16160 - DNA, 17 bp, Homo sapiens
gaccgtgcgccccccgg

SEQ ID NO: 16161 - DNA, 18 bp, Homo sapiens
gcgagtgtgtgcgcccgg

SEQ ID NO: 16162 - DNA, 21 bp, Homo sapiens
gcggcccccggggtccccggc

SEQ ID NO: 16163 - DNA, 16 bp, Homo sapiens
gagcgtgtgaccccgg

SEQ ID NO: 16164 - DNA, 20 bp, Homo sapiens
gcgggcgggcgtggggccgg

SEQ ID NO: 16165 - DNA, 19 bp, Homo sapiens
gcgggcggagaatccccgg

SEQ ID NO: 16166 - DNA, 16 bp, Homo sapiens
gcgaggtgcgctcccg

SEQ ID NO: 16167 - DNA, 22 bp, Homo sapiens
gcgagcggcgcggggaggcggc

SEQ ID NO: 16168 - DNA, 19 bp, Homo sapiens
gctgccctgcgtccccggc

SEQ ID NO: 16169 - DNA, 16 bp, Homo sapiens
gcgagcgtgcggggcg

SEQ ID NO: 16170 - DNA, 19 bp, Homo sapiens
gcgagcgagcgggccccgg

SEQ ID NO: 16171 - DNA, 19 bp, Homo sapiens
gcgagcgtggtgggactgg

SEQ ID NO: 16172 - DNA, 21 bp, Homo sapiens
gcggtgtgcgcgggatccggc

SEQ ID NO: 16173 - DNA, 18 bp, Homo sapiens
gcgggctgcgcggcgcgg

SEQ ID NO: 16174 - DNA, 18 bp, Homo sapiens
gcggcgtgcgcggcccgg

SEQ ID NO: 16175 - DNA, 18 bp, Homo sapiens
gcgggcggcgcgggacgg

SEQ ID NO: 16176 - DNA, 16 bp, Homo sapiens
gcgggcggcgcgggcg

SEQ ID NO: 16177 - DNA, 21 bp, Homo sapiens
gcgggcggcgggctcttcggc

SEQ ID NO: 16178 - DNA, 19 bp, Homo sapiens
gcggcgtgcgcgctctcgg

SEQ ID NO: 16179 - DNA, 23 bp, Homo sapiens
gcggggtgcgcggggaagggagc

SEQ ID NO: 16180 - DNA, 19 bp, Homo sapiens
gagcgcgcggatctccggc

SEQ ID NO: 16181 - DNA, 21 bp, Homo sapiens
cggcgacacaggatctttggc

SEQ ID NO: 16182 - DNA, 21 bp, Homo sapiens
gcgggcgcccgggatccccgg

SEQ ID NO: 16183 - DNA, 24 bp, Homo sapiens
gcgagcgtgtgcagcgggactggc

SEQ ID NO: 16184 - DNA, 81 bp, Rat cytomegalovirus
tcccgggcgctgacgccgccgacgacatcagacgagcggatctccggtcgttctttcgtcgggagaagaagcgagccggga

SEQ ID NO: 16185 - DNA, 24 bp, Rat cytomegalovirus
gtcgttctttcgtcgggagaagaa

SEQ ID NO: 16186 - DNA, 17 bp, Homo sapiens
gtcttctttcgtaagaa

SEQ ID NO: 16187 - DNA, 20 bp, Homo sapiens
gttccttcgtccattaggga

SEQ ID NO: 16188 - DNA, 20 bp, Homo sapiens
gttctttttttaaaagaaga

SEQ ID NO: 16189 - DNA, 20 bp, Homo sapiens
gtccttttttatgaggagaa

SEQ ID NO: 16190 - DNA, 16 bp, Homo sapiens
gtcttctttcggagag

SEQ ID NO: 16191 - DNA, 18 bp, Homo sapiens
gttccttcgggaggagaa

SEQ ID NO: 16192 - DNA, 23 bp, Homo sapiens
gttgttctttcaaaaaagaagaa

SEQ ID NO: 16193 - DNA, 16 bp, Homo sapiens
gttctttaggaggaga

SEQ ID NO: 16194 - DNA, 21 bp, Homo sapiens
gttcttcctatgggggaagaa

SEQ ID NO: 16195 - DNA, 16 bp, Homo sapiens
gtcgtgccgggaggag

SEQ ID NO: 16196 - DNA, 22 bp, Homo sapiens
gttctttttcgacgaggagaag

SEQ ID NO: 16197 - DNA, 19 bp, Homo sapiens
gtcgtcggctgggagagga

SEQ ID NO: 16198 - DNA, 19 bp, Homo sapiens
gtttttttcaacaggagaa

SEQ ID NO: 16199 - DNA, 17 bp, Homo sapiens
gtgctttgtagagaaga

SEQ ID NO: 16200 - DNA, 15 bp, Homo sapiens
gttctgtcaagaaga

SEQ ID NO: 16201 - DNA, 21 bp, Homo sapiens
gttgttcttagtgggagaaga

SEQ ID NO: 16202 - DNA, 22 bp, Homo sapiens
gtcgccgtcgtcggggggagaa

SEQ ID NO: 16203 - DNA, 23 bp, Homo sapiens
gtcgtctttcatctgggggagaa

SEQ ID NO: 16204 - DNA, 72 bp, Rat cytomegalovirus
ggcgggcggcgagcaggatcagcagcgccacgagattgtcgatcatcgtcgtccttcccctcgccgtccgtt

SEQ ID NO: 16205 - DNA, 24 bp, Rat cytomegalovirus
gcaggatcagcagcgccacgagat

SEQ ID NO: 16206 - DNA, 19 bp, Homo sapiens
gcaggatagcagcacagga

SEQ ID NO: 16207 - DNA, 22 bp, Homo sapiens
gcaggatccagtgacccgggat

SEQ ID NO: 16208 - DNA, 19 bp, Homo sapiens
acaggatcattccatgaga

SEQ ID NO: 16209 - DNA, 17 bp, Homo sapiens
gcaggatccagtggcca

SEQ ID NO: 16210 - DNA, 23 bp, Homo sapiens
gcggggctggcagcgcccgctat

SEQ ID NO: 16211 - DNA, 19 bp, Homo sapiens
ggtcagcagcagcatgacg

SEQ ID NO: 16212 - DNA, 18 bp, Homo sapiens
gctgggtcagcagcgcca

SEQ ID NO: 16213 - DNA, 18 bp, Homo sapiens
aggatcagcagtgccacg

SEQ ID NO: 16214 - DNA, 17 bp, Homo sapiens
acaggatcagcagagag

SEQ ID NO: 16215 - DNA, 22 bp, Homo sapiens
gcaggaccagcagggtggagat

SEQ ID NO: 16216 - DNA, 15 bp, Homo sapiens
ggatcagcagccgag

SEQ ID NO: 16217 - DNA, 61 bp, Rat cytomegalovirus
agtggacgcgcctcccggtttaccaaccatttcgtgtccgggaggatggtcgcgccctact

SEQ ID NO: 16218 - DNA, 24 bp, Rat cytomegalovirus
tccgggaggatggtcgcgccctac

SEQ ID NO: 16219 - DNA, 21 bp, Homo sapiens
gggaggatgaggttgtgctct

SEQ ID NO: 16220 - DNA, 18 bp, Homo sapiens
tcctgggggatggcctgc

SEQ ID NO: 16221 - DNA, 20 bp, Homo sapiens
cgggaggagctggctgcgcc

SEQ ID NO: 16222 - DNA, 20 bp, Homo sapiens
ccgggagggtcaggggccct

SEQ ID NO: 16223 - DNA, 23 bp, Homo sapiens
tccgggtggagccctgcgcccta

SEQ ID NO: 16224 - DNA, 20 bp, Homo sapiens
tccgggaggaggcagtccct

SEQ ID NO: 16225 - DNA, 22 bp, Homo sapiens
tccgggagcaagagggcgtcct

SEQ ID NO: 16226 - DNA, 21 bp, Homo sapiens
cctgggaggatggccagccct

SEQ ID NO: 16227 - DNA, 16 bp, Homo sapiens
ggaaggatgcacccta

SEQ ID NO: 16228 - DNA, 17 bp, Homo sapiens
gagaggaaggctgccct

SEQ ID NO: 16229 - DNA, 83 bp, Rat cytomegalovirus
cgtatttagaggcctcgaaacaacgtggaacggcgtttcgatcgatagcgcgttcgacggagtttcggggcttcgaaagtacg

SEQ ID NO: 16230 - DNA, 24 bp, Rat cytomegalovirus
tagaggcctcgaaacaacgtggaa

SEQ ID NO: 16231 - DNA, 19 bp, Homo sapiens
ggcctcgaggcacaatgga

SEQ ID NO: 16232 - DNA, 22 bp, Homo sapiens
aggtggaggagacaacgtggaa

SEQ ID NO: 16233 - DNA, 17 bp, Homo sapiens
ggcttcaaacaacagaa

SEQ ID NO: 16234 - DNA, 21 bp, Homo sapiens
tagaggcctcagacaccctgg

SEQ ID NO: 16235 - DNA, 19 bp, Homo sapiens
gaggctgcagtacgtggaa

SEQ ID NO: 16236 - DNA, 15 bp, Homo sapiens
tagagcacaacgtgg

SEQ ID NO: 16237 - DNA, 21 bp, Homo sapiens
tagaggccccggggcacggaa

SEQ ID NO: 16238 - DNA, 18 bp, Homo sapiens
gaccccgaaacaacgtgg

SEQ ID NO: 16239 - DNA, 15 bp, Homo sapiens
gaggcctcaaacggg

SEQ ID NO: 16240 - DNA, 20 bp, Homo sapiens
tagaggcctggaggccatgg

SEQ ID NO: 16241 - DNA, 68 bp, Rat cytomegalovirus
ggggggcctcctcgatcgtccgcgaagaatcgatttattaagcttcgggggcggtcggaaggtccccc

SEQ ID NO: 16242 - DNA, 23 bp, Rat cytomegalovirus
cgggggcggtcggaaggtccccc

SEQ ID NO: 16243 - DNA, 21 bp, Homo sapiens
ggggcggggacagggtctccc

SEQ ID NO: 16244 - DNA, 15 bp, Homo sapiens
gggggcggcggcccc

SEQ ID NO: 16245 - DNA, 19 bp, Homo sapiens
ggaggtggttgggggttcc

SEQ ID NO: 16246 - DNA, 19 bp, Homo sapiens
cggagacaggaaggtcccc

SEQ ID NO: 16247 - DNA, 21 bp, Homo sapiens
ggggcgtgcctaaggtccccc

SEQ ID NO: 16248 - DNA, 20 bp, Homo sapiens
cgggggccggctggtttccc

SEQ ID NO: 16249 - DNA, 18 bp, Homo sapiens
ggccttggagggtccccc

SEQ ID NO: 16250 - DNA, 18 bp, Homo sapiens
ggggcggtcgcagcctcc

SEQ ID NO: 16251 - DNA, 19 bp, Homo sapiens
gggcaccccggggttcccc

SEQ ID NO: 16252 - DNA, 20 bp, Homo sapiens
gggcatgtggaaggttttcc

SEQ ID NO: 16253 - DNA, 22 bp, Homo sapiens
cggcggctccgcggggtccccc

SEQ ID NO: 16254 - DNA, 24 bp, Homo sapiens
cgggagcggcggccgaaggtttcc

SEQ ID NO: 16255 - DNA, 17 bp, Homo sapiens
cggggacgcgggtctcc

SEQ ID NO: 16256 - DNA, 22 bp, Homo sapiens
cagacaccttggaaggttcccc

SEQ ID NO: 16257 - DNA, 21 bp, Homo sapiens
cgggggcggtggatagagtcc

SEQ ID NO: 16258 - DNA, 19 bp, Homo sapiens
cgggggcggttggcggggc

SEQ ID NO: 16259 - DNA, 17 bp, Homo sapiens
ggtggcagaaggtcccc

SEQ ID NO: 16260 - DNA, 18 bp, Homo sapiens
cgtgggcggccggtttcc

SEQ ID NO: 16261 - DNA, 19 bp, Homo sapiens
gggggcggcggggagaggc

SEQ ID NO: 16262 - DNA, 17 bp, Homo sapiens
gggggcggctgggggcc

SEQ ID NO: 16263 - DNA, 18 bp, Homo sapiens
ggggacggtcggtcctcc

SEQ ID NO: 16264 - DNA, 19 bp, Homo sapiens
cgggagcgcgggggtctcc

SEQ ID NO: 16265 - DNA, 16 bp, Homo sapiens
gggggcgggggtcccc

SEQ ID NO: 16266 - DNA, 17 bp, Homo sapiens
cgggggcggcgaacccc

SEQ ID NO: 16267 - DNA, 16 bp, Homo sapiens
gggggcggccgggccc

SEQ ID NO: 16268 - DNA, 18 bp, Homo sapiens
cagggaggaaggtctccc

SEQ ID NO: 16269 - DNA, 16 bp, Homo sapiens
gggggcgcaggtcccc

SEQ ID NO: 16270 - DNA, 16 bp, Homo sapiens
cgggggcggcggaggc

SEQ ID NO: 16271 - DNA, 18 bp, Homo sapiens
cgggggcggatggtgatc

SEQ ID NO: 16272 - DNA, 17 bp, Homo sapiens
cgggggcatggaggtcc

SEQ ID NO: 16273 - DNA, 18 bp, Homo sapiens
cgggggcggtcagagggc

SEQ ID NO: 16274 - DNA, 22 bp, Homo sapiens
gggggcagttggaacacacccc

SEQ ID NO: 16275 - DNA, 22 bp, Homo sapiens
gggaggcggcttccggtttccc

SEQ ID NO: 16276 - DNA, 16 bp, Homo sapiens
cgggggcggcggggcc

SEQ ID NO: 16277 - DNA, 17 bp, Homo sapiens
agggcagggaaggtccc

SEQ ID NO: 16278 - DNA, 16 bp, Homo sapiens
cgggggcggcgggggc

SEQ ID NO: 16279 - DNA, 17 bp, Homo sapiens
ggggtgcggggagggtc

SEQ ID NO: 16280 - DNA, 17 bp, Homo sapiens
gggggcgttggaaggcc

SEQ ID NO: 16281 - DNA, 21 bp, Homo sapiens
cgggggcggacggaagggccc

SEQ ID NO: 16282 - DNA, 23 bp, Homo sapiens
cgggggcggccggggggggctcc

SEQ ID NO: 16283 - DNA, 17 bp, Homo sapiens
cagaagcattggaaggt

SEQ ID NO: 16284 - DNA, 17 bp, Homo sapiens
gggggtggcaggtcccc

SEQ ID NO: 16285 - DNA, 16 bp, Homo sapiens
caggggcaggggtccc

SEQ ID NO: 16286 - DNA, 20 bp, Homo sapiens
gggggtgagtggggtccccc

SEQ ID NO: 16287 - DNA, 15 bp, Homo sapiens
ggggacagggtcccc

SEQ ID NO: 16288 - DNA, 29 bp, Homo sapiens
cgggggtggtgcggaagcattgttccccg

SEQ ID NO: 16289 - DNA, 20 bp, Homo sapiens
cgggggcggcggggcgctcc

SEQ ID NO: 16290 - DNA, 18 bp, Homo sapiens
cgggggcggcgggagccc

SEQ ID NO: 16291 - DNA, 18 bp, Homo sapiens
cgagggcaggggtcctcc

SEQ ID NO: 16292 - DNA, 24 bp, Homo sapiens
cgggggcggtcaaccccggttccc

SEQ ID NO: 16293 - DNA, 20 bp, Homo sapiens
cgagggaagggagggtctcc

SEQ ID NO: 16294 - DNA, 21 bp, Homo sapiens
ggaggcgggtggggggtcccc

SEQ ID NO: 16295 - DNA, 26 bp, Homo sapiens
cgggggcggcgagtcagaggttctcc

SEQ ID NO: 16296 - DNA, 16 bp, Homo sapiens
gggggcaggggtcccc

SEQ ID NO: 16297 - DNA, 23 bp, Homo sapiens
cgggggcggtcagagaatggtcc

SEQ ID NO: 16298 - DNA, 19 bp, Homo sapiens
gggctggggagggtccccc

SEQ ID NO: 16299 - DNA, 15 bp, Homo sapiens
gggggcaaggtcccc

SEQ ID NO: 16300 - DNA, 17 bp, Homo sapiens
gggggcgggcggggacc

SEQ ID NO: 16301 - DNA, 17 bp, Homo sapiens
ggtggggaaggtctccc

SEQ ID NO: 16302 - DNA, 20 bp, Homo sapiens
gggggcctccagggtccccc

SEQ ID NO: 16303 - DNA, 17 bp, Homo sapiens
cggggagcacagggtcc

SEQ ID NO: 16304 - DNA, 20 bp, Homo sapiens
caggggcagcatgagggtcc

SEQ ID NO: 16305 - DNA, 20 bp, Homo sapiens
gggaggttttggggtccccc

SEQ ID NO: 16306 - DNA, 20 bp, Homo sapiens
gggggaggacacggtccccc

SEQ ID NO: 16307 - DNA, 17 bp, Homo sapiens
cgggagggaggtctccc

SEQ ID NO: 16308 - DNA, 19 bp, Homo sapiens
cggtggtggcagagggtcc

SEQ ID NO: 16309 - DNA, 23 bp, Homo sapiens
gggggcggtggcctcggtttccc

SEQ ID NO: 16310 - DNA, 22 bp, Homo sapiens
gggggcggctcggggaggaacc

SEQ ID NO: 16311 - DNA, 20 bp, Homo sapiens
cggggccagaagaggtttcc

SEQ ID NO: 16312 - DNA, 18 bp, Homo sapiens
caggggcgcatgggtccc

SEQ ID NO: 16313 - DNA, 23 bp, Homo sapiens
gggggcggcctgaaaggttttcc

SEQ ID NO: 16314 - DNA, 22 bp, Homo sapiens
ggggacggggggggggtccccc

SEQ ID NO: 16315 - DNA, 16 bp, Homo sapiens
cgggggcgccggttcc

SEQ ID NO: 16316 - DNA, 21 bp, Homo sapiens
cgagggtggttggagcatccc

SEQ ID NO: 16317 - DNA, 21 bp, Homo sapiens
caggggtcagttgtggggggt

SEQ ID NO: 16318 - DNA, 20 bp, Homo sapiens
gggaggctggggggtccccc

SEQ ID NO: 16319 - DNA, 19 bp, Homo sapiens
cgggggtcccagggtcccc

SEQ ID NO: 16320 - DNA, 15 bp, Homo sapiens
cgggggcgtcgtccc

SEQ ID NO: 16321 - DNA, 18 bp, Homo sapiens
cggtggcggcgggtcccc

SEQ ID NO: 16322 - DNA, 17 bp, Homo sapiens
aggggcagggaggtccc

SEQ ID NO: 16323 - DNA, 24 bp, Homo sapiens
gggggcaggtcgggtggccacccc

SEQ ID NO: 16324 - DNA, 19 bp, Homo sapiens
ggaggcggctgggtcctcc

SEQ ID NO: 16325 - DNA, 17 bp, Homo sapiens
cgggggcgggcggggtc

SEQ ID NO: 16326 - DNA, 17 bp, Homo sapiens
ggggcggtgatggtccc

SEQ ID NO: 16327 - DNA, 20 bp, Homo sapiens
gagggttcaaaaggttttcc

SEQ ID NO: 16328 - DNA, 16 bp, Homo sapiens
gggggcagggggttcc

SEQ ID NO: 16329 - DNA, 19 bp, Homo sapiens
cgggggcggcggggcgtcc

SEQ ID NO: 16330 - DNA, 18 bp, Homo sapiens
cgggggcggccggggggc

SEQ ID NO: 16331 - DNA, 19 bp, Homo sapiens
cgggggcggcggaggcgcc

SEQ ID NO: 16332 - DNA, 17 bp, Homo sapiens
ggcagcggagggtcccc

SEQ ID NO: 16333 - DNA, 23 bp, Homo sapiens
cggaggcggtccctccgggttcc

SEQ ID NO: 16334 - DNA, 22 bp, Homo sapiens
gggggcggctggaggagccccc

SEQ ID NO: 16335 - DNA, 15 bp, Homo sapiens
cggaggcaaggtccc

SEQ ID NO: 16336 - DNA, 19 bp, Homo sapiens
gggcctctgggggtccccc

SEQ ID NO: 16337 - DNA, 18 bp, Homo sapiens
gggggcggcggggccccc

SEQ ID NO: 16338 - DNA, 22 bp, Homo sapiens
cgggggcggatgggggagaggc

SEQ ID NO: 16339 - DNA, 20 bp, Homo sapiens
caggggtcagggaaggtccc

SEQ ID NO: 16340 - DNA, 18 bp, Homo sapiens
cgggggcggtcaactttc

SEQ ID NO: 16341 - DNA, 20 bp, Homo sapiens
cgggggcggtggggtgtccc

SEQ ID NO: 16342 - DNA, 18 bp, Homo sapiens
ggggcagaaaggtccccc

SEQ ID NO: 16343 - DNA, 21 bp, Homo sapiens
caggggcgggcgaggtcttcc

SEQ ID NO: 16344 - DNA, 18 bp, Homo sapiens
gggagcaagtggggtccc

SEQ ID NO: 16345 - DNA, 17 bp, Homo sapiens
cgggggcagagctggtc

SEQ ID NO: 16346 - DNA, 18 bp, Homo sapiens
ggggtgcgacaggtcccc

SEQ ID NO: 16347 - DNA, 19 bp, Homo sapiens
ggggcggcaggggttcccc

SEQ ID NO: 16348 - DNA, 20 bp, Homo sapiens
gggagtccggagggtccccc

SEQ ID NO: 16349 - DNA, 21 bp, Homo sapiens
gagggtgacacccaggtcccc

SEQ ID NO: 16350 - DNA, 18 bp, Homo sapiens
gggggcaggggccggtcc

SEQ ID NO: 16351 - DNA, 16 bp, Homo sapiens
cggggtgcaggtcccc

SEQ ID NO: 16352 - DNA, 22 bp, Homo sapiens
cgggggcggcgggccggtctcc

SEQ ID NO: 16353 - DNA, 17 bp, Homo sapiens
cgtgggcaaaggtcccc

SEQ ID NO: 16354 - DNA, 17 bp, Homo sapiens
ggcggcggcgggtcccc

SEQ ID NO: 16355 - DNA, 23 bp, Homo sapiens
cggggtcctggtggaggtccccc

SEQ ID NO: 16356 - DNA, 17 bp, Homo sapiens
cgggggcggtcctcccc

SEQ ID NO: 16357 - DNA, 17 bp, Homo sapiens
ggggaggaaggtccccc

SEQ ID NO: 16358 - DNA, 20 bp, Homo sapiens
cggggtggggggggttcccc

SEQ ID NO: 16359 - DNA, 16 bp, Homo sapiens
ggggcccggggtctcc

SEQ ID NO: 16360 - DNA, 22 bp, Homo sapiens
gggggaggttggaaggtcttcc

SEQ ID NO: 16361 - DNA, 16 bp, Homo sapiens
gggggccgcggtcccc

SEQ ID NO: 16362 - DNA, 17 bp, Homo sapiens
cgggggcgtccgtcccc

SEQ ID NO: 16363 - DNA, 19 bp, Homo sapiens
cggggagcagaggttctcc

SEQ ID NO: 16364 - DNA, 19 bp, Homo sapiens
gggggcaggaaggtcttcc

SEQ ID NO: 16365 - DNA, 63 bp, Chimpanzee cytomegalovirus
cggaggaggcagacagacggcaggcggccggccgggcaccggctgcaaccctctcctcttctg

SEQ ID NO: 16366 - DNA, 24 bp, Chimpanzee cytomegalovirus
aggcagacagacggcaggcggccg

SEQ ID NO: 16367 - DNA, 21 bp, Homo sapiens
ggcaggcaggcgtgcaggtgg

SEQ ID NO: 16368 - DNA, 21 bp, Homo sapiens
aggtcgacggtcaggcggccg

SEQ ID NO: 16369 - DNA, 18 bp, Homo sapiens
agcagacaacacagtggc

SEQ ID NO: 16370 - DNA, 18 bp, Homo sapiens
agacagacaggtggcagg

SEQ ID NO: 16371 - DNA, 16 bp, Homo sapiens
aggcagcaggcgaggc

SEQ ID NO: 16372 - DNA, 19 bp, Homo sapiens
gcagacagcgcggcggccg

SEQ ID NO: 16373 - DNA, 22 bp, Homo sapiens
gcaggggccgggcgggcggccg

SEQ ID NO: 16374 - DNA, 19 bp, Homo sapiens
ggcgcaggcgggcgcggcc

SEQ ID NO: 16375 - DNA, 21 bp, Homo sapiens
ggcagagggggcaggcggccg

SEQ ID NO: 16376 - DNA, 21 bp, Homo sapiens
ggcgggacgggcgggcagccg

SEQ ID NO: 16377 - DNA, 19 bp, Homo sapiens
aggcgcgcagacggcagac

SEQ ID NO: 16378 - DNA, 21 bp, Homo sapiens
ggcagcctcagggcaggcggc

SEQ ID NO: 16379 - DNA, 19 bp, Homo sapiens
ggcgcaggcggcggcggcc

SEQ ID NO: 16380 - DNA, 18 bp, Homo sapiens
ggcaggcaggtgcagggc

SEQ ID NO: 16381 - DNA, 22 bp, Homo sapiens
ggctggcaggcggggcgggccg

SEQ ID NO: 16382 - DNA, 20 bp, Homo sapiens
aggcggcgggcaggcggccg

SEQ ID NO: 16383 - DNA, 16 bp, Homo sapiens
ggcgggcaggcggccg

SEQ ID NO: 16384 - DNA, 18 bp, Homo sapiens
aggcaggcggaggcggcc

SEQ ID NO: 16385 - DNA, 21 bp, Homo sapiens
aggcggcgggagcggcggccg

SEQ ID NO: 16386 - DNA, 17 bp, Homo sapiens
ggtgacaggcggcggcg

SEQ ID NO: 16387 - DNA, 26 bp, Homo sapiens
aggcaggcaggcaggcaggcaggccg

SEQ ID NO: 16388 - DNA, 18 bp, Homo sapiens
aggcaggcaggcaggcag

SEQ ID NO: 16389 - DNA, 18 bp, Homo sapiens
aggcagacaggcaggcag

SEQ ID NO: 16390 - DNA, 17 bp, Homo sapiens
ggcagccgggaagcggc

SEQ ID NO: 16391 - DNA, 18 bp, Homo sapiens
aggagactgcaggcggcc

SEQ ID NO: 16392 - DNA, 18 bp, Homo sapiens
aggggacagacagcggcc

SEQ ID NO: 16393 - DNA, 20 bp, Homo sapiens
ggcagacagcaacgggcggc

SEQ ID NO: 16394 - DNA, 27 bp, Homo sapiens
ggcagacagaggtgggcggccgcctgc

SEQ ID NO: 16395 - DNA, 20 bp, Homo sapiens
ggcaagacagacggcagacg

SEQ ID NO: 16396 - DNA, 16 bp, Homo sapiens
ggcaggcgggcggccg

SEQ ID NO: 16397 - DNA, 18 bp, Homo sapiens
ggcgcagacgggcggcca

SEQ ID NO: 16398 - DNA, 16 bp, Homo sapiens
ggcagacaggagcggc

SEQ ID NO: 16399 - DNA, 18 bp, Homo sapiens
ggcagcccgcaggcggcc

SEQ ID NO: 16400 - DNA, 19 bp, Homo sapiens
gggaaagggcgggcggccg

SEQ ID NO: 16401 - DNA, 17 bp, Homo sapiens
aggcagcgggcggcggc

SEQ ID NO: 16402 - DNA, 22 bp, Homo sapiens
agcagacagagcaaagtggccg

SEQ ID NO: 16403 - DNA, 21 bp, Homo sapiens
ggctgaaggggcgggcggccg

SEQ ID NO: 16404 - DNA, 18 bp, Homo sapiens
aggcaggtgggcaggcgg

SEQ ID NO: 16405 - DNA, 21 bp, Homo sapiens
aggcgggcagatggacagacg

SEQ ID NO: 16406 - DNA, 18 bp, Homo sapiens
ggcaggcaggggagaggc

SEQ ID NO: 16407 - DNA, 21 bp, Homo sapiens
aggccggcgtcggggcggccg

SEQ ID NO: 16408 - DNA, 17 bp, Homo sapiens
aggcagacagatgcagg

SEQ ID NO: 16409 - DNA, 18 bp, Homo sapiens
ggcaggcggcgggggccg

SEQ ID NO: 16410 - DNA, 20 bp, Homo sapiens
ggcaggcggcaagcgggccg

SEQ ID NO: 16411 - DNA, 19 bp, Homo sapiens
ggcggcagacggcgggcgg

SEQ ID NO: 16412 - DNA, 18 bp, Homo sapiens
ggtggacaggcaggagcc

SEQ ID NO: 16413 - DNA, 22 bp, Homo sapiens
aggtagagactccccaggcggc

SEQ ID NO: 16414 - DNA, 18 bp, Homo sapiens
ggcaggcagaggagccag

SEQ ID NO: 16415 - DNA, 22 bp, Homo sapiens
ggcaggcaggggccaggggccg

SEQ ID NO: 16416 - DNA, 21 bp, Homo sapiens
aggcaggcaggaggcattacg

SEQ ID NO: 16417 - DNA, 18 bp, Homo sapiens
ggcaggcgcggcggcggc

SEQ ID NO: 16418 - DNA, 19 bp, Homo sapiens
ggcagacaggtggcgggcg

SEQ ID NO: 16419 - DNA, 18 bp, Homo sapiens
aggcagggggcggcggcc

SEQ ID NO: 16420 - DNA, 18 bp, Homo sapiens
aggcggacggccggcggc

SEQ ID NO: 16421 - DNA, 16 bp, Homo sapiens
ggcggagcaggcgacc

SEQ ID NO: 16422 - DNA, 17 bp, Homo sapiens
ggcagaggcgggcggcc

SEQ ID NO: 16423 - DNA, 18 bp, Homo sapiens
aggcaggagacggtgccc

SEQ ID NO: 16424 - DNA, 18 bp, Homo sapiens
aggcaggcaggcggcagg

SEQ ID NO: 16425 - DNA, 19 bp, Homo sapiens
ggcaggcagggggcggggc

SEQ ID NO: 16426 - DNA, 18 bp, Homo sapiens
aggcagggcaggcggtcc

SEQ ID NO: 16427 - DNA, 22 bp, Homo sapiens
aggcaggcaggcaggcaggccg

SEQ ID NO: 16428 - DNA, 18 bp, Homo sapiens
ggcaggtggaggcaggcg

SEQ ID NO: 16429 - DNA, 21 bp, Homo sapiens
agccaggcggcgcggcggccg

SEQ ID NO: 16430 - DNA, 19 bp, Homo sapiens
aggcagatgtgcgggcgcc

SEQ ID NO: 16431 - DNA, 17 bp, Homo sapiens
aggccaaggcaggcggc

SEQ ID NO: 16432 - DNA, 16 bp, Homo sapiens
ggcagacagaggaggc

SEQ ID NO: 16433 - DNA, 24 bp, Homo sapiens
aggtgagcccgatgtgggcggccg

SEQ ID NO: 16434 - DNA, 20 bp, Homo sapiens
ggcgggcgaggaggcggccg

SEQ ID NO: 16435 - DNA, 19 bp, Homo sapiens
aggcaggcaatgcaaggcc

SEQ ID NO: 16436 - DNA, 24 bp, Homo sapiens
aggtggagggaggaccggcggccg

SEQ ID NO: 16437 - DNA, 17 bp, Homo sapiens
aggcagacggaggcgac

SEQ ID NO: 16438 - DNA, 18 bp, Homo sapiens
ggaggacgggcagcggcc

SEQ ID NO: 16439 - DNA, 19 bp, Homo sapiens
aggcggacagaagcgcggc

SEQ ID NO: 16440 - DNA, 22 bp, Homo sapiens
ggcaggcaggtggacatgaggc

SEQ ID NO: 16441 - DNA, 18 bp, Homo sapiens
aggcaggcaggtgcagcc

SEQ ID NO: 16442 - DNA, 21 bp, Homo sapiens
ggcagacaggggcagaaaccg

SEQ ID NO: 16443 - DNA, 28 bp, Homo sapiens
aggcaggcagaggtgtgcggccgcctgc

SEQ ID NO: 16444 - DNA, 22 bp, Homo sapiens
ggcgaggcgggctaggcggccg

SEQ ID NO: 16445 - DNA, 18 bp, Homo sapiens
agacagacagatggcaga

SEQ ID NO: 16446 - DNA, 20 bp, Homo sapiens
aggtgacaggcactggtggc

SEQ ID NO: 16447 - DNA, 20 bp, Homo sapiens
aggcaggaggatggcaggcg

SEQ ID NO: 16448 - DNA, 22 bp, Homo sapiens
aggcggcaggaagcagcggccg

SEQ ID NO: 16449 - DNA, 22 bp, Homo sapiens
ggcggcgccgcgcaggcggccg

SEQ ID NO: 16450 - DNA, 24 bp, Homo sapiens
aggcgggcgagagctgagtggccg

SEQ ID NO: 16451 - DNA, 20 bp, Homo sapiens
ggcactctggcgggcggccg

SEQ ID NO: 16452 - DNA, 17 bp, Homo sapiens
aggcaggcagatgcaga

SEQ ID NO: 16453 - DNA, 23 bp, Homo sapiens
ggcgggcgggacaccggcggccg

SEQ ID NO: 16454 - DNA, 24 bp, Homo sapiens
gcagacgggcacggcaggcggccg

SEQ ID NO: 16455 - DNA, 18 bp, Homo sapiens
aggcagccagatggcggg

SEQ ID NO: 16456 - DNA, 20 bp, Homo sapiens
aggcaggcagtggccagggc

SEQ ID NO: 16457 - DNA, 21 bp, Homo sapiens
aggcagtgccgcaggcggccg

SEQ ID NO: 16458 - DNA, 19 bp, Homo sapiens
ggaggcagacggcacctcc

SEQ ID NO: 16459 - DNA, 19 bp, Homo sapiens
aggcagacaggcagaaagc

SEQ ID NO: 16460 - DNA, 19 bp, Homo sapiens
aggcagacggccccagccg

SEQ ID NO: 16461 - DNA, 18 bp, Homo sapiens
ggtgagacagacggcagg

SEQ ID NO: 16462 - DNA, 22 bp, Homo sapiens
agcaggcaggcggcggcaaggc

SEQ ID NO: 16463 - DNA, 20 bp, Homo sapiens
agcaggcagaggagggcggc

SEQ ID NO: 16464 - DNA, 19 bp, Homo sapiens
ggcagacagggagtcaggc

SEQ ID NO: 16465 - DNA, 22 bp, Homo sapiens
aggtagacagacagtgggtacc

SEQ ID NO: 16466 - DNA, 19 bp, Homo sapiens
aggcagacgggatggcagg

SEQ ID NO: 16467 - DNA, 19 bp, Homo sapiens
aggcaggcagaggcagcag

SEQ ID NO: 16468 - DNA, 21 bp, Homo sapiens
agcaggcaggcgggcgggccg

SEQ ID NO: 16469 - DNA, 21 bp, Homo sapiens
gcaggcgggcggcgggcaccg

SEQ ID NO: 16470 - DNA, 19 bp, Homo sapiens
ggtcagttcggcaggcggc

SEQ ID NO: 16471 - DNA, 20 bp, Homo sapiens
aggcaggaggtggcacaggg

SEQ ID NO: 16472 - DNA, 17 bp, Homo sapiens
ggccgggcagacggcca

SEQ ID NO: 16473 - DNA, 18 bp, Homo sapiens
aggcagacaggtgacaga

SEQ ID NO: 16474 - DNA, 20 bp, Homo sapiens
ggcaggcggaaggcgactcg

SEQ ID NO: 16475 - DNA, 20 bp, Homo sapiens
ggcaggcaggcgggcggggc

SEQ ID NO: 16476 - DNA, 24 bp, Homo sapiens
aggcaggcaggcaggcaggctggc

SEQ ID NO: 16477 - DNA, 23 bp, Homo sapiens
ggcaggcaggcaggcaggcaggc

SEQ ID NO: 16478 - DNA, 20 bp, Homo sapiens
ggtggatagacggcaggggc

SEQ ID NO: 16479 - DNA, 18 bp, Homo sapiens
aggcagacaatggtggcc

SEQ ID NO: 16480 - DNA, 16 bp, Homo sapiens
ggaggcggcaggcggc

SEQ ID NO: 16481 - DNA, 17 bp, Homo sapiens
ggcggaagcaggcggcc

SEQ ID NO: 16482 - DNA, 20 bp, Homo sapiens
aggcaggcagggcggacagc

SEQ ID NO: 16483 - DNA, 17 bp, Homo sapiens
ggcgaggcgggcggccg

SEQ ID NO: 16484 - DNA, 20 bp, Homo sapiens
ggcaggcagagcagggtggc

SEQ ID NO: 16485 - DNA, 21 bp, Homo sapiens
aggcaggcaatggcaagcagc

SEQ ID NO: 16486 - DNA, 18 bp, Homo sapiens
ggcagacagacggggtcc

SEQ ID NO: 16487 - DNA, 23 bp, Homo sapiens
gggagaccccgcgcgggcggccg

SEQ ID NO: 16488 - DNA, 22 bp, Homo sapiens
agccaggcagacggtttctccg

SEQ ID NO: 16489 - DNA, 21 bp, Homo sapiens
aggcagcggcggcggcggccg

SEQ ID NO: 16490 - DNA, 22 bp, Homo sapiens
agacagacagacggacaggggc

SEQ ID NO: 16491 - DNA, 23 bp, Homo sapiens
ggtcagacctgcccgggcggccg

SEQ ID NO: 16492 - DNA, 17 bp, Homo sapiens
aggcaggcggtggcagc

SEQ ID NO: 16493 - DNA, 17 bp, Homo sapiens
aggtggacagacggacg

SEQ ID NO: 16494 - DNA, 19 bp, Homo sapiens
ggcaggcaggtgcagagcg

SEQ ID NO: 16495 - DNA, 19 bp, Homo sapiens
ggcaggcattgaaggtggc

SEQ ID NO: 16496 - DNA, 23 bp, Homo sapiens
ggcaggcgggcgggcgggggccg

SEQ ID NO: 16497 - DNA, 28 bp, Homo sapiens
aggcaggcagatgtgtgcggccgcctgc

SEQ ID NO: 16498 - DNA, 20 bp, Homo sapiens
gacggacggatggacggccg

SEQ ID NO: 16499 - DNA, 20 bp, Homo sapiens
ggcaggcgggtgggcgaccg

SEQ ID NO: 16500 - DNA, 21 bp, Homo sapiens
ggcagcacctccgcaggcggc

SEQ ID NO: 16501 - DNA, 24 bp, Homo sapiens
aggcagacaggtgggcagggtccg

SEQ ID NO: 16502 - DNA, 16 bp, Homo sapiens
aggcaggcaggaggcc

SEQ ID NO: 16503 - DNA, 23 bp, Homo sapiens
aggcagacggaggggcacggggc

SEQ ID NO: 16504 - DNA, 22 bp, Homo sapiens
aggcaggcagaggcagagagac

SEQ ID NO: 16505 - DNA, 21 bp, Homo sapiens
ggcaggcgccgggaggggccg

SEQ ID NO: 16506 - DNA, 18 bp, Homo sapiens
ggcagacgacggcgctcg

SEQ ID NO: 16507 - DNA, 21 bp, Homo sapiens
ggcgggcggcgaggacggccg

SEQ ID NO: 16508 - DNA, 21 bp, Homo sapiens
ggccaggcgcgggggcggccg

SEQ ID NO: 16509 - DNA, 18 bp, Homo sapiens
agacaggcaggtggaggc

SEQ ID NO: 16510 - DNA, 20 bp, Homo sapiens
aggaggacagatggcacagg

SEQ ID NO: 16511 - DNA, 22 bp, Homo sapiens
aggcggacggactggcagggac

SEQ ID NO: 16512 - DNA, 21 bp, Homo sapiens
gacaaacccggcgggcggccg

SEQ ID NO: 16513 - DNA, 18 bp, Homo sapiens
ggcagacagtgcggtgcg

SEQ ID NO: 16514 - DNA, 20 bp, Homo sapiens
ggaggacgggagggcggccg

SEQ ID NO: 16515 - DNA, 17 bp, Homo sapiens
ggcaggcagggctggcc

SEQ ID NO: 16516 - DNA, 16 bp, Homo sapiens
ggtagacagacgggcc

SEQ ID NO: 16517 - DNA, 24 bp, Homo sapiens
ggcacataggagcaggcaggtggc

SEQ ID NO: 16518 - DNA, 20 bp, Homo sapiens
ggtcaggcagatggcagcca

SEQ ID NO: 16519 - DNA, 24 bp, Homo sapiens
aggcggccagcgcgcaggcggccg

SEQ ID NO: 16520 - DNA, 22 bp, Homo sapiens
ggccgacaggcgggagggtggc

SEQ ID NO: 16521 - DNA, 18 bp, Homo sapiens
aggcggcggcggcggccg

SEQ ID NO: 16522 - DNA, 17 bp, Homo sapiens
gacaggcgcgggcggcc

SEQ ID NO: 16523 - DNA, 23 bp, Homo sapiens
ggcggcgggcggcgaggcagccg

SEQ ID NO: 16524 - DNA, 25 bp, Homo sapiens
aggtggacagacacgcaggcggccg

SEQ ID NO: 16525 - DNA, 17 bp, Homo sapiens
agccggacagacgaggc

SEQ ID NO: 16526 - DNA, 20 bp, Homo sapiens
aggaagagggggcaggcggc

SEQ ID NO: 16527 - DNA, 22 bp, Homo sapiens
agtggacggacggcaaagcagc

SEQ ID NO: 16528 - DNA, 22 bp, Homo sapiens
aggagacgggcgggggcggccg

SEQ ID NO: 16529 - DNA, 20 bp, Homo sapiens
ggcaggcaggcaggcgggcg

SEQ ID NO: 16530 - DNA, 16 bp, Homo sapiens
ggcaggcaggcaggcg

SEQ ID NO: 16531 - DNA, 21 bp, Homo sapiens
aggcaggcaggcgggcgggcg

SEQ ID NO: 16532 - DNA, 20 bp, Homo sapiens
ggtggaagtgctggcggccg

SEQ ID NO: 16533 - DNA, 29 bp, Homo sapiens
aggcaggcggggcaggcggggcaggcggc

SEQ ID NO: 16534 - DNA, 17 bp, Homo sapiens
aggcggacagggcggcc

SEQ ID NO: 16535 - DNA, 21 bp, Homo sapiens
agcaggcaaggtgcgggtggc

SEQ ID NO: 16536 - DNA, 18 bp, Homo sapiens
ggcaggcagcggggagcc

SEQ ID NO: 16537 - DNA, 19 bp, Homo sapiens
aggcagcagacggtggacg

SEQ ID NO: 16538 - DNA, 21 bp, Homo sapiens
agcaggcaggcgccgagcggc

SEQ ID NO: 16539 - DNA, 17 bp, Homo sapiens
aggcagacggaggcggc

SEQ ID NO: 16540 - DNA, 19 bp, Homo sapiens
ggcgggcaggaggcggccg

SEQ ID NO: 16541 - DNA, 23 bp, Homo sapiens
ggcgggcgagtacctggcggccg

SEQ ID NO: 16542 - DNA, 21 bp, Homo sapiens
aggcgggcaggcgggcaggcg

SEQ ID NO: 16543 - DNA, 20 bp, Homo sapiens
ggcaggaggcggtgacgccg

SEQ ID NO: 16544 - DNA, 24 bp, Homo sapiens
ggcagcaggctctccgggtggccg

SEQ ID NO: 16545 - DNA, 21 bp, Homo sapiens
aggcaggcagatgggggcacc

SEQ ID NO: 16546 - DNA, 20 bp, Homo sapiens
ggcaggcaggtgcgcgtccg

SEQ ID NO: 16547 - DNA, 19 bp, Homo sapiens
aggcaggcaggggcaaacg

SEQ ID NO: 16548 - DNA, 19 bp, Homo sapiens
gcaggcaacagggtggccg

SEQ ID NO: 16549 - DNA, 22 bp, Homo sapiens
ggcagacaggtaagcagagccg

SEQ ID NO: 16550 - DNA, 24 bp, Homo sapiens
ggcacgcaggcggcggggcagggc

SEQ ID NO: 16551 - DNA, 28 bp, Homo sapiens
aggcggacagacgtctgcggccgcctgc

SEQ ID NO: 16552 - DNA, 21 bp, Homo sapiens
ggagcagacggtgctggtggc

SEQ ID NO: 16553 - DNA, 18 bp, Homo sapiens
aggcagacagagggcagg

SEQ ID NO: 16554 - DNA, 19 bp, Homo sapiens
aggcaggcaggggtggcag

SEQ ID NO: 16555 - DNA, 23 bp, Homo sapiens
gcaggcaggtggtgtgcgggccg

SEQ ID NO: 16556 - DNA, 15 bp, Homo sapiens
aggcaggcaggcagc

SEQ ID NO: 16557 - DNA, 16 bp, Homo sapiens
aggcagacagaggggc

SEQ ID NO: 16558 - DNA, 22 bp, Homo sapiens
ggtagatggaggtttacggccg

SEQ ID NO: 16559 - DNA, 79 bp, Human herpesvirus 5
tcgcgggccgctcgctatgccgactgacgttgacgttaatatataacgacgtcgtcgacgacgcgggttctgctcccga

SEQ ID NO: 16560 - DNA, 24 bp, Human herpesvirus 5
tatgccgactgacgttgacgttaa

SEQ ID NO: 16561 - DNA, 16 bp, Homo sapiens
tgccgactacgttccg

SEQ ID NO: 16562 - DNA, 86 bp, Human herpesvirus 5
cggctcctccgcctcgggcgacgggggctcggagatgaccggctgtgtctgacactcctccccttcctcaggcggcccgggcgccg

SEQ ID NO: 16563 - DNA, 24 bp, Human herpesvirus 5
tgtgtctgacactcctccccttcc

SEQ ID NO: 16564 - DNA, 21 bp, Homo sapiens
gtgtctgatactgtaagcctt

SEQ ID NO: 16565 - DNA, 24 bp, Homo sapiens
tgtgtctgttgctctctactttcc

SEQ ID NO: 16566 - DNA, 22 bp, Homo sapiens
tgtgtctggcattccctgttcc

SEQ ID NO: 16567 - DNA, 18 bp, Homo sapiens
tgtcctctcctccctttc

SEQ ID NO: 16568 - DNA, 19 bp, Homo sapiens
tgttctgactgcccccctt

SEQ ID NO: 16569 - DNA, 24 bp, Homo sapiens
tgtgtctgactcttctgaatgtcc

SEQ ID NO: 16570 - DNA, 18 bp, Homo sapiens
tgtgtctgaacttctgcc

SEQ ID NO: 16571 - DNA, 22 bp, Homo sapiens
tgtatctgccatcttcttttcc

SEQ ID NO: 16572 - DNA, 19 bp, Homo sapiens
gtcctgttcttccccttcc

SEQ ID NO: 16573 - DNA, 27 bp, Homo sapiens
tgtgcctgacgtttcacagaccccctt

SEQ ID NO: 16574 - DNA, 22 bp, Homo sapiens
tgtgtctagtatagccccttcc

SEQ ID NO: 16575 - DNA, 20 bp, Homo sapiens
tgtccccatcctccccttcc

SEQ ID NO: 16576 - DNA, 19 bp, Homo sapiens
tgtgtctgttacttccctt

SEQ ID NO: 16577 - DNA, 23 bp, Homo sapiens
tgtatttccatctctccccttcc

SEQ ID NO: 16578 - DNA, 18 bp, Homo sapiens
tgtgtctggctcaccttc

SEQ ID NO: 16579 - DNA, 21 bp, Homo sapiens
tgtgtctgatgccctgggtcc

SEQ ID NO: 16580 - DNA, 19 bp, Homo sapiens
tgtgtctacaatgtccctt

SEQ ID NO: 16581 - DNA, 25 bp, Homo sapiens
tgtgtctgcaacccggctttccttc

SEQ ID NO: 16582 - DNA, 22 bp, Homo sapiens
tgtgttgagccccttcccttcc

SEQ ID NO: 16583 - DNA, 19 bp, Homo sapiens
tgtgcctggccccctcttc

SEQ ID NO: 16584 - DNA, 21 bp, Homo sapiens
tctgtttctttcttcccttcc

SEQ ID NO: 16585 - DNA, 16 bp, Homo sapiens
tggtctgcctcctccc

SEQ ID NO: 16586 - DNA, 23 bp, Homo sapiens
tcacaacacgctcttccccttcc

SEQ ID NO: 16587 - DNA, 23 bp, Homo sapiens
tgtgtctaaataaaatctccctt

SEQ ID NO: 16588 - DNA, 17 bp, Homo sapiens
tgtttgacacccccttc

SEQ ID NO: 16589 - DNA, 22 bp, Homo sapiens
tgtgtctgaccttctgagctcc

SEQ ID NO: 16590 - DNA, 20 bp, Homo sapiens
gctggcactcctccccttcc

SEQ ID NO: 16591 - DNA, 19 bp, Homo sapiens
tgtgtctgtgcctctcttc

SEQ ID NO: 16592 - DNA, 22 bp, Homo sapiens
tgtgtctgatgcatctgggtcc

SEQ ID NO: 16593 - DNA, 21 bp, Homo sapiens
tggcatgacattccttctctt

SEQ ID NO: 16594 - DNA, 17 bp, Homo sapiens
tgtatctacctctcctt

SEQ ID NO: 16595 - DNA, 19 bp, Homo sapiens
tgtgtctggcatcctagcc

SEQ ID NO: 16596 - DNA, 21 bp, Homo sapiens
tgctcttactcctccttttcc

SEQ ID NO: 16597 - DNA, 19 bp, Homo sapiens
gcaaatactcctcctcttc

SEQ ID NO: 16598 - DNA, 26 bp, Homo sapiens
tgtgtctgtgtcctcatctcttcttc

SEQ ID NO: 16599 - DNA, 18 bp, Homo sapiens
gtgctcactcctcctctt

SEQ ID NO: 16600 - DNA, 24 bp, Homo sapiens
tgggtttgaccagagaccccttcc

SEQ ID NO: 16601 - DNA, 18 bp, Homo sapiens
tgtgtctggcgtcccctc

SEQ ID NO: 16602 - DNA, 24 bp, Homo sapiens
tgttttcctctttcctccccttcc

SEQ ID NO: 16603 - DNA, 23 bp, Homo sapiens
tgtttctgaaaaagctccccttc

SEQ ID NO: 16604 - DNA, 21 bp, Homo sapiens
tctggacactcctttttttcc

SEQ ID NO: 16605 - DNA, 17 bp, Homo sapiens
tgtctctcctccctttc

SEQ ID NO: 16606 - DNA, 19 bp, Homo sapiens
tgtgtctgatgcctcgctc

SEQ ID NO: 16607 - DNA, 22 bp, Homo sapiens
tgacactcattcttcctcttcc

SEQ ID NO: 16608 - DNA, 20 bp, Homo sapiens
tgtatctgtctctccctttc

SEQ ID NO: 16609 - DNA, 21 bp, Homo sapiens
tgtgcctgtcacctttctctt

SEQ ID NO: 16610 - DNA, 19 bp, Homo sapiens
tgtgtctgaagtttcctcc

SEQ ID NO: 16611 - DNA, 18 bp, Homo sapiens
tgtggctgcttccccttc

SEQ ID NO: 16612 - DNA, 22 bp, Homo sapiens
atcagaatactcctcctttttc

SEQ ID NO: 16613 - DNA, 18 bp, Homo sapiens
tgtgtctggctttccttc

SEQ ID NO: 16614 - DNA, 21 bp, Homo sapiens
tgtgctcgcccctccccttcc

SEQ ID NO: 16615 - DNA, 18 bp, Homo sapiens
tgtttctacttccccttc

SEQ ID NO: 16616 - DNA, 19 bp, Homo sapiens
tgtggctaacttccccttc

SEQ ID NO: 16617 - DNA, 22 bp, Homo sapiens
tgtgcctggtgttctcggcttc

SEQ ID NO: 16618 - DNA, 18 bp, Homo sapiens
tgtgcctgactccctttc

SEQ ID NO: 16619 - DNA, 19 bp, Homo sapiens
tgcccaactcctcctcttc

SEQ ID NO: 16620 - DNA, 24 bp, Homo sapiens
tgtgtcttacagagattccttttc

SEQ ID NO: 16621 - DNA, 22 bp, Homo sapiens
tgtctaccaggtttctcccctt

SEQ ID NO: 16622 - DNA, 16 bp, Homo sapiens
tctgactcctcctctt

SEQ ID NO: 16623 - DNA, 22 bp, Homo sapiens
tgttttctgtcccttcccttcc

SEQ ID NO: 16624 - DNA, 19 bp, Homo sapiens
tgcgtctcttctcctcttc

SEQ ID NO: 16625 - DNA, 128 bp, Chimpanzee cytomegalovirus
gggggtggtcaacgccctagagagcgtgaccgtctacccggcctacgactgcgtgctctccgatctggaggccgccatgtgcctgctggccgcctacgggcacgcgctctgggacggccgcgaccccc

SEQ ID NO: 16626 - DNA, 24 bp, Chimpanzee cytomegalovirus
acccggcctacgactgcgtgctct

SEQ ID NO: 16627 - DNA, 20 bp, Homo sapiens
acccggcctgagactgtcat

SEQ ID NO: 16628 - DNA, 21 bp, Homo sapiens
cccggcctgcgcttgccccct

SEQ ID NO: 16629 - DNA, 18 bp, Homo sapiens
cctggcctacattcactc

SEQ ID NO: 16630 - DNA, 20 bp, Homo sapiens
cggctggcactgcgtgttct

SEQ ID NO: 16631 - DNA, 22 bp, Homo sapiens
acaccggtcaactgtgtgctct

SEQ ID NO: 16632 - DNA, 16 bp, Homo sapiens
acccggcctacggcat

SEQ ID NO: 16633 - DNA, 19 bp, Homo sapiens
ggcccacgccaggtgctct

SEQ ID NO: 16634 - DNA, 18 bp, Homo sapiens
cccggactgggcgtgctc

SEQ ID NO: 16635 - DNA, 20 bp, Homo sapiens
cccggcctccggtttcatct

SEQ ID NO: 16636 - DNA, 23 bp, Homo sapiens
cctggcccagctgcgcgtgctct

SEQ ID NO: 16637 - DNA, 20 bp, Homo sapiens
cccggcctggggctgcctct

SEQ ID NO: 16638 - DNA, 21 bp, Homo sapiens
acctggcctacactcattact

SEQ ID NO: 16639 - DNA, 23 bp, Homo sapiens
acctggcttgtaactacatttct

SEQ ID NO: 16640 - DNA, 22 bp, Homo sapiens
cccaggctcctgtgcgtgctct

SEQ ID NO: 16641 - DNA, 20 bp, Homo sapiens
cctggcctgcctcgtgctct

SEQ ID NO: 16642 - DNA, 22 bp, Homo sapiens
cctggcctgctgggaaggctct

SEQ ID NO: 16643 - DNA, 18 bp, Homo sapiens
cccggccttcgatttgcc

SEQ ID NO: 16644 - DNA, 19 bp, Homo sapiens
gcctgcgcactactgctct

SEQ ID NO: 16645 - DNA, 20 bp, Homo sapiens
cccggcctagattcatttct

SEQ ID NO: 16646 - DNA, 23 bp, Homo sapiens
cccggcctattgcttgggtctct

SEQ ID NO: 16647 - DNA, 21 bp, Homo sapiens
cccggccttgactcaacctct

SEQ ID NO: 16648 - DNA, 15 bp, Homo sapiens
cccggcccacggcgt

SEQ ID NO: 16649 - DNA, 21 bp, Homo sapiens
acccggcctatgatggttact

SEQ ID NO: 16650 - DNA, 19 bp, Homo sapiens
acccagcctgtggctgccc

SEQ ID NO: 16651 - DNA, 63 bp, Chimpanzee cytomegalovirus
ggcctcgggggcaacgggggcggcgctctgctcatgcagctcagccgcgtcaaccccgtggcc

SEQ ID NO: 16652 - DNA, 22 bp, Chimpanzee cytomegalovirus
cagccgcgtcaaccccgtggcc

SEQ ID NO: 16653 - DNA, 17 bp, Homo sapiens
cagccgctcaaccacgc

SEQ ID NO: 16654 - DNA, 20 bp, Homo sapiens
cagccgcgtgcagcccccgt

SEQ ID NO: 16655 - DNA, 19 bp, Homo sapiens
gcctcgcggtcccgtggcc

SEQ ID NO: 16656 - DNA, 18 bp, Homo sapiens
cagcagcgcccccgtggc

SEQ ID NO: 16657 - DNA, 18 bp, Homo sapiens
gcgtcagtcccccgtggc

SEQ ID NO: 16658 - DNA, 19 bp, Homo sapiens
cagccactctcccccgtgg

SEQ ID NO: 16659 - DNA, 17 bp, Homo sapiens
gccgcgtcgacgcggcc

SEQ ID NO: 16660 - DNA, 18 bp, Homo sapiens
gccgcccgctccgtggcc

SEQ ID NO: 16661 - DNA, 16 bp, Homo sapiens
cagccgcgcagtggac

SEQ ID NO: 16662 - DNA, 20 bp, Homo sapiens
caactcatcactccgtggcc

SEQ ID NO: 16663 - DNA, 21 bp, Homo sapiens
cagtgcgtgttgaccgcggcc

SEQ ID NO: 16664 - DNA, 19 bp, Homo sapiens
gccgtgcgcccctgtggcc

SEQ ID NO: 16665 - DNA, 16 bp, Homo sapiens
cagcccaccctgtggc

SEQ ID NO: 16666 - DNA, 19 bp, Homo sapiens
cagccgcgccagccgcgcc

SEQ ID NO: 16667 - DNA, 17 bp, Homo sapiens
gctgcgccgccgtggcc

SEQ ID NO: 16668 - DNA, 18 bp, Homo sapiens
cagccgcgtcgcccccgt

SEQ ID NO: 16669 - DNA, 20 bp, Homo sapiens
agtccaggcaccccgtggcc

SEQ ID NO: 16670 - DNA, 18 bp, Homo sapiens
gccgctctccccgtggcc

SEQ ID NO: 16671 - DNA, 21 bp, Homo sapiens
gcccgctgtcgctccgtggcc

SEQ ID NO: 16672 - DNA, 16 bp, Homo sapiens
agccgcctccccgtgg

SEQ ID NO: 16673 - DNA, 16 bp, Homo sapiens
cagcagcacccgtggc

SEQ ID NO: 16674 - DNA, 18 bp, Homo sapiens
gccgcgtcagacacgagg

SEQ ID NO: 16675 - DNA, 22 bp, Homo sapiens
cagcgcagcgccccccgtggcc

SEQ ID NO: 16676 - DNA, 19 bp, Homo sapiens
cagccgcggtcggtcggcc

SEQ ID NO: 16677 - DNA, 18 bp, Homo sapiens
agctgcaagcccgtggcc

SEQ ID NO: 16678 - DNA, 18 bp, Homo sapiens
cagccgcgtcatgacggg

SEQ ID NO: 16679 - DNA, 20 bp, Homo sapiens
cagccgcgccggcccggacc

SEQ ID NO: 16680 - DNA, 19 bp, Homo sapiens
cagccgcgtcacccggagc

SEQ ID NO: 16681 - DNA, 19 bp, Homo sapiens
cagccgttcggcccgggcc

SEQ ID NO: 16682 - DNA, 18 bp, Homo sapiens
cagccgcctcggcctgac

SEQ ID NO: 16683 - DNA, 21 bp, Homo sapiens
cagcctccccatcctgtggcc

SEQ ID NO: 16684 - DNA, 21 bp, Homo sapiens
tgacctcgcgatcccgtggcc

SEQ ID NO: 16685 - DNA, 18 bp, Homo sapiens
agccgctcgcccgtggcc

SEQ ID NO: 16686 - DNA, 20 bp, Homo sapiens
cagcctcgccacccgtggcc

SEQ ID NO: 16687 - DNA, 17 bp, Homo sapiens
cagccacagcctgtggc

SEQ ID NO: 16688 - DNA, 19 bp, Homo sapiens
agccacgttggccaccagg

SEQ ID NO: 16689 - DNA, 20 bp, Homo sapiens
cagcctgggcctctgtggcc

SEQ ID NO: 16690 - DNA, 18 bp, Homo sapiens
gccgcatcagtgatggcc

SEQ ID NO: 16691 - DNA, 26 bp, Homo sapiens
gccatggccccccaactctgtggccg

SEQ ID NO: 16692 - DNA, 18 bp, Homo sapiens
gccgaccccaccccgtgg

SEQ ID NO: 16693 - DNA, 23 bp, Homo sapiens
cagccgcgccggtcgacgcggcc

SEQ ID NO: 16694 - DNA, 18 bp, Homo sapiens
gcgtcaggtcccgtggcc

SEQ ID NO: 16695 - DNA, 20 bp, Homo sapiens
gctgcgctgcctccgtggcc

SEQ ID NO: 16696 - DNA, 18 bp, Homo sapiens
gcccgcgagcccgtggcc

SEQ ID NO: 16697 - DNA, 17 bp, Homo sapiens
cagcagcctcccgtggc

SEQ ID NO: 16698 - DNA, 18 bp, Homo sapiens
gccatctgtcccgtggcc

SEQ ID NO: 16699 - DNA, 20 bp, Homo sapiens
gccacgccggccccgtggcc

SEQ ID NO: 16700 - DNA, 17 bp, Homo sapiens
cagccacaacttgtggc

SEQ ID NO: 16701 - DNA, 17 bp, Homo sapiens
gccgatgtcccgtggcc

SEQ ID NO: 16702 - DNA, 19 bp, Homo sapiens
gccgctgtcacccgtggcc

SEQ ID NO: 16703 - DNA, 20 bp, Homo sapiens
gcctctctggccccgtggcc

SEQ ID NO: 16704 - DNA, 21 bp, Homo sapiens
gcgcacagcggccccgtggcc

SEQ ID NO: 16705 - DNA, 17 bp, Homo sapiens
gccgccagccccgtggc

SEQ ID NO: 16706 - DNA, 18 bp, Homo sapiens
gcacggagccccgtggcc

SEQ ID NO: 16707 - DNA, 19 bp, Homo sapiens
cagctggtcaacccaggcc

SEQ ID NO: 16708 - DNA, 26 bp, Homo sapiens
cagccgcattctgctgcctcgtggcc

SEQ ID NO: 16709 - DNA, 20 bp, Homo sapiens
gcctctctgtccccgtggcc

SEQ ID NO: 16710 - DNA, 19 bp, Homo sapiens
cagcagcgcccccgtggcc

SEQ ID NO: 16711 - DNA, 20 bp, Homo sapiens
cagccgcgccagcgccggcc

SEQ ID NO: 16712 - DNA, 18 bp, Homo sapiens
gccacccgctccgtggcc

SEQ ID NO: 16713 - DNA, 15 bp, Homo sapiens
cagccgcgcagcgac

SEQ ID NO: 16714 - DNA, 75 bp, Human herpesvirus 5
ctgggatacacggtaccttccgcgcatttgaccaaatcgtccttgacgtggggtagtacgcccgcgttgtcgcag

SEQ ID NO: 16715 - DNA, 24 bp, Human herpesvirus 5
cacggtaccttccgcgcatttgac

SEQ ID NO: 16716 - DNA, 22 bp, Homo sapiens
ggtgagaatccgtgcatttgac

SEQ ID NO: 16717 - DNA, 22 bp, Homo sapiens
cacagtgctttgttacatttga

SEQ ID NO: 16718 - DNA, 22 bp, Homo sapiens
ggtaccttctgagagctttgac

SEQ ID NO: 16719 - DNA, 20 bp, Homo sapiens
acagtacctttctatttgac

SEQ ID NO: 16720 - DNA, 93 bp, Human herpesvirus 5
gcgcgtttgcgcacgttcacctcgcgagtgacgttgtggatgcgggagcgcgcgtccaccaagtcgagagcctcgtgttcgtcgcagttgcgc

SEQ ID NO: 16721 - DNA, 24 bp, Human herpesvirus 5
tcgcgagtgacgttgtggatgcgg

SEQ ID NO: 16722 - DNA, 20 bp, Homo sapiens
gagtgacagaaatggtgcgg

SEQ ID NO: 16723 - DNA, 104 bp, Lumpy skin disease virus
ttaaaaatatggtttcagattgtctatttctggcttttaaaaataaaaacctttcgtttcctttactttcgaaccagtttatgcactttatttccattttttaa

SEQ ID NO: 16724 - DNA, 24 bp, Lumpy skin disease virus
tttctggcttttaaaaataaaaac

SEQ ID NO: 16725 - DNA, 25 bp, Homo sapiens
tttctggctttgccaaaaataaaaa

SEQ ID NO: 16726 - DNA, 19 bp, Homo sapiens
ttcctgggataaaaataaa

SEQ ID NO: 16727 - DNA, 20 bp, Homo sapiens
tctggcttttgtctcaaaaa

SEQ ID NO: 16728 - DNA, 24 bp, Homo sapiens
ttctggccactagagaatgaaaac

SEQ ID NO: 16729 - DNA, 21 bp, Homo sapiens
tttctagctccaaatgaaaac

SEQ ID NO: 16730 - DNA, 21 bp, Homo sapiens
tggcttttaaattccataaaa

SEQ ID NO: 16731 - DNA, 19 bp, Homo sapiens
tacctcttaaaaataaaaa

SEQ ID NO: 16732 - DNA, 18 bp, Homo sapiens
tttctggcttctgaaaac

SEQ ID NO: 16733 - DNA, 17 bp, Homo sapiens
tggcttttaatacaaaa

SEQ ID NO: 16734 - DNA, 18 bp, Homo sapiens
gcttattaaaaataaaaa

SEQ ID NO: 16735 - DNA, 18 bp, Homo sapiens
tttctgttttttaaaaac

SEQ ID NO: 16736 - DNA, 18 bp, Homo sapiens
tttctagcttttgaaaac

SEQ ID NO: 16737 - DNA, 19 bp, Homo sapiens
tttctggccaagtaaaaac

SEQ ID NO: 16738 - DNA, 19 bp, Homo sapiens
tagcttttaaaagaaaaaa

SEQ ID NO: 16739 - DNA, 22 bp, Homo sapiens
tctgtcaatttaaaaataaaaa

SEQ ID NO: 16740 - DNA, 17 bp, Homo sapiens
tggcttttacacaaaaa

SEQ ID NO: 16741 - DNA, 23 bp, Homo sapiens
tttctagctttaactcaaaaata

SEQ ID NO: 16742 - DNA, 20 bp, Homo sapiens
tgttttttaaaaataaaaac

SEQ ID NO: 16743 - DNA, 19 bp, Homo sapiens
ttctggctggagtaaaaac

SEQ ID NO: 16744 - DNA, 24 bp, Homo sapiens
tttctgcctttgtaaaataaaaac

SEQ ID NO: 16745 - DNA, 18 bp, Homo sapiens
tttctggctcttagaaat

SEQ ID NO: 16746 - DNA, 20 bp, Homo sapiens
cttctggaagccaaaaataa

SEQ ID NO: 16747 - DNA, 114 bp, Lumpy skin disease virus
gtggcgagtcttttaaagtatacttcgtaaaatattcgttcagtagattttaatttaaaactcctatctataattctttcatacgtttttatatttactaattttttttgccat

SEQ ID NO: 16748 - DNA, 24 bp, Lumpy skin disease virus
aagtatacttcgtaaaatattcgt

SEQ ID NO: 16749 - DNA, 22 bp, Homo sapiens
aagatacttcgtggcttttcgt

SEQ ID NO: 16750 - DNA, 88 bp, Lumpy skin disease virus
atgataaaatttcaacacatacttgtacagatgacatatttccacctgataacatttgcaaaagccttgttttgtatattcttatcat

SEQ ID NO: 16751 - DNA, 24 bp, Lumpy skin disease virus
caaaagccttgttttgtatattct

SEQ ID NO: 16752 - DNA, 17 bp, Homo sapiens
agtcttgttttgacatc

SEQ ID NO: 16753 - DNA, 19 bp, Homo sapiens
aagtcttgcttttgtatat

SEQ ID NO: 16754 - DNA, 23 bp, Homo sapiens
caaaagcttgggaattatattct

SEQ ID NO: 16755 - DNA, 19 bp, Homo sapiens
cagaaacccatctttgtat

SEQ ID NO: 16756 - DNA, 23 bp, Homo sapiens
tgaaagccctgtttaaaacttct

SEQ ID NO: 16757 - DNA, 18 bp, Homo sapiens
aaaggccttgtcacattc

SEQ ID NO: 16758 - DNA, 19 bp, Homo sapiens
agccttgttttgtcatatt

SEQ ID NO: 16759 - DNA, 20 bp, Homo sapiens
cagaagcctcgtttgacatt

SEQ ID NO: 16760 - DNA, 17 bp, Homo sapiens
agcctggtgtatattct

SEQ ID NO: 16761 - DNA, 23 bp, Homo sapiens
caaaggccttgttatcctcatct

SEQ ID NO: 16762 - DNA, 17 bp, Homo sapiens
cagaagccattctgtat

SEQ ID NO: 16763 - DNA, 19 bp, Homo sapiens
tgaagaccttgtcatattc

SEQ ID NO: 16764 - DNA, 19 bp, Homo sapiens
aaaggccctgtttctccat

SEQ ID NO: 16765 - DNA, 18 bp, Homo sapiens
caaaagacttgtttttgt

SEQ ID NO: 16766 - DNA, 21 bp, Homo sapiens
gccttgtctttattaaattct

SEQ ID NO: 16767 - DNA, 22 bp, Homo sapiens
caggagccctgcctgatgttct

SEQ ID NO: 16768 - DNA, 17 bp, Homo sapiens
ccttgttctatggttct

SEQ ID NO: 16769 - DNA, 18 bp, Homo sapiens
caaaagcttagcatattc

SEQ ID NO: 16770 - DNA, 20 bp, Homo sapiens
aaagccttgaaccatattct

SEQ ID NO: 16771 - DNA, 61 bp, Lumpy skin disease virus
aaatggatttataggttttgtagctaataatacttttccattttctacctttgatccattt

SEQ ID NO: 16772 - DNA, 24 bp, Lumpy skin disease virus
atggatttataggttttgtagcta

SEQ ID NO: 16773 - DNA, 20 bp, Homo sapiens
gatttatataattgtggcta

SEQ ID NO: 16774 - DNA, 17 bp, Homo sapiens
atggatttagggctgtg

SEQ ID NO: 16775 - DNA, 21 bp, Homo sapiens
atggctttaccatcattgtag

SEQ ID NO: 16776 - DNA, 20 bp, Homo sapiens
tgaatgacagttttgtggct

SEQ ID NO: 16777 - DNA, 20 bp, Homo sapiens
tggatttaaaaggagtagct

SEQ ID NO: 16778 - DNA, 21 bp, Homo sapiens
tggatttattggtttatctct

SEQ ID NO: 16779 - DNA, 19 bp, Homo sapiens
atagattagaattttgtag

SEQ ID NO: 16780 - DNA, 15 bp, Homo sapiens
gatttataggttgct

SEQ ID NO: 16781 - DNA, 18 bp, Homo sapiens
ataggtttataggttttg

SEQ ID NO: 16782 - DNA, 20 bp, Homo sapiens
atggatttattggttagcca

SEQ ID NO: 16783 - DNA, 20 bp, Homo sapiens
atgagatttatagccctggt

SEQ ID NO: 16784 - DNA, 16 bp, Homo sapiens
gatttgggttgtagct

SEQ ID NO: 16785 - DNA, 18 bp, Homo sapiens
atgaatttgtaggttttg

SEQ ID NO: 16786 - DNA, 130 bp, Lumpy skin disease virus
attttctcatctaataataagtttaatagaggtccttttattaatgtactagctctgtattcaaacaccatggattgtggcaatatataagtaaaagctccagcatctatttttgtttcaattccgtagt

SEQ ID NO: 16787 - DNA, 24 bp, Lumpy skin disease virus
tggcaatatataagtaaaagctcc

SEQ ID NO: 16788 - DNA, 17 bp, Homo sapiens
tggcaatatcaaaggct

SEQ ID NO: 16789 - DNA, 20 bp, Homo sapiens
gctgatacctcgtaaaagct

SEQ ID NO: 16790 - DNA, 18 bp, Homo sapiens
gctacaaggtaaaagctc

SEQ ID NO: 16791 - DNA, 19 bp, Homo sapiens
tggcaacagagtgagagct

SEQ ID NO: 16792 - DNA, 20 bp, Homo sapiens
tggaaatatacacaaggctc

SEQ ID NO: 16793 - DNA, 15 bp, Homo sapiens
tggcaaataaaagct

SEQ ID NO: 16794 - DNA, 23 bp, Homo sapiens
tggcaacatgcactggaagctcc

SEQ ID NO: 16795 - DNA, 21 bp, Homo sapiens
tggaccacagggtaaaagctc

SEQ ID NO: 16796 - DNA, 19 bp, Homo sapiens
tggcaataataactggctc

SEQ ID NO: 16797 - DNA, 20 bp, Homo sapiens
tgacaatatagtgagagctc

SEQ ID NO: 16798 - DNA, 16 bp, Homo sapiens
gcaatatacaaaggct

SEQ ID NO: 16799 - DNA, 16 bp, Homo sapiens
gcaatatgcaaaagct

SEQ ID NO: 16800 - DNA, 22 bp, Homo sapiens
tggcaacatgcccacgaaagct

SEQ ID NO: 16801 - DNA, 20 bp, Homo sapiens
tggcaaacgtcataaaagct

SEQ ID NO: 16802 - DNA, 24 bp, Homo sapiens
tgaaataatgtaagtgaaagctcc

SEQ ID NO: 16803 - DNA, 21 bp, Homo sapiens
tagcaatatgattaagagctc

SEQ ID NO: 16804 - DNA, 21 bp, Homo sapiens
tggtaaatataaataaaggct

SEQ ID NO: 16805 - DNA, 23 bp, Homo sapiens
tggctgtgggccgtaaaagctcc

SEQ ID NO: 16806 - DNA, 67 bp, Sheeppox virus
gtagcgagtcttttaaagtatacttcgtaaaatattctttcagtagattttaatttaaaactcctat

SEQ ID NO: 16807 - DNA, 24 bp, Sheeppox virus
tagattttaatttaaaactcctat

SEQ ID NO: 16808 - DNA, 22 bp, Homo sapiens
tagatatcattgaaactcctat

SEQ ID NO: 16809 - DNA, 30 bp, Homo sapiens
tagatttttaacatacttaaaactcctata

SEQ ID NO: 16810 - DNA, 20 bp, Homo sapiens
gatttcaattcaacacttct

SEQ ID NO: 16811 - DNA, 19 bp, Homo sapiens
gattttataggactcctat

SEQ ID NO: 16812 - DNA, 23 bp, Homo sapiens
gattcagtatttaaaactcttat

SEQ ID NO: 16813 - DNA, 22 bp, Homo sapiens
tagattttatttacattcctat

SEQ ID NO: 16814 - DNA, 22 bp, Homo sapiens
tacatcaaactttaaaactcct

SEQ ID NO: 16815 - DNA, 127 bp, Cowpox virus
agacgtattagcggatctaatggaatccaattgattgactatcttttgaaaatatacatttttatgatccgatacttgtaagaatatagcaacaatgataattccatcatcgtgtttttttgcctct

SEQ ID NO: 16816 - DNA, 24 bp, Cowpox virus
taagaatatagcaacaatgataat

SEQ ID NO: 16817 - DNA, 16 bp, Homo sapiens
gaacatagcatatgat

SEQ ID NO: 16818 - DNA, 21 bp, Homo sapiens
taagaatatataaaaaatgat

SEQ ID NO: 16819 - DNA, 20 bp, Homo sapiens
agcagcaccacaacaatgat

SEQ ID NO: 16820 - DNA, 20 bp, Homo sapiens
caagaataaacaataatgat

SEQ ID NO: 16821 - DNA, 17 bp, Homo sapiens
aaaatatagcaaataat

SEQ ID NO: 16822 - DNA, 23 bp, Homo sapiens
taagaatttagtaaaatgataat

SEQ ID NO: 16823 - DNA, 17 bp, Homo sapiens
taaaaatatagcacaac

SEQ ID NO: 16824 - DNA, 17 bp, Homo sapiens
gataaagcaacaatgat

SEQ ID NO: 16825 - DNA, 20 bp, Homo sapiens
caagaatgagagacaatgat

SEQ ID NO: 16826 - DNA, 20 bp, Homo sapiens
agaaagacagcagtgataat

SEQ ID NO: 16827 - DNA, 18 bp, Homo sapiens
aagaatatggcagcaatg

SEQ ID NO: 16828 - DNA, 21 bp, Homo sapiens
taagaataaagcaggtatgat

SEQ ID NO: 16829 - DNA, 19 bp, Homo sapiens
agagtccaacacaatgata

SEQ ID NO: 16830 - DNA, 21 bp, Homo sapiens
taagagtatgacaacagcaat

SEQ ID NO: 16831 - DNA, 98 bp, Sheeppox virus
gaaatataccgtaaatcaaagttgtttccattaaaagttaccacataatcgaatgtcaattccaaaagcttttttgcgacttttagcatggtaatttc

SEQ ID NO: 16832 - DNA, 24 bp, Sheeppox virus
caaaagcttttttgcgacttttag

SEQ ID NO: 16833 - DNA, 21 bp, Homo sapiens
caaaagcttttttttttttag

SEQ ID NO: 16834 - DNA, 19 bp, Homo sapiens
caaaagcttttttgtttac

SEQ ID NO: 16835 - DNA, 19 bp, Homo sapiens
cagaagctttttggcttct

SEQ ID NO: 16836 - DNA, 22 bp, Homo sapiens
caaaaacttttttgttgctttt

SEQ ID NO: 16837 - DNA, 24 bp, Homo sapiens
tgaaagcttttatgccagatttag

SEQ ID NO: 16838 - DNA, 26 bp, Homo sapiens
caaaagcttcagatggtgatttttag

SEQ ID NO: 16839 - DNA, 23 bp, Homo sapiens
caaaagctttattgtggatccag

SEQ ID NO: 16840 - DNA, 22 bp, Homo sapiens
caaaagcttcctgggcttttag

SEQ ID NO: 16841 - DNA, 85 bp, Human herpesvirus 2
ccgcccgcgcggcatctcattagcgcccggcgcgggcggcttccgcttccgcccgcgatgctaatgagaccctcgtcgcgggcgg

SEQ ID NO: 16842 - DNA, 24 bp, Human herpesvirus 2
catctcattagcgcccggcgcggg

SEQ ID NO: 16843 - DNA, 21 bp, Homo sapiens
tcccggctggcctggcgcggg

SEQ ID NO: 16844 - DNA, 15 bp, Homo sapiens
ctcagcccggcgcgg

SEQ ID NO: 16845 - DNA, 29 bp, Homo sapiens
cagctcattagcgggtgggcccgcgccgg

SEQ ID NO: 16846 - DNA, 18 bp, Homo sapiens
tcatcatgctggcgcggg

SEQ ID NO: 16847 - DNA, 18 bp, Homo sapiens
atctcattagcggcttgg

SEQ ID NO: 16848 - DNA, 19 bp, Homo sapiens
catctcatggtgcccccgg

SEQ ID NO: 16849 - DNA, 18 bp, Homo sapiens
ctcattggctaccgcggg

SEQ ID NO: 16850 - DNA, 21 bp, Homo sapiens
tcattagcgtttagtcgtggg

SEQ ID NO: 16851 - DNA, 66 bp, Cowpox virus
gtttctatattaataggagatagttgttgagtcatagtaaaaatgaaatgataactgtttagaaat

SEQ ID NO: 16852 - DNA, 24 bp, Cowpox virus
tctatattaataggagatagttgt

SEQ ID NO: 16853 - DNA, 23 bp, Homo sapiens
tctatattaatggaatctattgt

SEQ ID NO: 16854 - DNA, 22 bp, Homo sapiens
tctattttaataggggggacaa

SEQ ID NO: 16855 - DNA, 24 bp, Homo sapiens
tctataataataggaatgacttgt

SEQ ID NO: 16856 - DNA, 97 bp, Sheeppox virus
ttcttgtttgtttatttctgcttctaatctattatttgcaacaaatacagatactaatgtttcaggggataagtttccgaataaacatacattaggg

SEQ ID NO: 16857 - DNA, 24 bp, Sheeppox virus
aatacagatactaatgtttcaggg

SEQ ID NO: 16858 - DNA, 20 bp, Homo sapiens
aatacagagctagtgtttgg

SEQ ID NO: 16859 - DNA, 17 bp, Homo sapiens
caggtccagtttcaggg

SEQ ID NO: 16860 - DNA, 21 bp, Homo sapiens
aatacagatctaaagtctggg

SEQ ID NO: 16861 - DNA, 24 bp, Homo sapiens
gaacagatgtgcctgatttcaggg

SEQ ID NO: 16862 - DNA, 19 bp, Homo sapiens
gatactaaatgtggcaggg

SEQ ID NO: 16863 - DNA, 17 bp, Homo sapiens
tacgaatactaatgagg

SEQ ID NO: 16864 - DNA, 16 bp, Homo sapiens
acagatactggtttgg

SEQ ID NO: 16865 - DNA, 20 bp, Homo sapiens
acagttcagatgtttcaggg

SEQ ID NO: 16866 - DNA, 20 bp, Homo sapiens
caggtactatttcctcaggg

SEQ ID NO: 16867 - DNA, 17 bp, Homo sapiens
cagatactgtgcctggg

SEQ ID NO: 16868 - DNA, 18 bp, Homo sapiens
aacacagatgctttcagg

SEQ ID NO: 16869 - DNA, 20 bp, Homo sapiens
tacagtacagtgtttcaggg

SEQ ID NO: 16870 - DNA, 21 bp, Homo sapiens
aatacagatgactcttttggg

SEQ ID NO: 16871 - DNA, 24 bp, Homo sapiens
atacagatacaatccatatcaggg

SEQ ID NO: 16872 - DNA, 17 bp, Homo sapiens
agattagagtttcaggg

SEQ ID NO: 16873 - DNA, 21 bp, Homo sapiens
taaaggtaccagctttcaggg

SEQ ID NO: 16874 - DNA, 18 bp, Homo sapiens
caggtacctccttcaggg

SEQ ID NO: 16875 - DNA, 18 bp, Homo sapiens
cagggctatgcctcaggg

SEQ ID NO: 16876 - DNA, 22 bp, Homo sapiens
atacatgatgctggtcccaggg

SEQ ID NO: 16877 - DNA, 18 bp, Homo sapiens
aatataaatactaatggg

SEQ ID NO: 16878 - DNA, 64 bp, Beet yellows virus
ggaggtttctatcgcgacttaaaacgctggataggatgcgacgaagaaaactatagagactacc

SEQ ID NO: 16879 - DNA, 24 bp, Beet yellows virus
ggatgcgacgaagaaaactataga

SEQ ID NO: 16880 - DNA, 23 bp, Homo sapiens
ggaagcggcaaagaaattgtaga

SEQ ID NO: 16881 - DNA, 67 bp, Beet yellows virus
gtgcgctttgtactcagcttgtcttcgaaacgattctccgatgttgttggttgactgcgcagctcac

SEQ ID NO: 16882 - DNA, 21 bp, Beet yellows virus
ttggttgactgcgcagctcac

SEQ ID NO: 16883 - DNA, 19 bp, Homo sapiens
ggttgactcccccagctca

SEQ ID NO: 16884 - DNA, 19 bp, Homo sapiens
ttggttgattcaagctcac

SEQ ID NO: 16885 - DNA, 16 bp, Homo sapiens
ttggttgatgagctca

SEQ ID NO: 16886 - DNA, 18 bp, Homo sapiens
ttgcttgctcacgcagct

SEQ ID NO: 16887 - DNA, 19 bp, Homo sapiens
ttggttgactgcagcctcc

SEQ ID NO: 16888 - DNA, 16 bp, Homo sapiens
ttagttgactcaagct

SEQ ID NO: 16889 - DNA, 19 bp, Homo sapiens
ggcggggctgcgcagctca

SEQ ID NO: 16890 - DNA, 16 bp, Homo sapiens
ttggttggtggcctca

SEQ ID NO: 16891 - DNA, 15 bp, Homo sapiens
ggtcgctgcagctca

SEQ ID NO: 16892 - DNA, 17 bp, Homo sapiens
ttggtgaagacagctca

SEQ ID NO: 16893 - DNA, 22 bp, Homo sapiens
ctggttgagcagggtggctcac

SEQ ID NO: 16894 - DNA, 21 bp, Homo sapiens
ttggttaactagatgctggct

SEQ ID NO: 16895 - DNA, 17 bp, Homo sapiens
ttggttgaatgtcagct

SEQ ID NO: 16896 - DNA, 17 bp, Homo sapiens
tggagagcgcagctcac

SEQ ID NO: 16897 - DNA, 19 bp, Homo sapiens
tggttgactggaacttcac

SEQ ID NO: 16898 - DNA, 20 bp, Homo sapiens
ttggttgctaaagaagctca

SEQ ID NO: 16899 - DNA, 19 bp, Homo sapiens
tggtgtgattgcagctcac

SEQ ID NO: 16900 - DNA, 15 bp, Homo sapiens
ttagttgatggctca

SEQ ID NO: 16901 - DNA, 21 bp, Homo sapiens
ttggatgacttcccagctcac

SEQ ID NO: 16902 - DNA, 18 bp, Homo sapiens
tcggtgtgctgcagctca

SEQ ID NO: 16903 - DNA, 21 bp, Homo sapiens
ttggctgagtgcgacagctca

SEQ ID NO: 16904 - DNA, 16 bp, Homo sapiens
ttggttgatgccagct

SEQ ID NO: 16905 - DNA, 15 bp, Homo sapiens
ttagttagcagctca

SEQ ID NO: 16906 - DNA, 91 bp, Yaba-like disease virus
cttgtaaacttcatcgtttattgttatataatttcctgtagataaaactttagaaaatagcaatgattttccctttacgtccgttaacgag

SEQ ID NO: 16907 - DNA, 24 bp, Yaba-like disease virus
ttagaaaatagcaatgattttccc

SEQ ID NO: 16908 - DNA, 21 bp, Homo sapiens
ttagaaaagagcacaattttc

SEQ ID NO: 16909 - DNA, 21 bp, Homo sapiens
aaagatatgactgattttccc

SEQ ID NO: 16910 - DNA, 21 bp, Homo sapiens
ttaaaaaatgcttattttccc

SEQ ID NO: 16911 - DNA, 22 bp, Homo sapiens
tagaaaatagcttctgttttcc

SEQ ID NO: 16912 - DNA, 21 bp, Homo sapiens
ttagaaagaagcgtgattctc

SEQ ID NO: 16913 - DNA, 21 bp, Homo sapiens
agaaaatatctgaattttccc

SEQ ID NO: 16914 - DNA, 20 bp, Homo sapiens
agaaaatagaatggattttc

SEQ ID NO: 16915 - DNA, 17 bp, Homo sapiens
ttagagaatgcaatgat

SEQ ID NO: 16916 - DNA, 19 bp, Homo sapiens
tagaggcagctgattttcc

SEQ ID NO: 16917 - DNA, 22 bp, Homo sapiens
gaaaataccacttgattttccc

SEQ ID NO: 16918 - DNA, 21 bp, Homo sapiens
ttaggaaatagcaacagtttt

SEQ ID NO: 16919 - DNA, 16 bp, Homo sapiens
gaaaatagccttttcc

SEQ ID NO: 16920 - DNA, 16 bp, Homo sapiens
ttagaaaatacaattc

SEQ ID NO: 16921 - DNA, 23 bp, Homo sapiens
ttagaaaatggcagcgctattcc

SEQ ID NO: 16922 - DNA, 21 bp, Homo sapiens
tagaaaatagcaaatgatttt

SEQ ID NO: 16923 - DNA, 21 bp, Homo sapiens
agaaaatagtacatgctttcc

SEQ ID NO: 16924 - DNA, 20 bp, Homo sapiens
aaaaatagcagatcggttcc

SEQ ID NO: 16925 - DNA, 22 bp, Homo sapiens
ttagaaaatagaatatgaattc

SEQ ID NO: 16926 - DNA, 21 bp, Homo sapiens
gaaaacagtagcacccctccc

SEQ ID NO: 16927 - DNA, 18 bp, Homo sapiens
taggaaatagcactttcc

SEQ ID NO: 16928 - DNA, 17 bp, Homo sapiens
aaaaatagcaagattct

SEQ ID NO: 16929 - DNA, 22 bp, Homo sapiens
gaaaatagcggtgagggtttcc

SEQ ID NO: 16930 - DNA, 25 bp, Homo sapiens
agaaaatagctatccctggttttcc

SEQ ID NO: 16931 - DNA, 22 bp, Homo sapiens
ttaggaaacagacgattttccc

SEQ ID NO: 16932 - DNA, 20 bp, Homo sapiens
gaaaatagttgtaattttcc

SEQ ID NO: 16933 - DNA, 21 bp, Homo sapiens
tagaaaatagcagagactctc

SEQ ID NO: 16934 - DNA, 22 bp, Homo sapiens
ttagtatacagcagtgattttc

SEQ ID NO: 16935 - DNA, 22 bp, Homo sapiens
ttaggcaatagcaagtctttcc

SEQ ID NO: 16936 - DNA, 19 bp, Homo sapiens
ctagaaaataagattttcc

SEQ ID NO: 16937 - DNA, 18 bp, Homo sapiens
gaaaatgcagtgattttc

SEQ ID NO: 16938 - DNA, 23 bp, Homo sapiens
ttagaaaatgcaattgattttcc

SEQ ID NO: 16939 - DNA, 20 bp, Homo sapiens
gaatatagcaataaagtctc

SEQ ID NO: 16940 - DNA, 21 bp, Homo sapiens
ctagaacctagtgattttccc

SEQ ID NO: 16941 - DNA, 18 bp, Homo sapiens
tcagagtcaatgattttc

SEQ ID NO: 16942 - DNA, 21 bp, Homo sapiens
ctagagaatggcaatgacttt

SEQ ID NO: 16943 - DNA, 22 bp, Homo sapiens
ttaaactcgtagtgattttccc

SEQ ID NO: 16944 - DNA, 21 bp, Homo sapiens
ctagagaatggcgatgacttt

SEQ ID NO: 16945 - DNA, 18 bp, Homo sapiens
ttagaaaagctgattttc

SEQ ID NO: 16946 - DNA, 62 bp, Beet yellows virus
acgttaaagctaaattgcttatggtgggtgggtcttcttacttgcccggtctgctgtcacgt

SEQ ID NO: 16947 - DNA, 24 bp, Beet yellows virus
ttaaagctaaattgcttatggtgg

SEQ ID NO: 16948 - DNA, 20 bp, Homo sapiens
gctaagtgttgatatggtgg

SEQ ID NO: 16949 - DNA, 19 bp, Homo sapiens
ttaaagctgaattctttgg

SEQ ID NO: 16950 - DNA, 18 bp, Homo sapiens
ttaaggctgggcatggtg

SEQ ID NO: 16951 - DNA, 72 bp, Yaba-like disease virus
tatctttgttaattagcgtaaattttaactcttttccaaataagtttatgtaacaacaactaacatgagata

SEQ ID NO: 16952 - DNA, 24 bp, Yaba-like disease virus
tctttgttaattagcgtaaatttt

SEQ ID NO: 16953 - DNA, 18 bp, Homo sapiens
tctttattaattgtgcat

SEQ ID NO: 16954 - DNA, 94 bp, Beet yellows virus
gcaccggtgttatctgttcagtccctgccaactacaattgtttgcaaaggtcttttaccgaaagttgtgtcaatctgagtggctacccctgtgt

SEQ ID NO: 16955 - DNA, 24 bp, Beet yellows virus
tatctgttcagtccctgccaacta

SEQ ID NO: 16956 - DNA, 18 bp, Homo sapiens
tatctgttcatgtttctg

SEQ ID NO: 16957 - DNA, 18 bp, Homo sapiens
tgttcagtgctacagact

SEQ ID NO: 16958 - DNA, 21 bp, Homo sapiens
tatgtgtttaactgccaacta

SEQ ID NO: 16959 - DNA, 19 bp, Homo sapiens
tatctgttcaagtccctgc

SEQ ID NO: 16960 - DNA, 18 bp, Homo sapiens
catctgtctctgccagct

SEQ ID NO: 16961 - DNA, 18 bp, Homo sapiens
tgttcagcgacttaacta

SEQ ID NO: 16962 - DNA, 22 bp, Homo sapiens
tatctgtctagtaatctgacta

SEQ ID NO: 16963 - DNA, 23 bp, Homo sapiens
tatctgttagtcctggaaagcta

SEQ ID NO: 16964 - DNA, 22 bp, Homo sapiens
tatcttttcagtccaaaaacta

SEQ ID NO: 16965 - DNA, 22 bp, Homo sapiens
tatctgcttcagtttataacta

SEQ ID NO: 16966 - DNA, 17 bp, Homo sapiens
ctgttcagcagctaact

SEQ ID NO: 16967 - DNA, 19 bp, Homo sapiens
tacctgtttggaatccagc

SEQ ID NO: 16968 - DNA, 20 bp, Homo sapiens
tgttcagtttttcaccacta

SEQ ID NO: 16969 - DNA, 20 bp, Homo sapiens
ctgttcagtcagacaggcta

SEQ ID NO: 16970 - DNA, 21 bp, Homo sapiens
tgtctttcgggctgccaacta

SEQ ID NO: 16971 - DNA, 19 bp, Homo sapiens
tatctgcttagtttccagc

SEQ ID NO: 16972 - DNA, 23 bp, Homo sapiens
tatatgtctctttcctgccaact

SEQ ID NO: 16973 - DNA, 19 bp, Homo sapiens
tattgagcccctgccagct

SEQ ID NO: 16974 - DNA, 19 bp, Homo sapiens
cctacactctttgccagct

SEQ ID NO: 16975 - DNA, 20 bp, Homo sapiens
ctgtttgttctctgccaact

SEQ ID NO: 16976 - DNA, 18 bp, Homo sapiens
atctgctccctgtcagct

SEQ ID NO: 16977 - DNA, 18 bp, Homo sapiens
tctgggtccctgccagct

SEQ ID NO: 16978 - DNA, 75 bp, Human herpesvirus 6
cgttgtggattgtctgacctttgaaaaaatttttgtgtccgtgtagcatttcaataaaagtcattatctgctccg

SEQ ID NO: 16979 - DNA, 24 bp, Human herpesvirus 6
ttgaaaaaatttttgtgtccgtgt

SEQ ID NO: 16980 - DNA, 22 bp, Homo sapiens
ttaaaaaagtttccccccgtgt

SEQ ID NO: 16981 - DNA, 23 bp, Homo sapiens
ttaaaaaaagagcatgtctgtgt

SEQ ID NO: 16982 - DNA, 22 bp, Homo sapiens
gaaaacattttgtgttttgtgt

SEQ ID NO: 16983 - DNA, 21 bp, Homo sapiens
ttgaggaattttcatccgtgt

SEQ ID NO: 16984 - DNA, 129 bp, Human herpesvirus 6
cactatgtcgtggattagtttagatgacacttgttgtaggagattgtataagttcggggccgtatgggtggttctcatgaacggaacgattcctacagtacagatccagtctacatatctgttatagtg

SEQ ID NO: 16985 - DNA, 24 bp, Human herpesvirus 6
ttctcatgaacggaacgattccta

SEQ ID NO: 16986 - DNA, 17 bp, Homo sapiens
tcttgagggcaattcct

SEQ ID NO: 16987 - DNA, 19 bp, Homo sapiens
tcctcatggatggatgcct

SEQ ID NO: 16988 - DNA, 22 bp, Homo sapiens
ttctcatagaataactgttcct

SEQ ID NO: 16989 - DNA, 23 bp, Homo sapiens
ttctcatggaagccctcttccta

SEQ ID NO: 16990 - DNA, 18 bp, Homo sapiens
ttctcatgaatgacaatt

SEQ ID NO: 16991 - DNA, 19 bp, Homo sapiens
ttctcatggtaaagttcct

SEQ ID NO: 16992 - DNA, 22 bp, Homo sapiens
ttcttatgaacagagtgatcct

SEQ ID NO: 16993 - DNA, 20 bp, Homo sapiens
ttctcataatggagacagct

SEQ ID NO: 16994 - DNA, 22 bp, Homo sapiens
ttctcatggagggggggtccta

SEQ ID NO: 16995 - DNA, 16 bp, Homo sapiens
ttctcatgggatccta

SEQ ID NO: 16996 - DNA, 20 bp, Homo sapiens
ttcttctgaacaaaatgatt

SEQ ID NO: 16997 - DNA, 19 bp, Homo sapiens
ttctcatgaacgggcacct

SEQ ID NO: 16998 - DNA, 72 bp, Myxoma virus
ccacgtcgttggtttcttttatcatcttcttgtacttgaggcgttccgttagaaacgttttcaacaacttgg

SEQ ID NO: 16999 - DNA, 24 bp, Myxoma virus
cgttccgttagaaacgttttcaac

SEQ ID NO: 17000 - DNA, 19 bp, Homo sapiens
cgttctgttaaaaacctcc

SEQ ID NO: 17001 - DNA, 18 bp, Homo sapiens
atttcgttaagttttcaa

SEQ ID NO: 17002 - DNA, 23 bp, Homo sapiens
gttccgttcagaggcccctccca

SEQ ID NO: 17003 - DNA, 21 bp, Homo sapiens
gttttgttagaaagcattcaa

SEQ ID NO: 17004 - DNA, 18 bp, Homo sapiens
gccccaaaacgttttcaa

SEQ ID NO: 17005 - DNA, 18 bp, Homo sapiens
ccgccatggagacgtttt

SEQ ID NO: 17006 - DNA, 19 bp, Homo sapiens
ccttccgttaggaagtcct

SEQ ID NO: 17007 - DNA, 17 bp, Homo sapiens
gtccagtaaaacgtttt

SEQ ID NO: 17008 - DNA, 68 bp, Myxoma virus
cgaagaatgtcgtgccgttgttgttgtttacgtgatacgtggtgttcgataccccgccgactcctttg

SEQ ID NO: 17009 - DNA, 19 bp, Myxoma virus
taccccgccgactcctttg

SEQ ID NO: 17010 - DNA, 21 bp, Homo sapiens
ccccgccctcgctttcctttg

SEQ ID NO: 17011 - DNA, 18 bp, Homo sapiens
accccgccgtgtcatttg

SEQ ID NO: 17012 - DNA, 19 bp, Homo sapiens
cccctgcccccaccctttg

SEQ ID NO: 17013 - DNA, 19 bp, Homo sapiens
ccccgcttcattccctttg

SEQ ID NO: 17014 - DNA, 18 bp, Homo sapiens
cccctctccgctcctttg

SEQ ID NO: 17015 - DNA, 19 bp, Homo sapiens
tacctgccagcctcctttg

SEQ ID NO: 17016 - DNA, 21 bp, Homo sapiens
caccttctcctgactcctttg

SEQ ID NO: 17017 - DNA, 21 bp, Homo sapiens
tacccccttactggccctttg

SEQ ID NO: 17018 - DNA, 18 bp, Homo sapiens
taccccactcggcctttg

SEQ ID NO: 17019 - DNA, 19 bp, Homo sapiens
ccccgccgggactattttg

SEQ ID NO: 17020 - DNA, 16 bp, Homo sapiens
caccccgccgtctttg

SEQ ID NO: 17021 - DNA, 17 bp, Homo sapiens
tacccctccctactttg

SEQ ID NO: 17022 - DNA, 19 bp, Homo sapiens
ccacacgttgactcctttg

SEQ ID NO: 17023 - DNA, 23 bp, Homo sapiens
taccccctcccaatactcttttg

SEQ ID NO: 17024 - DNA, 16 bp, Homo sapiens
cacccagactcctttg

SEQ ID NO: 17025 - DNA, 19 bp, Homo sapiens
cacccgaggctctcctttg

SEQ ID NO: 17026 - DNA, 18 bp, Homo sapiens
cctccagcccctcctttg

SEQ ID NO: 17027 - DNA, 17 bp, Homo sapiens
cacccccctctcctttg

SEQ ID NO: 17028 - DNA, 18 bp, Homo sapiens
cacttgcgcactcctttg

SEQ ID NO: 17029 - DNA, 18 bp, Homo sapiens
cctcgccgactccacttg

SEQ ID NO: 17030 - DNA, 19 bp, Homo sapiens
tacttcacctgcccctttg

SEQ ID NO: 17031 - DNA, 18 bp, Homo sapiens
tacccaactgctcctttg

SEQ ID NO: 17032 - DNA, 21 bp, Homo sapiens
cccctccaatggctcttttgc

SEQ ID NO: 17033 - DNA, 17 bp, Homo sapiens
cactcccccctcctttg

SEQ ID NO: 17034 - DNA, 69 bp, Alcelaphine herpesvirus 1
gggctctctgccgtgcgaggctcctcacagacacacagcaagaaagaagcgccgcgcagcagatagccc

SEQ ID NO: 17035 - DNA, 18 bp, Alcelaphine herpesvirus 1
ccgcgcagcagatagccc

SEQ ID NO: 17036 - DNA, 18 bp, Homo sapiens
cgcagcagacactggccc

SEQ ID NO: 17037 - DNA, 21 bp, Homo sapiens
ccgcgcagcagcgaacggccc

SEQ ID NO: 17038 - DNA, 20 bp, Homo sapiens
ccgcgcaggtggaaagaccc

SEQ ID NO: 17039 - DNA, 19 bp, Homo sapiens
ccgcagcagccctcagccc

SEQ ID NO: 17040 - DNA, 18 bp, Homo sapiens
ccgcacagcagcgcaccc

SEQ ID NO: 17041 - DNA, 15 bp, Homo sapiens
ccgcgaggacagccc

SEQ ID NO: 17042 - DNA, 16 bp, Homo sapiens
cccgcagaaacagccc

SEQ ID NO: 17043 - DNA, 20 bp, Homo sapiens
ccgcgcagctcggccagccc

SEQ ID NO: 17044 - DNA, 19 bp, Homo sapiens
ccgcgcaggcgcagggccc

SEQ ID NO: 17045 - DNA, 16 bp, Homo sapiens
cctgcagagacagccc

SEQ ID NO: 17046 - DNA, 18 bp, Homo sapiens
ccaccagacagatagtcc

SEQ ID NO: 17047 - DNA, 19 bp, Homo sapiens
cgcgcagcggacgccgccc

SEQ ID NO: 17048 - DNA, 20 bp, Homo sapiens
cgcgcagcgagtggtagtcc

SEQ ID NO: 17049 - DNA, 20 bp, Homo sapiens
ccgcagcagcaacagtgccc

SEQ ID NO: 17050 - DNA, 18 bp, Homo sapiens
ccccgcagcaggcagccc

SEQ ID NO: 17051 - DNA, 17 bp, Homo sapiens
ccccgcagcaggagccc

SEQ ID NO: 17052 - DNA, 18 bp, Homo sapiens
ccatgccacaaatagtcc

SEQ ID NO: 17053 - DNA, 17 bp, Homo sapiens
ccgcacaggacgtgccc

SEQ ID NO: 17054 - DNA, 21 bp, Homo sapiens
ccgggcagcagagtacagtcc

SEQ ID NO: 17055 - DNA, 18 bp, Homo sapiens
cactgtaacagatagccc

SEQ ID NO: 17056 - DNA, 18 bp, Homo sapiens
gcgcagcagacaccgccc

SEQ ID NO: 17057 - DNA, 16 bp, Homo sapiens
ccggcagcagagaccc

SEQ ID NO: 17058 - DNA, 19 bp, Homo sapiens
ccgcgcagagcggcagtcc

SEQ ID NO: 17059 - DNA, 19 bp, Homo sapiens
ccacgcagccagacctagc

SEQ ID NO: 17060 - DNA, 18 bp, Homo sapiens
ccgcgcagcaaattggcc

SEQ ID NO: 17061 - DNA, 18 bp, Homo sapiens
ccgcagcagccgacgccc

SEQ ID NO: 17062 - DNA, 16 bp, Homo sapiens
cctgcagcaacagccc

SEQ ID NO: 17063 - DNA, 17 bp, Homo sapiens
ccgcactgcaatagccc

SEQ ID NO: 17064 - DNA, 18 bp, Homo sapiens
ccgcacagccggcagccc

SEQ ID NO: 17065 - DNA, 15 bp, Homo sapiens
ccgcgcagccagccc

SEQ ID NO: 17066 - DNA, 18 bp, Homo sapiens
ccccgcggccgacagccc

SEQ ID NO: 17067 - DNA, 17 bp, Homo sapiens
ccggcagcagagtaccc

SEQ ID NO: 17068 - DNA, 16 bp, Homo sapiens
ccgtcgacaatagccc

SEQ ID NO: 17069 - DNA, 17 bp, Homo sapiens
cctgcggcagacaaccc

SEQ ID NO: 17070 - DNA, 15 bp, Homo sapiens
ccggcagcagagccc

SEQ ID NO: 17071 - DNA, 17 bp, Homo sapiens
cctgccagggatagccc

SEQ ID NO: 17072 - DNA, 18 bp, Homo sapiens
ccgtcggtgcgacagccc

SEQ ID NO: 17073 - DNA, 21 bp, Homo sapiens
ccacgcagcacagcgcagccc

SEQ ID NO: 17074 - DNA, 18 bp, Homo sapiens
ccgcgcaggaagtagccc

SEQ ID NO: 17075 - DNA, 16 bp, Homo sapiens
ccgcgcagcgacgccc

SEQ ID NO: 17076 - DNA, 73 bp, Alcelaphine herpesvirus 1
gtgcagagaccgcctgggtgtgactgtttttaggcctaacaaaggcacagaaacacccgtgcggtctctgtat

SEQ ID NO: 17077 - DNA, 23 bp, Alcelaphine herpesvirus 1
aaacacccgtgcggtctctgtat

SEQ ID NO: 17078 - DNA, 17 bp, Homo sapiens
aaagacccttctctgta

SEQ ID NO: 17079 - DNA, 19 bp, Homo sapiens
ccctacaaaatctctgtat

SEQ ID NO: 17080 - DNA, 17 bp, Homo sapiens
aacaccagtgcctctgt

SEQ ID NO: 17081 - DNA, 20 bp, Homo sapiens
acaccagatcatctctgtat

SEQ ID NO: 17082 - DNA, 21 bp, Homo sapiens
aaacatctctgtggtcccagt

SEQ ID NO: 17083 - DNA, 16 bp, Homo sapiens
acaccctgtccctgta

SEQ ID NO: 17084 - DNA, 24 bp, Homo sapiens
gaacccctgggcacatttctgtat

SEQ ID NO: 17085 - DNA, 22 bp, Homo sapiens
ggacgactcgaaggctctgtat

SEQ ID NO: 17086 - DNA, 19 bp, Homo sapiens
cgtgtctcagtttctgtat

SEQ ID NO: 17087 - DNA, 20 bp, Homo sapiens
aaacactgtttgctctgtat

SEQ ID NO: 17088 - DNA, 16 bp, Homo sapiens
ccctgaagttctgtat

SEQ ID NO: 17089 - DNA, 21 bp, Homo sapiens
acacagtgttggtttctgtat

SEQ ID NO: 17090 - DNA, 19 bp, Homo sapiens
ccatcagttgtttctgtat

SEQ ID NO: 17091 - DNA, 20 bp, Homo sapiens
ggacacccgtgtggctttgt

SEQ ID NO: 17092 - DNA, 20 bp, Homo sapiens
aactacccacctctctgtat

SEQ ID NO: 17093 - DNA, 20 bp, Homo sapiens
aacaccaccagtctctgtat

SEQ ID NO: 17094 - DNA, 19 bp, Homo sapiens
aacagccgttcctctgtat

SEQ ID NO: 17095 - DNA, 20 bp, Homo sapiens
aaacagttggccctctgtat

SEQ ID NO: 17096 - DNA, 20 bp, Homo sapiens
cgtggtggtggtctctgtat

SEQ ID NO: 17097 - DNA, 17 bp, Homo sapiens
cacccgtgtggctctgc

SEQ ID NO: 17098 - DNA, 23 bp, Homo sapiens
aaacacccgggcttggtttgtgt

SEQ ID NO: 17099 - DNA, 81 bp, Human herpesvirus 7
gagacaagctttcaatatctgaatctaaagtaaagtcatgtttagaagtttcggataaatttattaatgaatgcatgtctt

SEQ ID NO: 17100 - DNA, 24 bp, Human herpesvirus 7
ttcaatatctgaatctaaagtaaa

SEQ ID NO: 17101 - DNA, 20 bp, Homo sapiens
ttcaaatccaattctaaagt

SEQ ID NO: 17102 - DNA, 21 bp, Homo sapiens
ctcaatatcttggggaagtaa

SEQ ID NO: 17103 - DNA, 22 bp, Homo sapiens
ttcaatattctgtaaaagtaaa

SEQ ID NO: 17104 - DNA, 21 bp, Homo sapiens
ttcaaatctgaatctgtgcaa

SEQ ID NO: 17105 - DNA, 21 bp, Homo sapiens
ctcaatatttgagtctctgca

SEQ ID NO: 17106 - DNA, 18 bp, Homo sapiens
caatatctgagaaaaata

SEQ ID NO: 17107 - DNA, 21 bp, Homo sapiens
ttcaataagaatctaaagtaa

SEQ ID NO: 17108 - DNA, 20 bp, Homo sapiens
tccaatatatgttctaaagt

SEQ ID NO: 17109 - DNA, 23 bp, Homo sapiens
ttcaatttctacagataaagtaa

SEQ ID NO: 17110 - DNA, 24 bp, Homo sapiens
aatatctgagttccactggggtaa

SEQ ID NO: 17111 - DNA, 21 bp, Homo sapiens
ttcaatatctgaagaaaagta

SEQ ID NO: 17112 - DNA, 101 bp, Human herpesvirus 7
tattttcaaatagccgatttgcagttttcagtgtttcgatttcgtccagttgtgattgaatctgttcctccatgcattttatgatttgttttttgaagata

SEQ ID NO: 17113 - DNA, 24 bp, Human herpesvirus 7
ttgaatctgttcctccatgcattt

SEQ ID NO: 17114 - DNA, 19 bp, Homo sapiens
ttcaatctgctcatgcatt

SEQ ID NO: 17115 - DNA, 19 bp, Homo sapiens
ttgaatctttcttcccatt

SEQ ID NO: 17116 - DNA, 19 bp, Homo sapiens
ttgaactgctttatgcatt

SEQ ID NO: 17117 - DNA, 18 bp, Homo sapiens
ttgaatctgtttctctac

SEQ ID NO: 17118 - DNA, 22 bp, Homo sapiens
ttgtgtctgttgcaatgcattt

SEQ ID NO: 17119 - DNA, 24 bp, Homo sapiens
ttgaatcatttaatctatgcattt

SEQ ID NO: 17120 - DNA, 17 bp, Homo sapiens
ttgatctgttccttcac

SEQ ID NO: 17121 - DNA, 19 bp, Homo sapiens
tgagtgcttccatgcattt

SEQ ID NO: 17122 - DNA, 66 bp, Human herpesvirus 7
gtattcagcaattgacacattttacggtgcctgtgtaggttttcgtgtttattcaattctgagtat

SEQ ID NO: 17123 - DNA, 24 bp, Human herpesvirus 7
ttcgtgtttattcaattctgagta

SEQ ID NO: 17124 - DNA, 21 bp, Homo sapiens
ttcgtttttattgtcctgagt

SEQ ID NO: 17125 - DNA, 19 bp, Homo sapiens
tgtctaagtaattctgagt

SEQ ID NO: 17126 - DNA, 19 bp, Homo sapiens
tgtctgtttaattctgagt

SEQ ID NO: 17127 - DNA, 23 bp, Homo sapiens
ttcatgtttattttaggagagta

SEQ ID NO: 17128 - DNA, 25 bp, Homo sapiens
ttcgtgcttttcctgtattttgagt

SEQ ID NO: 17129 - DNA, 16 bp, Homo sapiens
ttcatgtttatctgag

SEQ ID NO: 17130 - DNA, 21 bp, Homo sapiens
ctcgtgtttattcagtcactg

SEQ ID NO: 17131 - DNA, 68 bp, Lymphocystis disease virus 1
attatcaatcggaccagatattctagaatgtatcttatttacaactaaatgtcgtaaccgttgataat

SEQ ID NO: 17132 - DNA, 24 bp, Lymphocystis disease virus 1
caactaaatgtcgtaaccgttgat

SEQ ID NO: 17133 - DNA, 20 bp, Homo sapiens
taaatgtcttaaaagttgat

SEQ ID NO: 17134 - DNA, 97 bp, Human herpesvirus 6B
gaacgtctctctctcctgtgtcgatcgcagagcgttttcggaactgtcctcggttcagcataagtttattttggtctattatagagggggtgatttc

SEQ ID NO: 17135 - DNA, 24 bp, Human herpesvirus 6B
ttcagcataagtttattttggtct

SEQ ID NO: 17136 - DNA, 17 bp, Homo sapiens
cagcataagtttggccc

SEQ ID NO: 17137 - DNA, 22 bp, Homo sapiens
ttcagcataggttattcctggt

SEQ ID NO: 17138 - DNA, 21 bp, Homo sapiens
ttcagtaagtatcattttggt

SEQ ID NO: 17139 - DNA, 20 bp, Homo sapiens
ttcagcacaggtttatgcct

SEQ ID NO: 17140 - DNA, 17 bp, Homo sapiens
gcattttctattttggt

SEQ ID NO: 17141 - DNA, 21 bp, Homo sapiens
tccagtgtaagtttattgtct

SEQ ID NO: 17142 - DNA, 20 bp, Homo sapiens
tcagcgtaattctttggtct

SEQ ID NO: 17143 - DNA, 23 bp, Homo sapiens
ttcagcctgagtctaagtggtct

SEQ ID NO: 17144 - DNA, 21 bp, Homo sapiens
ttcagcagaagtgggtggtct

SEQ ID NO: 17145 - DNA, 18 bp, Homo sapiens
ttcagtgttcattttggt

SEQ ID NO: 17146 - DNA, 18 bp, Homo sapiens
tccagtgtaagtttattc

SEQ ID NO: 17147 - DNA, 24 bp, Homo sapiens
ttcaatgtaagttttttctggtct

SEQ ID NO: 17148 - DNA, 21 bp, Homo sapiens
ttcagcataagttaaaagcct

SEQ ID NO: 17149 - DNA, 18 bp, Homo sapiens
ttcagtataagtttgtgg

SEQ ID NO: 17150 - DNA, 19 bp, Homo sapiens
ttcatataagttttcagtc

SEQ ID NO: 17151 - DNA, 95 bp, Lymphocystis disease virus 1
gaaaggcatgtgggttaatgattaaatcaggtactatgccatctttagtgaaaggcatgttttcttgggcataaatcataccacaggtacctttt

SEQ ID NO: 17152 - DNA, 17 bp, Lymphocystis disease virus 1
taccacaggtacctttt

SEQ ID NO: 17153 - DNA, 19 bp, Homo sapiens
taccacagtgacacctttt

SEQ ID NO: 17154 - DNA, 18 bp, Homo sapiens
accacagggggacctttt

SEQ ID NO: 17155 - DNA, 18 bp, Homo sapiens
taccacaaataaactttt

SEQ ID NO: 17156 - DNA, 20 bp, Homo sapiens
accacaaagaaatacctttt

SEQ ID NO: 17157 - DNA, 18 bp, Homo sapiens
ccacaagctccacctttt

SEQ ID NO: 17158 - DNA, 21 bp, Homo sapiens
taccacaagatggcacctttt

SEQ ID NO: 17159 - DNA, 18 bp, Homo sapiens
taccacaagtattctttt

SEQ ID NO: 17160 - DNA, 19 bp, Homo sapiens
caccacagactttcctttt

SEQ ID NO: 17161 - DNA, 128 bp, Human herpesvirus 6B
agtttagatgacacttgttgtagaagattgtataagttcggggccgtaggggtggttctcatgaacggaacgattcctacggtacagatccagtctacatatctgttatagtgactgttgtctatgct

SEQ ID NO: 17162 - DNA, 24 bp, Human herpesvirus 6B
tagaagattgtataagttcggggc

SEQ ID NO: 17163 - DNA, 18 bp, Homo sapiens
gaagattgtgaggtgggg

SEQ ID NO: 17164 - DNA, 16 bp, Homo sapiens
tagaagattgtgtgcg

SEQ ID NO: 17165 - DNA, 22 bp, Homo sapiens
tagaagattgtctaagaaaagc

SEQ ID NO: 17166 - DNA, 18 bp, Homo sapiens
tagaagattgtggaaagg

SEQ ID NO: 17167 - DNA, 19 bp, Homo sapiens
tagaaggttgtgagtcagg

SEQ ID NO: 17168 - DNA, 18 bp, Homo sapiens
tagaagatttgttggggg

SEQ ID NO: 17169 - DNA, 20 bp, Homo sapiens
tagaagattgcatgttaggg

SEQ ID NO: 17170 - DNA, 72 bp, Lymphocystis disease virus 1
aggacaatttttgagttctatttcaatgtcatcacattttcgacaatattcaaaatcatcgcttattgtttt

SEQ ID NO: 17171 - DNA, 24 bp, Lymphocystis disease virus 1
caatttttgagttctatttcaatg

SEQ ID NO: 17172 - DNA, 23 bp, Homo sapiens
caattttcagtgctattttaatg

SEQ ID NO: 17173 - DNA, 23 bp, Homo sapiens
caattcttgaagcagtttcaatg

SEQ ID NO: 17174 - DNA, 15 bp, Homo sapiens
ttcttgagcttcaat

SEQ ID NO: 17175 - DNA, 17 bp, Homo sapiens
aatctttgaatttcaat

SEQ ID NO: 17176 - DNA, 22 bp, Homo sapiens
aatttttgaagcagtttcaatg

SEQ ID NO: 17177 - DNA, 25 bp, Homo sapiens
aatttttatgcctattatttcaatg

SEQ ID NO: 17178 - DNA, 78 bp, Lymphocystis disease virus 1
ggttgtattaaaggcttaatttcagctttatcaatacctagtgtaaatctaacagataatgctgtatttaatacaact

SEQ ID NO: 17179 - DNA, 22 bp, Lymphocystis disease virus 1
taatgctgtatttaatacaact

SEQ ID NO: 17180 - DNA, 17 bp, Homo sapiens
caatgcattttaataca

SEQ ID NO: 17181 - DNA, 19 bp, Homo sapiens
taatgctgtgtattcaata

SEQ ID NO: 17182 - DNA, 18 bp, Homo sapiens
caatgctatttaatacaa

SEQ ID NO: 17183 - DNA, 17 bp, Homo sapiens
aatgctgtatttgacaa

SEQ ID NO: 17184 - DNA, 18 bp, Homo sapiens
atactctttaatacaact

SEQ ID NO: 17185 - DNA, 21 bp, Homo sapiens
taatcctgtatttagagatac

SEQ ID NO: 17186 - DNA, 18 bp, Homo sapiens
taatgctgtttttaaaca

SEQ ID NO: 17187 - DNA, 21 bp, Homo sapiens
aatgctgtgattacagataca

SEQ ID NO: 17188 - DNA, 20 bp, Homo sapiens
atactttatttaatgcaact

SEQ ID NO: 17189 - DNA, 21 bp, Homo sapiens
taatactgaatcaatgcaact

SEQ ID NO: 17190 - DNA, 17 bp, Homo sapiens
caatgctgtatttttac

SEQ ID NO: 17191 - DNA, 18 bp, Homo sapiens
gctgtactcaatacaact

SEQ ID NO: 17192 - DNA, 20 bp, Homo sapiens
taatgtaatccaatacaact

SEQ ID NO: 17193 - DNA, 24 bp, Homo sapiens
taatgctgtagtagtaaagtacaa

SEQ ID NO: 17194 - DNA, 19 bp, Homo sapiens
taatgctgtttttaatgac

SEQ ID NO: 17195 - DNA, 130 bp, Galleria mellonella densovirus
tgcttatactctaagagtatcgccaccgacgacgacgacggcagtcgctgcccggcgaagccgagccgccgcgaagcggcgagcgactgccgtcgtcgtcgtcggtggcgatactcttagagtataagca

SEQ ID NO: 17196 - DNA, 24 bp, Galleria mellonella densovirus
taagagtatcgccaccgacgacga

SEQ ID NO: 17197 - DNA, 21 bp, Homo sapiens
tgaagctaacaccaccgatga

SEQ ID NO: 17198 - DNA, 18 bp, Homo sapiens
taagagtattgccacaga

SEQ ID NO: 17199 - DNA, 26 bp, Homo sapiens
gagtatcgtcactatggtcgtcgtcg

SEQ ID NO: 17200 - DNA, 22 bp, Homo sapiens
agagtatcagctacttccgccg

SEQ ID NO: 17201 - DNA, 22 bp, Homo sapiens
taagagtattgcaatcacatcg

SEQ ID NO: 17202 - DNA, 19 bp, Homo sapiens
gagcaccggccggtgatga

SEQ ID NO: 17203 - DNA, 70 bp, Sulfolobus virus SIRV-1
attcatagtttttaaaatttttacatttgagaaatcatattcaaatggaaaatttgttttatctaagaat

SEQ ID NO: 17204 - DNA, 24 bp, Sulfolobus virus SIRV-1
caaatggaaaatttgttttatcta

SEQ ID NO: 17205 - DNA, 18 bp, Homo sapiens
caaaaggaaaacttattt

SEQ ID NO: 17206 - DNA, 17 bp, Homo sapiens
caaatggaatgttctat

SEQ ID NO: 17207 - DNA, 19 bp, Homo sapiens
caaatagaaaatttgtcct

SEQ ID NO: 17208 - DNA, 21 bp, Homo sapiens
caaatggacagtttggatcta

SEQ ID NO: 17209 - DNA, 18 bp, Homo sapiens
gaaaatcctcttttatct

SEQ ID NO: 17210 - DNA, 23 bp, Homo sapiens
aaatgggtaaaaggtcttatcta

SEQ ID NO: 17211 - DNA, 22 bp, Homo sapiens
tgaatagaaagtaattttatct

SEQ ID NO: 17212 - DNA, 18 bp, Homo sapiens
aatggaaaataactgttt

SEQ ID NO: 17213 - DNA, 18 bp, Homo sapiens
tgaatggaatatttgcct

SEQ ID NO: 17214 - DNA, 23 bp, Homo sapiens
aaatggagtgttgtacttatcta

SEQ ID NO: 17215 - DNA, 19 bp, Homo sapiens
ggaaaatccacatttatct

SEQ ID NO: 17216 - DNA, 25 bp, Homo sapiens
aaatggaaaatggcctcttttgtct

SEQ ID NO: 17217 - DNA, 20 bp, Homo sapiens
caaatggaatgtttatttta

SEQ ID NO: 17218 - DNA, 18 bp, Homo sapiens
aatgggaaatttgtttca

SEQ ID NO: 17219 - DNA, 20 bp, Homo sapiens
caaatgaaaacatgttttat

SEQ ID NO: 17220 - DNA, 20 bp, Homo sapiens
tgaatgaaaaatttatttta

SEQ ID NO: 17221 - DNA, 21 bp, Homo sapiens
caaatggtaggtttgctttat

SEQ ID NO: 17222 - DNA, 19 bp, Homo sapiens
caaatggaagattattcta

SEQ ID NO: 17223 - DNA, 19 bp, Homo sapiens
caaatggaaaatctattct

SEQ ID NO: 17224 - DNA, 18 bp, Homo sapiens
caaatggaaaatatcctc

SEQ ID NO: 17225 - DNA, 19 bp, Homo sapiens
caaatggaaggtgtgtttt

SEQ ID NO: 17226 - DNA, 15 bp, Homo sapiens
ggaaaatttgcatct

SEQ ID NO: 17227 - DNA, 21 bp, Homo sapiens
caaatggaaaaattaatttta

SEQ ID NO: 17228 - DNA, 19 bp, Homo sapiens
tgaaagacctgctttatct

SEQ ID NO: 17229 - DNA, 23 bp, Homo sapiens
caattggaaaattttataatcta

SEQ ID NO: 17230 - DNA, 81 bp, Galleria mellonella densovirus
taccagagtttcgtgatgatgatttgttatgtgatcctaaaaatcgcgattacatacaagctgcatgcgatgactttggta

SEQ ID NO: 17231 - DNA, 24 bp, Galleria mellonella densovirus
tgatttgttatgtgatcctaaaaa

SEQ ID NO: 17232 - DNA, 16 bp, Homo sapiens
tgattttaatcctaaa

SEQ ID NO: 17233 - DNA, 19 bp, Homo sapiens
tttgtattggtcctaaaaa

SEQ ID NO: 17234 - DNA, 20 bp, Homo sapiens
tatcattgtgatcctaaaaa

SEQ ID NO: 17235 - DNA, 23 bp, Homo sapiens
tgattagttgtgaatcctaaaaa

SEQ ID NO: 17236 - DNA, 19 bp, Homo sapiens
tgttttgtttttcctaaaa

SEQ ID NO: 17237 - DNA, 19 bp, Homo sapiens
atttgttatgttgtcataa

SEQ ID NO: 17238 - DNA, 22 bp, Homo sapiens
tggtttggttggatcctaaaaa

SEQ ID NO: 17239 - DNA, 19 bp, Homo sapiens
tgatttgtttgtactaaaa

SEQ ID NO: 17240 - DNA, 17 bp, Homo sapiens
tgactgccggtgatcct

SEQ ID NO: 17241 - DNA, 66 bp, Galleria mellonella densovirus
accttctgagctgatggtctactgacctgatgatgaagaggatccgaagaccttggagctgaaggt

SEQ ID NO: 17242 - DNA, 24 bp, Galleria mellonella densovirus
tccgaagaccttggagctgaaggt

SEQ ID NO: 17243 - DNA, 25 bp, Homo sapiens
cccgaaggtcaggactgctgagggt

SEQ ID NO: 17244 - DNA, 22 bp, Homo sapiens
tccggaactcgatattgaaggt

SEQ ID NO: 17245 - DNA, 25 bp, Homo sapiens
tccgaagagttttgtttgtggaggt

SEQ ID NO: 17246 - DNA, 21 bp, Homo sapiens
cccggagcgggagctgggggt

SEQ ID NO: 17247 - DNA, 20 bp, Homo sapiens
gaagcagcagagctggaggt

SEQ ID NO: 17248 - DNA, 17 bp, Homo sapiens
gaagagaagctgagggt

SEQ ID NO: 17249 - DNA, 18 bp, Homo sapiens
gaggccttggaagaaggt

SEQ ID NO: 17250 - DNA, 18 bp, Homo sapiens
tctgagagaagctgaggg

SEQ ID NO: 17251 - DNA, 20 bp, Homo sapiens
tccgagacggagctgggggt

SEQ ID NO: 17252 - DNA, 16 bp, Homo sapiens
gaaacggagctgaagg

SEQ ID NO: 17253 - DNA, 18 bp, Homo sapiens
agacgcggagctgaaggt

SEQ ID NO: 17254 - DNA, 18 bp, Homo sapiens
gaagcgtgagctgaaggt

SEQ ID NO: 17255 - DNA, 22 bp, Homo sapiens
cagagacagcaaagctgaaggt

SEQ ID NO: 17256 - DNA, 20 bp, Homo sapiens
ccggggcctgagctgaaggt

SEQ ID NO: 17257 - DNA, 21 bp, Homo sapiens
gaaggttccagagctgaaggt

SEQ ID NO: 17258 - DNA, 18 bp, Homo sapiens
gaaaatcttgtcaaaggt

SEQ ID NO: 17259 - DNA, 20 bp, Homo sapiens
aaccttggggcgagggaggt

SEQ ID NO: 17260 - DNA, 21 bp, Homo sapiens
tccagggctggacctgaaggt

SEQ ID NO: 17261 - DNA, 21 bp, Homo sapiens
tctgcagactggcctgaaggt

SEQ ID NO: 17262 - DNA, 21 bp, Homo sapiens
cctggagactttgggcgaagg

SEQ ID NO: 17263 - DNA, 19 bp, Homo sapiens
gaaggctcttgccgaaggt

SEQ ID NO: 17264 - DNA, 20 bp, Homo sapiens
ccggctctggggctgagggt

SEQ ID NO: 17265 - DNA, 87 bp, Human herpesvirus 7
ggtactttctttgccaaaaaaaaagttgattgaagtcattttcacaagaattgatcagaaagtttttagcgtgtgtcaaagtgtgcc

SEQ ID NO: 17266 - DNA, 24 bp, Human herpesvirus 7
agaaagtttttagcgtgtgtcaaa

SEQ ID NO: 17267 - DNA, 19 bp, Homo sapiens
aggaagtttttgcgtatgt

SEQ ID NO: 17268 - DNA, 24 bp, Homo sapiens
agtaagttccaattgtgtgtcaaa

SEQ ID NO: 17269 - DNA, 18 bp, Homo sapiens
aggaagttgctgtgtcaa

SEQ ID NO: 17270 - DNA, 21 bp, Homo sapiens
agagagatcacagtgtgtcaa

SEQ ID NO: 17271 - DNA, 18 bp, Homo sapiens
aaaaagttttttacatgt

SEQ ID NO: 17272 - DNA, 18 bp, Homo sapiens
agaagtttctcctgtgtc

SEQ ID NO: 17273 - DNA, 21 bp, Homo sapiens
aaatttttagctaaagtgtca

SEQ ID NO: 17274 - DNA, 22 bp, Homo sapiens
agaaagttttatacaagtcaaa

SEQ ID NO: 17275 - DNA, 18 bp, Homo sapiens
agagagcttttattatgt

SEQ ID NO: 17276 - DNA, 21 bp, Homo sapiens
agggagttttcagtgtcgtca

SEQ ID NO: 17277 - DNA, 22 bp, Homo sapiens
aaaaggtttttaatgagtcaaa

SEQ ID NO: 17278 - DNA, 18 bp, Homo sapiens
gaaaatttttagcacaca

SEQ ID NO: 17279 - DNA, 18 bp, Homo sapiens
aagtttttagtaaatgtg

SEQ ID NO: 17280 - DNA, 20 bp, Homo sapiens
gaaaatttttaacaaattgt

SEQ ID NO: 17281 - DNA, 16 bp, Homo sapiens
agaaagtttttaatgc

SEQ ID NO: 17282 - DNA, 19 bp, Homo sapiens
agaaagtttttaatcagtg

SEQ ID NO: 17283 - DNA, 65 bp, Human herpesvirus 7
ttgataacagttgaaagccaaatatttgccaaaatcggtttcaatttgcgtttcgctgttgccaa

SEQ ID NO: 17284 - DNA, 24 bp, Human herpesvirus 7
ttgaaagccaaatatttgccaaaa

SEQ ID NO: 17285 - DNA, 17 bp, Homo sapiens
ttgaaaccaaatattta

SEQ ID NO: 17286 - DNA, 23 bp, Homo sapiens
ttgaaagcaagatattttctcaa

SEQ ID NO: 17287 - DNA, 23 bp, Homo sapiens
ttgaaagctagaattactcaaaa

SEQ ID NO: 17288 - DNA, 20 bp, Homo sapiens
ctgaaagccagattttcaaa

SEQ ID NO: 17289 - DNA, 18 bp, Homo sapiens
ttaaaggccatctgccaa

SEQ ID NO: 17290 - DNA, 17 bp, Homo sapiens
ttgaaagccaacctcta

SEQ ID NO: 17291 - DNA, 20 bp, Homo sapiens
ttgaaagcaaaagaacctgc

SEQ ID NO: 17292 - DNA, 20 bp, Homo sapiens
ttgaagccaaagtacatctg

SEQ ID NO: 17293 - DNA, 20 bp, Homo sapiens
ttgaaaccacatctgctaaa

SEQ ID NO: 17294 - DNA, 21 bp, Homo sapiens
ttgaaagcctgataatcggca

SEQ ID NO: 17295 - DNA, 17 bp, Homo sapiens
tcggagccaaacaggcc

SEQ ID NO: 17296 - DNA, 23 bp, Homo sapiens
ttaaaagctaaattatatccaaa

SEQ ID NO: 17297 - DNA, 16 bp, Homo sapiens
ttgaaagatttgccaa

SEQ ID NO: 17298 - DNA, 16 bp, Homo sapiens
ttggaacctttgccaa

SEQ ID NO: 17299 - DNA, 18 bp, Homo sapiens
ttaaaagccagagccaaa

SEQ ID NO: 17300 - DNA, 18 bp, Homo sapiens
ttgaaagcaaagcacttg

SEQ ID NO: 17301 - DNA, 22 bp, Homo sapiens
ctggaagccaaactacagccaa

SEQ ID NO: 17302 - DNA, 18 bp, Homo sapiens
tcgggagccaaatgctgc

SEQ ID NO: 17303 - DNA, 22 bp, Homo sapiens
ttgggatccaaatatttcacaa

SEQ ID NO: 17304 - DNA, 17 bp, Homo sapiens
ttgaaagccgaactgcc

SEQ ID NO: 17305 - DNA, 17 bp, Homo sapiens
ttgaagccaaatatctg

SEQ ID NO: 17306 - DNA, 21 bp, Homo sapiens
ttgaaagctgtacaaccaaaa

SEQ ID NO: 17307 - DNA, 23 bp, Homo sapiens
ttgaaagccaggtcattagcaaa

SEQ ID NO: 17308 - DNA, 17 bp, Homo sapiens
ttgaaaaccaagttctg

SEQ ID NO: 17309 - DNA, 25 bp, Homo sapiens
ttgatagctaaatatcctcatcaaa

SEQ ID NO: 17310 - DNA, 19 bp, Homo sapiens
ttggagcccagatctgcca

SEQ ID NO: 17311 - DNA, 23 bp, Homo sapiens
ttgaaatccaaatatttcccaaa

SEQ ID NO: 17312 - DNA, 20 bp, Homo sapiens
ttaaaagccagcatgctaaa

SEQ ID NO: 17313 - DNA, 17 bp, Homo sapiens
ttgaaagccaagcacca

SEQ ID NO: 17314 - DNA, 21 bp, Homo sapiens
ttgaaagccagaagaccaaaa

SEQ ID NO: 17315 - DNA, 20 bp, Homo sapiens
tgaaggccaaataagtcaaa

SEQ ID NO: 17316 - DNA, 19 bp, Homo sapiens
ttgaagaccaaatatatgc

SEQ ID NO: 17317 - DNA, 21 bp, Homo sapiens
ttgaagtaccttttgccaaaa

SEQ ID NO: 17318 - DNA, 16 bp, Homo sapiens
ttgaaaaccaaaagcc

SEQ ID NO: 17319 - DNA, 21 bp, Homo sapiens
ttgagactcatatttgccaaa

SEQ ID NO: 17320 - DNA, 18 bp, Homo sapiens
ttcaaagccaaaccacca

SEQ ID NO: 17321 - DNA, 20 bp, Homo sapiens
ttaaaagccaaaatatttgc

SEQ ID NO: 17322 - DNA, 101 bp, Rat cytomegalovirus
actttcatcctgatcacctgtatcctctctctactctacgtgatcggtgacggtaacgagattgaagagacagacaacgggacaggtgagacaatgaaggt

SEQ ID NO: 17323 - DNA, 24 bp, Rat cytomegalovirus
taacgagattgaagagacagacaa

SEQ ID NO: 17324 - DNA, 20 bp, Homo sapiens
aacagatggagagacagaca

SEQ ID NO: 17325 - DNA, 19 bp, Homo sapiens
gagattgaaaaacaggcaa

SEQ ID NO: 17326 - DNA, 21 bp, Homo sapiens
cgatggagaaggggacagaca

SEQ ID NO: 17327 - DNA, 17 bp, Homo sapiens
gagagaagagagagaca

SEQ ID NO: 17328 - DNA, 22 bp, Homo sapiens
gagaggggagggagacagacaa

SEQ ID NO: 17329 - DNA, 19 bp, Homo sapiens
gagacgatggagacagaca

SEQ ID NO: 17330 - DNA, 19 bp, Homo sapiens
acagatggagagatggaca

SEQ ID NO: 17331 - DNA, 23 bp, Homo sapiens
taataagattgaagaacattcaa

SEQ ID NO: 17332 - DNA, 19 bp, Homo sapiens
caaagaaaagggacagaca

SEQ ID NO: 17333 - DNA, 19 bp, Homo sapiens
gagaagacaagacagacaa

SEQ ID NO: 17334 - DNA, 19 bp, Homo sapiens
gagggtgggagacagacaa

SEQ ID NO: 17335 - DNA, 16 bp, Homo sapiens
gagagagagacagaca

SEQ ID NO: 17336 - DNA, 19 bp, Homo sapiens
gaaattcttgaagagacag

SEQ ID NO: 17337 - DNA, 19 bp, Homo sapiens
aagctgggagagacaggca

SEQ ID NO: 17338 - DNA, 21 bp, Homo sapiens
gaggaagacagagacagacaa

SEQ ID NO: 17339 - DNA, 19 bp, Homo sapiens
acaggtcgagagacagaca

SEQ ID NO: 17340 - DNA, 21 bp, Homo sapiens
gagaaaactaagggacagaca

SEQ ID NO: 17341 - DNA, 19 bp, Homo sapiens
cgaagtgaggggacagaca

SEQ ID NO: 17342 - DNA, 18 bp, Homo sapiens
gagattcagagagacaga

SEQ ID NO: 17343 - DNA, 18 bp, Homo sapiens
agatgaattggagacaga

SEQ ID NO: 17344 - DNA, 21 bp, Homo sapiens
gaatgagaagaagacagacaa

SEQ ID NO: 17345 - DNA, 20 bp, Homo sapiens
taaaggctgagagacagaca

SEQ ID NO: 17346 - DNA, 18 bp, Homo sapiens
acagagtgaagagacgga

SEQ ID NO: 17347 - DNA, 20 bp, Homo sapiens
acgggatgcagagacagaca

SEQ ID NO: 17348 - DNA, 18 bp, Homo sapiens
gagagtggagacagacaa

SEQ ID NO: 17349 - DNA, 17 bp, Homo sapiens
gagagtggagacagaca

SEQ ID NO: 17350 - DNA, 16 bp, Homo sapiens
caagagagacaggcaa

SEQ ID NO: 17351 - DNA, 64 bp, Rat cytomegalovirus
gagaggtgtaaaagatatatggctcgatcagctgatacaccgccaccgtaaaaccacgcctctc

SEQ ID NO: 17352 - DNA, 24 bp, Rat cytomegalovirus
tacaccgccaccgtaaaaccacgc

SEQ ID NO: 17353 - DNA, 16 bp, Homo sapiens
acgccgccacccacac

SEQ ID NO: 17354 - DNA, 20 bp, Homo sapiens
catactgccgcagcaccacg

SEQ ID NO: 17355 - DNA, 22 bp, Homo sapiens
caccgccaacagctgaccgcgc

SEQ ID NO: 17356 - DNA, 18 bp, Homo sapiens
caccataaaaaaccgcgc

SEQ ID NO: 17357 - DNA, 23 bp, Homo sapiens
tacgacgccaccacaaactgcgc

SEQ ID NO: 17358 - DNA, 22 bp, Homo sapiens
tacaccgcgctggcggccgcgc

SEQ ID NO: 17359 - DNA, 24 bp, Homo sapiens
accgccacctgtggagggaccgcg

SEQ ID NO: 17360 - DNA, 21 bp, Homo sapiens
tacaccgccaccttctcacgc

SEQ ID NO: 17361 - DNA, 20 bp, Homo sapiens
caccgccatgtccgccgcgc

SEQ ID NO: 17362 - DNA, 80 bp, TT virus
ccgccattttaagtagctgacgtcaaggattgacgtaaaggttaaaggtcatcctcggcggaagctacacaaaatggtgg

SEQ ID NO: 17363 - DNA, 24 bp, TT virus
aagtagctgacgtcaaggattgac

SEQ ID NO: 17364 - DNA, 23 bp, Homo sapiens
aagtaactgttaggtgaggattg

SEQ ID NO: 17365 - DNA, 19 bp, Homo sapiens
aagtagctggtgtgaggat

SEQ ID NO: 17366 - DNA, 22 bp, Homo sapiens
agtggtgacttttgggattgac

SEQ ID NO: 17367 - DNA, 21 bp, Homo sapiens
aagtagctgactctcaattgg

SEQ ID NO: 17368 - DNA, 18 bp, Homo sapiens
aagtagctgaatgtcagg

SEQ ID NO: 17369 - DNA, 18 bp, Homo sapiens
aagtagccgatgtcctgg

SEQ ID NO: 17370 - DNA, 18 bp, Homo sapiens
agtagctacgttgaaagg

SEQ ID NO: 17371 - DNA, 20 bp, Homo sapiens
aagtagctggtatcacagat

SEQ ID NO: 17372 - DNA, 21 bp, Homo sapiens
atagtggaaagttaaggattg

SEQ ID NO: 17373 - DNA, 20 bp, Homo sapiens
aaatagtttgaaaggattga

SEQ ID NO: 17374 - DNA, 19 bp, Homo sapiens
aagtagctggcattacagg

SEQ ID NO: 17375 - DNA, 18 bp, Homo sapiens
aagagctgacggagattg

SEQ ID NO: 17376 - DNA, 17 bp, Homo sapiens
aagtagctgactcagga

SEQ ID NO: 17377 - DNA, 20 bp, Homo sapiens
agaggctgacgttggaggat

SEQ ID NO: 17378 - DNA, 18 bp, Homo sapiens
aagtagctggtgcggttg

SEQ ID NO: 17379 - DNA, 21 bp, Homo sapiens
aaatagttcgaaaggattgac

SEQ ID NO: 17380 - DNA, 19 bp, Homo sapiens
aagtagctgacattacagg

SEQ ID NO: 17381 - DNA, 81 bp, TT virus
gtgcgtacgtcacaagtcacgtggaggggacccgctgtaacccggaagtaggccccgtcacgtgacttaccacgtgtgtac

SEQ ID NO: 17382 - DNA, 24 bp, TT virus
taggccccgtcacgtgacttacca

SEQ ID NO: 17383 - DNA, 17 bp, Homo sapiens
ggccccgttggctcacc

SEQ ID NO: 17384 - DNA, 18 bp, Homo sapiens
ggctctgtcacatattac

SEQ ID NO: 17385 - DNA, 18 bp, Homo sapiens
gggttacgatgacttacc

SEQ ID NO: 17386 - DNA, 131 bp, Rat cytomegalovirus
ccggcggacgcacctcgagagggccccgggcccgacggccgcggcgacgatgaggtcgcagatctcgaccccggaggcgccgtagggcgactcggaccgggccgcccgatcgaagatgccgttcctcccgg

SEQ ID NO: 17387 - DNA, 24 bp, Rat cytomegalovirus
gaccgggccgcccgatcgaagatg

SEQ ID NO: 17388 - DNA, 20 bp, Homo sapiens
gggcctgcccagcaaagatg

SEQ ID NO: 17389 - DNA, 18 bp, Homo sapiens
gaccgagctgctcgctcg

SEQ ID NO: 17390 - DNA, 17 bp, Homo sapiens
ccgggcctccggcggat

SEQ ID NO: 17391 - DNA, 19 bp, Homo sapiens
gacctggtcgttcaaagat

SEQ ID NO: 17392 - DNA, 18 bp, Homo sapiens
gacggggccgcccaagca

SEQ ID NO: 17393 - DNA, 23 bp, Homo sapiens
gaccgggatcgccccgcgagatg

SEQ ID NO: 17394 - DNA, 16 bp, Homo sapiens
gacgggccgcctaccg

SEQ ID NO: 17395 - DNA, 65 bp, TT virus
gcagcatatggatatgtagaattttgtgcaaaaagtacaggagaccaaaacatacacatgaatgc

SEQ ID NO: 17396 - DNA, 24 bp, TT virus
caggagaccaaaacatacacatga

SEQ ID NO: 17397 - DNA, 27 bp, Homo sapiens
caagagactaaagtgtactaatgcatg

SEQ ID NO: 17398 - DNA, 20 bp, Homo sapiens
cagggaatcaaaacattcac

SEQ ID NO: 17399 - DNA, 21 bp, Homo sapiens
agattaaaaatgtacacatga

SEQ ID NO: 17400 - DNA, 18 bp, Homo sapiens
caggagactggacataca

SEQ ID NO: 17401 - DNA, 22 bp, Homo sapiens
agaggtcagagagcacacatga

SEQ ID NO: 17402 - DNA, 22 bp, Homo sapiens
agataccaaaacatacatgtga

SEQ ID NO: 17403 - DNA, 20 bp, Homo sapiens
gagaccaagaatatccatga

SEQ ID NO: 17404 - DNA, 16 bp, Homo sapiens
caggaaccacacacat

SEQ ID NO: 17405 - DNA, 16 bp, Homo sapiens
ggagaccaagcacatg

SEQ ID NO: 17406 - DNA, 18 bp, Homo sapiens
agagaccaaaatcccatg

SEQ ID NO: 17407 - DNA, 22 bp, Homo sapiens
caggagacagacacagagcatg

SEQ ID NO: 17408 - DNA, 20 bp, Homo sapiens
agaggaccaaaaggacatga

SEQ ID NO: 17409 - DNA, 18 bp, Homo sapiens
caggaagccgcacacatg

SEQ ID NO: 17410 - DNA, 21 bp, Homo sapiens
caggagaccagcagcaccttg

SEQ ID NO: 17411 - DNA, 21 bp, Homo sapiens
caggagctcaacacctacatg

SEQ ID NO: 17412 - DNA, 20 bp, Homo sapiens
cagtagaaacatacatatga

SEQ ID NO: 17413 - DNA, 20 bp, Homo sapiens
ggataacaagcatacacatg

SEQ ID NO: 17414 - DNA, 19 bp, Homo sapiens
caggagaccaagagcactg

SEQ ID NO: 17415 - DNA, 21 bp, Homo sapiens
ggcagaggcatatacacatga

SEQ ID NO: 17416 - DNA, 18 bp, Homo sapiens
aggaggacaaaacacatg

SEQ ID NO: 17417 - DNA, 25 bp, Homo sapiens
aggaaccaaaataaatttcacatga

SEQ ID NO: 17418 - DNA, 24 bp, Homo sapiens
caggagacccagctccagcacgtg

SEQ ID NO: 17419 - DNA, 23 bp, Homo sapiens
caggaaactaaagcacacagtga

SEQ ID NO: 17420 - DNA, 100 bp, TT virus
tgtatgacgagtacaaaaggtttatgaactactggacagcatctaacgaagacctagacctttgtagatatctaggagtaaacctgtactttttcagaca

SEQ ID NO: 17421 - DNA, 24 bp, TT virus
tatctaggagtaaacctgtacttt

SEQ ID NO: 17422 - DNA, 18 bp, Homo sapiens
tatccaggagtgccctgc

SEQ ID NO: 17423 - DNA, 24 bp, Homo sapiens
tctaggagtaaacattgaaacttt

SEQ ID NO: 17424 - DNA, 18 bp, Homo sapiens
tctaagagtaaacggtgt

SEQ ID NO: 17425 - DNA, 19 bp, Homo sapiens
catctagggtttctcactt

SEQ ID NO: 17426 - DNA, 16 bp, Homo sapiens
ctaggagtagcagctt

SEQ ID NO: 17427 - DNA, 18 bp, Homo sapiens
tatctagggtaagcctgc

SEQ ID NO: 17428 - DNA, 23 bp, Homo sapiens
tatccactggaaatctgtacttt

SEQ ID NO: 17429 - DNA, 22 bp, Homo sapiens
tatctaggagcaaatgacatgc

SEQ ID NO: 17430 - DNA, 23 bp, Homo sapiens
tatctgggggcgggcctgggcct

SEQ ID NO: 17431 - DNA, 21 bp, Homo sapiens
tctgggacagtcctgtacttt

SEQ ID NO: 17432 - DNA, 18 bp, Homo sapiens
taggagtaaatttggact

SEQ ID NO: 17433 - DNA, 63 bp, Rat cytomegalovirus
ggcgccgttggcggccacgacccggcggtcccagaccagggtgtggcggtagccgatcgtgcc

SEQ ID NO: 17434 - DNA, 22 bp, Rat cytomegalovirus
tgtggcggtagccgatcgtgcc

SEQ ID NO: 17435 - DNA, 19 bp, Homo sapiens
tggcggtaacctttgtgcc

SEQ ID NO: 17436 - DNA, 21 bp, Homo sapiens
gcggtgagccgagatcgtgcc

SEQ ID NO: 17437 - DNA, 17 bp, Homo sapiens
tgtggcggggctcctgc

SEQ ID NO: 17438 - DNA, 17 bp, Homo sapiens
tgtggcggcagaggtgc

SEQ ID NO: 17439 - DNA, 18 bp, Homo sapiens
gtggcggtggccgcggcc

SEQ ID NO: 17440 - DNA, 19 bp, Homo sapiens
tgtggtggttggaggtgcc

SEQ ID NO: 17441 - DNA, 16 bp, Homo sapiens
tggcggtagctgatgc

SEQ ID NO: 17442 - DNA, 22 bp, Homo sapiens
tgtggtgagctgagatcgtgcc

SEQ ID NO: 17443 - DNA, 19 bp, Homo sapiens
gtggcggtggcctccagcc

SEQ ID NO: 17444 - DNA, 23 bp, Homo sapiens
tgcggcggtggctgcctcgtgcc

SEQ ID NO: 17445 - DNA, 16 bp, Homo sapiens
tgtggcggggcctcgc

SEQ ID NO: 17446 - DNA, 22 bp, Homo sapiens
tgtggcaggtggcagtagtgcc

SEQ ID NO: 17447 - DNA, 24 bp, Homo sapiens
tgtgacggtggtgaagtatgtgcc

SEQ ID NO: 17448 - DNA, 19 bp, Homo sapiens
tgtgacggtggccacagcc

SEQ ID NO: 17449 - DNA, 17 bp, Homo sapiens
tgtggcggaggccgcgc

SEQ ID NO: 17450 - DNA, 17 bp, Homo sapiens
tgcggcggtccttgtgc

SEQ ID NO: 17451 - DNA, 22 bp, Homo sapiens
tgtagtgagctaagatcgtgcc

SEQ ID NO: 17452 - DNA, 18 bp, Homo sapiens
tggggcggtagcattgtg

SEQ ID NO: 17453 - DNA, 22 bp, Homo sapiens
tgtggtgagccaagatcgtgcc

SEQ ID NO: 17454 - DNA, 20 bp, Homo sapiens
gcggtgagccaagatcgtgc

SEQ ID NO: 17455 - DNA, 22 bp, Homo sapiens
tgtggcagtggcaggttgtgcc

SEQ ID NO: 17456 - DNA, 21 bp, Homo sapiens
tgtggcagtcaccatcgtgcc

SEQ ID NO: 17457 - DNA, 19 bp, Homo sapiens
tgtggcggtggccctgtgc

SEQ ID NO: 17458 - DNA, 21 bp, Homo sapiens
tgtggtgtagctcagcatgcc

SEQ ID NO: 17459 - DNA, 18 bp, Homo sapiens
tgtggcagtggcttctgc

SEQ ID NO: 17460 - DNA, 17 bp, Homo sapiens
gtggcggtggcggtgcc

SEQ ID NO: 17461 - DNA, 16 bp, Homo sapiens
tgaggcgagatcgtgc

SEQ ID NO: 17462 - DNA, 18 bp, Homo sapiens
tgtggcgataagcttgtg

SEQ ID NO: 17463 - DNA, 85 bp, Sulfolobus virus SIRV-1
ttggatcttgttctgttagtactggttgtccagatacgtaaacttctttctggaaaaatccagctaatgcagatatattattcgg

SEQ ID NO: 17464 - DNA, 24 bp, Sulfolobus virus SIRV-1
tggaaaaatccagctaatgcagat

SEQ ID NO: 17465 - DNA, 19 bp, Homo sapiens
tggagaaatccggcagcag

SEQ ID NO: 17466 - DNA, 21 bp, Homo sapiens
gaaaaatccatgacagcagat

SEQ ID NO: 17467 - DNA, 22 bp, Homo sapiens
ggaaatccaggccttggcagat

SEQ ID NO: 17468 - DNA, 19 bp, Homo sapiens
tggaaaaatgtatatgcag

SEQ ID NO: 17469 - DNA, 18 bp, Homo sapiens
tggagaaatccagtgaga

SEQ ID NO: 17470 - DNA, 25 bp, Homo sapiens
tggaaaaattcaatattctgcagat

SEQ ID NO: 17471 - DNA, 17 bp, Homo sapiens
tggaaaaatccactggc

SEQ ID NO: 17472 - DNA, 19 bp, Homo sapiens
tggtaaaatccagctgcag

SEQ ID NO: 17473 - DNA, 131 bp, Macaca mulatta rhadinovirus
cccgggctccccgttccccgagggtcccgggctccccgttccccgagggtcccgggctccccgttccccgagggtcccgggctccccgttccccgagggtcccgggctccccgttccccgagggtcccggg

SEQ ID NO: 17474 - DNA, 24 bp, Macaca mulatta rhadinovirus
ctccccgttccccgagggtcccgg

SEQ ID NO: 17475 - DNA, 17 bp, Homo sapiens
ctcctcgttcccctggg

SEQ ID NO: 17476 - DNA, 16 bp, Homo sapiens
cccgtgccccgaggcg

SEQ ID NO: 17477 - DNA, 25 bp, Homo sapiens
ctccccgttccgccggaggacctgg

SEQ ID NO: 17478 - DNA, 22 bp, Homo sapiens
ctccttggtccctgaggcctgg

SEQ ID NO: 17479 - DNA, 22 bp, Homo sapiens
cctggtctcctgggggtcccgg

SEQ ID NO: 17480 - DNA, 22 bp, Homo sapiens
ctctccgctccccgagcctcgg

SEQ ID NO: 17481 - DNA, 17 bp, Homo sapiens
gtcccccacaattccgg

SEQ ID NO: 17482 - DNA, 26 bp, Homo sapiens
ctcatcccgggccccgggggtcctgg

SEQ ID NO: 17483 - DNA, 24 bp, Homo sapiens
ctgcctgtggagaaagggtcctgg

SEQ ID NO: 17484 - DNA, 26 bp, Homo sapiens
ctccccgctccctggcagccacctgg

SEQ ID NO: 17485 - DNA, 21 bp, Homo sapiens
ctccccattctccctgcctgg

SEQ ID NO: 17486 - DNA, 28 bp, Homo sapiens
ctccccgttctccgggcgagcttctcgg

SEQ ID NO: 17487 - DNA, 18 bp, Homo sapiens
tccctgttccaggttctg

SEQ ID NO: 17488 - DNA, 24 bp, Homo sapiens
ctccttttccccgaagggttccgg

SEQ ID NO: 17489 - DNA, 15 bp, Homo sapiens
ctccccttccctccc

SEQ ID NO: 17490 - DNA, 19 bp, Homo sapiens
ctgccctgttccctgatgg

SEQ ID NO: 17491 - DNA, 17 bp, Homo sapiens
tcccccttccccgaccg

SEQ ID NO: 17492 - DNA, 19 bp, Homo sapiens
ccccgttccctggccgcgg

SEQ ID NO: 17493 - DNA, 21 bp, Homo sapiens
ctccctatttctgcatcctgg

SEQ ID NO: 17494 - DNA, 21 bp, Homo sapiens
ctctgctccccgggtcagagg

SEQ ID NO: 17495 - DNA, 20 bp, Homo sapiens
tccccgcaggggggtcccgg

SEQ ID NO: 17496 - DNA, 18 bp, Homo sapiens
ctccccgatctccccccg

SEQ ID NO: 17497 - DNA, 22 bp, Homo sapiens
cctttccccgacgctgccccgg

SEQ ID NO: 17498 - DNA, 20 bp, Homo sapiens
ccggttcctccgggtcccgg

SEQ ID NO: 17499 - DNA, 22 bp, Homo sapiens
tcccttgttccctggcacccgg

SEQ ID NO: 17500 - DNA, 22 bp, Homo sapiens
ctccccagttctccatccctgg

SEQ ID NO: 17501 - DNA, 16 bp, Homo sapiens
cgctcgggggtcccgg

SEQ ID NO: 17502 - DNA, 20 bp, Homo sapiens
ctctgctccccaaaccctgg

SEQ ID NO: 17503 - DNA, 22 bp, Homo sapiens
cctccgtttcctgggggtctgg

SEQ ID NO: 17504 - DNA, 24 bp, Homo sapiens
ctctccgtcctccgaaagtcccgg

SEQ ID NO: 17505 - DNA, 24 bp, Homo sapiens
ctccccatttcaaatatgtcctgg

SEQ ID NO: 17506 - DNA, 19 bp, Homo sapiens
ccattcccgggggtctcgg

SEQ ID NO: 17507 - DNA, 21 bp, Homo sapiens
ctccatgttccccgcgctcgg

SEQ ID NO: 17508 - DNA, 21 bp, Homo sapiens
tcctgtcctagccggtcccgg

SEQ ID NO: 17509 - DNA, 19 bp, Homo sapiens
ctctgttccccaagcctgg

SEQ ID NO: 17510 - DNA, 20 bp, Homo sapiens
tccccgtcccttccctccgg

SEQ ID NO: 17511 - DNA, 21 bp, Homo sapiens
tctccgcagtgagggtcctgg

SEQ ID NO: 17512 - DNA, 18 bp, Homo sapiens
ctctcgttccccacaccg

SEQ ID NO: 17513 - DNA, 21 bp, Homo sapiens
ccgttccctggggcctcctgg

SEQ ID NO: 17514 - DNA, 18 bp, Homo sapiens
cgccccagcgagggtccg

SEQ ID NO: 17515 - DNA, 21 bp, Homo sapiens
ctccctgttccccgctcccgg

SEQ ID NO: 17516 - DNA, 23 bp, Homo sapiens
ctcctgggaaccgagggtcctgg

SEQ ID NO: 17517 - DNA, 22 bp, Homo sapiens
ctcttcctttccctcagcctgg

SEQ ID NO: 17518 - DNA, 21 bp, Homo sapiens
tccccgtctctccggcgtcgg

SEQ ID NO: 17519 - DNA, 22 bp, Homo sapiens
cccgtgggtctgagggtcctgg

SEQ ID NO: 17520 - DNA, 23 bp, Homo sapiens
ctccccattctcctttgttctgg

SEQ ID NO: 17521 - DNA, 18 bp, Homo sapiens
tccccgttccctctcccg

SEQ ID NO: 17522 - DNA, 17 bp, Homo sapiens
tccctgttccccggccg

SEQ ID NO: 17523 - DNA, 25 bp, Homo sapiens
ctccccgtttctctccccatcttgg

SEQ ID NO: 17524 - DNA, 22 bp, Homo sapiens
tccccgctctcctctcctccgg

SEQ ID NO: 17525 - DNA, 20 bp, Homo sapiens
ctccccattctccatcttgg

SEQ ID NO: 17526 - DNA, 16 bp, Homo sapiens
gctccccaggtcctgg

SEQ ID NO: 17527 - DNA, 19 bp, Homo sapiens
ctccccttccccactctgg

SEQ ID NO: 17528 - DNA, 19 bp, Homo sapiens
gctggcctgagggtcctgg

SEQ ID NO: 17529 - DNA, 30 bp, Homo sapiens
ctccccgctccctggggttgtgtttccggc

SEQ ID NO: 17530 - DNA, 22 bp, Homo sapiens
ctccccttctttgtagctccgg

SEQ ID NO: 17531 - DNA, 24 bp, Homo sapiens
tccccgcttcccgccgcagctcgg

SEQ ID NO: 17532 - DNA, 22 bp, Homo sapiens
ctcccactcccgggggtcccgg

SEQ ID NO: 17533 - DNA, 64 bp, Macaca mulatta rhadinovirus
gtttgtgttggtttttatgaccagcttggtacaaaacctgctggtgattttttacccaacaaat

SEQ ID NO: 17534 - DNA, 23 bp, Macaca mulatta rhadinovirus
tggtgattttttacccaacaaat

SEQ ID NO: 17535 - DNA, 16 bp, Homo sapiens
tggtgatttcttccaa

SEQ ID NO: 17536 - DNA, 16 bp, Homo sapiens
gtgatttttcaacaaa

SEQ ID NO: 17537 - DNA, 20 bp, Homo sapiens
tggtaattttttatttgaca

SEQ ID NO: 17538 - DNA, 19 bp, Homo sapiens
tgggatttgagcccagcaa

SEQ ID NO: 17539 - DNA, 17 bp, Homo sapiens
tgctgattttttcccaa

SEQ ID NO: 17540 - DNA, 17 bp, Homo sapiens
tgactttacccaataaa

SEQ ID NO: 17541 - DNA, 25 bp, Homo sapiens
gggaattcttttttgtccaacaaat

SEQ ID NO: 17542 - DNA, 22 bp, Homo sapiens
tggtgatctcctcctccagcaa

SEQ ID NO: 17543 - DNA, 21 bp, Homo sapiens
tggtgatttctttaaaacaaa

SEQ ID NO: 17544 - DNA, 15 bp, Homo sapiens
tggtattaccaacaa

SEQ ID NO: 17545 - DNA, 21 bp, Homo sapiens
tggtaatagcactcaacaaat

SEQ ID NO: 17546 - DNA, 63 bp, Macaca mulatta rhadinovirus
ttgggttccccgagggtcccgggctccccgttccccgagggtcccgggctccccgttccccga

SEQ ID NO: 17547 - DNA, 23 bp, Macaca mulatta rhadinovirus
gtcccgggctccccgttccccga

SEQ ID NO: 17548 - DNA, 22 bp, Homo sapiens
gtcccgggactcccataggctc

SEQ ID NO: 17549 - DNA, 24 bp, Homo sapiens
gtcccgggactcccggcagcccga

SEQ ID NO: 17550 - DNA, 20 bp, Homo sapiens
gtcccggctccccagcccga

SEQ ID NO: 17551 - DNA, 18 bp, Homo sapiens
gccccgggctcttccccg

SEQ ID NO: 17552 - DNA, 19 bp, Homo sapiens
gccctgggctcccagctcc

SEQ ID NO: 17553 - DNA, 19 bp, Homo sapiens
gtgccgggctctcgccccg

SEQ ID NO: 17554 - DNA, 23 bp, Homo sapiens
tctcgggctccttcgcggctcga

SEQ ID NO: 17555 - DNA, 18 bp, Homo sapiens
tcccgggctcctctcgct

SEQ ID NO: 17556 - DNA, 20 bp, Homo sapiens
tcccgggctcctgaccctcg

SEQ ID NO: 17557 - DNA, 21 bp, Homo sapiens
tcccgggcttctcctgccccc

SEQ ID NO: 17558 - DNA, 22 bp, Homo sapiens
cctgggctccccgctctccccg

SEQ ID NO: 17559 - DNA, 16 bp, Homo sapiens
gtcccgggccagctcc

SEQ ID NO: 17560 - DNA, 20 bp, Homo sapiens
gtctcggactcccggcttcc

SEQ ID NO: 17561 - DNA, 20 bp, Homo sapiens
ccccgaactttgtttcccga

SEQ ID NO: 17562 - DNA, 19 bp, Homo sapiens
gccccgggctccgggctcc

SEQ ID NO: 17563 - DNA, 21 bp, Homo sapiens
atccctctccccgtttttcga

SEQ ID NO: 17564 - DNA, 19 bp, Homo sapiens
gtctcgctctgttccccga

SEQ ID NO: 17565 - DNA, 21 bp, Homo sapiens
gtcttgggccccctcgtaccg

SEQ ID NO: 17566 - DNA, 22 bp, Homo sapiens
gtcccggcgagtccgttccccg

SEQ ID NO: 17567 - DNA, 21 bp, Homo sapiens
gccccgggctcccccgccccg

SEQ ID NO: 17568 - DNA, 19 bp, Homo sapiens
ccgggctcctcctgcctcg

SEQ ID NO: 17569 - DNA, 26 bp, Homo sapiens
gtcccgggcacccctcctctccccga

SEQ ID NO: 17570 - DNA, 17 bp, Homo sapiens
cgggtttccccacccga

SEQ ID NO: 17571 - DNA, 21 bp, Homo sapiens
gtccggggctcccccgcccga

SEQ ID NO: 17572 - DNA, 18 bp, Homo sapiens
gccccgggctctgactcc

SEQ ID NO: 17573 - DNA, 16 bp, Homo sapiens
cgggctccccccgccg

SEQ ID NO: 17574 - DNA, 19 bp, Homo sapiens
cctgattcccgttccctga

SEQ ID NO: 17575 - DNA, 19 bp, Homo sapiens
atcctgggcccttccctga

SEQ ID NO: 17576 - DNA, 18 bp, Homo sapiens
gctccgggctctctcccg

SEQ ID NO: 17577 - DNA, 22 bp, Homo sapiens
gtcccgggcgcccgcatgtccc

SEQ ID NO: 17578 - DNA, 19 bp, Homo sapiens
gtcccgggtcaatggctcc

SEQ ID NO: 17579 - DNA, 19 bp, Homo sapiens
gctccgggctccgcgtccc

SEQ ID NO: 17580 - DNA, 23 bp, Homo sapiens
gtcccgggcctctcggcttcccg

SEQ ID NO: 17581 - DNA, 21 bp, Homo sapiens
gtcctggctccccttctcccg

SEQ ID NO: 17582 - DNA, 24 bp, Homo sapiens
gtcctgggtcctccccaagcctcg

SEQ ID NO: 17583 - DNA, 22 bp, Homo sapiens
gtccagggctcccaccaggttc

SEQ ID NO: 17584 - DNA, 21 bp, Homo sapiens
cccgggctcctccaggcctcg

SEQ ID NO: 17585 - DNA, 19 bp, Homo sapiens
gctccgggctccgggctcc

SEQ ID NO: 17586 - DNA, 19 bp, Homo sapiens
tcctgtggcttgttccccg

SEQ ID NO: 17587 - DNA, 20 bp, Homo sapiens
gtcctgagctccccaagacc

SEQ ID NO: 17588 - DNA, 28 bp, Homo sapiens
gtcgcgggctccctgaggtcggggaacg

SEQ ID NO: 17589 - DNA, 17 bp, Homo sapiens
cccgcgcccgttccccg

SEQ ID NO: 17590 - DNA, 16 bp, Homo sapiens
gtcccagggctttccc

SEQ ID NO: 17591 - DNA, 18 bp, Homo sapiens
gccccatcccttgttccc

SEQ ID NO: 17592 - DNA, 22 bp, Homo sapiens
gtctagggctcccacacctccg

SEQ ID NO: 17593 - DNA, 17 bp, Homo sapiens
gtctcgggctccctttc

SEQ ID NO: 17594 - DNA, 20 bp, Homo sapiens
gtctcggtctccccacagcg

SEQ ID NO: 17595 - DNA, 19 bp, Homo sapiens
gtcctgggccccactcgcc

SEQ ID NO: 17596 - DNA, 23 bp, Homo sapiens
gtctcaggctcctatatggttcc

SEQ ID NO: 17597 - DNA, 23 bp, Homo sapiens
gtctcgggctcctgtgcagtcga

SEQ ID NO: 17598 - DNA, 17 bp, Homo sapiens
cccgggcttcgtccccg

SEQ ID NO: 17599 - DNA, 19 bp, Homo sapiens
gtcccgggcgctcaggccg

SEQ ID NO: 17600 - DNA, 19 bp, Homo sapiens
gggttccccgccgcccccg

SEQ ID NO: 17601 - DNA, 21 bp, Homo sapiens
gtcccgggctctgcttcgcga

SEQ ID NO: 17602 - DNA, 20 bp, Homo sapiens
gtcccaggctcaggcccccg

SEQ ID NO: 17603 - DNA, 19 bp, Homo sapiens
gtcccgggccggagccccg

SEQ ID NO: 17604 - DNA, 25 bp, Homo sapiens
gtcctggactccctggatcggggac

SEQ ID NO: 17605 - DNA, 27 bp, Homo sapiens
tcctgggctcccattggtcggggaacg

SEQ ID NO: 17606 - DNA, 23 bp, Homo sapiens
tctcgggctccctgcagctgccg

SEQ ID NO: 17607 - DNA, 23 bp, Homo sapiens
ccgggctccagatgagttcctcg

SEQ ID NO: 17608 - DNA, 16 bp, Homo sapiens
gtctcgggcgttcccc

SEQ ID NO: 17609 - DNA, 20 bp, Homo sapiens
tcctgggcttcctcctgccg

SEQ ID NO: 17610 - DNA, 22 bp, Homo sapiens
gccctggtgtcctgttccccga

SEQ ID NO: 17611 - DNA, 21 bp, Homo sapiens
gtcaccgatccccgttccccg

SEQ ID NO: 17612 - DNA, 23 bp, Homo sapiens
tcctcatgccctccgttccctga

SEQ ID NO: 17613 - DNA, 17 bp, Homo sapiens
caggtccctgttccccg

SEQ ID NO: 17614 - DNA, 19 bp, Homo sapiens
gccccgggcttctgccttc

SEQ ID NO: 17615 - DNA, 28 bp, Homo sapiens
gtcccgggactctctgtccagcacctcg

SEQ ID NO: 17616 - DNA, 19 bp, Homo sapiens
tcctgggcttcctcctgct

SEQ ID NO: 17617 - DNA, 25 bp, Homo sapiens
gtcccaggcttcctgggtcggggac

SEQ ID NO: 17618 - DNA, 22 bp, Homo sapiens
gtctggccgtccccgtttcccg

SEQ ID NO: 17619 - DNA, 27 bp, Homo sapiens
tcctgggctccctgaggtcggggaacg

SEQ ID NO: 17620 - DNA, 27 bp, Homo sapiens
gtccagggctccctgcacttccttcga

SEQ ID NO: 17621 - DNA, 23 bp, Homo sapiens
gccctgggctcccccagctctcg

SEQ ID NO: 17622 - DNA, 18 bp, Homo sapiens
gtcccaggctccgacccg

SEQ ID NO: 17623 - DNA, 23 bp, Homo sapiens
gccccgggctcctgtagcctccg

SEQ ID NO: 17624 - DNA, 20 bp, Homo sapiens
gtcctggagctccccggctc

SEQ ID NO: 17625 - DNA, 16 bp, Homo sapiens
gggcttcctcccccga

SEQ ID NO: 17626 - DNA, 18 bp, Homo sapiens
cccgggctccccagctcc

SEQ ID NO: 17627 - DNA, 23 bp, Homo sapiens
tcccgggctccccactccctccg

SEQ ID NO: 17628 - DNA, 19 bp, Homo sapiens
gccctgggcttcgaacccg

SEQ ID NO: 17629 - DNA, 66 bp, Human herpesvirus 4
ggcctagagaaggagagggagctctatctaaagaagatccgctccatggagtctcagctgcaggcc

SEQ ID NO: 17630 - DNA, 24 bp, Human herpesvirus 4
ccgctccatggagtctcagctgca

SEQ ID NO: 17631 - DNA, 17 bp, Homo sapiens
gctccgggggtctcagc

SEQ ID NO: 17632 - DNA, 21 bp, Homo sapiens
cgctctgtcgcccaggctgca

SEQ ID NO: 17633 - DNA, 19 bp, Homo sapiens
tggatgcctctcagctgca

SEQ ID NO: 17634 - DNA, 19 bp, Homo sapiens
ccgcttcatggagctgctg

SEQ ID NO: 17635 - DNA, 19 bp, Homo sapiens
ctcctctatctctcagctg

SEQ ID NO: 17636 - DNA, 18 bp, Homo sapiens
ccgctgtacctcagctgc

SEQ ID NO: 17637 - DNA, 16 bp, Homo sapiens
gctccacacttagctg

SEQ ID NO: 17638 - DNA, 20 bp, Homo sapiens
ccagcttcataactcagctg

SEQ ID NO: 17639 - DNA, 20 bp, Homo sapiens
ccgctcctggacactgctgc

SEQ ID NO: 17640 - DNA, 17 bp, Homo sapiens
tccaaagatctcagctg

SEQ ID NO: 17641 - DNA, 20 bp, Homo sapiens
gctccatgggcttctggctg

SEQ ID NO: 17642 - DNA, 20 bp, Homo sapiens
ctccaaaatctttggctgca

SEQ ID NO: 17643 - DNA, 22 bp, Homo sapiens
gcgttctggaatctcagctgca

SEQ ID NO: 17644 - DNA, 18 bp, Homo sapiens
ccgctccacggagactgc

SEQ ID NO: 17645 - DNA, 17 bp, Homo sapiens
gccccatggggccttgc

SEQ ID NO: 17646 - DNA, 16 bp, Homo sapiens
gcccatgaacagctgc

SEQ ID NO: 17647 - DNA, 21 bp, Homo sapiens
cgtcccatggagacaattgca

SEQ ID NO: 17648 - DNA, 18 bp, Homo sapiens
cctctccacttcagctgc

SEQ ID NO: 17649 - DNA, 21 bp, Homo sapiens
ccagctctgatttcagttgca

SEQ ID NO: 17650 - DNA, 18 bp, Homo sapiens
ccctccatgggttgctgc

SEQ ID NO: 17651 - DNA, 21 bp, Homo sapiens
gctctgacagtctcagttgca

SEQ ID NO: 17652 - DNA, 19 bp, Homo sapiens
ccgctccaggagccgctgc

SEQ ID NO: 17653 - DNA, 18 bp, Homo sapiens
gctcatggtccaaggctg

SEQ ID NO: 17654 - DNA, 20 bp, Homo sapiens
gctcctggagtcctcttgca

SEQ ID NO: 17655 - DNA, 23 bp, Homo sapiens
ccctccacccagtctcagctgca

SEQ ID NO: 17656 - DNA, 18 bp, Homo sapiens
tccgtgggtcccgttgca

SEQ ID NO: 17657 - DNA, 21 bp, Homo sapiens
ccttccatctgttcagctgca

SEQ ID NO: 17658 - DNA, 19 bp, Homo sapiens
cgcttcacgttcagctgca

SEQ ID NO: 17659 - DNA, 20 bp, Homo sapiens
gctctgtgtctgcagctgca

SEQ ID NO: 17660 - DNA, 15 bp, Homo sapiens
gcccagtctcagctg

SEQ ID NO: 17661 - DNA, 16 bp, Homo sapiens
gctccttctcagctgc

SEQ ID NO: 17662 - DNA, 23 bp, Homo sapiens
ccagctccaccccttctcagctg

SEQ ID NO: 17663 - DNA, 16 bp, Homo sapiens
ctccagactcagctgc

SEQ ID NO: 17664 - DNA, 19 bp, Homo sapiens
gctcctgctctcagctgca

SEQ ID NO: 17665 - DNA, 19 bp, Homo sapiens
ccccttcatgcccagctgc

SEQ ID NO: 17666 - DNA, 17 bp, Homo sapiens
tcctggagtcttagctg

SEQ ID NO: 17667 - DNA, 15 bp, Homo sapiens
ctccatgggccactg

SEQ ID NO: 17668 - DNA, 17 bp, Homo sapiens
ccgctccatggggcagc

SEQ ID NO: 17669 - DNA, 19 bp, Homo sapiens
tccatgagattcagctgca

SEQ ID NO: 17670 - DNA, 21 bp, Homo sapiens
gcttcatggagtctcattgca

SEQ ID NO: 17671 - DNA, 18 bp, Homo sapiens
ccgctccagggagtttca

SEQ ID NO: 17672 - DNA, 18 bp, Homo sapiens
ccgtgtgggtctcagctg

SEQ ID NO: 17673 - DNA, 20 bp, Homo sapiens
tctatggtgccgcagctgca

SEQ ID NO: 17674 - DNA, 21 bp, Homo sapiens
ccctcagcttggtctcagctg

SEQ ID NO: 17675 - DNA, 15 bp, Homo sapiens
cccaggctcagctgc

SEQ ID NO: 17676 - DNA, 23 bp, Homo sapiens
ccgctccacaccgctcggctgca

SEQ ID NO: 17677 - DNA, 24 bp, Homo sapiens
ccgctttgtggattaattcatgca

SEQ ID NO: 17678 - DNA, 18 bp, Homo sapiens
cccatggagttctccctg

SEQ ID NO: 17679 - DNA, 20 bp, Homo sapiens
actctatggagtcttccctg

SEQ ID NO: 17680 - DNA, 22 bp, Homo sapiens
ccgctgtgtggagtctctcctg

SEQ ID NO: 17681 - DNA, 15 bp, Homo sapiens
gctccatgcagctgc

SEQ ID NO: 17682 - DNA, 20 bp, Homo sapiens
ccgcgccgtggagtccgggc

SEQ ID NO: 17683 - DNA, 23 bp, Homo sapiens
ctcttttatggtaggcagctgca

SEQ ID NO: 17684 - DNA, 19 bp, Homo sapiens
ccgccccatggagttgctg

SEQ ID NO: 17685 - DNA, 74 bp, Equine herpesvirus 1
gttggaaacttactcgccaccccccacccgctgggaaagccggcatcatcgagggtgggcacaatagttctagc

SEQ ID NO: 17686 - DNA, 24 bp, Equine herpesvirus 1
tggaaacttactcgccacccccca

SEQ ID NO: 17687 - DNA, 22 bp, Homo sapiens
tggaaactcacttctaccttcc

SEQ ID NO: 17688 - DNA, 21 bp, Homo sapiens
agaaggcactgtcacccccca

SEQ ID NO: 17689 - DNA, 21 bp, Homo sapiens
ggacgctccccccacccccca

SEQ ID NO: 17690 - DNA, 20 bp, Homo sapiens
tggggacctcggcacccccc

SEQ ID NO: 17691 - DNA, 24 bp, Homo sapiens
tggaaacctattaacatgccttcc

SEQ ID NO: 17692 - DNA, 25 bp, Homo sapiens
tgaaaacttgctcagtgtgccttcc

SEQ ID NO: 17693 - DNA, 19 bp, Homo sapiens
gaaatccacgccgcccccc

SEQ ID NO: 17694 - DNA, 21 bp, Homo sapiens
tagaaactttgacacccctca

SEQ ID NO: 17695 - DNA, 18 bp, Homo sapiens
tggaaacttgcccttcca

SEQ ID NO: 17696 - DNA, 21 bp, Homo sapiens
tgggggcctccgccacccccc

SEQ ID NO: 17697 - DNA, 18 bp, Homo sapiens
tgaaaactcagtcactcc

SEQ ID NO: 17698 - DNA, 19 bp, Homo sapiens
tgggaacctactgggcacc

SEQ ID NO: 17699 - DNA, 16 bp, Homo sapiens
tgaaaacttactcccc

SEQ ID NO: 17700 - DNA, 22 bp, Homo sapiens
tggccgcccctcgccaccctcc

SEQ ID NO: 17701 - DNA, 21 bp, Homo sapiens
tggaaacttgccattttccca

SEQ ID NO: 17702 - DNA, 20 bp, Homo sapiens
ggaggtttccccacccccca

SEQ ID NO: 17703 - DNA, 24 bp, Homo sapiens
tggaaactcaaagaatactttcca

SEQ ID NO: 17704 - DNA, 18 bp, Homo sapiens
tggggacattaacccccc

SEQ ID NO: 17705 - DNA, 20 bp, Homo sapiens
tggaaactgctttcctcccc

SEQ ID NO: 17706 - DNA, 24 bp, Homo sapiens
tggagaggcctgcgccaccctcca

SEQ ID NO: 17707 - DNA, 22 bp, Homo sapiens
tgaaaacttattcacaattcca

SEQ ID NO: 17708 - DNA, 19 bp, Homo sapiens
tggaaacctgctcccttcc

SEQ ID NO: 17709 - DNA, 20 bp, Homo sapiens
tggcaaacttcaccacctcc

SEQ ID NO: 17710 - DNA, 20 bp, Homo sapiens
ggaaatcccaggccaccccc

SEQ ID NO: 17711 - DNA, 25 bp, Homo sapiens
tggaaactctgctgccagaatcccc

SEQ ID NO: 17712 - DNA, 24 bp, Homo sapiens
tgaaagcttgacctgcgcccccca

SEQ ID NO: 17713 - DNA, 22 bp, Homo sapiens
tggaaactgccgcagcgctccc

SEQ ID NO: 17714 - DNA, 17 bp, Homo sapiens
ggaaacttgccataccc

SEQ ID NO: 17715 - DNA, 16 bp, Homo sapiens
tgaaagcttaaccccc

SEQ ID NO: 17716 - DNA, 22 bp, Homo sapiens
tggaagctcactggtgtcctcc

SEQ ID NO: 17717 - DNA, 17 bp, Homo sapiens
ggaaactcactctaccc

SEQ ID NO: 17718 - DNA, 69 bp, Human herpesvirus 4
ccggtggaactcgtgacagatgtctacgccaccctaggcatcgtggagatcatcgacgagctctaccgg

SEQ ID NO: 17719 - DNA, 24 bp, Human herpesvirus 4
catcgtggagatcatcgacgagct

SEQ ID NO: 17720 - DNA, 20 bp, Homo sapiens
tcgtgaagattcagtgagct

SEQ ID NO: 17721 - DNA, 16 bp, Homo sapiens
tcgtggagatcggagc

SEQ ID NO: 17722 - DNA, 22 bp, Homo sapiens
cgtggagacactgtggtgagct

SEQ ID NO: 17723 - DNA, 18 bp, Homo sapiens
gtgaagatcaacgtggct

SEQ ID NO: 17724 - DNA, 23 bp, Homo sapiens
ccgtggagattggtgatggagct

SEQ ID NO: 17725 - DNA, 74 bp, Equine herpesvirus 1
agtttgccatgctacagtttgcatacgatcacatccaatcccacgtcaatgaaatgctaagtagaatagcaact

SEQ ID NO: 17726 - DNA, 24 bp, Equine herpesvirus 1
gctacagtttgcatacgatcacat

SEQ ID NO: 17727 - DNA, 21 bp, Homo sapiens
tacagtgagctatgatcacat

SEQ ID NO: 17728 - DNA, 19 bp, Homo sapiens
gctgtatttgcataaacca

SEQ ID NO: 17729 - DNA, 19 bp, Homo sapiens
gctatggtttgcattcaat

SEQ ID NO: 17730 - DNA, 19 bp, Homo sapiens
cagtggtgcacgatcacat

SEQ ID NO: 17731 - DNA, 17 bp, Homo sapiens
gctaagtttgcaaccac

SEQ ID NO: 17732 - DNA, 22 bp, Homo sapiens
tactgttacttcatgatcacat

SEQ ID NO: 17733 - DNA, 23 bp, Homo sapiens
gctacagttttctagggtcacat

SEQ ID NO: 17734 - DNA, 20 bp, Homo sapiens
gctacagtgagctgtgatca

SEQ ID NO: 17735 - DNA, 21 bp, Homo sapiens
gctacagtattaagattacat

SEQ ID NO: 17736 - DNA, 23 bp, Homo sapiens
gcagtacagtggtatgatcacat

SEQ ID NO: 17737 - DNA, 24 bp, Homo sapiens
gctgcagtttgcaatataccacat

SEQ ID NO: 17738 - DNA, 19 bp, Homo sapiens
gcttacagtgatgatcaca

SEQ ID NO: 17739 - DNA, 25 bp, Homo sapiens
actgtagtttgcatcatccccacat

SEQ ID NO: 17740 - DNA, 101 bp, Equine herpesvirus 1
gcgcaagctgatcgagccgtgcgccctcaatcagaagcgctactttaagtttggcaaagagtacgtttactacgagaactacacgttcgtccgcaaagtgc

SEQ ID NO: 17741 - DNA, 24 bp, Equine herpesvirus 1
agagtacgtttactacgagaacta

SEQ ID NO: 17742 - DNA, 21 bp, Homo sapiens
agatacgtttacaataaagaa

SEQ ID NO: 17743 - DNA, 21 bp, Homo sapiens
gagatagtcttatgagaacta

SEQ ID NO: 17744 - DNA, 20 bp, Homo sapiens
aggtaacatctgcgagaact

SEQ ID NO: 17745 - DNA, 21 bp, Homo sapiens
agggtcgtttaccgtcgaact

SEQ ID NO: 17746 - DNA, 18 bp, Homo sapiens
aggatacgtttacaaact

SEQ ID NO: 17747 - DNA, 15 bp, Homo sapiens
gagtgtttgagaact

SEQ ID NO: 17748 - DNA, 79 bp, Gallid herpesvirus 3
tttcgcgtggactaagtactgcgctccgcccgacgtcaaagttgtgatcgtcgggcaagacccgtacgttcatccggga

SEQ ID NO: 17749 - DNA, 24 bp, Gallid herpesvirus 3
gggcaagacccgtacgttcatccg

SEQ ID NO: 17750 - DNA, 22 bp, Homo sapiens
gggtgagacccgcgcccacccg

SEQ ID NO: 17751 - DNA, 20 bp, Homo sapiens
ggacagggcctgcgtccatc

SEQ ID NO: 17752 - DNA, 17 bp, Homo sapiens
gggcaagacccggtgtc

SEQ ID NO: 17753 - DNA, 18 bp, Homo sapiens
gggcaggacccatactcc

SEQ ID NO: 17754 - DNA, 18 bp, Homo sapiens
gggcaagacctggcagcc

SEQ ID NO: 17755 - DNA, 20 bp, Homo sapiens
gggagacccgtggcagtccg

SEQ ID NO: 17756 - DNA, 63 bp, Human papillomavirus type 32
gactacgccagtaatacacttacaaggtgatcctaattgcctaaagtgtttaaggtggaggtt

SEQ ID NO: 17757 - DNA, 22 bp, Human papillomavirus type 32
taaagtgtttaaggtggaggtt

SEQ ID NO: 17758 - DNA, 16 bp, Homo sapiens
aaatgtttataaaggt

SEQ ID NO: 17759 - DNA, 20 bp, Homo sapiens
taaagtctttttgagaggtt

SEQ ID NO: 17760 - DNA, 21 bp, Homo sapiens
cgaggcagaagggtgggggtt

SEQ ID NO: 17761 - DNA, 17 bp, Homo sapiens
tgaggtttgatggaggt

SEQ ID NO: 17762 - DNA, 18 bp, Homo sapiens
gcctgggaggtggaggtt

SEQ ID NO: 17763 - DNA, 18 bp, Homo sapiens
aaagtgttgttggaggtt

SEQ ID NO: 17764 - DNA, 20 bp, Homo sapiens
taaagagtttaagaacagtt

SEQ ID NO: 17765 - DNA, 21 bp, Homo sapiens
aaagaggttaaggtgggggtt

SEQ ID NO: 17766 - DNA, 20 bp, Homo sapiens
aagtgtttaagttaggggtt

SEQ ID NO: 17767 - DNA, 17 bp, Homo sapiens
taaaatgtttaaaaggt

SEQ ID NO: 17768 - DNA, 18 bp, Homo sapiens
aagtgtcttaggctggtt

SEQ ID NO: 17769 - DNA, 19 bp, Homo sapiens
taaaatgtttgaggaggtt

SEQ ID NO: 17770 - DNA, 21 bp, Homo sapiens
taaagtgttttaggaaaagtt

SEQ ID NO: 17771 - DNA, 20 bp, Homo sapiens
aaatgtttaagaaaatagtt

SEQ ID NO: 17772 - DNA, 21 bp, Homo sapiens
tactttgttagggtggaggtt

SEQ ID NO: 17773 - DNA, 17 bp, Homo sapiens
taaaggatagtggaggt

SEQ ID NO: 17774 - DNA, 19 bp, Homo sapiens
taaagtgtttagaaaatag

SEQ ID NO: 17775 - DNA, 17 bp, Homo sapiens
agtaggaggtggaggtt

SEQ ID NO: 17776 - DNA, 19 bp, Homo sapiens
taaactgtttcctgaggtt

SEQ ID NO: 17777 - DNA, 19 bp, Homo sapiens
aatcccagaggtggaggtt

SEQ ID NO: 17778 - DNA, 21 bp, Homo sapiens
taaagtatttataattaggtt

SEQ ID NO: 17779 - DNA, 18 bp, Homo sapiens
aggtttaataaagaggtt

SEQ ID NO: 17780 - DNA, 18 bp, Homo sapiens
aaatgtttggttcaggtt

SEQ ID NO: 17781 - DNA, 18 bp, Homo sapiens
atccaggaggtggaggtt

SEQ ID NO: 17782 - DNA, 18 bp, Homo sapiens
aaggtcaaggtgggggtt

SEQ ID NO: 17783 - DNA, 23 bp, Homo sapiens
taaagtagtttgaagataaggtt

SEQ ID NO: 17784 - DNA, 16 bp, Homo sapiens
aggtctggtgggggtt

SEQ ID NO: 17785 - DNA, 18 bp, Homo sapiens
gtctgggaggtggaggtt

SEQ ID NO: 17786 - DNA, 18 bp, Homo sapiens
acacgcaaggtggaggtt

SEQ ID NO: 17787 - DNA, 17 bp, Homo sapiens
gtgtctgcgtggaggtt

SEQ ID NO: 17788 - DNA, 21 bp, Homo sapiens
ggaggctggtgggtgggggtt

SEQ ID NO: 17789 - DNA, 18 bp, Homo sapiens
aagtgtttgtaaaaggtt

SEQ ID NO: 17790 - DNA, 21 bp, Homo sapiens
agaatctggaaggtggaggtt

SEQ ID NO: 17791 - DNA, 19 bp, Homo sapiens
taaagtgtttgagatcaaa

SEQ ID NO: 17792 - DNA, 20 bp, Homo sapiens
gcacctgggaggtggaggtt

SEQ ID NO: 17793 - DNA, 21 bp, Homo sapiens
aagtgtttgaggaagtgggtt

SEQ ID NO: 17794 - DNA, 20 bp, Homo sapiens
gcacccgggaggtggaggtt

SEQ ID NO: 17795 - DNA, 18 bp, Homo sapiens
gcccaggaggtggaggtt

SEQ ID NO: 17796 - DNA, 15 bp, Homo sapiens
gtgtcaatggaggtt

SEQ ID NO: 17797 - DNA, 128 bp, Rat cytomegalovirus
tccgccccctgccggacgagcagccagaggcggccgagcacgatcccgacctcgccgaggccggcccggcagtgcagcgggtacaggaagcggtagccgacggcggcgaagtcctcggcggaggtgga

SEQ ID NO: 17798 - DNA, 24 bp, Rat cytomegalovirus
cagcgggtacaggaagcggtagcc

SEQ ID NO: 17799 - DNA, 18 bp, Homo sapiens
cagcgggtcaggcctggc

SEQ ID NO: 17800 - DNA, 21 bp, Homo sapiens
cagtgggcacaggggcatcag

SEQ ID NO: 17801 - DNA, 20 bp, Homo sapiens
aggtccaggaggcggtagcc

SEQ ID NO: 17802 - DNA, 16 bp, Homo sapiens
gcggggtaacggtagc

SEQ ID NO: 17803 - DNA, 20 bp, Homo sapiens
gcggtaacagcggcggtggc

SEQ ID NO: 17804 - DNA, 18 bp, Homo sapiens
cagtgagtacaggaaagt

SEQ ID NO: 17805 - DNA, 20 bp, Homo sapiens
cagtgggacaggaagtaggc

SEQ ID NO: 17806 - DNA, 19 bp, Homo sapiens
agcgggcacggggaggagc

SEQ ID NO: 17807 - DNA, 22 bp, Homo sapiens
gggtacaaagtcggcggtggcc

SEQ ID NO: 17808 - DNA, 16 bp, Homo sapiens
gcgggtaccaggaggt

SEQ ID NO: 17809 - DNA, 20 bp, Homo sapiens
cagcaggtgcagggtgcggc

SEQ ID NO: 17810 - DNA, 21 bp, Homo sapiens
cagcgggtgaaggaagactgc

SEQ ID NO: 17811 - DNA, 19 bp, Homo sapiens
cagcaggtgcaggagggac

SEQ ID NO: 17812 - DNA, 22 bp, Homo sapiens
cagcgggctgtgctgggtggcc

SEQ ID NO: 17813 - DNA, 20 bp, Homo sapiens
cagcgggcatggggaggagc

SEQ ID NO: 17814 - DNA, 26 bp, Homo sapiens
caggcacagagtggggggtggtggcc

SEQ ID NO: 17815 - DNA, 18 bp, Homo sapiens
cagtgggacaggaaaggc

SEQ ID NO: 17816 - DNA, 20 bp, Homo sapiens
gcgggcacaggaggcggagc

SEQ ID NO: 17817 - DNA, 23 bp, Homo sapiens
cagtggtggtcagggtggtggcc

SEQ ID NO: 17818 - DNA, 17 bp, Homo sapiens
gggcacagggccttagc

SEQ ID NO: 17819 - DNA, 19 bp, Homo sapiens
gcgggcacaggcgcctggc

SEQ ID NO: 17820 - DNA, 17 bp, Homo sapiens
cagcgggtgcagcagcc

SEQ ID NO: 17821 - DNA, 16 bp, Homo sapiens
agtgggacaggagggc

SEQ ID NO: 17822 - DNA, 16 bp, Homo sapiens
gggtacagacagtagc

SEQ ID NO: 17823 - DNA, 22 bp, Homo sapiens
cagatggcttccaggaagtggt

SEQ ID NO: 17824 - DNA, 17 bp, Homo sapiens
agcgggtgcaggagggc

SEQ ID NO: 17825 - DNA, 18 bp, Homo sapiens
gggcacaggagaccgtgc

SEQ ID NO: 17826 - DNA, 21 bp, Homo sapiens
cagcgggtgcacgggtgcagc

SEQ ID NO: 17827 - DNA, 27 bp, Homo sapiens
agcgggtatggcaggcatggctaccgc

SEQ ID NO: 17828 - DNA, 21 bp, Homo sapiens
gcgggtacgggggcgcgcggc

SEQ ID NO: 17829 - DNA, 19 bp, Homo sapiens
cagggggcaaagcggtggc

SEQ ID NO: 17830 - DNA, 22 bp, Homo sapiens
gccgggtacaggagacggggcc

SEQ ID NO: 17831 - DNA, 18 bp, Homo sapiens
cagctggtgcaggaaagt

SEQ ID NO: 17832 - DNA, 20 bp, Homo sapiens
gcaggtatagggcaatagcc

SEQ ID NO: 17833 - DNA, 17 bp, Homo sapiens
cagcgggtgcaggcgcg

SEQ ID NO: 17834 - DNA, 21 bp, Homo sapiens
cagcgagtgcaggcacctggc

SEQ ID NO: 17835 - DNA, 17 bp, Homo sapiens
gcgggtacaggggtaac

SEQ ID NO: 17836 - DNA, 23 bp, Homo sapiens
cagtggggcaggggaccacagcc

SEQ ID NO: 17837 - DNA, 17 bp, Homo sapiens
cagcgggcacggggggt

SEQ ID NO: 17838 - DNA, 18 bp, Homo sapiens
agcggggacaggatgggc

SEQ ID NO: 17839 - DNA, 23 bp, Homo sapiens
cagcgggtgtaagggctgtgggc

SEQ ID NO: 17840 - DNA, 21 bp, Homo sapiens
cagtggtggagaagcggtggc

SEQ ID NO: 17841 - DNA, 25 bp, Homo sapiens
cagcgggtgcagggatgtggctacg

SEQ ID NO: 17842 - DNA, 18 bp, Homo sapiens
gggtacagggagaagggc

SEQ ID NO: 17843 - DNA, 20 bp, Homo sapiens
gggtacagagtgggactagc

SEQ ID NO: 17844 - DNA, 92 bp, Human papillomavirus type 32
acagaaaaagactatacacgtgactcaaaggatggtataataacaattcattattataatgaggaacaacgagataagtttttaagtactgt

SEQ ID NO: 17845 - DNA, 24 bp, Human papillomavirus type 32
taatgaggaacaacgagataagtt

SEQ ID NO: 17846 - DNA, 22 bp, Homo sapiens
taatgaggtggcaaccacagtt

SEQ ID NO: 17847 - DNA, 18 bp, Homo sapiens
taatgagaaacatctgag

SEQ ID NO: 17848 - DNA, 16 bp, Homo sapiens
taatgaggaaaaatag

SEQ ID NO: 17849 - DNA, 61 bp, Rat cytomegalovirus
gggcagcggcacgagccgccccgcgtggcgcgcgatgagggcgcgcacggcgtcggtgccc

SEQ ID NO: 17850 - DNA, 24 bp, Rat cytomegalovirus
tgagggcgcgcacggcgtcggtgc

SEQ ID NO: 17851 - DNA, 22 bp, Homo sapiens
tgagggcgggcatggctggggt

SEQ ID NO: 17852 - DNA, 18 bp, Homo sapiens
tgggggcgcgcgggtggc

SEQ ID NO: 17853 - DNA, 18 bp, Homo sapiens
tgcgggcgcgcgtgggtg

SEQ ID NO: 17854 - DNA, 21 bp, Homo sapiens
tgagggcgcgggcggcggtgc

SEQ ID NO: 17855 - DNA, 17 bp, Homo sapiens
gggggcaggcgtcggtg

SEQ ID NO: 17856 - DNA, 23 bp, Homo sapiens
gagggcgcgcgcggcgagagggc

SEQ ID NO: 17857 - DNA, 20 bp, Homo sapiens
cgggggcgcgcgcggctccg

SEQ ID NO: 17858 - DNA, 22 bp, Homo sapiens
tgagggcggtgtgggtcatgtg

SEQ ID NO: 17859 - DNA, 21 bp, Homo sapiens
agggtgcggcgcagtcggtgc

SEQ ID NO: 17860 - DNA, 22 bp, Homo sapiens
tgggggcgggcgcgatcggtgc

SEQ ID NO: 17861 - DNA, 22 bp, Homo sapiens
tgagggcgcacgtggggtctgt

SEQ ID NO: 17862 - DNA, 23 bp, Homo sapiens
tgggggcgcgcttggcgatccgc

SEQ ID NO: 17863 - DNA, 24 bp, Homo sapiens
tgggggcgcacgcaggagcggtgc

SEQ ID NO: 17864 - DNA, 16 bp, Homo sapiens
tgagggcgccgcaggt

SEQ ID NO: 17865 - DNA, 21 bp, Homo sapiens
gagtgcccagggtgtcggtgc

SEQ ID NO: 17866 - DNA, 18 bp, Homo sapiens
tgagggcgtgcacagcgc

SEQ ID NO: 17867 - DNA, 30 bp, Homo sapiens
tgggggcgcgcgctggctgaagatggtgcg

SEQ ID NO: 17868 - DNA, 64 bp, Equine herpesvirus 4
cgattctacgatatagacagcgttgtcaacgtggacaacactgctgtcattatgcagggaattg

SEQ ID NO: 17869 - DNA, 24 bp, Equine herpesvirus 4
tctacgatatagacagcgttgtca

SEQ ID NO: 17870 - DNA, 16 bp, Homo sapiens
gatatagtgcttgtca

SEQ ID NO: 17871 - DNA, 17 bp, Homo sapiens
tacaatatggaattgtc

SEQ ID NO: 17872 - DNA, 68 bp, Rat cytomegalovirus
gtcggcccggcgccgggacgcgagtcgccgctcgaggggagcgcggcggccgcggacgccgggccgat

SEQ ID NO: 17873 - DNA, 20 bp, Rat cytomegalovirus
gccgcggacgccgggccgat

SEQ ID NO: 17874 - DNA, 15 bp, Homo sapiens
gcccacgccgggccg

SEQ ID NO: 17875 - DNA, 19 bp, Homo sapiens
gccggcggctcgggccgat

SEQ ID NO: 17876 - DNA, 18 bp, Homo sapiens
gccagcccgcgggccgat

SEQ ID NO: 17877 - DNA, 18 bp, Homo sapiens
cgtggacgccaggacgat

SEQ ID NO: 17878 - DNA, 18 bp, Homo sapiens
gcggcggacgcggagccg

SEQ ID NO: 17879 - DNA, 19 bp, Homo sapiens
gccacggaatgaggctgat

SEQ ID NO: 17880 - DNA, 20 bp, Homo sapiens
cgcggacgggggccgggccg

SEQ ID NO: 17881 - DNA, 19 bp, Homo sapiens
gccgcagaacggggtcgat

SEQ ID NO: 17882 - DNA, 16 bp, Homo sapiens
gccgcggccgccgccg

SEQ ID NO: 17883 - DNA, 19 bp, Homo sapiens
gccgcggaggtcgcccagg

SEQ ID NO: 17884 - DNA, 18 bp, Homo sapiens
gccgccgacgccgacacc

SEQ ID NO: 17885 - DNA, 17 bp, Homo sapiens
gcccggagtcgcggccg

SEQ ID NO: 17886 - DNA, 20 bp, Homo sapiens
cgcggctgcgccgggccgat

SEQ ID NO: 17887 - DNA, 20 bp, Homo sapiens
gccacgaaccgcgggccgat

SEQ ID NO: 17888 - DNA, 16 bp, Homo sapiens
ccgggcgccgggcgat

SEQ ID NO: 17889 - DNA, 18 bp, Homo sapiens
gccgcggacctggacacg

SEQ ID NO: 17890 - DNA, 19 bp, Homo sapiens
gccgcggaggcccggagat

SEQ ID NO: 17891 - DNA, 16 bp, Homo sapiens
gccgcgggcgccgccg

SEQ ID NO: 17892 - DNA, 19 bp, Homo sapiens
gccacggaccagtactgat

SEQ ID NO: 17893 - DNA, 16 bp, Homo sapiens
cgcggacgctcacgat

SEQ ID NO: 17894 - DNA, 20 bp, Homo sapiens
gccgatggagcggggccgat

SEQ ID NO: 17895 - DNA, 17 bp, Homo sapiens
gccgcggacgccagccg

SEQ ID NO: 17896 - DNA, 17 bp, Homo sapiens
gctgccacgccgggccg

SEQ ID NO: 17897 - DNA, 20 bp, Homo sapiens
gctgcacagcctgggccgat

SEQ ID NO: 17898 - DNA, 18 bp, Homo sapiens
gccgcgggttccgggccg

SEQ ID NO: 17899 - DNA, 17 bp, Homo sapiens
ccgcggacgctgcgcga

SEQ ID NO: 17900 - DNA, 20 bp, Homo sapiens
gccgcggacgcccgcgcgca

SEQ ID NO: 17901 - DNA, 16 bp, Homo sapiens
gccgcggaggccacca

SEQ ID NO: 17902 - DNA, 20 bp, Homo sapiens
gcggcggacgggaagccgat

SEQ ID NO: 17903 - DNA, 78 bp, Rat cytomegalovirus
ccgagactccggcggacgagagcctccgtctccctcgcgaggtggtggcccgggcgctccgtcggcgggaaccctcgg

SEQ ID NO: 17904 - DNA, 24 bp, Rat cytomegalovirus
tggcccgggcgctccgtcggcggg

SEQ ID NO: 17905 - DNA, 15 bp, Homo sapiens
ggcccgggcgctgcg

SEQ ID NO: 17906 - DNA, 24 bp, Homo sapiens
ggcccgggcgcgcggactggcggg

SEQ ID NO: 17907 - DNA, 24 bp, Homo sapiens
tggtttgaggcgcttgcacgtggg

SEQ ID NO: 17908 - DNA, 28 bp, Homo sapiens
tggcctgggtgcttagggcccgccgacg

SEQ ID NO: 17909 - DNA, 27 bp, Homo sapiens
ggctcgggcgctgtgggcccgccgacg

SEQ ID NO: 17910 - DNA, 18 bp, Homo sapiens
ggctcgggcgctcagcgg

SEQ ID NO: 17911 - DNA, 24 bp, Homo sapiens
tggcccgggccgtcccccggcggg

SEQ ID NO: 17912 - DNA, 22 bp, Homo sapiens
tggcccggggctgactggtggg

SEQ ID NO: 17913 - DNA, 16 bp, Homo sapiens
gggcgctcccgccggg

SEQ ID NO: 17914 - DNA, 21 bp, Homo sapiens
tggcccgtgcgctccgcccgg

SEQ ID NO: 17915 - DNA, 23 bp, Homo sapiens
tggcccgggcggcgggcggcggg

SEQ ID NO: 17916 - DNA, 28 bp, Homo sapiens
tggcccaggtgctgtgggcccgccgacg

SEQ ID NO: 17917 - DNA, 22 bp, Homo sapiens
ggtcccaaggtctgtcggcggg

SEQ ID NO: 17918 - DNA, 16 bp, Homo sapiens
tggccgggcgtcggcg

SEQ ID NO: 17919 - DNA, 28 bp, Homo sapiens
tggcccgggtgtcctgggcccgccgacg

SEQ ID NO: 17920 - DNA, 27 bp, Homo sapiens
ggcttgggcgctctgggcccgccgacg

SEQ ID NO: 17921 - DNA, 18 bp, Homo sapiens
tggtccgggcgcctgcgg

SEQ ID NO: 17922 - DNA, 123 bp, Ictalurid herpesvirus 1
tctcctctggtgtttttccatggttgtctcctcatgaacccgaaaatctagatgaggctcgcgattcgcgacctcacggggccatacagagggagagagtgagcgggaaataacggggggaga

SEQ ID NO: 17923 - DNA, 24 bp, Ictalurid herpesvirus 1
tcacggggccatacagagggagag

SEQ ID NO: 17924 - DNA, 15 bp, Homo sapiens
cggggacagagggag

SEQ ID NO: 17925 - DNA, 17 bp, Homo sapiens
tcacaatacagggggag

SEQ ID NO: 17926 - DNA, 21 bp, Homo sapiens
tcaaggggccacgtgggggag

SEQ ID NO: 17927 - DNA, 22 bp, Homo sapiens
tcgcggggccatccacatcgag

SEQ ID NO: 17928 - DNA, 20 bp, Homo sapiens
cgaagtgtacggagggagag

SEQ ID NO: 17929 - DNA, 16 bp, Homo sapiens
gggaccagagggagag

SEQ ID NO: 17930 - DNA, 18 bp, Homo sapiens
tcgcggggtcagagggag

SEQ ID NO: 17931 - DNA, 20 bp, Homo sapiens
agacacatgcagagggagag

SEQ ID NO: 17932 - DNA, 21 bp, Homo sapiens
tcatggaggaggcagagggag

SEQ ID NO: 17933 - DNA, 16 bp, Homo sapiens
cggggaacagagggag

SEQ ID NO: 17934 - DNA, 20 bp, Homo sapiens
tcactggaccacagagggag

SEQ ID NO: 17935 - DNA, 21 bp, Homo sapiens
gagaaaggtacagagggagag

SEQ ID NO: 17936 - DNA, 20 bp, Homo sapiens
tcctgggcttgcagagggag

SEQ ID NO: 17937 - DNA, 21 bp, Homo sapiens
acggggccacaccagggagag

SEQ ID NO: 17938 - DNA, 20 bp, Homo sapiens
tcacggggctgtgtacagag

SEQ ID NO: 17939 - DNA, 16 bp, Homo sapiens
cacgggccggagggag

SEQ ID NO: 17940 - DNA, 15 bp, Homo sapiens
caaggacagagggag

SEQ ID NO: 17941 - DNA, 21 bp, Homo sapiens
tcacggggctaatccacaggg

SEQ ID NO: 17942 - DNA, 21 bp, Homo sapiens
acagggctgctgatgggagag

SEQ ID NO: 17943 - DNA, 21 bp, Homo sapiens
cgcggaaaggcagagggagag

SEQ ID NO: 17944 - DNA, 21 bp, Homo sapiens
ggggccatacgttagccagag

SEQ ID NO: 17945 - DNA, 18 bp, Homo sapiens
gggggtaaggagggagag

SEQ ID NO: 17946 - DNA, 22 bp, Homo sapiens
tcacgaggccatgcagcatgag

SEQ ID NO: 17947 - DNA, 18 bp, Homo sapiens
tcaggggctgggagggag

SEQ ID NO: 17948 - DNA, 20 bp, Homo sapiens
cgtccagtacggagggagag

SEQ ID NO: 17949 - DNA, 17 bp, Homo sapiens
cagggtcctagagggag

SEQ ID NO: 17950 - DNA, 16 bp, Homo sapiens
tcaggggcagagggag

SEQ ID NO: 17951 - DNA, 23 bp, Homo sapiens
cacggggctgtgcagctccaggg

SEQ ID NO: 17952 - DNA, 21 bp, Homo sapiens
tcaggggtgacagagagggag

SEQ ID NO: 17953 - DNA, 74 bp, Ictalurid herpesvirus 1
cgagacccggagattttcgggatctgaccatgtgggcacagccccggtccgagacttggagattttcgggatcg

SEQ ID NO: 17954 - DNA, 24 bp, Ictalurid herpesvirus 1
acccggagattttcgggatctgac

SEQ ID NO: 17955 - DNA, 15 bp, Homo sapiens
ggaattttcaggctg

SEQ ID NO: 17956 - DNA, 23 bp, Homo sapiens
acctggggggagggggatctgac

SEQ ID NO: 17957 - DNA, 19 bp, Homo sapiens
cgggattttcaaaattctg

SEQ ID NO: 17958 - DNA, 19 bp, Homo sapiens
cagagatccattgatctga

SEQ ID NO: 17959 - DNA, 18 bp, Homo sapiens
ccagctttcggggtctga

SEQ ID NO: 17960 - DNA, 18 bp, Homo sapiens
acccgggaggggggtctg

SEQ ID NO: 17961 - DNA, 17 bp, Homo sapiens
cccggagatctgctctg

SEQ ID NO: 17962 - DNA, 22 bp, Homo sapiens
acctgaaggtgcgcgatctgac

SEQ ID NO: 17963 - DNA, 17 bp, Homo sapiens
ccagagaaggggtctga

SEQ ID NO: 17964 - DNA, 22 bp, Homo sapiens
acctggagatatgcaaaatctg

SEQ ID NO: 17965 - DNA, 17 bp, Homo sapiens
ggtgataaggatctgac

SEQ ID NO: 17966 - DNA, 21 bp, Homo sapiens
cctgagattttactgagtctg

SEQ ID NO: 17967 - DNA, 19 bp, Homo sapiens
cctagactcctgggatctg

SEQ ID NO: 17968 - DNA, 18 bp, Homo sapiens
cgggatcccgggtctgac

SEQ ID NO: 17969 - DNA, 21 bp, Homo sapiens
gaagattctccatggatttga

SEQ ID NO: 17970 - DNA, 18 bp, Homo sapiens
ccggagattattctgcct

SEQ ID NO: 17971 - DNA, 90 bp, Human herpesvirus 2
gcccgcccgcgacgagggtctcattagcatcgcgggcggaagcggaagccgcccgcgccgggcgctaatgagatgccgcgcgggcggagc

SEQ ID NO: 17972 - DNA, 22 bp, Human herpesvirus 2
tgagatgccgcgcgggcggagc

SEQ ID NO: 17973 - DNA, 17 bp, Homo sapiens
gaggtgccaaagcggag

SEQ ID NO: 17974 - DNA, 16 bp, Homo sapiens
tgagatgctgcggcag

SEQ ID NO: 17975 - DNA, 23 bp, Homo sapiens
tgagatgcccgcctgggcggggc

SEQ ID NO: 17976 - DNA, 18 bp, Homo sapiens
tggcactgcgggcggagc

SEQ ID NO: 17977 - DNA, 20 bp, Homo sapiens
cgcggtcgcgcgggcggagc

SEQ ID NO: 17978 - DNA, 17 bp, Homo sapiens
tgagaggccgcggacga

SEQ ID NO: 17979 - DNA, 20 bp, Homo sapiens
gagggagctgcgggcggggc

SEQ ID NO: 17980 - DNA, 20 bp, Homo sapiens
gagggcagggcgggcggggc

SEQ ID NO: 17981 - DNA, 21 bp, Homo sapiens
tgagatgccagtgactagagc

SEQ ID NO: 17982 - DNA, 22 bp, Homo sapiens
tgggacgccgccagttctggag

SEQ ID NO: 17983 - DNA, 21 bp, Homo sapiens
gagatgcatcatgggtggagc

SEQ ID NO: 17984 - DNA, 20 bp, Homo sapiens
tgaggtgccacgcctctggc

SEQ ID NO: 17985 - DNA, 20 bp, Homo sapiens
cgaggaacggcgggcggggc

SEQ ID NO: 17986 - DNA, 20 bp, Homo sapiens
tgaaatgctgtgtgcgcagg

SEQ ID NO: 17987 - DNA, 19 bp, Homo sapiens
tgagatgctccgtgggagc

SEQ ID NO: 17988 - DNA, 16 bp, Homo sapiens
gagatgccgagtggag

SEQ ID NO: 17989 - DNA, 19 bp, Homo sapiens
gcaggcacgcgggcggggc

SEQ ID NO: 17990 - DNA, 20 bp, Homo sapiens
gagccgcgggcgggcggggc

SEQ ID NO: 17991 - DNA, 17 bp, Homo sapiens
tgggagccgcgcgggag

SEQ ID NO: 17992 - DNA, 20 bp, Homo sapiens
tgaggggcctgcagcggagc

SEQ ID NO: 17993 - DNA, 19 bp, Homo sapiens
tgagatgcagcgggagggc

SEQ ID NO: 17994 - DNA, 19 bp, Homo sapiens
agaaaggcgcgggcggagc

SEQ ID NO: 17995 - DNA, 21 bp, Homo sapiens
gagatgctgcggccgcggggg

SEQ ID NO: 17996 - DNA, 17 bp, Homo sapiens
tgaggggccgcaggcgg

SEQ ID NO: 17997 - DNA, 16 bp, Homo sapiens
tgaaatgccagtggag

SEQ ID NO: 17998 - DNA, 21 bp, Homo sapiens
tgaggttctgcagggtggagc

SEQ ID NO: 17999 - DNA, 22 bp, Homo sapiens
tggatctcggtgcgggcggagc

SEQ ID NO: 18000 - DNA, 19 bp, Homo sapiens
gccgagctgcgggcggagc

SEQ ID NO: 18001 - DNA, 22 bp, Homo sapiens
tgggagccgcgcagacacgggc

SEQ ID NO: 18002 - DNA, 21 bp, Homo sapiens
tgaggtgtgcacaggcggggc

SEQ ID NO: 18003 - DNA, 20 bp, Homo sapiens
tgagatgctgctgaagacag

SEQ ID NO: 18004 - DNA, 19 bp, Homo sapiens
tgggactcacgggcggggc

SEQ ID NO: 18005 - DNA, 17 bp, Homo sapiens
tgagatactgctggggg

SEQ ID NO: 18006 - DNA, 19 bp, Homo sapiens
tgaaatgctgcagcagggg

SEQ ID NO: 18007 - DNA, 23 bp, Homo sapiens
tgagcatgcagacggggtggggc

SEQ ID NO: 18008 - DNA, 23 bp, Homo sapiens
tgagagcacagactgggtggggc

SEQ ID NO: 18009 - DNA, 20 bp, Homo sapiens
tgagatgctctgggaggggc

SEQ ID NO: 18010 - DNA, 18 bp, Homo sapiens
tgagtgccgcgccgaggc

SEQ ID NO: 18011 - DNA, 20 bp, Homo sapiens
gagagaggcgcgggcggagc

SEQ ID NO: 18012 - DNA, 18 bp, Homo sapiens
gaggtgccgcggccgggc

SEQ ID NO: 18013 - DNA, 19 bp, Homo sapiens
tgagatgcccggcctgagc

SEQ ID NO: 18014 - DNA, 18 bp, Homo sapiens
tgagatgctgctgccagc

SEQ ID NO: 18015 - DNA, 18 bp, Homo sapiens
tgagatgctcacgggagc

SEQ ID NO: 18016 - DNA, 20 bp, Homo sapiens
gaggggagcgcgggcggagc

SEQ ID NO: 18017 - DNA, 20 bp, Homo sapiens
tgagatgcgtgtcagtgagc

SEQ ID NO: 18018 - DNA, 17 bp, Homo sapiens
tgagctgcccggcggag

SEQ ID NO: 18019 - DNA, 17 bp, Homo sapiens
tgagacgccgactggag

SEQ ID NO: 18020 - DNA, 18 bp, Homo sapiens
tgagatgctggcagaggc

SEQ ID NO: 18021 - DNA, 20 bp, Homo sapiens
tgagatgctccggcctgagc

SEQ ID NO: 18022 - DNA, 18 bp, Homo sapiens
tgaggtgcctgcacacag

SEQ ID NO: 18023 - DNA, 16 bp, Homo sapiens
tgagatgccgaggcgg

SEQ ID NO: 18024 - DNA, 20 bp, Homo sapiens
tgagatgctgctgtgagagg

SEQ ID NO: 18025 - DNA, 16 bp, Homo sapiens
tgaggatgcggcggag

SEQ ID NO: 18026 - DNA, 20 bp, Homo sapiens
tgggatgccatggacagagc

SEQ ID NO: 18027 - DNA, 18 bp, Homo sapiens
tgagataccgtgcctggc

SEQ ID NO: 18028 - DNA, 130 bp, Equine herpesvirus 2
attacagcttaacaaccctagaaagttaccccattctttacagtgtgaaatcatgtgtgattagttctgcatgatttcacactgtaaagagtggcataattaaaaactttatgggtcggtaatctgtaat

SEQ ID NO: 18029 - DNA, 24 bp, Equine herpesvirus 2
cacactgtaaagagtggcataatt

SEQ ID NO: 18030 - DNA, 19 bp, Homo sapiens
tgcatcgagtggcataatt

SEQ ID NO: 18031 - DNA, 19 bp, Homo sapiens
tgttgggaggggcacaatt

SEQ ID NO: 18032 - DNA, 22 bp, Homo sapiens
acaatgtagtactggcataatt

SEQ ID NO: 18033 - DNA, 25 bp, Homo sapiens
acattgtaaaaatgactccataatt

SEQ ID NO: 18034 - DNA, 18 bp, Homo sapiens
acactgtaaacggttcat

SEQ ID NO: 18035 - DNA, 15 bp, Homo sapiens
acactgtgaatggca

SEQ ID NO: 18036 - DNA, 22 bp, Homo sapiens
acctgtaaaaagaagtgtaatt

SEQ ID NO: 18037 - DNA, 16 bp, Homo sapiens
cacactgcaaagggca

SEQ ID NO: 18038 - DNA, 22 bp, Homo sapiens
acttgtagaagttagcataatt

SEQ ID NO: 18039 - DNA, 19 bp, Homo sapiens
caaactgtaaactaacata

SEQ ID NO: 18040 - DNA, 21 bp, Homo sapiens
cacactttaaaatacataatt

SEQ ID NO: 18041 - DNA, 21 bp, Homo sapiens
caccattttggtggcataatt

SEQ ID NO: 18042 - DNA, 20 bp, Homo sapiens
acattgtggagagttacata

SEQ ID NO: 18043 - DNA, 19 bp, Homo sapiens
catcctgtagtggcataat

SEQ ID NO: 18044 - DNA, 22 bp, Homo sapiens
ctgtaaagatactatcataatt

SEQ ID NO: 18045 - DNA, 19 bp, Homo sapiens
cacactataaagctggtgg

SEQ ID NO: 18046 - DNA, 15 bp, Homo sapiens
acactgtgagtagca

SEQ ID NO: 18047 - DNA, 124 bp, Ictalurid herpesvirus 1
ggggaataatatgtggggggggatgtggaagagggagggagggagagagcgagagagagagcaacccgcacttcttttttttttactcgacttcatcatcatcatcatcatcatcatcatctcc

SEQ ID NO: 18048 - DNA, 24 bp, Ictalurid herpesvirus 1
tggaagagggagggagggagagag

SEQ ID NO: 18049 - DNA, 17 bp, Homo sapiens
tggtggagggagggggg

SEQ ID NO: 18050 - DNA, 18 bp, Homo sapiens
tggaagaggtagggggag

SEQ ID NO: 18051 - DNA, 24 bp, Homo sapiens
gggggagggaggggaaggggagag

SEQ ID NO: 18052 - DNA, 19 bp, Homo sapiens
ggaggagggggggagggag

SEQ ID NO: 18053 - DNA, 21 bp, Homo sapiens
tgggggagacaccagggagag

SEQ ID NO: 18054 - DNA, 19 bp, Homo sapiens
ggaggagggagggagggag

SEQ ID NO: 18055 - DNA, 23 bp, Homo sapiens
ggaggagggagggagggagcgag

SEQ ID NO: 18056 - DNA, 18 bp, Homo sapiens
ggaagaggggccggaggg

SEQ ID NO: 18057 - DNA, 21 bp, Homo sapiens
tggaagagggaggggcttggg

SEQ ID NO: 18058 - DNA, 23 bp, Homo sapiens
tggggtaggagatggggagagag

SEQ ID NO: 18059 - DNA, 18 bp, Homo sapiens
tggggtgggggaagggag

SEQ ID NO: 18060 - DNA, 22 bp, Homo sapiens
tgggggaagggaggggtgagag

SEQ ID NO: 18061 - DNA, 23 bp, Homo sapiens
ggagctgggagggagggagagag

SEQ ID NO: 18062 - DNA, 19 bp, Homo sapiens
tgggggatgggagggaggg

SEQ ID NO: 18063 - DNA, 18 bp, Homo sapiens
tgggagggggaggaaagg

SEQ ID NO: 18064 - DNA, 20 bp, Homo sapiens
ggggacagagggagggagag

SEQ ID NO: 18065 - DNA, 19 bp, Homo sapiens
tgggagagggaagggggag

SEQ ID NO: 18066 - DNA, 18 bp, Homo sapiens
ggaagggggaggggaggg

SEQ ID NO: 18067 - DNA, 23 bp, Homo sapiens
gggggagggaggggccacaggag

SEQ ID NO: 18068 - DNA, 17 bp, Homo sapiens
ggaggagggggagggag

SEQ ID NO: 18069 - DNA, 17 bp, Homo sapiens
gggaggggggaagggag

SEQ ID NO: 18070 - DNA, 19 bp, Homo sapiens
ggaggaggggaagggagag

SEQ ID NO: 18071 - DNA, 19 bp, Homo sapiens
gggagggggtgggggagag

SEQ ID NO: 18072 - DNA, 22 bp, Homo sapiens
ggaagggggagatcagagagag

SEQ ID NO: 18073 - DNA, 19 bp, Homo sapiens
tggaggagcagggagggag

SEQ ID NO: 18074 - DNA, 19 bp, Homo sapiens
gggggaaggagggagggag

SEQ ID NO: 18075 - DNA, 23 bp, Homo sapiens
gggagagggaggaagaaagagag

SEQ ID NO: 18076 - DNA, 20 bp, Homo sapiens
tggagagggaggctggggag

SEQ ID NO: 18077 - DNA, 17 bp, Homo sapiens
tggagagggagggagag

SEQ ID NO: 18078 - DNA, 18 bp, Homo sapiens
gagggagggagcagggag

SEQ ID NO: 18079 - DNA, 17 bp, Homo sapiens
ggaaggggcggggagag

SEQ ID NO: 18080 - DNA, 21 bp, Homo sapiens
gggagaggggttgggggaggg

SEQ ID NO: 18081 - DNA, 16 bp, Homo sapiens
tggggagggagagggg

SEQ ID NO: 18082 - DNA, 20 bp, Homo sapiens
tgggggagcgggggaaggag

SEQ ID NO: 18083 - DNA, 20 bp, Homo sapiens
tggtaagttgggagggaggg

SEQ ID NO: 18084 - DNA, 22 bp, Homo sapiens
tggggagggaggggagaaagag

SEQ ID NO: 18085 - DNA, 18 bp, Homo sapiens
gaggagggagggaaggag

SEQ ID NO: 18086 - DNA, 19 bp, Homo sapiens
ggaagggggcgggagggag

SEQ ID NO: 18087 - DNA, 23 bp, Homo sapiens
ggaggagggagggaaagagggag

SEQ ID NO: 18088 - DNA, 21 bp, Homo sapiens
tgggagggaggccggggggag

SEQ ID NO: 18089 - DNA, 22 bp, Homo sapiens
gggagaggagaaagggagagag

SEQ ID NO: 18090 - DNA, 18 bp, Homo sapiens
ggaagagggagggcaggg

SEQ ID NO: 18091 - DNA, 19 bp, Homo sapiens
tggagcagggagaagaggg

SEQ ID NO: 18092 - DNA, 20 bp, Homo sapiens
ggaggaggttggggagggag

SEQ ID NO: 18093 - DNA, 20 bp, Homo sapiens
tgggggaagggagggaagag

SEQ ID NO: 18094 - DNA, 21 bp, Homo sapiens
aggaggaggggcgggagagag

SEQ ID NO: 18095 - DNA, 20 bp, Homo sapiens
tgggaaagggaggaggaggg

SEQ ID NO: 18096 - DNA, 19 bp, Homo sapiens
tggggggacaaagggagag

SEQ ID NO: 18097 - DNA, 17 bp, Homo sapiens
gggagggccggggggag

SEQ ID NO: 18098 - DNA, 27 bp, Homo sapiens
tgcgagagggaaagttcggggggaggg

SEQ ID NO: 18099 - DNA, 18 bp, Homo sapiens
gaggggggagggaagaag

SEQ ID NO: 18100 - DNA, 18 bp, Homo sapiens
tggaagggaggttgggag

SEQ ID NO: 18101 - DNA, 18 bp, Homo sapiens
ggaaggagggggagggag

SEQ ID NO: 18102 - DNA, 18 bp, Homo sapiens
gggggagggaagggggag

SEQ ID NO: 18103 - DNA, 22 bp, Homo sapiens
tgggggggtgggcgggggagag

SEQ ID NO: 18104 - DNA, 22 bp, Homo sapiens
ggaaaggaggggggagggagag

SEQ ID NO: 18105 - DNA, 16 bp, Homo sapiens
gaagggggaggggaaa

SEQ ID NO: 18106 - DNA, 19 bp, Homo sapiens
tgggggagggatggggcag

SEQ ID NO: 18107 - DNA, 21 bp, Homo sapiens
tggggtgaggggcagggagag

SEQ ID NO: 18108 - DNA, 26 bp, Homo sapiens
ggagaagggaggggactctcagggag

SEQ ID NO: 18109 - DNA, 23 bp, Homo sapiens
tgggagagagagggaatagggag

SEQ ID NO: 18110 - DNA, 21 bp, Homo sapiens
gggagggagagagggagagag

SEQ ID NO: 18111 - DNA, 19 bp, Homo sapiens
gagggtaaaagggagagag

SEQ ID NO: 18112 - DNA, 23 bp, Homo sapiens
tgagagagggaagaaggggagag

SEQ ID NO: 18113 - DNA, 20 bp, Homo sapiens
tgaaaggcagagggagggag

SEQ ID NO: 18114 - DNA, 23 bp, Homo sapiens
tggggagggagatcgggagggag

SEQ ID NO: 18115 - DNA, 20 bp, Homo sapiens
gaggaggggagaggagagag

SEQ ID NO: 18116 - DNA, 22 bp, Homo sapiens
tggaaggggtagggtcccagag

SEQ ID NO: 18117 - DNA, 23 bp, Homo sapiens
ggaggggacagaaggagggggag

SEQ ID NO: 18118 - DNA, 18 bp, Homo sapiens
tggaagatggagagaggg

SEQ ID NO: 18119 - DNA, 17 bp, Homo sapiens
tggaggagggagggtga

SEQ ID NO: 18120 - DNA, 22 bp, Homo sapiens
tggggaagggtggcagggagag

SEQ ID NO: 18121 - DNA, 19 bp, Homo sapiens
agaagagggagggagggag

SEQ ID NO: 18122 - DNA, 20 bp, Homo sapiens
ggaggaggggctggggggag

SEQ ID NO: 18123 - DNA, 21 bp, Homo sapiens
tggggggtggtatggagagag

SEQ ID NO: 18124 - DNA, 22 bp, Homo sapiens
tgaaggagggaggggatgggag

SEQ ID NO: 18125 - DNA, 18 bp, Homo sapiens
agggagagggagagagag

SEQ ID NO: 18126 - DNA, 19 bp, Homo sapiens
tggggagggggtgggagag

SEQ ID NO: 18127 - DNA, 21 bp, Homo sapiens
tgggagagaggaggggcggag

SEQ ID NO: 18128 - DNA, 24 bp, Homo sapiens
tggaagagaggaccctggagggag

SEQ ID NO: 18129 - DNA, 18 bp, Homo sapiens
tgggagaggaagggaggg

SEQ ID NO: 18130 - DNA, 19 bp, Homo sapiens
ggagagggaggaaagaggg

SEQ ID NO: 18131 - DNA, 23 bp, Homo sapiens
tgaaaggggggggccgaagagag

SEQ ID NO: 18132 - DNA, 21 bp, Homo sapiens
gagggggggagggagtcggag

SEQ ID NO: 18133 - DNA, 19 bp, Homo sapiens
tgggggggacgggagggag

SEQ ID NO: 18134 - DNA, 17 bp, Homo sapiens
tggaggaggagggagga

SEQ ID NO: 18135 - DNA, 21 bp, Homo sapiens
gggagggaaagagggagggag

SEQ ID NO: 18136 - DNA, 20 bp, Homo sapiens
tggaggagggagccagggag

SEQ ID NO: 18137 - DNA, 21 bp, Homo sapiens
tggggggatcgagggagggag

SEQ ID NO: 18138 - DNA, 18 bp, Homo sapiens
gggaaaggggggagggag

SEQ ID NO: 18139 - DNA, 17 bp, Homo sapiens
tgggaagggagggtggg

SEQ ID NO: 18140 - DNA, 18 bp, Homo sapiens
tgggagggagggagggag

SEQ ID NO: 18141 - DNA, 20 bp, Homo sapiens
tggagagagggtggggaggg

SEQ ID NO: 18142 - DNA, 22 bp, Homo sapiens
ggagctggagggagggagggag

SEQ ID NO: 18143 - DNA, 16 bp, Homo sapiens
tggaggagagggaggg

SEQ ID NO: 18144 - DNA, 20 bp, Homo sapiens
tgggaggagggaagggagag

SEQ ID NO: 18145 - DNA, 18 bp, Homo sapiens
ggagaggaccagggagag

SEQ ID NO: 18146 - DNA, 19 bp, Homo sapiens
tgggagagggagggcgtgg

SEQ ID NO: 18147 - DNA, 25 bp, Homo sapiens
tggagggtgggaaagagggagggag

SEQ ID NO: 18148 - DNA, 19 bp, Homo sapiens
ggagaaaggagggggagag

SEQ ID NO: 18149 - DNA, 21 bp, Homo sapiens
tgggcaggaggagggagagag

SEQ ID NO: 18150 - DNA, 21 bp, Homo sapiens
tgtgagtcgggagggagggag

SEQ ID NO: 18151 - DNA, 20 bp, Homo sapiens
tggaagggctagggagggag

SEQ ID NO: 18152 - DNA, 20 bp, Homo sapiens
tggaaaaggtagggagggag

SEQ ID NO: 18153 - DNA, 19 bp, Homo sapiens
ggaggagggagactgaggg

SEQ ID NO: 18154 - DNA, 20 bp, Homo sapiens
ggaggaggaaggggagggag

SEQ ID NO: 18155 - DNA, 18 bp, Homo sapiens
tgggaggcggagggaggg

SEQ ID NO: 18156 - DNA, 17 bp, Homo sapiens
ggaagggagggagggag

SEQ ID NO: 18157 - DNA, 21 bp, Homo sapiens
gggagagagagagggagagag

SEQ ID NO: 18158 - DNA, 19 bp, Homo sapiens
gggggaggaagggagggag

SEQ ID NO: 18159 - DNA, 26 bp, Homo sapiens
ggacagagagggagggagggagggag

SEQ ID NO: 18160 - DNA, 21 bp, Homo sapiens
gggggagggggcaagagagag

SEQ ID NO: 18161 - DNA, 25 bp, Homo sapiens
tgagagaggagaaagagggagagag

SEQ ID NO: 18162 - DNA, 22 bp, Homo sapiens
tgggagggggaggaagggggag

SEQ ID NO: 18163 - DNA, 20 bp, Homo sapiens
tggcagagggagggaggaaa

SEQ ID NO: 18164 - DNA, 20 bp, Homo sapiens
tggatctgggagggagggag

SEQ ID NO: 18165 - DNA, 17 bp, Homo sapiens
tggggagggggagaggg

SEQ ID NO: 18166 - DNA, 16 bp, Homo sapiens
tggagagggaggggag

SEQ ID NO: 18167 - DNA, 18 bp, Homo sapiens
tgggggaggggtggggag

SEQ ID NO: 18168 - DNA, 20 bp, Homo sapiens
tgggtgaggatgggagggag

SEQ ID NO: 18169 - DNA, 19 bp, Homo sapiens
ggagagggagggctcagag

SEQ ID NO: 18170 - DNA, 26 bp, Homo sapiens
tggggtggggagggagtccaagagag

SEQ ID NO: 18171 - DNA, 20 bp, Homo sapiens
gggtggggatggggagagag

SEQ ID NO: 18172 - DNA, 21 bp, Homo sapiens
ggagggggagggagaggggag

SEQ ID NO: 18173 - DNA, 22 bp, Homo sapiens
gggggagggagaggggagggag

SEQ ID NO: 18174 - DNA, 19 bp, Homo sapiens
ggaggaaggagggagggag

SEQ ID NO: 18175 - DNA, 19 bp, Homo sapiens
gggggagggggagggagag

SEQ ID NO: 18176 - DNA, 18 bp, Homo sapiens
tgggggggcgggagggag

SEQ ID NO: 18177 - DNA, 18 bp, Homo sapiens
tgggggagggaggatgag

SEQ ID NO: 18178 - DNA, 20 bp, Homo sapiens
tgggagagggagagagaaag

SEQ ID NO: 18179 - DNA, 26 bp, Homo sapiens
tggcgagggggagggacttaacagag

SEQ ID NO: 18180 - DNA, 19 bp, Homo sapiens
gggaggggaagggagggag

SEQ ID NO: 18181 - DNA, 18 bp, Homo sapiens
tgggaagggaggtgggag

SEQ ID NO: 18182 - DNA, 20 bp, Homo sapiens
tggaggatgggggaagggag

SEQ ID NO: 18183 - DNA, 19 bp, Homo sapiens
tgggggagggaaggaaaga

SEQ ID NO: 18184 - DNA, 20 bp, Homo sapiens
tgaaggagggggtgagggag

SEQ ID NO: 18185 - DNA, 20 bp, Homo sapiens
ggaagagatgagggggggag

SEQ ID NO: 18186 - DNA, 20 bp, Homo sapiens
ggacagggagggggttcaag

SEQ ID NO: 18187 - DNA, 19 bp, Homo sapiens
tggaagaggtgggggaagg

SEQ ID NO: 18188 - DNA, 18 bp, Homo sapiens
ggagagggggaaggaggg

SEQ ID NO: 18189 - DNA, 21 bp, Homo sapiens
ggaagagggagggaaggagag

SEQ ID NO: 18190 - DNA, 22 bp, Homo sapiens
tggaaaggaagaagggagggag

SEQ ID NO: 18191 - DNA, 27 bp, Homo sapiens
gggagagggaggaagtgagggagggag

SEQ ID NO: 18192 - DNA, 24 bp, Homo sapiens
tggggagggggggaagggagggag

SEQ ID NO: 18193 - DNA, 24 bp, Homo sapiens
gggagagggaaggtggggagagag

SEQ ID NO: 18194 - DNA, 20 bp, Homo sapiens
tagaggaaggagggagggag

SEQ ID NO: 18195 - DNA, 20 bp, Homo sapiens
tgggagagggggcaggaggg

SEQ ID NO: 18196 - DNA, 18 bp, Homo sapiens
aggggagggagaaagaga

SEQ ID NO: 18197 - DNA, 24 bp, Homo sapiens
tgggggaggggaccagggagagag

SEQ ID NO: 18198 - DNA, 18 bp, Homo sapiens
tggaggaggcagagggag

SEQ ID NO: 18199 - DNA, 17 bp, Homo sapiens
tggagagggagggggag

SEQ ID NO: 18200 - DNA, 22 bp, Homo sapiens
tggaaagggagggagaatggag

SEQ ID NO: 18201 - DNA, 18 bp, Homo sapiens
tagaagaggatggggggg

SEQ ID NO: 18202 - DNA, 20 bp, Homo sapiens
ggaaggcactagggagagag

SEQ ID NO: 18203 - DNA, 20 bp, Homo sapiens
gaggagggacccagagggag

SEQ ID NO: 18204 - DNA, 19 bp, Homo sapiens
tggacagagggaggggtgg

SEQ ID NO: 18205 - DNA, 18 bp, Homo sapiens
cggggaacagagggaggg

SEQ ID NO: 18206 - DNA, 20 bp, Homo sapiens
ggaagggggggcagagggag

SEQ ID NO: 18207 - DNA, 18 bp, Homo sapiens
gagagagggagggagaga

SEQ ID NO: 18208 - DNA, 19 bp, Homo sapiens
tggggggggaggcagagag

SEQ ID NO: 18209 - DNA, 22 bp, Homo sapiens
tggggtgagggggtggggagag

SEQ ID NO: 18210 - DNA, 21 bp, Homo sapiens
ggaagagacagagggagagag

SEQ ID NO: 18211 - DNA, 19 bp, Homo sapiens
aggaggagggagaggagag

SEQ ID NO: 18212 - DNA, 22 bp, Homo sapiens
tgggggaggaggggaaggagag

SEQ ID NO: 18213 - DNA, 21 bp, Homo sapiens
gggagagggagagggagagag

SEQ ID NO: 18214 - DNA, 20 bp, Homo sapiens
gggagagggagagaggagag

SEQ ID NO: 18215 - DNA, 19 bp, Homo sapiens
tgggggaaggaagagggag

SEQ ID NO: 18216 - DNA, 18 bp, Homo sapiens
ggaagagggaggggagag

SEQ ID NO: 18217 - DNA, 19 bp, Homo sapiens
tgggggagggaagggagaa

SEQ ID NO: 18218 - DNA, 19 bp, Homo sapiens
ggagcagggagggagggag

SEQ ID NO: 18219 - DNA, 18 bp, Homo sapiens
tgggggaggaagggaggg

SEQ ID NO: 18220 - DNA, 17 bp, Homo sapiens
tgggagggaggggcggg

SEQ ID NO: 18221 - DNA, 20 bp, Homo sapiens
tggaaagggagggcagagag

SEQ ID NO: 18222 - DNA, 20 bp, Homo sapiens
tggcagagccagggagggag

SEQ ID NO: 18223 - DNA, 16 bp, Homo sapiens
gaggggggaggagaga

SEQ ID NO: 18224 - DNA, 20 bp, Homo sapiens
tgggagggagacggggagag

SEQ ID NO: 18225 - DNA, 18 bp, Homo sapiens
ggaggggcagggagggag

SEQ ID NO: 18226 - DNA, 20 bp, Homo sapiens
ggcaagagggagggagagag

SEQ ID NO: 18227 - DNA, 18 bp, Homo sapiens
ggaagggggagaggaggg

SEQ ID NO: 18228 - DNA, 18 bp, Homo sapiens
tggacgagggagagagag

SEQ ID NO: 18229 - DNA, 24 bp, Homo sapiens
tgggggagtggacgagggagagag

SEQ ID NO: 18230 - DNA, 20 bp, Homo sapiens
gggaggggaaggggggggag

SEQ ID NO: 18231 - DNA, 19 bp, Homo sapiens
gggaggggaaaagagggag

SEQ ID NO: 18232 - DNA, 19 bp, Homo sapiens
tgggaggggcgggagggag

SEQ ID NO: 18233 - DNA, 23 bp, Homo sapiens
ggaggaggcagagagggagagag

SEQ ID NO: 18234 - DNA, 17 bp, Homo sapiens
gaagggggaggagggag

SEQ ID NO: 18235 - DNA, 26 bp, Homo sapiens
tggggtgagggaggcgagcaggggag

SEQ ID NO: 18236 - DNA, 23 bp, Homo sapiens
gggaggggaggggagggggagag

SEQ ID NO: 18237 - DNA, 21 bp, Homo sapiens
agggggaggggagggagagag

SEQ ID NO: 18238 - DNA, 18 bp, Homo sapiens
tggggggtggggagggag

SEQ ID NO: 18239 - DNA, 21 bp, Homo sapiens
tggtggagggaggcaggagag

SEQ ID NO: 18240 - DNA, 19 bp, Homo sapiens
gaagagggagggctcaggg

SEQ ID NO: 18241 - DNA, 19 bp, Homo sapiens
tgggagagagggaagggag

SEQ ID NO: 18242 - DNA, 20 bp, Homo sapiens
tggagagagaggggagagag

SEQ ID NO: 18243 - DNA, 23 bp, Homo sapiens
tggggcagggaggggaaggggag

SEQ ID NO: 18244 - DNA, 24 bp, Homo sapiens
tgggaggcgggagggtaaggggag

SEQ ID NO: 18245 - DNA, 24 bp, Homo sapiens
tgggaggcgggagggtaaagggag

SEQ ID NO: 18246 - DNA, 19 bp, Homo sapiens
gggaaagggagggagggag

SEQ ID NO: 18247 - DNA, 19 bp, Homo sapiens
cgggggagggagggcagag

SEQ ID NO: 18248 - DNA, 18 bp, Homo sapiens
tggatagggggaagggag

SEQ ID NO: 18249 - DNA, 21 bp, Homo sapiens
ggaggagggagctacagaggg

SEQ ID NO: 18250 - DNA, 20 bp, Homo sapiens
tggaagaggagagtggaggg

SEQ ID NO: 18251 - DNA, 24 bp, Homo sapiens
tggatggagggacaagggagagag

SEQ ID NO: 18252 - DNA, 18 bp, Homo sapiens
ggaagaggtgggggagag

SEQ ID NO: 18253 - DNA, 18 bp, Homo sapiens
tggcggggggaggaggag

SEQ ID NO: 18254 - DNA, 21 bp, Homo sapiens
ggaggagggaggagaagggag

SEQ ID NO: 18255 - DNA, 21 bp, Homo sapiens
tgggggaggggggagggatag

SEQ ID NO: 18256 - DNA, 18 bp, Homo sapiens
ggaaggggcgggagagag

SEQ ID NO: 18257 - DNA, 22 bp, Homo sapiens
tggggagggagggtccacaggg

SEQ ID NO: 18258 - DNA, 20 bp, Homo sapiens
tggacagagggaggttggag

SEQ ID NO: 18259 - DNA, 31 bp, Homo sapiens
tgggagggggagagaggattctgggagagcc

SEQ ID NO: 18260 - DNA, 22 bp, Homo sapiens
tgggagagagagtccaagggag

SEQ ID NO: 18261 - DNA, 26 bp, Homo sapiens
tggaggagggaggcgggcagtcggag

SEQ ID NO: 18262 - DNA, 20 bp, Homo sapiens
ggctgtggagggagggagag

SEQ ID NO: 18263 - DNA, 20 bp, Homo sapiens
tgggggtgggagggaggaag

SEQ ID NO: 18264 - DNA, 19 bp, Homo sapiens
tgggggtgaggggagggag

SEQ ID NO: 18265 - DNA, 21 bp, Homo sapiens
tgggagaggaggacgagggag

SEQ ID NO: 18266 - DNA, 24 bp, Homo sapiens
tggaatgggggagggacaggagag

SEQ ID NO: 18267 - DNA, 20 bp, Homo sapiens
tgaaagagggaggggaagag

SEQ ID NO: 18268 - DNA, 22 bp, Homo sapiens
tggagggggcaggaggagagag

SEQ ID NO: 18269 - DNA, 19 bp, Homo sapiens
tgaaagggggggaggggag

SEQ ID NO: 18270 - DNA, 18 bp, Homo sapiens
tgggggagggcaggaaag

SEQ ID NO: 18271 - DNA, 19 bp, Homo sapiens
aggaggagggaggtgagag

SEQ ID NO: 18272 - DNA, 25 bp, Homo sapiens
tgggggcagggagaggtggagggag

SEQ ID NO: 18273 - DNA, 18 bp, Homo sapiens
tggggaggtgggagggag

SEQ ID NO: 18274 - DNA, 18 bp, Homo sapiens
tggggagggagcagaggg

SEQ ID NO: 18275 - DNA, 21 bp, Homo sapiens
tggagcccaggagggagggag

SEQ ID NO: 18276 - DNA, 18 bp, Homo sapiens
aggaggagggagggagca

SEQ ID NO: 18277 - DNA, 19 bp, Homo sapiens
gggagagggggggaccgag

SEQ ID NO: 18278 - DNA, 19 bp, Homo sapiens
gaggagggaggatggggag

SEQ ID NO: 18279 - DNA, 20 bp, Homo sapiens
agaaggagggagggagggag

SEQ ID NO: 18280 - DNA, 19 bp, Homo sapiens
gagagagggagggagagag

SEQ ID NO: 18281 - DNA, 19 bp, Homo sapiens
tgggagggggtggagggag

SEQ ID NO: 18282 - DNA, 20 bp, Homo sapiens
ggaaggggcttctgagggag

SEQ ID NO: 18283 - DNA, 20 bp, Homo sapiens
tggaggaggagggagtctag

SEQ ID NO: 18284 - DNA, 24 bp, Homo sapiens
gggagagggggggcacccagggag

SEQ ID NO: 18285 - DNA, 20 bp, Homo sapiens
gggaggggtgggggagagag

SEQ ID NO: 18286 - DNA, 23 bp, Homo sapiens
gggggagggaggcgcggagggag

SEQ ID NO: 18287 - DNA, 20 bp, Homo sapiens
tggaaagagggggcagaggg

SEQ ID NO: 18288 - DNA, 19 bp, Homo sapiens
tggggggggggaaggagag

SEQ ID NO: 18289 - DNA, 18 bp, Homo sapiens
tgggggaaggagagggag

SEQ ID NO: 18290 - DNA, 21 bp, Homo sapiens
tgggtgggggtcaggagagag

SEQ ID NO: 18291 - DNA, 19 bp, Homo sapiens
gagggaggggacaggagag

SEQ ID NO: 18292 - DNA, 18 bp, Homo sapiens
gaggggaggcgggagaga

SEQ ID NO: 18293 - DNA, 18 bp, Homo sapiens
ggaagggggaggagggag

SEQ ID NO: 18294 - DNA, 18 bp, Homo sapiens
tggaggagggagagggag

SEQ ID NO: 18295 - DNA, 22 bp, Homo sapiens
gaagagggaggacctttgggag

SEQ ID NO: 18296 - DNA, 18 bp, Homo sapiens
gggaggggagggaccggg

SEQ ID NO: 18297 - DNA, 18 bp, Homo sapiens
tgggggtgggaggagaga

SEQ ID NO: 18298 - DNA, 23 bp, Homo sapiens
tgggagagggacaatggggaggg

SEQ ID NO: 18299 - DNA, 21 bp, Homo sapiens
ggagggaaggaggggggggag

SEQ ID NO: 18300 - DNA, 20 bp, Homo sapiens
tgggagggggaggggccaag

SEQ ID NO: 18301 - DNA, 18 bp, Homo sapiens
tggagagggaggggggag

SEQ ID NO: 18302 - DNA, 23 bp, Homo sapiens
tgggagggagttgggggagagag

SEQ ID NO: 18303 - DNA, 18 bp, Homo sapiens
tggggagggaagggggag

SEQ ID NO: 18304 - DNA, 22 bp, Homo sapiens
tggaggagcgagggaggcagag

SEQ ID NO: 18305 - DNA, 19 bp, Homo sapiens
ggaaaagggagggggagag

SEQ ID NO: 18306 - DNA, 20 bp, Homo sapiens
tggaagggggagggatagag

SEQ ID NO: 18307 - DNA, 19 bp, Homo sapiens
tggcggggggcgggggaga

SEQ ID NO: 18308 - DNA, 18 bp, Homo sapiens
gaagagggagggactggg

SEQ ID NO: 18309 - DNA, 22 bp, Homo sapiens
ggaaggagagggagggagagag

SEQ ID NO: 18310 - DNA, 23 bp, Homo sapiens
tggggagggaggaggagggagag

SEQ ID NO: 18311 - DNA, 17 bp, Homo sapiens
ggaggagggagagggag

SEQ ID NO: 18312 - DNA, 20 bp, Homo sapiens
gggagagggaggctagaggg

SEQ ID NO: 18313 - DNA, 20 bp, Homo sapiens
tggtgggggatcagggagag

SEQ ID NO: 18314 - DNA, 24 bp, Homo sapiens
tgggagggaggaagcgggagggag

SEQ ID NO: 18315 - DNA, 19 bp, Homo sapiens
tgggagagggagagggcag

SEQ ID NO: 18316 - DNA, 23 bp, Homo sapiens
ggagaaagtggggagggagagag

SEQ ID NO: 18317 - DNA, 17 bp, Homo sapiens
tggagagggaagagggg

SEQ ID NO: 18318 - DNA, 24 bp, Homo sapiens
tgggagatggagatgaggagagag

SEQ ID NO: 18319 - DNA, 18 bp, Homo sapiens
tgggagcgggagggagga

SEQ ID NO: 18320 - DNA, 18 bp, Homo sapiens
ggaagggaggggcagaga

SEQ ID NO: 18321 - DNA, 20 bp, Homo sapiens
tgggggaggggcagagggag

SEQ ID NO: 18322 - DNA, 19 bp, Homo sapiens
tggaggggaggggagggag

SEQ ID NO: 18323 - DNA, 20 bp, Homo sapiens
tggggagggagggtggggag

SEQ ID NO: 18324 - DNA, 22 bp, Homo sapiens
tggggtgggatgagggagagag

SEQ ID NO: 18325 - DNA, 21 bp, Homo sapiens
gggaggcggggagggagggag

SEQ ID NO: 18326 - DNA, 21 bp, Homo sapiens
tggagaaggtaagggagagag

SEQ ID NO: 18327 - DNA, 21 bp, Homo sapiens
ggaagggggagggaaggggag

SEQ ID NO: 18328 - DNA, 25 bp, Homo sapiens
ggaaggattgcagggagggagggag

SEQ ID NO: 18329 - DNA, 19 bp, Homo sapiens
gggagagcaggggagagag

SEQ ID NO: 18330 - DNA, 17 bp, Homo sapiens
tgggagggtggagggag

SEQ ID NO: 18331 - DNA, 23 bp, Homo sapiens
tggagggagggagggaggtggag

SEQ ID NO: 18332 - DNA, 19 bp, Homo sapiens
gagggagaaagggagagag

SEQ ID NO: 18333 - DNA, 17 bp, Homo sapiens
tggcagggggagggggg

SEQ ID NO: 18334 - DNA, 22 bp, Homo sapiens
gggagagggaaatgggggaggg

SEQ ID NO: 18335 - DNA, 18 bp, Homo sapiens
cggggggaggggagggag

SEQ ID NO: 18336 - DNA, 19 bp, Homo sapiens
agggggagggagggatgag

SEQ ID NO: 18337 - DNA, 19 bp, Homo sapiens
tggaggagggaggagaggg

SEQ ID NO: 18338 - DNA, 21 bp, Homo sapiens
ggaagggaaacagggagggag

SEQ ID NO: 18339 - DNA, 18 bp, Homo sapiens
tgggggagtgagagagag

SEQ ID NO: 18340 - DNA, 20 bp, Homo sapiens
tgccagggggagggagggag

SEQ ID NO: 18341 - DNA, 19 bp, Homo sapiens
gggggagggagggaggcag

SEQ ID NO: 18342 - DNA, 19 bp, Homo sapiens
tgggagaggaaagggaggg

SEQ ID NO: 18343 - DNA, 19 bp, Homo sapiens
gggaggggaagggagagag

SEQ ID NO: 18344 - DNA, 18 bp, Homo sapiens
tggagaggggagagggag

SEQ ID NO: 18345 - DNA, 18 bp, Homo sapiens
tgggaggggcggagggag

SEQ ID NO: 18346 - DNA, 19 bp, Homo sapiens
tgggggtgggaggaagaga

SEQ ID NO: 18347 - DNA, 18 bp, Homo sapiens
gggggagggagaggggag

SEQ ID NO: 18348 - DNA, 24 bp, Homo sapiens
tgggagggagagggggagggagag

SEQ ID NO: 18349 - DNA, 18 bp, Homo sapiens
tggaagaagggttgaggg

SEQ ID NO: 18350 - DNA, 20 bp, Homo sapiens
gggagcagtgagggagagag

SEQ ID NO: 18351 - DNA, 20 bp, Homo sapiens
ggaagggctgggggagggag

SEQ ID NO: 18352 - DNA, 25 bp, Homo sapiens
tgggggagggagagtgtggggggag

SEQ ID NO: 18353 - DNA, 19 bp, Homo sapiens
tggaaggaggggaggaggg

SEQ ID NO: 18354 - DNA, 20 bp, Homo sapiens
tgggagagggaaggatggag

SEQ ID NO: 18355 - DNA, 18 bp, Homo sapiens
tgggcgggagggagggag

SEQ ID NO: 18356 - DNA, 18 bp, Homo sapiens
gagtgaagggagggggag

SEQ ID NO: 18357 - DNA, 19 bp, Homo sapiens
ggaagaggggaggggaggg

SEQ ID NO: 18358 - DNA, 19 bp, Homo sapiens
tggtaggtagggggagaga

SEQ ID NO: 18359 - DNA, 24 bp, Homo sapiens
tggcagagggagggcagaaaggag

SEQ ID NO: 18360 - DNA, 18 bp, Homo sapiens
tggggagggagtggaggg

SEQ ID NO: 18361 - DNA, 20 bp, Homo sapiens
tgggaggaatggggagggag

SEQ ID NO: 18362 - DNA, 23 bp, Homo sapiens
tgggggaaggagaggagggggag

SEQ ID NO: 18363 - DNA, 20 bp, Homo sapiens
tggaagtgggggaaggagag

SEQ ID NO: 18364 - DNA, 19 bp, Homo sapiens
ggagagggagaaaagagag

SEQ ID NO: 18365 - DNA, 22 bp, Homo sapiens
tggaagagggcaggggatagag

SEQ ID NO: 18366 - DNA, 25 bp, Homo sapiens
ggaagggagggagggagggagggag

SEQ ID NO: 18367 - DNA, 30 bp, Homo sapiens
ggaagaaaggaagggagggagggagggagc

SEQ ID NO: 18368 - DNA, 22 bp, Homo sapiens
tggaggagggagagggaaagag

SEQ ID NO: 18369 - DNA, 16 bp, Homo sapiens
tggagagggagggggg

SEQ ID NO: 18370 - DNA, 20 bp, Homo sapiens
tggcagagggagggaaggag

SEQ ID NO: 18371 - DNA, 23 bp, Homo sapiens
tgggagagagaggcaggggagag

SEQ ID NO: 18372 - DNA, 17 bp, Homo sapiens
tggcgggagggagggag

SEQ ID NO: 18373 - DNA, 19 bp, Homo sapiens
tggaaggagattgggaggg

SEQ ID NO: 18374 - DNA, 19 bp, Homo sapiens
gggagggggaggatgagag

SEQ ID NO: 18375 - DNA, 25 bp, Homo sapiens
tggagggaggggaggagggagggag

SEQ ID NO: 18376 - DNA, 17 bp, Homo sapiens
ggaggagggagggagag

SEQ ID NO: 18377 - DNA, 18 bp, Homo sapiens
ggaagtggagggggagag

SEQ ID NO: 18378 - DNA, 19 bp, Homo sapiens
tggcagttcggagggaggg

SEQ ID NO: 18379 - DNA, 22 bp, Homo sapiens
gaggagggaggtagggagagag

SEQ ID NO: 18380 - DNA, 19 bp, Homo sapiens
gggggagggaagaggggag

SEQ ID NO: 18381 - DNA, 19 bp, Homo sapiens
tggaggaagggagggaagg

SEQ ID NO: 18382 - DNA, 17 bp, Homo sapiens
tggatgggcagggaggg

SEQ ID NO: 18383 - DNA, 19 bp, Homo sapiens
gggagagagagggagagag

SEQ ID NO: 18384 - DNA, 19 bp, Homo sapiens
tggaagaggtgaggaaggg

SEQ ID NO: 18385 - DNA, 17 bp, Homo sapiens
tgggggaggggagggag

SEQ ID NO: 18386 - DNA, 19 bp, Homo sapiens
tggaagggagcggggaggg

SEQ ID NO: 18387 - DNA, 21 bp, Homo sapiens
tggaagagattggggagggag

SEQ ID NO: 18388 - DNA, 16 bp, Homo sapiens
gaagagggagagggag

SEQ ID NO: 18389 - DNA, 19 bp, Homo sapiens
ggaagagggggtcagaggg

SEQ ID NO: 18390 - DNA, 21 bp, Homo sapiens
gggggagagtaggagggagag

SEQ ID NO: 18391 - DNA, 19 bp, Homo sapiens
ggagaaaggagggagggag

SEQ ID NO: 18392 - DNA, 20 bp, Homo sapiens
ggaaggggagagggagggag

SEQ ID NO: 18393 - DNA, 23 bp, Homo sapiens
gggagagggagggagaatatgag

SEQ ID NO: 18394 - DNA, 18 bp, Homo sapiens
gggaggggtgggagggag

SEQ ID NO: 18395 - DNA, 21 bp, Homo sapiens
tgggagcagggagggggcggg

SEQ ID NO: 18396 - DNA, 24 bp, Homo sapiens
ggaggagggagggagggaggagag

SEQ ID NO: 18397 - DNA, 19 bp, Homo sapiens
gggagggggagcaagggag

SEQ ID NO: 18398 - DNA, 19 bp, Homo sapiens
tgggggagggagcagggag

SEQ ID NO: 18399 - DNA, 20 bp, Homo sapiens
ggagagagggagggagggag

SEQ ID NO: 18400 - DNA, 20 bp, Homo sapiens
tggaagggggtgggagagag

SEQ ID NO: 18401 - DNA, 19 bp, Homo sapiens
tggagagggaggcagagag

SEQ ID NO: 18402 - DNA, 22 bp, Homo sapiens
tggaagagtgggctggagagag

SEQ ID NO: 18403 - DNA, 21 bp, Homo sapiens
tggcagagaccagggagagag

SEQ ID NO: 18404 - DNA, 19 bp, Homo sapiens
tgggaggggagggaatggg

SEQ ID NO: 18405 - DNA, 20 bp, Homo sapiens
ggacgagggaggggagagag

SEQ ID NO: 18406 - DNA, 18 bp, Homo sapiens
gaagggggagggaggaag

SEQ ID NO: 18407 - DNA, 19 bp, Homo sapiens
tggagagggagggcgggag

SEQ ID NO: 18408 - DNA, 19 bp, Homo sapiens
gggagagggcaggggaggg

SEQ ID NO: 18409 - DNA, 20 bp, Homo sapiens
tggggggggggtggggagag

SEQ ID NO: 18410 - DNA, 20 bp, Homo sapiens
ggaagggggaggggacaggg

SEQ ID NO: 18411 - DNA, 18 bp, Homo sapiens
aggggatgggggagggag

SEQ ID NO: 18412 - DNA, 22 bp, Homo sapiens
ggaagggaggggagggagggag

SEQ ID NO: 18413 - DNA, 24 bp, Homo sapiens
tgggagagagagggagaaactgag

SEQ ID NO: 18414 - DNA, 21 bp, Homo sapiens
tgagagagggaggggaaggag

SEQ ID NO: 18415 - DNA, 19 bp, Homo sapiens
tggagagggagggggaggg

SEQ ID NO: 18416 - DNA, 22 bp, Homo sapiens
tggggagggagggggtgctgag

SEQ ID NO: 18417 - DNA, 22 bp, Homo sapiens
tggtggagggagggggactgag

SEQ ID NO: 18418 - DNA, 19 bp, Homo sapiens
tggcaggagggagagagag

SEQ ID NO: 18419 - DNA, 23 bp, Homo sapiens
tggggggtggagataagagggag

SEQ ID NO: 18420 - DNA, 19 bp, Homo sapiens
ggaggagagagggggagag

SEQ ID NO: 18421 - DNA, 20 bp, Homo sapiens
tggagggggtggggagggag

SEQ ID NO: 18422 - DNA, 18 bp, Homo sapiens
ggagaagggaggggggaa

SEQ ID NO: 18423 - DNA, 25 bp, Homo sapiens
ggaaggggggggcggagggagggag

SEQ ID NO: 18424 - DNA, 19 bp, Homo sapiens
ggcggagggagggagggag

SEQ ID NO: 18425 - DNA, 19 bp, Homo sapiens
gggggagggaggtggggag

SEQ ID NO: 18426 - DNA, 23 bp, Homo sapiens
tgggggaagggtctgggagagag

SEQ ID NO: 18427 - DNA, 20 bp, Homo sapiens
tggggaagggacagggggag

SEQ ID NO: 18428 - DNA, 20 bp, Homo sapiens
gggagagggcagggggggag

SEQ ID NO: 18429 - DNA, 22 bp, Homo sapiens
gggggagggagagaggggagag

SEQ ID NO: 18430 - DNA, 18 bp, Homo sapiens
tggggagggaggagggag

SEQ ID NO: 18431 - DNA, 20 bp, Homo sapiens
tggagagggagagtggagag

SEQ ID NO: 18432 - DNA, 20 bp, Homo sapiens
tggagtggggggggtaggag

SEQ ID NO: 18433 - DNA, 25 bp, Homo sapiens
tggaggaggaagcagagagggagag

SEQ ID NO: 18434 - DNA, 18 bp, Homo sapiens
gggggagggaagggaggg

SEQ ID NO: 18435 - DNA, 20 bp, Homo sapiens
gggagagggagggggcggag

SEQ ID NO: 18436 - DNA, 18 bp, Homo sapiens
tgggagaggaagggcggg

SEQ ID NO: 18437 - DNA, 21 bp, Homo sapiens
tggggggaggagaggagagag

SEQ ID NO: 18438 - DNA, 18 bp, Homo sapiens
tggagggggcagagggag

SEQ ID NO: 18439 - DNA, 19 bp, Homo sapiens
tgggggcgggggtggagag

SEQ ID NO: 18440 - DNA, 18 bp, Homo sapiens
gaggggagaagggagaga

SEQ ID NO: 18441 - DNA, 22 bp, Homo sapiens
tgggggagagaggagaatagag

SEQ ID NO: 18442 - DNA, 19 bp, Homo sapiens
gggagagtaagggagggag

SEQ ID NO: 18443 - DNA, 26 bp, Homo sapiens
tgggggtggggaggaagaggagagag

SEQ ID NO: 18444 - DNA, 20 bp, Homo sapiens
tggaggaggggtggagagag

SEQ ID NO: 18445 - DNA, 24 bp, Homo sapiens
tggaaagagcggggggggggggag

SEQ ID NO: 18446 - DNA, 20 bp, Homo sapiens
ggggggggggggagggggag

SEQ ID NO: 18447 - DNA, 17 bp, Homo sapiens
ggagaagggggagggag

SEQ ID NO: 18448 - DNA, 22 bp, Homo sapiens
tggaagggggttaaagggaggg

SEQ ID NO: 18449 - DNA, 18 bp, Homo sapiens
tgggagagagttggaggg

SEQ ID NO: 18450 - DNA, 19 bp, Homo sapiens
tggagagggagggtcaggg

SEQ ID NO: 18451 - DNA, 18 bp, Homo sapiens
gagggaagagggagagag

SEQ ID NO: 18452 - DNA, 23 bp, Homo sapiens
tggggggaggggagcagagagag

SEQ ID NO: 18453 - DNA, 19 bp, Homo sapiens
gaaagagggagggagggag

SEQ ID NO: 18454 - DNA, 20 bp, Homo sapiens
gagagggggggaggagagag

SEQ ID NO: 18455 - DNA, 23 bp, Homo sapiens
tgggggagggatgtccgagggag

SEQ ID NO: 18456 - DNA, 23 bp, Homo sapiens
tggaagagaggggccttggagag

SEQ ID NO: 18457 - DNA, 19 bp, Homo sapiens
gaggggggagggaagggag

SEQ ID NO: 18458 - DNA, 19 bp, Homo sapiens
tggaagagggagatgagag

SEQ ID NO: 18459 - DNA, 21 bp, Homo sapiens
tggaaaggaaaggggagggag

SEQ ID NO: 18460 - DNA, 21 bp, Homo sapiens
tggaagggaaaggggagggag

SEQ ID NO: 18461 - DNA, 20 bp, Homo sapiens
tgggaagggaggcaggagag

SEQ ID NO: 18462 - DNA, 27 bp, Homo sapiens
tggagagggctgaaaggagggagagag

SEQ ID NO: 18463 - DNA, 18 bp, Homo sapiens
tgggggagtgggggaggg

SEQ ID NO: 18464 - DNA, 17 bp, Homo sapiens
ggctgggagggagggag

SEQ ID NO: 18465 - DNA, 20 bp, Homo sapiens
tgggaggggaggtcagggag

SEQ ID NO: 18466 - DNA, 21 bp, Homo sapiens
tgggggaggaagggaggcaag

SEQ ID NO: 18467 - DNA, 23 bp, Homo sapiens
gaagagggaggggccaaggggag

SEQ ID NO: 18468 - DNA, 18 bp, Homo sapiens
gggaggggcaagggagag

SEQ ID NO: 18469 - DNA, 21 bp, Homo sapiens
tggatagagggagggagggag

SEQ ID NO: 18470 - DNA, 20 bp, Homo sapiens
tggaggagggagcctgggag

SEQ ID NO: 18471 - DNA, 20 bp, Homo sapiens
tggtagggggatggagggag

SEQ ID NO: 18472 - DNA, 21 bp, Homo sapiens
tgggagggaggggggcaggag

SEQ ID NO: 18473 - DNA, 19 bp, Homo sapiens
gggagttggagggagagag

SEQ ID NO: 18474 - DNA, 22 bp, Homo sapiens
tggcggggggtgggggagagag

SEQ ID NO: 18475 - DNA, 21 bp, Homo sapiens
ggaagggggtaaaggggagag

SEQ ID NO: 18476 - DNA, 21 bp, Homo sapiens
tggagagagggggaaagggag

SEQ ID NO: 18477 - DNA, 18 bp, Homo sapiens
agggctggggagggagag

SEQ ID NO: 18478 - DNA, 20 bp, Homo sapiens
tggagagggaggcagaggag

SEQ ID NO: 18479 - DNA, 20 bp, Homo sapiens
tggatagagaggggagaggg

SEQ ID NO: 18480 - DNA, 22 bp, Homo sapiens
tgggaggaggataaagagagag

SEQ ID NO: 18481 - DNA, 20 bp, Homo sapiens
tggagggtgggaggagggag

SEQ ID NO: 18482 - DNA, 22 bp, Homo sapiens
tgggggagggaggaggaaggag

SEQ ID NO: 18483 - DNA, 21 bp, Homo sapiens
tggtggagggaggggacagag

SEQ ID NO: 18484 - DNA, 18 bp, Homo sapiens
tggaagaaggaaggaggg

SEQ ID NO: 18485 - DNA, 18 bp, Homo sapiens
tggaggggagggacagag

SEQ ID NO: 18486 - DNA, 23 bp, Homo sapiens
gggagagggcagaggggagggag

SEQ ID NO: 18487 - DNA, 23 bp, Homo sapiens
ggaggagggaggggaagggagag

SEQ ID NO: 18488 - DNA, 21 bp, Homo sapiens
tggcagaggttggggagagag

SEQ ID NO: 18489 - DNA, 20 bp, Homo sapiens
tggaaaagctagggagggag

SEQ ID NO: 18490 - DNA, 18 bp, Homo sapiens
agagcagggagggagaga

SEQ ID NO: 18491 - DNA, 18 bp, Homo sapiens
gagaaggggagggagaga

SEQ ID NO: 18492 - DNA, 20 bp, Homo sapiens
gggggagggagactggggag

SEQ ID NO: 18493 - DNA, 20 bp, Homo sapiens
tggaagaggcgggggaggag

SEQ ID NO: 18494 - DNA, 18 bp, Homo sapiens
tggaagagggaggtagag

SEQ ID NO: 18495 - DNA, 18 bp, Homo sapiens
gggagagggagggaggga

SEQ ID NO: 18496 - DNA, 21 bp, Homo sapiens
tggaagagggggtgtctggag

SEQ ID NO: 18497 - DNA, 18 bp, Homo sapiens
tggaagaggtagagaggg

SEQ ID NO: 18498 - DNA, 25 bp, Homo sapiens
ggaagggggaggcccgctgggagag

SEQ ID NO: 18499 - DNA, 23 bp, Homo sapiens
tgggggaggaaggccgcggggag

SEQ ID NO: 18500 - DNA, 19 bp, Homo sapiens
tgggagaaggagaggaggg

SEQ ID NO: 18501 - DNA, 23 bp, Homo sapiens
tgggagagggatagaggagggag

SEQ ID NO: 18502 - DNA, 26 bp, Homo sapiens
ggaagaaagggagggagggagggagc

SEQ ID NO: 18503 - DNA, 21 bp, Homo sapiens
gggagggagggagggagggag

SEQ ID NO: 18504 - DNA, 20 bp, Homo sapiens
tggaagaagggttgggaggg

SEQ ID NO: 18505 - DNA, 21 bp, Homo sapiens
tggaggggaggtcagggagag

SEQ ID NO: 18506 - DNA, 25 bp, Homo sapiens
gggagagcaagagggagggagagag

SEQ ID NO: 18507 - DNA, 17 bp, Homo sapiens
aggggtgggagggagag

SEQ ID NO: 18508 - DNA, 25 bp, Homo sapiens
tgggggatggggggaaggaagagag

SEQ ID NO: 18509 - DNA, 22 bp, Homo sapiens
ggaaggggagggaaagagagag

SEQ ID NO: 18510 - DNA, 22 bp, Homo sapiens
ggaagaggccatggggagagag

SEQ ID NO: 18511 - DNA, 21 bp, Homo sapiens
ggaaggaagggagggagggag

SEQ ID NO: 18512 - DNA, 17 bp, Homo sapiens
tggaagagcagggaggg

SEQ ID NO: 18513 - DNA, 18 bp, Homo sapiens
ggaagggaagggagagag

SEQ ID NO: 18514 - DNA, 18 bp, Homo sapiens
tgggaggggaggagggag

SEQ ID NO: 18515 - DNA, 21 bp, Homo sapiens
tgggagggaggttggagggag

SEQ ID NO: 18516 - DNA, 21 bp, Homo sapiens
tgggagagggagggagtaaag

SEQ ID NO: 18517 - DNA, 18 bp, Homo sapiens
gggagccgggggagggag

SEQ ID NO: 18518 - DNA, 22 bp, Homo sapiens
ggaggagggaggaaacggggag

SEQ ID NO: 18519 - DNA, 19 bp, Homo sapiens
tggagagaggcggggaggg

SEQ ID NO: 18520 - DNA, 22 bp, Homo sapiens
gggagagggagaaggaggggag

SEQ ID NO: 18521 - DNA, 23 bp, Homo sapiens
tgggagagggagggagggaagag

SEQ ID NO: 18522 - DNA, 18 bp, Homo sapiens
tgggagagggagggaggg

SEQ ID NO: 18523 - DNA, 20 bp, Homo sapiens
tggagggggaggggagagag

SEQ ID NO: 18524 - DNA, 21 bp, Homo sapiens
gaagagggacagaggggagag

SEQ ID NO: 18525 - DNA, 20 bp, Homo sapiens
gggagggggaagggagagag

SEQ ID NO: 18526 - DNA, 21 bp, Homo sapiens
ggaagggagagagggagagag

SEQ ID NO: 18527 - DNA, 21 bp, Homo sapiens
tggcaagaggaagggggggag

SEQ ID NO: 18528 - DNA, 22 bp, Homo sapiens
tggaggagggaggtctggggag

SEQ ID NO: 18529 - DNA, 25 bp, Homo sapiens
tggagagggagggccagacagggag

SEQ ID NO: 18530 - DNA, 19 bp, Homo sapiens
gggagagggagagggagag

SEQ ID NO: 18531 - DNA, 17 bp, Homo sapiens
gggagagggagagggag

SEQ ID NO: 18532 - DNA, 21 bp, Homo sapiens
tggatagaggggtgaggagag

SEQ ID NO: 18533 - DNA, 119 bp, Human herpesvirus 2
gctgtggcccccttcgcgatgccgccgctgccgtcccggtctccgccgcgcagccggtgtgcccctggtgcggcggcgaccgggacgccggccctttatgtgcgcgaggaacggcccgc

SEQ ID NO: 18534 - DNA, 24 bp, Human herpesvirus 2
tgtggcccccttcgcgatgccgcc

SEQ ID NO: 18535 - DNA, 18 bp, Homo sapiens
gtggctcttcagtgctgc

SEQ ID NO: 18536 - DNA, 20 bp, Homo sapiens
tgggtccccttcgccggatg

SEQ ID NO: 18537 - DNA, 19 bp, Homo sapiens
tggcccccttccccactgc

SEQ ID NO: 18538 - DNA, 20 bp, Homo sapiens
tgtgccccccttcttctgcc

SEQ ID NO: 18539 - DNA, 22 bp, Homo sapiens
gtggccccctctctgtgctgcc

SEQ ID NO: 18540 - DNA, 21 bp, Homo sapiens
tgtggccccctcgagcttgcc

SEQ ID NO: 18541 - DNA, 17 bp, Homo sapiens
tgtggccccctcgtgcc

SEQ ID NO: 18542 - DNA, 16 bp, Homo sapiens
tgtggccctctttgcc

SEQ ID NO: 18543 - DNA, 20 bp, Homo sapiens
tgtggtccttgtgcggccgc

SEQ ID NO: 18544 - DNA, 21 bp, Homo sapiens
tgtggccctcattctgcctgc

SEQ ID NO: 18545 - DNA, 18 bp, Homo sapiens
tggggcccctccgtgccg

SEQ ID NO: 18546 - DNA, 19 bp, Homo sapiens
tgtggccccctttctgagc

SEQ ID NO: 18547 - DNA, 21 bp, Homo sapiens
tgtggccctttctgcacctgc

SEQ ID NO: 18548 - DNA, 24 bp, Homo sapiens
tggggttccctccacggtgctgcc

SEQ ID NO: 18549 - DNA, 17 bp, Homo sapiens
tggtccccttcgaccgc

SEQ ID NO: 18550 - DNA, 21 bp, Homo sapiens
tgtagttccagaagatgccgc

SEQ ID NO: 18551 - DNA, 17 bp, Homo sapiens
tggctcctccgtgccgc

SEQ ID NO: 18552 - DNA, 27 bp, Homo sapiens
tgtggccccttcctgtcggcggcatcg

SEQ ID NO: 18553 - DNA, 20 bp, Homo sapiens
tgtggccctttcctcttgcc

SEQ ID NO: 18554 - DNA, 22 bp, Homo sapiens
tgtggccctttcctggcccgcc

SEQ ID NO: 18555 - DNA, 18 bp, Homo sapiens
tgtggccccgttgctgcc

SEQ ID NO: 18556 - DNA, 18 bp, Homo sapiens
tgggctcccttcaccgcc

SEQ ID NO: 18557 - DNA, 107 bp, Ictalurid herpesvirus 1
cgcggctcgatccgggtcctccgcggtcgagactctcgggacgcgcccgatcgcgcgagctccccgggttcgacacccggagagtcccggatcgcgaaccggccgcg

SEQ ID NO: 18558 - DNA, 24 bp, Ictalurid herpesvirus 1
tccccgggttcgacacccggagag

SEQ ID NO: 18559 - DNA, 16 bp, Homo sapiens
ggcatcgcccggagag

SEQ ID NO: 18560 - DNA, 18 bp, Homo sapiens
tccccgggtgtgacagag

SEQ ID NO: 18561 - DNA, 19 bp, Homo sapiens
tccccaggtaactctggag

SEQ ID NO: 18562 - DNA, 20 bp, Homo sapiens
ccgatgacgcgcccggagag

SEQ ID NO: 18563 - DNA, 21 bp, Homo sapiens
tccttggtgacctccggagag

SEQ ID NO: 18564 - DNA, 20 bp, Homo sapiens
caactctgacgcccggggag

SEQ ID NO: 18565 - DNA, 21 bp, Homo sapiens
ccccagccggtgcccggagag

SEQ ID NO: 18566 - DNA, 20 bp, Homo sapiens
tccccgggtctggccggtag

SEQ ID NO: 18567 - DNA, 22 bp, Homo sapiens
tccccggggggcacctggggag

SEQ ID NO: 18568 - DNA, 22 bp, Homo sapiens
ccccgggtttgacaagggggag

SEQ ID NO: 18569 - DNA, 23 bp, Homo sapiens
tccaccggagaacacttggggag

SEQ ID NO: 18570 - DNA, 22 bp, Homo sapiens
ccctggttagctccccggagag

SEQ ID NO: 18571 - DNA, 19 bp, Homo sapiens
cccaaagacacctggagag

SEQ ID NO: 18572 - DNA, 22 bp, Homo sapiens
tccccagggttcgggggcggag

SEQ ID NO: 18573 - DNA, 21 bp, Homo sapiens
tccccaggtctgagcctggag

SEQ ID NO: 18574 - DNA, 16 bp, Homo sapiens
cccccgggccgcccgg

SEQ ID NO: 18575 - DNA, 18 bp, Homo sapiens
tccccgggctgctcggag

SEQ ID NO: 18576 - DNA, 90 bp, Chimpanzee cytomegalovirus
tcaccttccccgtcatctctaccaagccctcggtagtcagcaaccatcacctgacgcccgaacggctcttcttccacccggggctggtga

SEQ ID NO: 18577 - DNA, 24 bp, Chimpanzee cytomegalovirus
aagccctcggtagtcagcaaccat

SEQ ID NO: 18578 - DNA, 23 bp, Homo sapiens
aaccctttggttcaagcaaccat

SEQ ID NO: 18579 - DNA, 18 bp, Homo sapiens
agccctcggtgcatggca

SEQ ID NO: 18580 - DNA, 18 bp, Homo sapiens
aagcccccggtgttcaac

SEQ ID NO: 18581 - DNA, 21 bp, Homo sapiens
gccctcagccagggagtggcc

SEQ ID NO: 18582 - DNA, 21 bp, Homo sapiens
ccctggtgcagccccggccat

SEQ ID NO: 18583 - DNA, 22 bp, Homo sapiens
aagctctcggtagtccagccac

SEQ ID NO: 18584 - DNA, 21 bp, Homo sapiens
ccctcagtgctcggcagtcat

SEQ ID NO: 18585 - DNA, 21 bp, Homo sapiens
agccctgagaagtcagcagcc

SEQ ID NO: 18586 - DNA, 26 bp, Homo sapiens
aagtccccggtagccgggaggcggcc

SEQ ID NO: 18587 - DNA, 19 bp, Homo sapiens
aaaccctcggtggtcgaca

SEQ ID NO: 18588 - DNA, 19 bp, Homo sapiens
aaccccttggtggtccaca

SEQ ID NO: 18589 - DNA, 18 bp, Homo sapiens
tcagaagtcagcagccat

SEQ ID NO: 18590 - DNA, 15 bp, Homo sapiens
gcctcacagcaacca

SEQ ID NO: 18591 - DNA, 21 bp, Homo sapiens
gctgacagagtcagcaaccat

SEQ ID NO: 18592 - DNA, 22 bp, Homo sapiens
agctcctcggctgggcggccat

SEQ ID NO: 18593 - DNA, 21 bp, Homo sapiens
cccggattagtcagcaaccat

SEQ ID NO: 18594 - DNA, 73 bp, Chimpanzee cytomegalovirus
tgttcttcctctgcctctacgtctacagccccaccttcttcttcgaacaccggcggaggcagatcttggagca

SEQ ID NO: 18595 - DNA, 24 bp, Chimpanzee cytomegalovirus
cctctgcctctacgtctacagccc

SEQ ID NO: 18596 - DNA, 18 bp, Homo sapiens
cctctgcctgctgcagcc

SEQ ID NO: 18597 - DNA, 19 bp, Homo sapiens
tctgccttcataggcagcc

SEQ ID NO: 18598 - DNA, 19 bp, Homo sapiens
tctgcctctgatcaggccc

SEQ ID NO: 18599 - DNA, 19 bp, Homo sapiens
ctgctgcctctgggtggcc

SEQ ID NO: 18600 - DNA, 19 bp, Homo sapiens
ctgctgcctctggctggcc

SEQ ID NO: 18601 - DNA, 22 bp, Homo sapiens
cctctgccatcttggcgcggcc

SEQ ID NO: 18602 - DNA, 23 bp, Homo sapiens
ctctgcctctgccgccacatggc

SEQ ID NO: 18603 - DNA, 20 bp, Homo sapiens
cccctgccttcgtctgcagc

SEQ ID NO: 18604 - DNA, 17 bp, Homo sapiens
cctctgccctgtgtcac

SEQ ID NO: 18605 - DNA, 20 bp, Homo sapiens
cctctgcctctgcctctgcc

SEQ ID NO: 18606 - DNA, 22 bp, Homo sapiens
cctctccctctcagcacagccc

SEQ ID NO: 18607 - DNA, 20 bp, Homo sapiens
cctgcctctgccaggcggcc

SEQ ID NO: 18608 - DNA, 21 bp, Homo sapiens
ctctaccttccatatgtagcc

SEQ ID NO: 18609 - DNA, 22 bp, Homo sapiens
cccctgcctgagcctgtggtcc

SEQ ID NO: 18610 - DNA, 22 bp, Homo sapiens
ccttttctctggagcacagccc

SEQ ID NO: 18611 - DNA, 20 bp, Homo sapiens
cctcgcctggcagctacagc

SEQ ID NO: 18612 - DNA, 24 bp, Homo sapiens
ctctgcctctgtcttcacacggcc

SEQ ID NO: 18613 - DNA, 16 bp, Homo sapiens
ctctgccctacgtagc

SEQ ID NO: 18614 - DNA, 20 bp, Homo sapiens
ctctgcctctcctggggccc

SEQ ID NO: 18615 - DNA, 17 bp, Homo sapiens
cctctgccactaccagc

SEQ ID NO: 18616 - DNA, 20 bp, Homo sapiens
ctctgcctgtgcccagggcc

SEQ ID NO: 18617 - DNA, 19 bp, Homo sapiens
cctgctgtccgtctacagc

SEQ ID NO: 18618 - DNA, 24 bp, Homo sapiens
cctctgccttctgctcctccagcc

SEQ ID NO: 18619 - DNA, 22 bp, Homo sapiens
ctgtgcctctaacatgtagtcc

SEQ ID NO: 18620 - DNA, 23 bp, Homo sapiens
ccgctgcctccgcgactgcggcc

SEQ ID NO: 18621 - DNA, 22 bp, Homo sapiens
cctctgcctctcacagaagccc

SEQ ID NO: 18622 - DNA, 19 bp, Homo sapiens
cctctgccccagtgtggcc

SEQ ID NO: 18623 - DNA, 19 bp, Homo sapiens
ccgctgcctcttcatgcag

SEQ ID NO: 18624 - DNA, 17 bp, Homo sapiens
ctttcctctacccacag

SEQ ID NO: 18625 - DNA, 21 bp, Homo sapiens
ctctgccttcacacaaagccc

SEQ ID NO: 18626 - DNA, 18 bp, Homo sapiens
tctgcttatccccacagc

SEQ ID NO: 18627 - DNA, 17 bp, Homo sapiens
cctctgcctcttctcag

SEQ ID NO: 18628 - DNA, 18 bp, Homo sapiens
tctgcctctgtcccagcc

SEQ ID NO: 18629 - DNA, 19 bp, Homo sapiens
tctgcccctgtgcaggccc

SEQ ID NO: 18630 - DNA, 21 bp, Homo sapiens
cctctgcccttggtcctggcc

SEQ ID NO: 18631 - DNA, 21 bp, Homo sapiens
ccttctgtccctctctacagc

SEQ ID NO: 18632 - DNA, 19 bp, Homo sapiens
cctccgctcttctgcagcc

SEQ ID NO: 18633 - DNA, 18 bp, Homo sapiens
ctctgcctttttccagcc

SEQ ID NO: 18634 - DNA, 21 bp, Homo sapiens
cctcttttctgctgtcagccc

SEQ ID NO: 18635 - DNA, 15 bp, Homo sapiens
cctgcctctgtcagc

SEQ ID NO: 18636 - DNA, 22 bp, Homo sapiens
ctgctgcctccccatgcagtcc

SEQ ID NO: 18637 - DNA, 23 bp, Homo sapiens
cctctgcctgtgccctccagccc

SEQ ID NO: 18638 - DNA, 16 bp, Homo sapiens
tcttcctctcacagcc

SEQ ID NO: 18639 - DNA, 19 bp, Homo sapiens
cctctgccatgctgcagcc

SEQ ID NO: 18640 - DNA, 20 bp, Homo sapiens
ctctgcctccgctgcagtcc

SEQ ID NO: 18641 - DNA, 20 bp, Homo sapiens
ctctgcccttcctgtagtcc

SEQ ID NO: 18642 - DNA, 18 bp, Homo sapiens
ctctgcctctgttttcag

SEQ ID NO: 18643 - DNA, 17 bp, Homo sapiens
cctctgccctgtctggc

SEQ ID NO: 18644 - DNA, 17 bp, Homo sapiens
ctctcccttctacagcc

SEQ ID NO: 18645 - DNA, 20 bp, Homo sapiens
cctctgtcactgtgtacggc

SEQ ID NO: 18646 - DNA, 21 bp, Homo sapiens
ccttgcctctggtctcagccc

SEQ ID NO: 18647 - DNA, 16 bp, Homo sapiens
ccctgcctctgccagc

SEQ ID NO: 18648 - DNA, 24 bp, Homo sapiens
cctctacctctacggtgccaggcc

SEQ ID NO: 18649 - DNA, 22 bp, Homo sapiens
ccatttgtcaacctctacagcc

SEQ ID NO: 18650 - DNA, 20 bp, Homo sapiens
cctctccctctatgaagtcc

SEQ ID NO: 18651 - DNA, 22 bp, Homo sapiens
cctctgcccctgagcctggccc

SEQ ID NO: 18652 - DNA, 20 bp, Homo sapiens
cctttgtttctacaccagcc

SEQ ID NO: 18653 - DNA, 16 bp, Homo sapiens
cctctgccctatcagc

SEQ ID NO: 18654 - DNA, 17 bp, Homo sapiens
cctctgccctgcctcag

SEQ ID NO: 18655 - DNA, 21 bp, Homo sapiens
ccctgcctcctcctacagccc

SEQ ID NO: 18656 - DNA, 20 bp, Homo sapiens
ctctgcctctgtctgggccc

SEQ ID NO: 18657 - DNA, 21 bp, Homo sapiens
ctctgccgctacacctccggc

SEQ ID NO: 18658 - DNA, 18 bp, Homo sapiens
tctgctttagccacagcc

SEQ ID NO: 18659 - DNA, 21 bp, Homo sapiens
tctgcctccctgttatagtcc

SEQ ID NO: 18660 - DNA, 22 bp, Homo sapiens
cctccgcctctgctgtagcagc

SEQ ID NO: 18661 - DNA, 19 bp, Homo sapiens
cctctccctctggccagcc

SEQ ID NO: 18662 - DNA, 16 bp, Homo sapiens
cctctgcctgttaccc

SEQ ID NO: 18663 - DNA, 20 bp, Homo sapiens
cctgagcgtacgtctacagc

SEQ ID NO: 18664 - DNA, 23 bp, Homo sapiens
cctctgccctctgtgccctcagc

SEQ ID NO: 18665 - DNA, 24 bp, Homo sapiens
cctctgcccctcgggtttgcagcc

SEQ ID NO: 18666 - DNA, 23 bp, Homo sapiens
cctctacctctgctgtgtggccc

SEQ ID NO: 18667 - DNA, 16 bp, Homo sapiens
cctgcctctgtcagcc

SEQ ID NO: 18668 - DNA, 19 bp, Homo sapiens
cctctgcctctgcccagcc

SEQ ID NO: 18669 - DNA, 18 bp, Homo sapiens
ctctgccctactcaggcc

SEQ ID NO: 18670 - DNA, 19 bp, Homo sapiens
cctcagcctcttgagtagc

SEQ ID NO: 18671 - DNA, 21 bp, Homo sapiens
cctctctttctgttctcagcc

SEQ ID NO: 18672 - DNA, 20 bp, Homo sapiens
cctcagcttctgcctcggcc

SEQ ID NO: 18673 - DNA, 20 bp, Homo sapiens
cctctgcctcactggtggcc

SEQ ID NO: 18674 - DNA, 21 bp, Homo sapiens
cctctcttcccagtctacagc

SEQ ID NO: 18675 - DNA, 23 bp, Homo sapiens
cctctgcctcctccagtgcagcc

SEQ ID NO: 18676 - DNA, 21 bp, Homo sapiens
cctctgccctggacagcagcc

SEQ ID NO: 18677 - DNA, 20 bp, Homo sapiens
tgcctctaaagtttctacag

SEQ ID NO: 18678 - DNA, 19 bp, Homo sapiens
cctctgcctctctgtcagc

SEQ ID NO: 18679 - DNA, 21 bp, Homo sapiens
cctcttctcaccttgcagccc

SEQ ID NO: 18680 - DNA, 21 bp, Homo sapiens
cctctgcccctttggcagccc

SEQ ID NO: 18681 - DNA, 20 bp, Homo sapiens
tctgcctcctggccccagcc

SEQ ID NO: 18682 - DNA, 23 bp, Homo sapiens
cctctgcctttgagtttgcaccc

SEQ ID NO: 18683 - DNA, 18 bp, Homo sapiens
ctctgccttctcatggcc

SEQ ID NO: 18684 - DNA, 19 bp, Homo sapiens
ctccgcctctacaccagcc

SEQ ID NO: 18685 - DNA, 19 bp, Homo sapiens
cctcgcctgcccctgcagc

SEQ ID NO: 18686 - DNA, 18 bp, Homo sapiens
cctcgcctcctcttgcag

SEQ ID NO: 18687 - DNA, 17 bp, Homo sapiens
cctgcctctgccccagc

SEQ ID NO: 18688 - DNA, 22 bp, Homo sapiens
cctctacctcctcgctgcggcc

SEQ ID NO: 18689 - DNA, 23 bp, Homo sapiens
ctctgcctattacgacaaaagcc

SEQ ID NO: 18690 - DNA, 19 bp, Homo sapiens
ctctgcatctacaaagcag

SEQ ID NO: 18691 - DNA, 22 bp, Homo sapiens
cctatgtctctgcaaacagtcc

SEQ ID NO: 18692 - DNA, 16 bp, Homo sapiens
ctctgcctcctgcagc

SEQ ID NO: 18693 - DNA, 20 bp, Homo sapiens
tctgccccacccctgtagcc

SEQ ID NO: 18694 - DNA, 22 bp, Homo sapiens
cctctgcctttgggcacagccc

SEQ ID NO: 18695 - DNA, 19 bp, Homo sapiens
cctctcctttctgcagtct

SEQ ID NO: 18696 - DNA, 18 bp, Homo sapiens
cctctgccctcagcagcc

SEQ ID NO: 18697 - DNA, 20 bp, Homo sapiens
ctctgcctgctgcacagccc

SEQ ID NO: 18698 - DNA, 19 bp, Homo sapiens
ctctgcctatgcccagtcc

SEQ ID NO: 18699 - DNA, 16 bp, Homo sapiens
cctctgccctgccagc

SEQ ID NO: 18700 - DNA, 17 bp, Homo sapiens
ctctgcctctcgttagc

SEQ ID NO: 18701 - DNA, 19 bp, Homo sapiens
ctctgcctctatggccagc

SEQ ID NO: 18702 - DNA, 25 bp, Homo sapiens
ccactgcctctaaggcatgcagtcc

SEQ ID NO: 18703 - DNA, 20 bp, Homo sapiens
tctgcctctgtcttggcagc

SEQ ID NO: 18704 - DNA, 23 bp, Homo sapiens
cctctgttctgcaaagccagccc

SEQ ID NO: 18705 - DNA, 18 bp, Homo sapiens
cctctgcctccacgttcc

SEQ ID NO: 18706 - DNA, 20 bp, Homo sapiens
ctctgcctctggtcatgccc

SEQ ID NO: 18707 - DNA, 22 bp, Homo sapiens
ctctgcctctgtccctgggtcc

SEQ ID NO: 18708 - DNA, 21 bp, Homo sapiens
ctctgcctcttttagcagccc

SEQ ID NO: 18709 - DNA, 19 bp, Homo sapiens
cctctgcctctttgagtct

SEQ ID NO: 18710 - DNA, 20 bp, Homo sapiens
cctctccctctccagcagcc

SEQ ID NO: 18711 - DNA, 20 bp, Homo sapiens
ccctgcctctgccgcagtcc

SEQ ID NO: 18712 - DNA, 18 bp, Homo sapiens
ctctgccctcgggtagcc

SEQ ID NO: 18713 - DNA, 20 bp, Homo sapiens
ctctaccctctctgcagccc

SEQ ID NO: 18714 - DNA, 20 bp, Homo sapiens
ctgctgcctctcgccacagc

SEQ ID NO: 18715 - DNA, 18 bp, Homo sapiens
ctctgcctcagtgttaca

SEQ ID NO: 18716 - DNA, 20 bp, Homo sapiens
cctctcctctgcactgtggc

SEQ ID NO: 18717 - DNA, 22 bp, Homo sapiens
tctgctgttgtcttcacagccc

SEQ ID NO: 18718 - DNA, 29 bp, Homo sapiens
cctctgccctctgcagactctctgcagcc

SEQ ID NO: 18719 - DNA, 23 bp, Homo sapiens
cctctggtctctaaaccacagcc

SEQ ID NO: 18720 - DNA, 19 bp, Homo sapiens
ctctgcctccgttgcagcc

SEQ ID NO: 18721 - DNA, 20 bp, Homo sapiens
ccctgcctctgcctcagccc

SEQ ID NO: 18722 - DNA, 19 bp, Homo sapiens
tctgcctctagccccggcc

SEQ ID NO: 18723 - DNA, 21 bp, Homo sapiens
cctctgccgctgcacgtggcc

SEQ ID NO: 18724 - DNA, 19 bp, Homo sapiens
cctctgctcaccttgcagc

SEQ ID NO: 18725 - DNA, 22 bp, Homo sapiens
ctctgcctttcaggaacagccc

SEQ ID NO: 18726 - DNA, 22 bp, Homo sapiens
cctctccctctccggggcagcc

SEQ ID NO: 18727 - DNA, 17 bp, Homo sapiens
ctctgcctcctgcggcc

SEQ ID NO: 18728 - DNA, 18 bp, Homo sapiens
tctgcctctcacccacag

SEQ ID NO: 18729 - DNA, 68 bp, Borna disease virus
ggcaggaataaaccgtaccgaccagtctcttaaaaaccctctcctcggaacagaggtctctttctgcc

SEQ ID NO: 18730 - DNA, 21 bp, Borna disease virus
gaacagaggtctctttctgcc

SEQ ID NO: 18731 - DNA, 19 bp, Homo sapiens
gaacaaagattactttctg

SEQ ID NO: 18732 - DNA, 17 bp, Homo sapiens
gaatagaggtttctgcc

SEQ ID NO: 18733 - DNA, 20 bp, Homo sapiens
gaacagaggctccctctgcc

SEQ ID NO: 18734 - DNA, 16 bp, Homo sapiens
gaacaaagtcttctgc

SEQ ID NO: 18735 - DNA, 15 bp, Homo sapiens
gaaagaagtttctgc

SEQ ID NO: 18736 - DNA, 18 bp, Homo sapiens
gaacagaaggtagcttgc

SEQ ID NO: 18737 - DNA, 19 bp, Homo sapiens
aaacgtctgcctctttctg

SEQ ID NO: 18738 - DNA, 19 bp, Homo sapiens
caaagatgtttctttctgc

SEQ ID NO: 18739 - DNA, 22 bp, Homo sapiens
aacagccacccctttttctgcc

SEQ ID NO: 18740 - DNA, 20 bp, Homo sapiens
gaacggctgatttttctgcc

SEQ ID NO: 18741 - DNA, 15 bp, Homo sapiens
aaacagaatttctgc

SEQ ID NO: 18742 - DNA, 19 bp, Homo sapiens
acaaaacatcctttctgcc

SEQ ID NO: 18743 - DNA, 20 bp, Homo sapiens
gaaaagagtgagcttctgcc

SEQ ID NO: 18744 - DNA, 19 bp, Homo sapiens
aaacacccgtctttctgcc

SEQ ID NO: 18745 - DNA, 18 bp, Homo sapiens
aaacctgatctctttctg

SEQ ID NO: 18746 - DNA, 17 bp, Homo sapiens
caggaggtccttctgcc

SEQ ID NO: 18747 - DNA, 16 bp, Homo sapiens
gaacagagtgccctgc

SEQ ID NO: 18748 - DNA, 20 bp, Homo sapiens
gacagaggctgttctttctg

SEQ ID NO: 18749 - DNA, 18 bp, Homo sapiens
cagcagataccctttctg

SEQ ID NO: 18750 - DNA, 17 bp, Homo sapiens
gacggagtctctttctg

SEQ ID NO: 18751 - DNA, 19 bp, Homo sapiens
cagacagtttctttctgcc

SEQ ID NO: 18752 - DNA, 18 bp, Homo sapiens
gaacacaggtctcctgcc

SEQ ID NO: 18753 - DNA, 15 bp, Homo sapiens
cagaagtctcctgcc

SEQ ID NO: 18754 - DNA, 17 bp, Homo sapiens
gaacagggcctttctgc

SEQ ID NO: 18755 - DNA, 19 bp, Homo sapiens
aagttctcttctttctgcc

SEQ ID NO: 18756 - DNA, 18 bp, Homo sapiens
aacagagtctctttttgc

SEQ ID NO: 18757 - DNA, 17 bp, Homo sapiens
cagaggtctcgtctgcc

SEQ ID NO: 18758 - DNA, 21 bp, Homo sapiens
acagaagtcctgtggtctgcc

SEQ ID NO: 18759 - DNA, 17 bp, Homo sapiens
ggacagaactttctgcc

SEQ ID NO: 18760 - DNA, 18 bp, Homo sapiens
gaacaatgtctctttctg

SEQ ID NO: 18761 - DNA, 18 bp, Homo sapiens
caggggccacctcctgcc

SEQ ID NO: 18762 - DNA, 15 bp, Homo sapiens
cagaacctttctgcc

SEQ ID NO: 18763 - DNA, 16 bp, Homo sapiens
gaacagaggtctgtgc

SEQ ID NO: 18764 - DNA, 18 bp, Homo sapiens
caggggtccacctctgcc

SEQ ID NO: 18765 - DNA, 23 bp, Homo sapiens
cagaggtccctgcagctttctgc

SEQ ID NO: 18766 - DNA, 19 bp, Homo sapiens
aacagaggtctagaatgcc

SEQ ID NO: 18767 - DNA, 20 bp, Homo sapiens
gacacaaatttttttctgcc

SEQ ID NO: 18768 - DNA, 19 bp, Homo sapiens
agaagccattttttctgcc

SEQ ID NO: 18769 - DNA, 20 bp, Homo sapiens
gaacagcaattctttctgcc

SEQ ID NO: 18770 - DNA, 16 bp, Homo sapiens
acagaggtctccagcc

SEQ ID NO: 18771 - DNA, 18 bp, Homo sapiens
caggggtcccccatctgc

SEQ ID NO: 18772 - DNA, 16 bp, Homo sapiens
acagggtttttctgcc

SEQ ID NO: 18773 - DNA, 18 bp, Homo sapiens
gaatggagttcttctgcc

SEQ ID NO: 18774 - DNA, 18 bp, Homo sapiens
aaacaaaagtctttctgc

SEQ ID NO: 18775 - DNA, 19 bp, Homo sapiens
ggaaggaaccatttctgcc

SEQ ID NO: 18776 - DNA, 18 bp, Homo sapiens
gaacagagtctcgtactg

SEQ ID NO: 18777 - DNA, 20 bp, Homo sapiens
aacatcttctctctttctgc

SEQ ID NO: 18778 - DNA, 15 bp, Homo sapiens
gaacagagattttcc

SEQ ID NO: 18779 - DNA, 17 bp, Homo sapiens
gaactgagccccttctg

SEQ ID NO: 18780 - DNA, 19 bp, Homo sapiens
gagcagcaggtctcctgcc

SEQ ID NO: 18781 - DNA, 15 bp, Homo sapiens
cagaggtcccctgcc

SEQ ID NO: 18782 - DNA, 17 bp, Homo sapiens
aacagagggcttctgcc

SEQ ID NO: 18783 - DNA, 15 bp, Homo sapiens
cagaggtcccttgcc

SEQ ID NO: 18784 - DNA, 16 bp, Homo sapiens
gaacaagtcctttctg

SEQ ID NO: 18785 - DNA, 23 bp, Homo sapiens
gaacaaatgcaacctttttctgc

SEQ ID NO: 18786 - DNA, 20 bp, Homo sapiens
gagcatctggttctttctgc

SEQ ID NO: 18787 - DNA, 15 bp, Homo sapiens
gaacaaaggtcttgc

SEQ ID NO: 18788 - DNA, 19 bp, Homo sapiens
gaaaaactctttttctgcc

SEQ ID NO: 18789 - DNA, 17 bp, Homo sapiens
aaacagaggtcgtctgc

SEQ ID NO: 18790 - DNA, 18 bp, Homo sapiens
ggacagtaccctttctgc

SEQ ID NO: 18791 - DNA, 21 bp, Homo sapiens
gaagaggttcttttttctgcc

SEQ ID NO: 18792 - DNA, 19 bp, Homo sapiens
gaacagagggtactttgcc

SEQ ID NO: 18793 - DNA, 21 bp, Homo sapiens
gaacaaaggtttttcctcttg

SEQ ID NO: 18794 - DNA, 16 bp, Homo sapiens
gagcagagctttctgc

SEQ ID NO: 18795 - DNA, 20 bp, Homo sapiens
aaacaaataatttttctgcc

SEQ ID NO: 18796 - DNA, 19 bp, Homo sapiens
gaacagaggtacttcaatc

SEQ ID NO: 18797 - DNA, 18 bp, Homo sapiens
agggcctagctttctgcc

SEQ ID NO: 18798 - DNA, 18 bp, Homo sapiens
gaatgaaggtcccatgcc

SEQ ID NO: 18799 - DNA, 17 bp, Homo sapiens
cagtggccacctctgcc

SEQ ID NO: 18800 - DNA, 17 bp, Homo sapiens
aacaaattctttctgcc

SEQ ID NO: 18801 - DNA, 20 bp, Homo sapiens
gaacagaggtgcttgaagcc

SEQ ID NO: 18802 - DNA, 17 bp, Homo sapiens
aaacaggggtcccctgc

SEQ ID NO: 18803 - DNA, 18 bp, Homo sapiens
ggacagaggtctcctgcc

SEQ ID NO: 18804 - DNA, 21 bp, Homo sapiens
agagcccatattctttctgcc

SEQ ID NO: 18805 - DNA, 17 bp, Homo sapiens
cagagtccctacctgcc

SEQ ID NO: 18806 - DNA, 19 bp, Homo sapiens
aaacaaaaatctctttctg

SEQ ID NO: 18807 - DNA, 20 bp, Homo sapiens
gaacagaggtacttaacacc

SEQ ID NO: 18808 - DNA, 16 bp, Homo sapiens
cagagggctccctgcc

SEQ ID NO: 18809 - DNA, 20 bp, Homo sapiens
gaacaggtgtctcctttgcc

SEQ ID NO: 18810 - DNA, 21 bp, Homo sapiens
gaacatagaagaatttctgcc

SEQ ID NO: 18811 - DNA, 20 bp, Homo sapiens
gaaggggccagtctttctgc

SEQ ID NO: 18812 - DNA, 20 bp, Homo sapiens
acagaggccagacttctgcc

SEQ ID NO: 18813 - DNA, 17 bp, Homo sapiens
cagtgtctttttctgcc

SEQ ID NO: 18814 - DNA, 16 bp, Homo sapiens
gaacagagatgcctgc

SEQ ID NO: 18815 - DNA, 21 bp, Homo sapiens
gagcagcggtctctggaatgc

SEQ ID NO: 18816 - DNA, 19 bp, Homo sapiens
cagcaggggtcttcctgcc

SEQ ID NO: 18817 - DNA, 20 bp, Homo sapiens
gagatgccactctttctgcc

SEQ ID NO: 18818 - DNA, 15 bp, Homo sapiens
gaacagagactctgc

SEQ ID NO: 18819 - DNA, 19 bp, Homo sapiens
gaacaggggtctctccatg

SEQ ID NO: 18820 - DNA, 17 bp, Homo sapiens
gacagaggttgttttgc

SEQ ID NO: 18821 - DNA, 17 bp, Homo sapiens
cagagccaccttctgcc

SEQ ID NO: 18822 - DNA, 19 bp, Homo sapiens
gagcagggctacccctgcc

SEQ ID NO: 18823 - DNA, 17 bp, Homo sapiens
gaacagaggctctgact

SEQ ID NO: 18824 - DNA, 18 bp, Homo sapiens
ggaagggacccttctgcc

SEQ ID NO: 18825 - DNA, 17 bp, Homo sapiens
gacagaggcagtctgcc

SEQ ID NO: 18826 - DNA, 18 bp, Homo sapiens
gaacagagataacctgcc

SEQ ID NO: 18827 - DNA, 21 bp, Homo sapiens
gatcagcatgtttctttctgc

SEQ ID NO: 18828 - DNA, 20 bp, Homo sapiens
gaaatagatatctttctgcc

SEQ ID NO: 18829 - DNA, 15 bp, Homo sapiens
acagagattctttgc

SEQ ID NO: 18830 - DNA, 18 bp, Homo sapiens
gacggagaggcctctgcc

SEQ ID NO: 18831 - DNA, 15 bp, Homo sapiens
gaacagagtttcacc

SEQ ID NO: 18832 - DNA, 21 bp, Homo sapiens
gaagagaatgacatttctgcc

SEQ ID NO: 18833 - DNA, 21 bp, Homo sapiens
gaacaaagcagcccctttctg

SEQ ID NO: 18834 - DNA, 16 bp, Homo sapiens
aacagtgcctttctgc

SEQ ID NO: 18835 - DNA, 18 bp, Homo sapiens
gaacagaagtcttcagtc

SEQ ID NO: 18836 - DNA, 20 bp, Homo sapiens
gaagggtcagactttctgcc

SEQ ID NO: 18837 - DNA, 19 bp, Homo sapiens
gagcagaagtcacttctgc

SEQ ID NO: 18838 - DNA, 18 bp, Homo sapiens
aaacagaggactcttctg

SEQ ID NO: 18839 - DNA, 20 bp, Homo sapiens
acagtttctctctttctgcc

SEQ ID NO: 18840 - DNA, 17 bp, Homo sapiens
caggggtctctactgcc

SEQ ID NO: 18841 - DNA, 65 bp, Bovine immunodeficiency virus
ggcagtgggtcagaagtgtatttataatagcaatattgggaactctcactatggcaggaactgct

SEQ ID NO: 18842 - DNA, 24 bp, Bovine immunodeficiency virus
ttgggaactctcactatggcagga

SEQ ID NO: 18843 - DNA, 16 bp, Homo sapiens
ttgggaatctcatggg

SEQ ID NO: 18844 - DNA, 20 bp, Homo sapiens
ttgggaacactcctcgtagg

SEQ ID NO: 18845 - DNA, 21 bp, Homo sapiens
ttggggctctcactggtttgg

SEQ ID NO: 18846 - DNA, 23 bp, Homo sapiens
ttgggaactgctcaatattggga

SEQ ID NO: 18847 - DNA, 16 bp, Homo sapiens
ggggactctcagcagg

SEQ ID NO: 18848 - DNA, 23 bp, Homo sapiens
ttgggaattctcaccatcacaga

SEQ ID NO: 18849 - DNA, 18 bp, Homo sapiens
ggggactctcactcgggg

SEQ ID NO: 18850 - DNA, 21 bp, Homo sapiens
ttggggactctgagcctgggg

SEQ ID NO: 18851 - DNA, 24 bp, Homo sapiens
ttgggaacctggacagtggtggga

SEQ ID NO: 18852 - DNA, 23 bp, Homo sapiens
ttggaaactctcaactcaacagg

SEQ ID NO: 18853 - DNA, 18 bp, Homo sapiens
ttgggaagctgtggcagg

SEQ ID NO: 18854 - DNA, 16 bp, Homo sapiens
ttggaaactctggcag

SEQ ID NO: 18855 - DNA, 18 bp, Homo sapiens
ttgggaaccttaaccagg

SEQ ID NO: 18856 - DNA, 18 bp, Homo sapiens
ttgggaggctgtggcagg

SEQ ID NO: 18857 - DNA, 15 bp, Homo sapiens
ttgggaactctggcg

SEQ ID NO: 18858 - DNA, 21 bp, Homo sapiens
ctgggaaggactgtggcagga

SEQ ID NO: 18859 - DNA, 23 bp, Homo sapiens
ttgtgaactccaggttggcagga

SEQ ID NO: 18860 - DNA, 22 bp, Homo sapiens
ttgggaagctgagatggcagga

SEQ ID NO: 18861 - DNA, 22 bp, Homo sapiens
ttgagaacccgatgtggcagga

SEQ ID NO: 18862 - DNA, 20 bp, Homo sapiens
tgggaacttttactaaagga

SEQ ID NO: 18863 - DNA, 67 bp, Bovine immunodeficiency virus
ctgatttggatactaatgtttcaattatgcctttattggggtttgggtgaaacatctagagaattag

SEQ ID NO: 18864 - DNA, 24 bp, Bovine immunodeficiency virus
taatgtttcaattatgcctttatt

SEQ ID NO: 18865 - DNA, 15 bp, Homo sapiens
taatgtttcaagccc

SEQ ID NO: 18866 - DNA, 22 bp, Homo sapiens
taatgcttccagagcctttatt

SEQ ID NO: 18867 - DNA, 22 bp, Homo sapiens
taatgcttcaaactactttatt

SEQ ID NO: 18868 - DNA, 23 bp, Homo sapiens
atatttcagtttatgcctttatt

SEQ ID NO: 18869 - DNA, 19 bp, Homo sapiens
atgtttcaatactgacttt

SEQ ID NO: 18870 - DNA, 21 bp, Homo sapiens
gtttttaattgtgcctttatt

SEQ ID NO: 18871 - DNA, 22 bp, Homo sapiens
taatgtttcaggttcctttatt

SEQ ID NO: 18872 - DNA, 20 bp, Homo sapiens
tgtaggtatatgcctttatt

SEQ ID NO: 18873 - DNA, 23 bp, Homo sapiens
taatgtctcctgtggcctttatt

SEQ ID NO: 18874 - DNA, 20 bp, Homo sapiens
gtttcaattatgtctttatt

SEQ ID NO: 18875 - DNA, 21 bp, Homo sapiens
taatgatccaatgcctttatt

SEQ ID NO: 18876 - DNA, 62 bp, Murid herpesvirus 4
ggccccctcccgagctggggcccggatccccgacctccccggccccctcccgagctggggcc

SEQ ID NO: 18877 - DNA, 23 bp, Murid herpesvirus 4
cggccccctcccgagctggggcc

SEQ ID NO: 18878 - DNA, 20 bp, Homo sapiens
cggccccctcctcgacagct

SEQ ID NO: 18879 - DNA, 22 bp, Homo sapiens
cagcctcccaagtagctggggc

SEQ ID NO: 18880 - DNA, 21 bp, Homo sapiens
gctccctcctgaagccaggcc

SEQ ID NO: 18881 - DNA, 20 bp, Homo sapiens
ggtcccctcccacccaggcc

SEQ ID NO: 18882 - DNA, 17 bp, Homo sapiens
ggtgccctcccgagtgg

SEQ ID NO: 18883 - DNA, 19 bp, Homo sapiens
cggcccccatctcggcggc

SEQ ID NO: 18884 - DNA, 18 bp, Homo sapiens
cagccccctcccggcagc

SEQ ID NO: 18885 - DNA, 19 bp, Homo sapiens
ggccccttcctgccccgcc

SEQ ID NO: 18886 - DNA, 21 bp, Homo sapiens
cgggtcctctcccctggggcc

SEQ ID NO: 18887 - DNA, 17 bp, Homo sapiens
ggccccctcctggaagc

SEQ ID NO: 18888 - DNA, 17 bp, Homo sapiens
gcctccctcccacgggc

SEQ ID NO: 18889 - DNA, 21 bp, Homo sapiens
cagtccctgtaggctggggcc

SEQ ID NO: 18890 - DNA, 20 bp, Homo sapiens
cagcccttcaagagctgggg

SEQ ID NO: 18891 - DNA, 22 bp, Homo sapiens
ggtctcctcctgtcactggggc

SEQ ID NO: 18892 - DNA, 18 bp, Homo sapiens
cagctccttggctggggc

SEQ ID NO: 18893 - DNA, 18 bp, Homo sapiens
ccccctcccaggagggcc

SEQ ID NO: 18894 - DNA, 21 bp, Homo sapiens
ggccccctcctgagggcggcc

SEQ ID NO: 18895 - DNA, 18 bp, Homo sapiens
cggctccctcccgcccgc

SEQ ID NO: 18896 - DNA, 19 bp, Homo sapiens
cggccccctggctggggcc

SEQ ID NO: 18897 - DNA, 17 bp, Homo sapiens
cagccccctcccatggg

SEQ ID NO: 18898 - DNA, 16 bp, Homo sapiens
gcccctctcctgggac

SEQ ID NO: 18899 - DNA, 19 bp, Homo sapiens
cggcccctccctggaaacc

SEQ ID NO: 18900 - DNA, 19 bp, Homo sapiens
cggtcctcggggctggggc

SEQ ID NO: 18901 - DNA, 22 bp, Homo sapiens
cggccccccttcctcgagggcc

SEQ ID NO: 18902 - DNA, 19 bp, Homo sapiens
ggcccccttcagtttgggc

SEQ ID NO: 18903 - DNA, 17 bp, Homo sapiens
cagcccctcgctggggc

SEQ ID NO: 18904 - DNA, 19 bp, Homo sapiens
ggcctctgtccctggggcc

SEQ ID NO: 18905 - DNA, 21 bp, Homo sapiens
ggcctcttccccaccagggcc

SEQ ID NO: 18906 - DNA, 17 bp, Homo sapiens
ggccagcgagctggggc

SEQ ID NO: 18907 - DNA, 21 bp, Homo sapiens
cagccccctcctggtcttagc

SEQ ID NO: 18908 - DNA, 19 bp, Homo sapiens
ggtcccctccctgagggcc

SEQ ID NO: 18909 - DNA, 15 bp, Homo sapiens
cggccccctcccggg

SEQ ID NO: 18910 - DNA, 20 bp, Homo sapiens
ggtccccttggcctggggcc

SEQ ID NO: 18911 - DNA, 19 bp, Homo sapiens
cagttccctcccggggggc

SEQ ID NO: 18912 - DNA, 20 bp, Homo sapiens
ggtctcctagggagctgggg

SEQ ID NO: 18913 - DNA, 21 bp, Homo sapiens
ggcttcagggaggctggggcc

SEQ ID NO: 18914 - DNA, 21 bp, Homo sapiens
cggcctcccaaagtgctgggg

SEQ ID NO: 18915 - DNA, 17 bp, Homo sapiens
gcccctctcactggggc

SEQ ID NO: 18916 - DNA, 18 bp, Homo sapiens
cagctccctcccatgggc

SEQ ID NO: 18917 - DNA, 19 bp, Homo sapiens
ggcccggcggggctggggc

SEQ ID NO: 18918 - DNA, 20 bp, Homo sapiens
ggccttgtcccgagcgggac

SEQ ID NO: 18919 - DNA, 22 bp, Homo sapiens
gctctctcttgaacccggggcc

SEQ ID NO: 18920 - DNA, 21 bp, Homo sapiens
ggccccctgcttggcttggcc

SEQ ID NO: 18921 - DNA, 20 bp, Homo sapiens
cagccccctctccctggggc

SEQ ID NO: 18922 - DNA, 19 bp, Homo sapiens
ggcgccctcccgaaagggg

SEQ ID NO: 18923 - DNA, 18 bp, Homo sapiens
cctcccaaagtgctgggg

SEQ ID NO: 18924 - DNA, 21 bp, Homo sapiens
ggccttctcagcagctggggc

SEQ ID NO: 18925 - DNA, 21 bp, Homo sapiens
cggctcctcagggctggggcc

SEQ ID NO: 18926 - DNA, 20 bp, Homo sapiens
ggcccccttctggccaagct

SEQ ID NO: 18927 - DNA, 19 bp, Homo sapiens
ggtccccactcccggggcc

SEQ ID NO: 18928 - DNA, 18 bp, Homo sapiens
ggcctcgcgggctggggc

SEQ ID NO: 18929 - DNA, 20 bp, Homo sapiens
ggccttccccaagctgggcc

SEQ ID NO: 18930 - DNA, 20 bp, Homo sapiens
cgcccccctcctccggggcc

SEQ ID NO: 18931 - DNA, 18 bp, Homo sapiens
cggcccgcctcccggggc

SEQ ID NO: 18932 - DNA, 20 bp, Homo sapiens
cagcctcagaaggctggggc

SEQ ID NO: 18933 - DNA, 20 bp, Homo sapiens
cggccggagggagctggggc

SEQ ID NO: 18934 - DNA, 18 bp, Homo sapiens
cggcccccttcctgccgc

SEQ ID NO: 18935 - DNA, 20 bp, Homo sapiens
ggattcccacggctggggcc

SEQ ID NO: 18936 - DNA, 20 bp, Homo sapiens
ggcttccttctcccagggcc

SEQ ID NO: 18937 - DNA, 22 bp, Homo sapiens
gcgtcccctgggtgctggggcc

SEQ ID NO: 18938 - DNA, 18 bp, Homo sapiens
cagctccagggctggggc

SEQ ID NO: 18939 - DNA, 15 bp, Homo sapiens
ggccccagctggggc

SEQ ID NO: 18940 - DNA, 19 bp, Homo sapiens
ggcccctcctggctggggc

SEQ ID NO: 18941 - DNA, 17 bp, Homo sapiens
ggctccctccccagggc

SEQ ID NO: 18942 - DNA, 20 bp, Homo sapiens
cggcccacgacgctggggcc

SEQ ID NO: 18943 - DNA, 23 bp, Homo sapiens
cggcccccgtcgggtgttggggc

SEQ ID NO: 18944 - DNA, 20 bp, Homo sapiens
ggcccctccctgagatggcc

SEQ ID NO: 18945 - DNA, 19 bp, Homo sapiens
cgacttcctcctggagtgg

SEQ ID NO: 18946 - DNA, 18 bp, Homo sapiens
cggcctcccctcggcagc

SEQ ID NO: 18947 - DNA, 20 bp, Homo sapiens
cggcgcccggagctggggcc

SEQ ID NO: 18948 - DNA, 17 bp, Homo sapiens
cagccccctcccggggc

SEQ ID NO: 18949 - DNA, 20 bp, Homo sapiens
ggtccctcgcctctggggcc

SEQ ID NO: 18950 - DNA, 22 bp, Homo sapiens
ggtcccctccctgcagtatgcc

SEQ ID NO: 18951 - DNA, 16 bp, Homo sapiens
cgcgccccagctgggg

SEQ ID NO: 18952 - DNA, 18 bp, Homo sapiens
cggcacctctcccgaggc

SEQ ID NO: 18953 - DNA, 19 bp, Homo sapiens
gctccctcccgaggaggcc

SEQ ID NO: 18954 - DNA, 19 bp, Homo sapiens
ggccccccatcctggggcc

SEQ ID NO: 18955 - DNA, 21 bp, Homo sapiens
ggatccctcctgtctggggcc

SEQ ID NO: 18956 - DNA, 22 bp, Homo sapiens
ggcccccttcttgagcagggcc

SEQ ID NO: 18957 - DNA, 17 bp, Homo sapiens
cagctccctcccggggg

SEQ ID NO: 18958 - DNA, 22 bp, Homo sapiens
cggcccccacctgcgtgccggg

SEQ ID NO: 18959 - DNA, 23 bp, Homo sapiens
ggctccacgctccgggctggggc

SEQ ID NO: 18960 - DNA, 26 bp, Homo sapiens
gccccctcccggcccgcgctggggcc

SEQ ID NO: 18961 - DNA, 19 bp, Homo sapiens
ggccccctccccggagtgg

SEQ ID NO: 18962 - DNA, 21 bp, Homo sapiens
gcgtcctctccccgacgggcc

SEQ ID NO: 18963 - DNA, 20 bp, Homo sapiens
cggcccacctgggctggggc

SEQ ID NO: 18964 - DNA, 17 bp, Homo sapiens
cggtgccctgctggggc

SEQ ID NO: 18965 - DNA, 16 bp, Homo sapiens
gaccccctccctgggg

SEQ ID NO: 18966 - DNA, 20 bp, Homo sapiens
cggccccctccagcctgggg

SEQ ID NO: 18967 - DNA, 22 bp, Homo sapiens
agccccttcccggaacctcggc

SEQ ID NO: 18968 - DNA, 21 bp, Homo sapiens
ggcctgcgcggggctggggcc

SEQ ID NO: 18969 - DNA, 20 bp, Homo sapiens
ggcctcccaaagtgctgggg

SEQ ID NO: 18970 - DNA, 19 bp, Homo sapiens
cggccttctctgctggggc

SEQ ID NO: 18971 - DNA, 22 bp, Homo sapiens
ggcccgggcccgagctggggcc

SEQ ID NO: 18972 - DNA, 21 bp, Homo sapiens
cggcctcctcacggcccagcc

SEQ ID NO: 18973 - DNA, 20 bp, Homo sapiens
cggtccctgacggctggggc

SEQ ID NO: 18974 - DNA, 16 bp, Homo sapiens
ggctccggagctgggg

SEQ ID NO: 18975 - DNA, 15 bp, Homo sapiens
ggccccctccagggc

SEQ ID NO: 18976 - DNA, 18 bp, Homo sapiens
ggccccctctccaggggc

SEQ ID NO: 18977 - DNA, 20 bp, Homo sapiens
ggctatctcccgaattagcc

SEQ ID NO: 18978 - DNA, 18 bp, Homo sapiens
cgcgcctcctcccggggc

SEQ ID NO: 18979 - DNA, 18 bp, Homo sapiens
cggtccctcccggcgcgc

SEQ ID NO: 18980 - DNA, 22 bp, Homo sapiens
cggcccctccctgaacgtggcc

SEQ ID NO: 18981 - DNA, 23 bp, Homo sapiens
cggccccctcactgccccaggcc

SEQ ID NO: 18982 - DNA, 17 bp, Homo sapiens
cagccccctccccgggc

SEQ ID NO: 18983 - DNA, 17 bp, Homo sapiens
ggccccctccctctggg

SEQ ID NO: 18984 - DNA, 18 bp, Homo sapiens
gcttctcacaaaagggcc

SEQ ID NO: 18985 - DNA, 20 bp, Homo sapiens
cggtctgccctgctggggcc

SEQ ID NO: 18986 - DNA, 22 bp, Homo sapiens
cggccccctgccgacccccgcc

SEQ ID NO: 18987 - DNA, 22 bp, Homo sapiens
cagcctcccgagtagctggggc

SEQ ID NO: 18988 - DNA, 18 bp, Homo sapiens
cggtcactcagctggggc

SEQ ID NO: 18989 - DNA, 18 bp, Homo sapiens
cggctccctcccgccgct

SEQ ID NO: 18990 - DNA, 20 bp, Homo sapiens
ggccccctggcgctggggcc

SEQ ID NO: 18991 - DNA, 22 bp, Homo sapiens
cggccttcctctgcctggggcc

SEQ ID NO: 18992 - DNA, 21 bp, Homo sapiens
cagcttcccgagtagctgggg

SEQ ID NO: 18993 - DNA, 20 bp, Homo sapiens
ccttttccgtgcccggggcc

SEQ ID NO: 18994 - DNA, 21 bp, Homo sapiens
cagcctcctgagtagctgggg

SEQ ID NO: 18995 - DNA, 20 bp, Homo sapiens
ggctttctttagctaaggcc

SEQ ID NO: 18996 - DNA, 17 bp, Homo sapiens
cagccctctcctggggc

SEQ ID NO: 18997 - DNA, 17 bp, Homo sapiens
gccccctccaggggggc

SEQ ID NO: 18998 - DNA, 19 bp, Homo sapiens
cagtcccttcagctggggc

SEQ ID NO: 18999 - DNA, 23 bp, Homo sapiens
cggcctccgtctcctccagggcc

SEQ ID NO: 19000 - DNA, 17 bp, Homo sapiens
cagctccttcccgggac

SEQ ID NO: 19001 - DNA, 21 bp, Homo sapiens
cggcccccgcccccccgggcc

SEQ ID NO: 19002 - DNA, 21 bp, Homo sapiens
ggctgggctccgggctggggc

SEQ ID NO: 19003 - DNA, 16 bp, Homo sapiens
ggtctcccgctggggc

SEQ ID NO: 19004 - DNA, 17 bp, Homo sapiens
cggacccctccccgggc

SEQ ID NO: 19005 - DNA, 15 bp, Homo sapiens
gcccccagctggggc

SEQ ID NO: 19006 - DNA, 19 bp, Homo sapiens
gggctccttcactggggcc

SEQ ID NO: 19007 - DNA, 18 bp, Homo sapiens
ggctcctcccccagggcc

SEQ ID NO: 19008 - DNA, 20 bp, Homo sapiens
ggctccctcgggctggggcc

SEQ ID NO: 19009 - DNA, 18 bp, Homo sapiens
ggttgctccagctggggc

SEQ ID NO: 19010 - DNA, 21 bp, Homo sapiens
cggccccctcttagctgggcc

SEQ ID NO: 19011 - DNA, 19 bp, Homo sapiens
ccgtccctgaggctggggc

SEQ ID NO: 19012 - DNA, 21 bp, Homo sapiens
agtcccctcttcccagcgggc

SEQ ID NO: 19013 - DNA, 20 bp, Homo sapiens
gccccctccactccggggcc

SEQ ID NO: 19014 - DNA, 16 bp, Homo sapiens
ggccccctcctggggc

SEQ ID NO: 19015 - DNA, 21 bp, Homo sapiens
cagctccctcccgagggcgcc

SEQ ID NO: 19016 - DNA, 23 bp, Homo sapiens
cggccccctcccagttggccccg

SEQ ID NO: 19017 - DNA, 18 bp, Homo sapiens
ctccctgagtctggggcc

SEQ ID NO: 19018 - DNA, 21 bp, Homo sapiens
cagcctcccaagtagctgggg

SEQ ID NO: 19019 - DNA, 19 bp, Homo sapiens
ggcttctgagcctggggcc

SEQ ID NO: 19020 - DNA, 15 bp, Homo sapiens
cggcccctccccggg

SEQ ID NO: 19021 - DNA, 17 bp, Homo sapiens
cggcccccactcgggac

SEQ ID NO: 19022 - DNA, 17 bp, Homo sapiens
cagccccctttctgagg

SEQ ID NO: 19023 - DNA, 15 bp, Homo sapiens
cggcccctcccgggg

SEQ ID NO: 19024 - DNA, 21 bp, Homo sapiens
cgactgagccgggctggggcc

SEQ ID NO: 19025 - DNA, 17 bp, Homo sapiens
cagcttcgagctggggc

SEQ ID NO: 19026 - DNA, 19 bp, Homo sapiens
cggcgctctctcgagccgg

SEQ ID NO: 19027 - DNA, 21 bp, Homo sapiens
ggtccccctcctgtctcgggc

SEQ ID NO: 19028 - DNA, 22 bp, Homo sapiens
ggcccctctgtagggctggggc

SEQ ID NO: 19029 - DNA, 21 bp, Homo sapiens
ggccacttcctgagccaggcc

SEQ ID NO: 19030 - DNA, 17 bp, Homo sapiens
cggcccccgtctggggc

SEQ ID NO: 19031 - DNA, 17 bp, Homo sapiens
ggcctccccccgaggac

SEQ ID NO: 19032 - DNA, 19 bp, Homo sapiens
gggcccctccctcctgggg

SEQ ID NO: 19033 - DNA, 21 bp, Homo sapiens
cgtctccctcctcctggggcc

SEQ ID NO: 19034 - DNA, 20 bp, Homo sapiens
cggttccctccactggggcc

SEQ ID NO: 19035 - DNA, 18 bp, Homo sapiens
ggccccctcccatccctg

SEQ ID NO: 19036 - DNA, 17 bp, Homo sapiens
ggaccccaagctggggc

SEQ ID NO: 19037 - DNA, 22 bp, Homo sapiens
ggctgccgaggctgctggggcc

SEQ ID NO: 19038 - DNA, 18 bp, Homo sapiens
cagccccctcctgccagg

SEQ ID NO: 19039 - DNA, 22 bp, Homo sapiens
ggcccctgcctgccctggggcc

SEQ ID NO: 19040 - DNA, 23 bp, Homo sapiens
cggcctcccccccggctggggcc

SEQ ID NO: 19041 - DNA, 18 bp, Homo sapiens
cggtcccctccccgtggc

SEQ ID NO: 19042 - DNA, 21 bp, Homo sapiens
cggccccctcccacacacagg

SEQ ID NO: 19043 - DNA, 18 bp, Homo sapiens
ggccccctgccctggggc

SEQ ID NO: 19044 - DNA, 16 bp, Homo sapiens
cggctctcgctggggc

SEQ ID NO: 19045 - DNA, 23 bp, Homo sapiens
ggcccccttctgcagagcggggc

SEQ ID NO: 19046 - DNA, 16 bp, Homo sapiens
ggccccttcctggggc

SEQ ID NO: 19047 - DNA, 21 bp, Homo sapiens
ggccctcagggaggctggggc

SEQ ID NO: 19048 - DNA, 16 bp, Homo sapiens
gcctcctccctggggc

SEQ ID NO: 19049 - DNA, 20 bp, Homo sapiens
cggccccctctcagcgaaga

SEQ ID NO: 19050 - DNA, 20 bp, Homo sapiens
gcctcctctcgcgccgggcc

SEQ ID NO: 19051 - DNA, 22 bp, Homo sapiens
cagcccctagggagctggggcc

SEQ ID NO: 19052 - DNA, 17 bp, Homo sapiens
ggctcccttgctgaggc

SEQ ID NO: 19053 - DNA, 17 bp, Homo sapiens
cagctcccaagctgggg

SEQ ID NO: 19054 - DNA, 17 bp, Homo sapiens
ggcccagcggctggggc

SEQ ID NO: 19055 - DNA, 17 bp, Homo sapiens
cagcttcctcccagggc

SEQ ID NO: 19056 - DNA, 19 bp, Homo sapiens
gcccccaagccagttgggg

SEQ ID NO: 19057 - DNA, 20 bp, Homo sapiens
cagtcccctggaagctgggg

SEQ ID NO: 19058 - DNA, 17 bp, Homo sapiens
ggctccctcccggcggg

SEQ ID NO: 19059 - DNA, 22 bp, Homo sapiens
ggcgaggggccgagctggggcc

SEQ ID NO: 19060 - DNA, 22 bp, Homo sapiens
cagcctccctagtagctggggc

SEQ ID NO: 19061 - DNA, 21 bp, Homo sapiens
cggtgctcggagagctggggc

SEQ ID NO: 19062 - DNA, 18 bp, Homo sapiens
cgactcccctgctggggc

SEQ ID NO: 19063 - DNA, 21 bp, Homo sapiens
gccttcctcccgaaaacggcc

SEQ ID NO: 19064 - DNA, 18 bp, Homo sapiens
cggccccctccccggcgc

SEQ ID NO: 19065 - DNA, 21 bp, Homo sapiens
cagcctcccgcggctggggcc

SEQ ID NO: 19066 - DNA, 17 bp, Homo sapiens
ggccgcccgagctgggg

SEQ ID NO: 19067 - DNA, 16 bp, Homo sapiens
gccccctccagggggc

SEQ ID NO: 19068 - DNA, 19 bp, Homo sapiens
ggccttcctcccacgggcc

SEQ ID NO: 19069 - DNA, 19 bp, Homo sapiens
gctctcctcctactggggc

SEQ ID NO: 19070 - DNA, 18 bp, Homo sapiens
cggcccccacccacaggg

SEQ ID NO: 19071 - DNA, 20 bp, Homo sapiens
ggttccctcccagagggggc

SEQ ID NO: 19072 - DNA, 20 bp, Homo sapiens
agcccttctgagctggggcc

SEQ ID NO: 19073 - DNA, 19 bp, Homo sapiens
gctcctctctcactggggc

SEQ ID NO: 19074 - DNA, 20 bp, Homo sapiens
ggcccattcctgccagggcc

SEQ ID NO: 19075 - DNA, 17 bp, Homo sapiens
cagcctcctcctgaagc

SEQ ID NO: 19076 - DNA, 21 bp, Homo sapiens
cagcctccctagtagctgggg

SEQ ID NO: 19077 - DNA, 17 bp, Homo sapiens
ggcttcccaactggggc

SEQ ID NO: 19078 - DNA, 19 bp, Homo sapiens
ggcctctacccaccagggc

SEQ ID NO: 19079 - DNA, 21 bp, Homo sapiens
agcctcctcctcagtggggcc

SEQ ID NO: 19080 - DNA, 19 bp, Homo sapiens
gcccttgaaagctggggcc

SEQ ID NO: 19081 - DNA, 20 bp, Homo sapiens
cagccctctccacgggggcc

SEQ ID NO: 19082 - DNA, 21 bp, Homo sapiens
cggcccctccccggtacggcc

SEQ ID NO: 19083 - DNA, 16 bp, Homo sapiens
gcctccctcccggggc

SEQ ID NO: 19084 - DNA, 21 bp, Homo sapiens
cagccttcttgctctggggcc

SEQ ID NO: 19085 - DNA, 20 bp, Homo sapiens
gcctttgctccgagctgggg

SEQ ID NO: 19086 - DNA, 24 bp, Homo sapiens
ggcccctccctccgaaactggggc

SEQ ID NO: 19087 - DNA, 19 bp, Homo sapiens
cggccgtcggggctggggc

SEQ ID NO: 19088 - DNA, 18 bp, Homo sapiens
gccccttccccgcggggc

SEQ ID NO: 19089 - DNA, 23 bp, Homo sapiens
ggccctttagcagagctggggcc

SEQ ID NO: 19090 - DNA, 22 bp, Homo sapiens
cagcctcctgagtagctggggc

SEQ ID NO: 19091 - DNA, 16 bp, Homo sapiens
ggctcccccgaggggc

SEQ ID NO: 19092 - DNA, 21 bp, Homo sapiens
cggacctcagtcagctggggc

SEQ ID NO: 19093 - DNA, 16 bp, Homo sapiens
ggttcccagctggggc

SEQ ID NO: 19094 - DNA, 20 bp, Homo sapiens
ggtcctctcccaaggggggc

SEQ ID NO: 19095 - DNA, 17 bp, Homo sapiens
gccccctcccccagggc

SEQ ID NO: 19096 - DNA, 20 bp, Homo sapiens
cggttccctatcccagggcc

SEQ ID NO: 19097 - DNA, 23 bp, Homo sapiens
ggcccccggagggagctggggcc

SEQ ID NO: 19098 - DNA, 19 bp, Homo sapiens
ggccccctcctgcaaggcc

SEQ ID NO: 19099 - DNA, 22 bp, Homo sapiens
gctccttcctcgttctggggcc

SEQ ID NO: 19100 - DNA, 18 bp, Homo sapiens
ggctccctccccggggcc

SEQ ID NO: 19101 - DNA, 18 bp, Homo sapiens
cggccccctcccaggcgc

SEQ ID NO: 19102 - DNA, 19 bp, Homo sapiens
cggccccctcctcggcggc

SEQ ID NO: 19103 - DNA, 19 bp, Homo sapiens
cggctctcctgctggggcc

SEQ ID NO: 19104 - DNA, 20 bp, Homo sapiens
gctcctcccgaagccgggcc

SEQ ID NO: 19105 - DNA, 21 bp, Homo sapiens
gggtccctgccagctggggcc

SEQ ID NO: 19106 - DNA, 18 bp, Homo sapiens
cggcccctccccggccgc

SEQ ID NO: 19107 - DNA, 17 bp, Homo sapiens
gcctcctcctccggggc

SEQ ID NO: 19108 - DNA, 19 bp, Homo sapiens
cggcgccctctttgccggg

SEQ ID NO: 19109 - DNA, 21 bp, Homo sapiens
cagcctcccaaatagctgggg

SEQ ID NO: 19110 - DNA, 22 bp, Homo sapiens
cggctcattctccgccggggcc

SEQ ID NO: 19111 - DNA, 20 bp, Homo sapiens
ggccccctccctggcgggcc

SEQ ID NO: 19112 - DNA, 20 bp, Homo sapiens
ggtcccctctccctggggcc

SEQ ID NO: 19113 - DNA, 17 bp, Homo sapiens
cagcctcccagctgggg

SEQ ID NO: 19114 - DNA, 21 bp, Homo sapiens
cggcctcccaatgtgctgggg

SEQ ID NO: 19115 - DNA, 16 bp, Homo sapiens
gccccctctcggcagc

SEQ ID NO: 19116 - DNA, 22 bp, Homo sapiens
ggctccctggctccctggggcc

SEQ ID NO: 19117 - DNA, 19 bp, Homo sapiens
ggccccctcctcatcactg

SEQ ID NO: 19118 - DNA, 20 bp, Homo sapiens
ggccccctccagttgaggcc

SEQ ID NO: 19119 - DNA, 16 bp, Homo sapiens
cggctccggctggggc

SEQ ID NO: 19120 - DNA, 22 bp, Homo sapiens
ggcccttgtccgtgccggggcc

SEQ ID NO: 19121 - DNA, 17 bp, Homo sapiens
ggaccccgggctggggc

SEQ ID NO: 19122 - DNA, 23 bp, Homo sapiens
cagccccctctccccgctgggcc

SEQ ID NO: 19123 - DNA, 20 bp, Homo sapiens
gcagattctgagctggggcc

SEQ ID NO: 19124 - DNA, 19 bp, Homo sapiens
cggcccccctctcggccgg

SEQ ID NO: 19125 - DNA, 20 bp, Homo sapiens
cagccccttcccggaaggcc

SEQ ID NO: 19126 - DNA, 16 bp, Homo sapiens
agcccccttctgggac

SEQ ID NO: 19127 - DNA, 21 bp, Homo sapiens
cagcctcccgagtagctgggg

SEQ ID NO: 19128 - DNA, 19 bp, Homo sapiens
cagcccttcaggctggggc

SEQ ID NO: 19129 - DNA, 20 bp, Homo sapiens
cggccccctcctcaccagcc

SEQ ID NO: 19130 - DNA, 65 bp, Equine herpesvirus 2
gcccgtcttcaacctggtgctggactttgacctccccctgaaaaagcccggcctgagcctggagc

SEQ ID NO: 19131 - DNA, 24 bp, Equine herpesvirus 2
cccctgaaaaagcccggcctgagc

SEQ ID NO: 19132 - DNA, 16 bp, Homo sapiens
cctggaaaagcctgag

SEQ ID NO: 19133 - DNA, 20 bp, Homo sapiens
ccctgaaagaggtacctgag

SEQ ID NO: 19134 - DNA, 20 bp, Homo sapiens
cccagagaggctgcctgagc

SEQ ID NO: 19135 - DNA, 19 bp, Homo sapiens
ctgaagaagcccagttctg

SEQ ID NO: 19136 - DNA, 23 bp, Homo sapiens
cccctgaagagggctttagggag

SEQ ID NO: 19137 - DNA, 19 bp, Homo sapiens
cctcttaaaaaggcctgag

SEQ ID NO: 19138 - DNA, 19 bp, Homo sapiens
ccctgaaaaagttacatag

SEQ ID NO: 19139 - DNA, 17 bp, Homo sapiens
ccctgaggccggcctgg

SEQ ID NO: 19140 - DNA, 22 bp, Homo sapiens
cccctggagaatcccactgggc

SEQ ID NO: 19141 - DNA, 20 bp, Homo sapiens
ctggaaagcccggcctgagc

SEQ ID NO: 19142 - DNA, 20 bp, Homo sapiens
cctcggaaaacagacctgag

SEQ ID NO: 19143 - DNA, 21 bp, Homo sapiens
cctccgggaaagcccaggggc

SEQ ID NO: 19144 - DNA, 25 bp, Homo sapiens
ccccagcctcggagcctggcctgag

SEQ ID NO: 19145 - DNA, 21 bp, Homo sapiens
ccctgaaagggctgctccagc

SEQ ID NO: 19146 - DNA, 18 bp, Homo sapiens
tgaggaagcccaactagc

SEQ ID NO: 19147 - DNA, 19 bp, Homo sapiens
cctaaaaagcctggaaaag

SEQ ID NO: 19148 - DNA, 15 bp, Homo sapiens
cccagcccggcctga

SEQ ID NO: 19149 - DNA, 18 bp, Homo sapiens
cccctgagagaacctgag

SEQ ID NO: 19150 - DNA, 18 bp, Homo sapiens
cccctcaaagggcccgag

SEQ ID NO: 19151 - DNA, 20 bp, Homo sapiens
ccttagaaaaagcccttgag

SEQ ID NO: 19152 - DNA, 22 bp, Homo sapiens
cctggaagacctgaaccctgag

SEQ ID NO: 19153 - DNA, 19 bp, Homo sapiens
cctgaaaaacgtccgggag

SEQ ID NO: 19154 - DNA, 18 bp, Homo sapiens
ccctcgggaaagcccgcc

SEQ ID NO: 19155 - DNA, 20 bp, Homo sapiens
cctccgggaaagcccaaggc

SEQ ID NO: 19156 - DNA, 19 bp, Homo sapiens
ctgaagaaaaagacctgag

SEQ ID NO: 19157 - DNA, 19 bp, Homo sapiens
ccaggagctcggcctgagc

SEQ ID NO: 19158 - DNA, 18 bp, Homo sapiens
cccccgaaaggggactgg

SEQ ID NO: 19159 - DNA, 22 bp, Homo sapiens
cccttggaaaacccagaaagag

SEQ ID NO: 19160 - DNA, 23 bp, Homo sapiens
cccctgaaaaacttcggaggagc

SEQ ID NO: 19161 - DNA, 21 bp, Homo sapiens
ccctgaaaagcaatagttgag

SEQ ID NO: 19162 - DNA, 21 bp, Homo sapiens
cccgctgggagcagcctgagc

SEQ ID NO: 19163 - DNA, 21 bp, Homo sapiens
cctagaaaaagcatgttgagc

SEQ ID NO: 19164 - DNA, 17 bp, Homo sapiens
cctgaaaaggctgggag

SEQ ID NO: 19165 - DNA, 22 bp, Homo sapiens
cccctgagagccaggcctgagc

SEQ ID NO: 19166 - DNA, 20 bp, Homo sapiens
cctgaaaagctccacctggc

SEQ ID NO: 19167 - DNA, 23 bp, Homo sapiens
cctctaagaagcccggctggggc

SEQ ID NO: 19168 - DNA, 21 bp, Homo sapiens
ccctttgaagggtcctggggc

SEQ ID NO: 19169 - DNA, 20 bp, Homo sapiens
cccctgaagatgctcctggc

SEQ ID NO: 19170 - DNA, 20 bp, Homo sapiens
cccctggtgaagtccctggc

SEQ ID NO: 19171 - DNA, 19 bp, Homo sapiens
ccctgagaaggcccaagag

SEQ ID NO: 19172 - DNA, 23 bp, Homo sapiens
ccttgagacccagctggcctgag

SEQ ID NO: 19173 - DNA, 21 bp, Homo sapiens
cctctggaacgccacctgagc

SEQ ID NO: 19174 - DNA, 15 bp, Homo sapiens
tgaaaaaggactgag

SEQ ID NO: 19175 - DNA, 26 bp, Homo sapiens
cccctgaaagggacaggaagttgggc

SEQ ID NO: 19176 - DNA, 19 bp, Homo sapiens
cctctaagccaggcctgag

SEQ ID NO: 19177 - DNA, 23 bp, Homo sapiens
cccttgaaagtgctatcaggagc

SEQ ID NO: 19178 - DNA, 20 bp, Homo sapiens
ccctgaaacggaggcctgag

SEQ ID NO: 19179 - DNA, 15 bp, Homo sapiens
ccctgaaaaaaacct

SEQ ID NO: 19180 - DNA, 18 bp, Homo sapiens
ccgctgcagtccggcctg

SEQ ID NO: 19181 - DNA, 22 bp, Homo sapiens
cccctgaaaaggtcatctgggc

SEQ ID NO: 19182 - DNA, 19 bp, Homo sapiens
cctgaagagcccgaggaag

SEQ ID NO: 19183 - DNA, 18 bp, Homo sapiens
ctgaaaaagaacttgagc

SEQ ID NO: 19184 - DNA, 23 bp, Homo sapiens
cccctgaaggggccccgtggggc

SEQ ID NO: 19185 - DNA, 17 bp, Homo sapiens
tgaaggcctggcctgag

SEQ ID NO: 19186 - DNA, 20 bp, Homo sapiens
tgagaaggatggacctgagc

SEQ ID NO: 19187 - DNA, 18 bp, Homo sapiens
ccctagaacgagcctgag

SEQ ID NO: 19188 - DNA, 15 bp, Homo sapiens
ctgaaaagacctgag

SEQ ID NO: 19189 - DNA, 22 bp, Homo sapiens
cccccgaaagggtgtcctgagc

SEQ ID NO: 19190 - DNA, 21 bp, Homo sapiens
ctagaggagcctggcctgagc

SEQ ID NO: 19191 - DNA, 21 bp, Homo sapiens
ccccagagatggggcctgagc

SEQ ID NO: 19192 - DNA, 18 bp, Homo sapiens
cctggaaaccagcctgag

SEQ ID NO: 19193 - DNA, 18 bp, Homo sapiens
cccctgaaagtgccccgg

SEQ ID NO: 19194 - DNA, 19 bp, Homo sapiens
cctctaggaagcccaggag

SEQ ID NO: 19195 - DNA, 20 bp, Homo sapiens
ccctggacaaggccgagagc

SEQ ID NO: 19196 - DNA, 19 bp, Homo sapiens
ccactggggcaggcctgag

SEQ ID NO: 19197 - DNA, 15 bp, Homo sapiens
ctgaaaaggcctaaa

SEQ ID NO: 19198 - DNA, 18 bp, Homo sapiens
cccctggcagggcctgag

SEQ ID NO: 19199 - DNA, 25 bp, Homo sapiens
ctaaaaaagcttcccaatgcttgag

SEQ ID NO: 19200 - DNA, 24 bp, Homo sapiens
cccctgaaaaagactggaaaatgc

SEQ ID NO: 19201 - DNA, 23 bp, Homo sapiens
cctcgtgatccgccggcctgggc

SEQ ID NO: 19202 - DNA, 19 bp, Homo sapiens
cctgaaaaacctccaagaa

SEQ ID NO: 19203 - DNA, 25 bp, Homo sapiens
tgaagaagcctcgtggtgctcaggc

SEQ ID NO: 19204 - DNA, 21 bp, Homo sapiens
cccctggtgtcaggcctgagc

SEQ ID NO: 19205 - DNA, 24 bp, Homo sapiens
cccctgagatgctccggcctgagc

SEQ ID NO: 19206 - DNA, 16 bp, Homo sapiens
cctgagaccagcctgg

SEQ ID NO: 19207 - DNA, 17 bp, Homo sapiens
ccctgagagagcctaag

SEQ ID NO: 19208 - DNA, 22 bp, Homo sapiens
ccctgaaagaggcgttttgagc

SEQ ID NO: 19209 - DNA, 17 bp, Homo sapiens
ccttcaaagaacctgag

SEQ ID NO: 19210 - DNA, 22 bp, Homo sapiens
ccaggagaaaggaaacctgagc

SEQ ID NO: 19211 - DNA, 20 bp, Homo sapiens
cccgaccccctggcctgagc

SEQ ID NO: 19212 - DNA, 16 bp, Homo sapiens
ccgatgccggcctgag

SEQ ID NO: 19213 - DNA, 22 bp, Homo sapiens
ccccttagacccaggcctgagc

SEQ ID NO: 19214 - DNA, 23 bp, Homo sapiens
cctgggggaagaggtgcctgagc

SEQ ID NO: 19215 - DNA, 18 bp, Homo sapiens
cccccagcctggcttgag

SEQ ID NO: 19216 - DNA, 19 bp, Homo sapiens
ctgaaaaaggcccttaagc

SEQ ID NO: 19217 - DNA, 68 bp, Murid herpesvirus 4
cccggccccctcccgagctggggcccggatccccgacctccccggccccctcccgagctggggcccgg

SEQ ID NO: 19218 - DNA, 17 bp, Murid herpesvirus 4
cccgagctggggcccgg

SEQ ID NO: 19219 - DNA, 20 bp, Homo sapiens
ccccagccctgagggcccgg

SEQ ID NO: 19220 - DNA, 19 bp, Homo sapiens
cccggcccgcggggcctgg

SEQ ID NO: 19221 - DNA, 18 bp, Homo sapiens
cccaagcccagaccccgg

SEQ ID NO: 19222 - DNA, 19 bp, Homo sapiens
ccgagccgccagtccctgg

SEQ ID NO: 19223 - DNA, 19 bp, Homo sapiens
cccagctagagctgcctgg

SEQ ID NO: 19224 - DNA, 19 bp, Homo sapiens
cccgagccgttcagcctgg

SEQ ID NO: 19225 - DNA, 19 bp, Homo sapiens
ccagaggccctgggcccgg

SEQ ID NO: 19226 - DNA, 19 bp, Homo sapiens
ccgcgcgctcagggcccgg

SEQ ID NO: 19227 - DNA, 20 bp, Homo sapiens
cctcggcacctggggtccgg

SEQ ID NO: 19228 - DNA, 20 bp, Homo sapiens
ccccagctggtgagccctgg

SEQ ID NO: 19229 - DNA, 19 bp, Homo sapiens
cccaagctgcagcgcccgg

SEQ ID NO: 19230 - DNA, 18 bp, Homo sapiens
ccggagctggtgccccgg

SEQ ID NO: 19231 - DNA, 19 bp, Homo sapiens
cccagctaaaagtgtccgg

SEQ ID NO: 19232 - DNA, 21 bp, Homo sapiens
cccggagctggaccttctcgg

SEQ ID NO: 19233 - DNA, 18 bp, Homo sapiens
cccaggcccggggcccgg

SEQ ID NO: 19234 - DNA, 19 bp, Homo sapiens
ccggagctagacagcctgg

SEQ ID NO: 19235 - DNA, 18 bp, Homo sapiens
cccgaaccaccagcccgg

SEQ ID NO: 19236 - DNA, 19 bp, Homo sapiens
ccgaggccccgaggcctgg

SEQ ID NO: 19237 - DNA, 18 bp, Homo sapiens
cctagctggaaaccctgg

SEQ ID NO: 19238 - DNA, 18 bp, Homo sapiens
cccgaactggggccgcgg

SEQ ID NO: 19239 - DNA, 18 bp, Homo sapiens
cccgagcccagagcctgg

SEQ ID NO: 19240 - DNA, 22 bp, Homo sapiens
ccgggctggggctgggtccggc

SEQ ID NO: 19241 - DNA, 19 bp, Homo sapiens
cccggcggtgggggcccgg

SEQ ID NO: 19242 - DNA, 19 bp, Homo sapiens
cccaagctgggtggcctgg

SEQ ID NO: 19243 - DNA, 18 bp, Homo sapiens
ccagagcaggatgcccgg

SEQ ID NO: 19244 - DNA, 18 bp, Homo sapiens
cccagggccgacgcccgg

SEQ ID NO: 19245 - DNA, 18 bp, Homo sapiens
cccgaaggctaagcccgg

SEQ ID NO: 19246 - DNA, 20 bp, Homo sapiens
ccggagctgcgagctctcgg

SEQ ID NO: 19247 - DNA, 18 bp, Homo sapiens
ccccagctaggaatccgg

SEQ ID NO: 19248 - DNA, 20 bp, Homo sapiens
cccgacggggagcggcccgg

SEQ ID NO: 19249 - DNA, 19 bp, Homo sapiens
cccaagctctgcggcccgg

SEQ ID NO: 19250 - DNA, 18 bp, Homo sapiens
cccggagctgcgactcgg

SEQ ID NO: 19251 - DNA, 18 bp, Homo sapiens
cccaagccgggggcctgg

SEQ ID NO: 19252 - DNA, 21 bp, Homo sapiens
cccgagctccgcagggctcgg

SEQ ID NO: 19253 - DNA, 19 bp, Homo sapiens
ccctggaacctgggtccgg

SEQ ID NO: 19254 - DNA, 18 bp, Homo sapiens
cccgagctgctggcctgg

SEQ ID NO: 19255 - DNA, 19 bp, Homo sapiens
cccgagagcccaggcctgg

SEQ ID NO: 19256 - DNA, 18 bp, Homo sapiens
cccgggctggacgcacgg

SEQ ID NO: 19257 - DNA, 19 bp, Homo sapiens
ccacgggcacacggcccgg

SEQ ID NO: 19258 - DNA, 18 bp, Homo sapiens
cccgcgctgagaccctgg

SEQ ID NO: 19259 - DNA, 19 bp, Homo sapiens
cccgaagcccagcccctgg

SEQ ID NO: 19260 - DNA, 19 bp, Homo sapiens
ccagagccggcaggcctgg

SEQ ID NO: 19261 - DNA, 18 bp, Homo sapiens
ccggggctgcgagcccgg

SEQ ID NO: 19262 - DNA, 20 bp, Homo sapiens
cccgagccgaacgacctcgg

SEQ ID NO: 19263 - DNA, 22 bp, Homo sapiens
cccgagtcctccagggcctggc

SEQ ID NO: 19264 - DNA, 20 bp, Homo sapiens
cccggaggggcggggctcgg

SEQ ID NO: 19265 - DNA, 19 bp, Homo sapiens
cccgccagcaggggcctgg

SEQ ID NO: 19266 - DNA, 20 bp, Homo sapiens
ccgcgggccgccgagcccgg

SEQ ID NO: 19267 - DNA, 18 bp, Homo sapiens
cccacaccaggggcctgg

SEQ ID NO: 19268 - DNA, 20 bp, Homo sapiens
ccagagctgagcctgcctgg

SEQ ID NO: 19269 - DNA, 19 bp, Homo sapiens
cccaaagtggagggtccgg

SEQ ID NO: 19270 - DNA, 21 bp, Homo sapiens
cccggactcaccacggcccgg

SEQ ID NO: 19271 - DNA, 20 bp, Homo sapiens
cctgagccggcgcgccccgg

SEQ ID NO: 19272 - DNA, 21 bp, Homo sapiens
gagcagcgtgtggggcccggc

SEQ ID NO: 19273 - DNA, 18 bp, Homo sapiens
cccaagctgctggtccgg

SEQ ID NO: 19274 - DNA, 21 bp, Homo sapiens
cccggctgaagcgaggcccgg

SEQ ID NO: 19275 - DNA, 21 bp, Homo sapiens
cccagctgtgactgggcctgg

SEQ ID NO: 19276 - DNA, 19 bp, Homo sapiens
cccggggagccgggcccgg

SEQ ID NO: 19277 - DNA, 19 bp, Homo sapiens
cccgggcctgcaaccctgg

SEQ ID NO: 19278 - DNA, 18 bp, Homo sapiens
cccgcagcagcaccctgg

SEQ ID NO: 19279 - DNA, 20 bp, Homo sapiens
cccagcccttacgggcccgg

SEQ ID NO: 19280 - DNA, 19 bp, Homo sapiens
cccgagctggactgactgg

SEQ ID NO: 19281 - DNA, 20 bp, Homo sapiens
cccgagaccaaattgcccgg

SEQ ID NO: 19282 - DNA, 19 bp, Homo sapiens
cccaggctgcggggctcgg

SEQ ID NO: 19283 - DNA, 22 bp, Homo sapiens
cccgggaaggcaggggctcggc

SEQ ID NO: 19284 - DNA, 18 bp, Homo sapiens
cccaagctcagggttcgg

SEQ ID NO: 19285 - DNA, 19 bp, Homo sapiens
ccctggctgggactcctgg

SEQ ID NO: 19286 - DNA, 18 bp, Homo sapiens
cccggagccgcggcccgg

SEQ ID NO: 19287 - DNA, 18 bp, Homo sapiens
cctgagctaaaaggccgg

SEQ ID NO: 19288 - DNA, 21 bp, Homo sapiens
cccagagccggactggcctgg

SEQ ID NO: 19289 - DNA, 21 bp, Homo sapiens
cccggggccgcgcgggctcgg

SEQ ID NO: 19290 - DNA, 20 bp, Homo sapiens
cccggcgcgctgaggcccgg

SEQ ID NO: 19291 - DNA, 19 bp, Homo sapiens
ccagagctggactacctgg

SEQ ID NO: 19292 - DNA, 18 bp, Homo sapiens
ccaaggccaggggtccgg

SEQ ID NO: 19293 - DNA, 19 bp, Homo sapiens
cccgagccggatggttcgg

SEQ ID NO: 19294 - DNA, 20 bp, Homo sapiens
ccgagctgagctgagcccgg

SEQ ID NO: 19295 - DNA, 19 bp, Homo sapiens
cccagccagtcgggtccgg

SEQ ID NO: 19296 - DNA, 18 bp, Homo sapiens
ccggagcgcgaagcccgg

SEQ ID NO: 19297 - DNA, 18 bp, Homo sapiens
cccggctggagctcccgg

SEQ ID NO: 19298 - DNA, 18 bp, Homo sapiens
ccgcgccgccgggcccgg

SEQ ID NO: 19299 - DNA, 23 bp, Homo sapiens
cccgagcctcagtgcggcccggc

SEQ ID NO: 19300 - DNA, 21 bp, Homo sapiens
cccaggctcaaggaggcctgg

SEQ ID NO: 19301 - DNA, 20 bp, Homo sapiens
cccggagccactccgcccgg

SEQ ID NO: 19302 - DNA, 19 bp, Homo sapiens
cccggctggagaagcccgg

SEQ ID NO: 19303 - DNA, 19 bp, Homo sapiens
cccatgctggggcccggcc

SEQ ID NO: 19304 - DNA, 18 bp, Homo sapiens
cccaagctggggtcccgg

SEQ ID NO: 19305 - DNA, 20 bp, Homo sapiens
cccgagggccccaggctcgg

SEQ ID NO: 19306 - DNA, 18 bp, Homo sapiens
cccgggccggagccccgg

SEQ ID NO: 19307 - DNA, 18 bp, Homo sapiens
ccgagctggtgccgccgg

SEQ ID NO: 19308 - DNA, 18 bp, Homo sapiens
cccagggctgaagcctgg

SEQ ID NO: 19309 - DNA, 18 bp, Homo sapiens
cccgcgctgggggcctgg

SEQ ID NO: 19310 - DNA, 20 bp, Homo sapiens
cctgaagcccaggcgcccgg

SEQ ID NO: 19311 - DNA, 18 bp, Homo sapiens
cccggcccagaaccccgg

SEQ ID NO: 19312 - DNA, 20 bp, Homo sapiens
ccggagccgccggggtccgg

SEQ ID NO: 19313 - DNA, 20 bp, Homo sapiens
cccgagctgaagtcgctcgg

SEQ ID NO: 19314 - DNA, 18 bp, Homo sapiens
cccagctggaatctccgg

SEQ ID NO: 19315 - DNA, 18 bp, Homo sapiens
cccaagctcggggcctgg

SEQ ID NO: 19316 - DNA, 19 bp, Homo sapiens
cccgagctcgtgaccccgg

SEQ ID NO: 19317 - DNA, 21 bp, Homo sapiens
ccccagggccccggggcccgg

SEQ ID NO: 19318 - DNA, 18 bp, Homo sapiens
cccaggcccaagtcccgg

SEQ ID NO: 19319 - DNA, 20 bp, Homo sapiens
cccgagcccgcggggtccgg

SEQ ID NO: 19320 - DNA, 18 bp, Homo sapiens
cccgagcaggcgacctgg

SEQ ID NO: 19321 - DNA, 18 bp, Homo sapiens
cccggggccgcagcccgg

SEQ ID NO: 19322 - DNA, 18 bp, Homo sapiens
cccgaacctgaagcctgg

SEQ ID NO: 19323 - DNA, 19 bp, Homo sapiens
cccagctcctggggcctgg

SEQ ID NO: 19324 - DNA, 18 bp, Homo sapiens
cccaagctggtgacctgg

SEQ ID NO: 19325 - DNA, 21 bp, Homo sapiens
cccggggcggggctggcccgg

SEQ ID NO: 19326 - DNA, 19 bp, Homo sapiens
cccaagctgatgaagctgg

SEQ ID NO: 19327 - DNA, 18 bp, Homo sapiens
cccgggccggatccccgg

SEQ ID NO: 19328 - DNA, 20 bp, Homo sapiens
ccgcggctggtggggcctgg

SEQ ID NO: 19329 - DNA, 18 bp, Homo sapiens
ccgcagccgggggcccgg

SEQ ID NO: 19330 - DNA, 18 bp, Homo sapiens
cccaagcttaaaggctgg

SEQ ID NO: 19331 - DNA, 20 bp, Homo sapiens
ccggagctggaggcgcccgg

SEQ ID NO: 19332 - DNA, 18 bp, Homo sapiens
cccggagctacgacctgg

SEQ ID NO: 19333 - DNA, 19 bp, Homo sapiens
cccgaggccgccggcccgg

SEQ ID NO: 19334 - DNA, 19 bp, Homo sapiens
cccaagctctgcggcctgg

SEQ ID NO: 19335 - DNA, 19 bp, Homo sapiens
ccctggaacccgggcccgg

SEQ ID NO: 19336 - DNA, 18 bp, Homo sapiens
cccgggccgaagcgccgg

SEQ ID NO: 19337 - DNA, 18 bp, Homo sapiens
cctgaactaaaatcccgg

SEQ ID NO: 19338 - DNA, 17 bp, Homo sapiens
ccgggctggggcctggc

SEQ ID NO: 19339 - DNA, 94 bp, Murid herpesvirus 4
cgaccttcccggccccctcccgagctggggcccggatccccccggttcccccgaccttcccggccccctcccgagctggggcccggatcccccg

SEQ ID NO: 19340 - DNA, 24 bp, Murid herpesvirus 4
tggggcccggatccccccggttcc

SEQ ID NO: 19341 - DNA, 19 bp, Homo sapiens
ggcgtccgggtccccggcc

SEQ ID NO: 19342 - DNA, 21 bp, Homo sapiens
ggggcctgtggctctggttcc

SEQ ID NO: 19343 - DNA, 18 bp, Homo sapiens
tgggacctgggtctggct

SEQ ID NO: 19344 - DNA, 24 bp, Homo sapiens
tggggtccagatccttgatcattc

SEQ ID NO: 19345 - DNA, 20 bp, Homo sapiens
tggggcccggcttccctggt

SEQ ID NO: 19346 - DNA, 19 bp, Homo sapiens
tggggtctggacccccagc

SEQ ID NO: 19347 - DNA, 19 bp, Homo sapiens
tagggcccggatttcccgg

SEQ ID NO: 19348 - DNA, 22 bp, Homo sapiens
ggtacggggtccctccggttcc

SEQ ID NO: 19349 - DNA, 20 bp, Homo sapiens
tggggtccgggtcccccggt

SEQ ID NO: 19350 - DNA, 18 bp, Homo sapiens
ggcccgatccccttggtt

SEQ ID NO: 19351 - DNA, 23 bp, Homo sapiens
tgaggcccgggtcctcaggatcc

SEQ ID NO: 19352 - DNA, 18 bp, Homo sapiens
tggggcctaggtcccccc

SEQ ID NO: 19353 - DNA, 19 bp, Homo sapiens
tgggggatccccttggttc

SEQ ID NO: 19354 - DNA, 19 bp, Homo sapiens
tggggcccccctctggttc

SEQ ID NO: 19355 - DNA, 22 bp, Homo sapiens
tggggcccagatctctaaagcc

SEQ ID NO: 19356 - DNA, 20 bp, Homo sapiens
tggggcttggagcccctgcc

SEQ ID NO: 19357 - DNA, 21 bp, Homo sapiens
tgaggcccgggtgctggttcc

SEQ ID NO: 19358 - DNA, 18 bp, Homo sapiens
tggggccccgatcttccc

SEQ ID NO: 19359 - DNA, 19 bp, Homo sapiens
tggggcctgggcccagctc

SEQ ID NO: 19360 - DNA, 21 bp, Homo sapiens
tggggtccaggttccccggcc

SEQ ID NO: 19361 - DNA, 20 bp, Homo sapiens
tggggcccgggccctcggct

SEQ ID NO: 19362 - DNA, 20 bp, Homo sapiens
tggggcccggggcctcagct

SEQ ID NO: 19363 - DNA, 124 bp, Murid herpesvirus 4
cgagctggggcccggatcccccgacctccccggccccctcccgagctggggcccggttcccccgacctccccggccccctcccgagctggggcccggttcccccaccttcccggccctcgcccg

SEQ ID NO: 19364 - DNA, 24 bp, Murid herpesvirus 4
tccccggccccctcccgagctggg

SEQ ID NO: 19365 - DNA, 21 bp, Homo sapiens
ccctggccctgagcggctggg

SEQ ID NO: 19366 - DNA, 24 bp, Homo sapiens
tcctcggcctcccaaaatattggg

SEQ ID NO: 19367 - DNA, 18 bp, Homo sapiens
tccccgccccctcctgcc

SEQ ID NO: 19368 - DNA, 17 bp, Homo sapiens
cggccccctacctctgg

SEQ ID NO: 19369 - DNA, 21 bp, Homo sapiens
tcccccgcgggccgagctggg

SEQ ID NO: 19370 - DNA, 25 bp, Homo sapiens
tccccggctctggcagcgggctggg

SEQ ID NO: 19371 - DNA, 24 bp, Homo sapiens
tccttggcctcccaaagtgttggg

SEQ ID NO: 19372 - DNA, 23 bp, Homo sapiens
tcctcggccccctgctctgccgg

SEQ ID NO: 19373 - DNA, 23 bp, Homo sapiens
cccttggtcccctcccacccagg

SEQ ID NO: 19374 - DNA, 19 bp, Homo sapiens
cccttggccccttcctgcc

SEQ ID NO: 19375 - DNA, 19 bp, Homo sapiens
cccgccccctccgcccggg

SEQ ID NO: 19376 - DNA, 21 bp, Homo sapiens
ccccggcctcctcctctcggg

SEQ ID NO: 19377 - DNA, 23 bp, Homo sapiens
ccccggcctcccaaaatgctggg

SEQ ID NO: 19378 - DNA, 21 bp, Homo sapiens
tccccggctccctcccgcccg

SEQ ID NO: 19379 - DNA, 27 bp, Homo sapiens
tcccctgccccctcccttccccctggg

SEQ ID NO: 19380 - DNA, 20 bp, Homo sapiens
ccccgggaatccgagctggg

SEQ ID NO: 19381 - DNA, 23 bp, Homo sapiens
cctcggcctcccaaagagctggg

SEQ ID NO: 19382 - DNA, 19 bp, Homo sapiens
tccccggcttctcccgccg

SEQ ID NO: 19383 - DNA, 17 bp, Homo sapiens
ccaggcccccttcctgg

SEQ ID NO: 19384 - DNA, 24 bp, Homo sapiens
tccttggcctcccaaagtgctggg

SEQ ID NO: 19385 - DNA, 23 bp, Homo sapiens
cctcggcctcccaaaatgctggg

SEQ ID NO: 19386 - DNA, 17 bp, Homo sapiens
cagctccctcccatggg

SEQ ID NO: 19387 - DNA, 21 bp, Homo sapiens
ggctttccttcctgagctggg

SEQ ID NO: 19388 - DNA, 24 bp, Homo sapiens
tccttggactcccaaagtgctggg

SEQ ID NO: 19389 - DNA, 22 bp, Homo sapiens
tctccagtctcaaggagctggg

SEQ ID NO: 19390 - DNA, 23 bp, Homo sapiens
cctcggcctcccaaagggctggg

SEQ ID NO: 19391 - DNA, 20 bp, Homo sapiens
ccgcctcccaaagtgctggg

SEQ ID NO: 19392 - DNA, 23 bp, Homo sapiens
ccttggcctcccaaaatgttggg

SEQ ID NO: 19393 - DNA, 20 bp, Homo sapiens
gccttggcttccaagctggg

SEQ ID NO: 19394 - DNA, 15 bp, Homo sapiens
tccccgccccctccg

SEQ ID NO: 19395 - DNA, 20 bp, Homo sapiens
tccccggctccctccgatgg

SEQ ID NO: 19396 - DNA, 21 bp, Homo sapiens
ccccggctcagctgagctggg

SEQ ID NO: 19397 - DNA, 19 bp, Homo sapiens
tcctcggccccctccttgg

SEQ ID NO: 19398 - DNA, 22 bp, Homo sapiens
ccctgcccctcagcaagctggg

SEQ ID NO: 19399 - DNA, 18 bp, Homo sapiens
tccatggcccccttctgg

SEQ ID NO: 19400 - DNA, 23 bp, Homo sapiens
cctcggcctcccaaactgctggg

SEQ ID NO: 19401 - DNA, 21 bp, Homo sapiens
tccttggccctaggagctggg

SEQ ID NO: 19402 - DNA, 23 bp, Homo sapiens
ccttggcctcccaaagagctggg

SEQ ID NO: 19403 - DNA, 20 bp, Homo sapiens
ccgggtctctgcgagctggg

SEQ ID NO: 19404 - DNA, 19 bp, Homo sapiens
cctggcggctcgagctggg

SEQ ID NO: 19405 - DNA, 23 bp, Homo sapiens
tccccggccccctccagcctggg

SEQ ID NO: 19406 - DNA, 18 bp, Homo sapiens
cctcggtcttccaaactg

SEQ ID NO: 19407 - DNA, 25 bp, Homo sapiens
cccggccccctccctgcttcctggg

SEQ ID NO: 19408 - DNA, 26 bp, Homo sapiens
tcccaggcccccttttggcccagctg

SEQ ID NO: 19409 - DNA, 23 bp, Homo sapiens
ccctctcagccttctgagctggg

SEQ ID NO: 19410 - DNA, 19 bp, Homo sapiens
cctggccccctctccaggg

SEQ ID NO: 19411 - DNA, 23 bp, Homo sapiens
tccttggcccccaaagtgctggg

SEQ ID NO: 19412 - DNA, 24 bp, Homo sapiens
tcctcggcctcccaaagtgctggg

SEQ ID NO: 19413 - DNA, 23 bp, Homo sapiens
cctcggtctcccgagtagctggg

SEQ ID NO: 19414 - DNA, 24 bp, Homo sapiens
tccccagcctcctgagtagctggg

SEQ ID NO: 19415 - DNA, 19 bp, Homo sapiens
ggcctcccaaagtgttggg

SEQ ID NO: 19416 - DNA, 16 bp, Homo sapiens
cggctccctcccgccg

SEQ ID NO: 19417 - DNA, 20 bp, Homo sapiens
cggcctcccaaaatgctggg

SEQ ID NO: 19418 - DNA, 23 bp, Homo sapiens
cctcggcctcccaaattgctggg

SEQ ID NO: 19419 - DNA, 20 bp, Homo sapiens
cggcctcccaaaatgttggg

SEQ ID NO: 19420 - DNA, 24 bp, Homo sapiens
cctgcagcgccttcttgagctggg

SEQ ID NO: 19421 - DNA, 20 bp, Homo sapiens
cccggccctctctccgctgg

SEQ ID NO: 19422 - DNA, 16 bp, Homo sapiens
tccccggcgccctccg

SEQ ID NO: 19423 - DNA, 29 bp, Homo sapiens
tccctggcctcctacagggcccagctcgg

SEQ ID NO: 19424 - DNA, 23 bp, Homo sapiens
cctcggcctcccaagtagctggg

SEQ ID NO: 19425 - DNA, 22 bp, Homo sapiens
tccccgtcccctccccacaggg

SEQ ID NO: 19426 - DNA, 19 bp, Homo sapiens
tcctgaccccctcccagag

SEQ ID NO: 19427 - DNA, 16 bp, Homo sapiens
tctccggcccctcctg

SEQ ID NO: 19428 - DNA, 18 bp, Homo sapiens
tcctcagtctagagctgg

SEQ ID NO: 19429 - DNA, 16 bp, Homo sapiens
tccccggctctccccg

SEQ ID NO: 19430 - DNA, 23 bp, Homo sapiens
ccttggcctcccaaattgctggg

SEQ ID NO: 19431 - DNA, 23 bp, Homo sapiens
cctcggccccacaaagagctggg

SEQ ID NO: 19432 - DNA, 21 bp, Homo sapiens
tccccggctgttcttccatgg

SEQ ID NO: 19433 - DNA, 19 bp, Homo sapiens
ggcctcccaaagagctggg

SEQ ID NO: 19434 - DNA, 18 bp, Homo sapiens
tccccggctcccatctag

SEQ ID NO: 19435 - DNA, 21 bp, Homo sapiens
tccccggccccctcctctagg

SEQ ID NO: 19436 - DNA, 20 bp, Homo sapiens
cccggccccacaaggctggg

SEQ ID NO: 19437 - DNA, 23 bp, Homo sapiens
tcccctgccccctccactccggg

SEQ ID NO: 19438 - DNA, 23 bp, Homo sapiens
ccttggcctcccaaaatgctggg

SEQ ID NO: 19439 - DNA, 20 bp, Homo sapiens
cggcctcccaaagtgctggg

SEQ ID NO: 19440 - DNA, 17 bp, Homo sapiens
ccccggccctctccagg

SEQ ID NO: 19441 - DNA, 20 bp, Homo sapiens
tccccagctccctcccctgg

SEQ ID NO: 19442 - DNA, 27 bp, Homo sapiens
tcctcgaccccctcttcggcccagctg

SEQ ID NO: 19443 - DNA, 18 bp, Homo sapiens
tcccttgccccaagctgg

SEQ ID NO: 19444 - DNA, 20 bp, Homo sapiens
cccggccgaggcgggctggg

SEQ ID NO: 19445 - DNA, 18 bp, Homo sapiens
tctccagcttcgagctgg

SEQ ID NO: 19446 - DNA, 25 bp, Homo sapiens
ccccggccccgggtgacgggctggg

SEQ ID NO: 19447 - DNA, 19 bp, Homo sapiens
tccctggccccctgcaagg

SEQ ID NO: 19448 - DNA, 19 bp, Homo sapiens
ccctgggggcctgagctgg

SEQ ID NO: 19449 - DNA, 18 bp, Homo sapiens
tccccggcctgctcctga

SEQ ID NO: 19450 - DNA, 19 bp, Homo sapiens
ggcccctcctgaggctggg

SEQ ID NO: 19451 - DNA, 23 bp, Homo sapiens
cctcggcttcccaaactgctggg

SEQ ID NO: 19452 - DNA, 16 bp, Homo sapiens
tcccaggccccctctg

SEQ ID NO: 19453 - DNA, 23 bp, Homo sapiens
tccctggttatccctgagctggg

SEQ ID NO: 19454 - DNA, 22 bp, Homo sapiens
tccccggccatttccttacggg

SEQ ID NO: 19455 - DNA, 19 bp, Homo sapiens
cccggtcccctccccgtgg

SEQ ID NO: 19456 - DNA, 23 bp, Homo sapiens
cctcggcctcccgagtagctggg

SEQ ID NO: 19457 - DNA, 20 bp, Homo sapiens
gccttcctcccgagctctgg

SEQ ID NO: 19458 - DNA, 23 bp, Homo sapiens
tccttggccccctccccgacagg

SEQ ID NO: 19459 - DNA, 22 bp, Homo sapiens
gccttggtctcccaaagctggg

SEQ ID NO: 19460 - DNA, 19 bp, Homo sapiens
cagcccctagggagctggg

SEQ ID NO: 19461 - DNA, 21 bp, Homo sapiens
ccttggccctggagagctggg

SEQ ID NO: 19462 - DNA, 17 bp, Homo sapiens
tccctggccctccctgc

SEQ ID NO: 19463 - DNA, 28 bp, Homo sapiens
tccccgacccatgggctcttgggctggg

SEQ ID NO: 19464 - DNA, 18 bp, Homo sapiens
cccccggctttctcctgg

SEQ ID NO: 19465 - DNA, 17 bp, Homo sapiens
cccggccccctccccgg

SEQ ID NO: 19466 - DNA, 17 bp, Homo sapiens
agcccttctgagctggg

SEQ ID NO: 19467 - DNA, 20 bp, Homo sapiens
ccctggtcttccaagctggg

SEQ ID NO: 19468 - DNA, 22 bp, Homo sapiens
tccccggccctcccttgggctg

SEQ ID NO: 19469 - DNA, 22 bp, Homo sapiens
tcctcggccctccccgctcggg

SEQ ID NO: 19470 - DNA, 20 bp, Homo sapiens
tccccggcctcctcctctgg

SEQ ID NO: 19471 - DNA, 23 bp, Homo sapiens
tctccggccttttcccaagctgg

SEQ ID NO: 19472 - DNA, 24 bp, Homo sapiens
tccccgagcctcctcctcagtggg

SEQ ID NO: 19473 - DNA, 17 bp, Homo sapiens
tccccggcccctgcctg

SEQ ID NO: 19474 - DNA, 16 bp, Homo sapiens
tccccgccccctccag

SEQ ID NO: 19475 - DNA, 24 bp, Homo sapiens
cctcggccccctccagaatttggg

SEQ ID NO: 19476 - DNA, 18 bp, Homo sapiens
cgaccccctcccgcaagg

SEQ ID NO: 19477 - DNA, 20 bp, Homo sapiens
ggctcccccgaggggctggg

SEQ ID NO: 19478 - DNA, 24 bp, Homo sapiens
ccctggcctgggctctgagctggg

SEQ ID NO: 19479 - DNA, 19 bp, Homo sapiens
cccctggccccctccctgg

SEQ ID NO: 19480 - DNA, 25 bp, Homo sapiens
tcctaggtcccccccaagagctggg

SEQ ID NO: 19481 - DNA, 19 bp, Homo sapiens
tcctggcccctccctgctg

SEQ ID NO: 19482 - DNA, 20 bp, Homo sapiens
cggcctcccaaagtactggg

SEQ ID NO: 19483 - DNA, 21 bp, Homo sapiens
tccccggctgtcctcctgctg

SEQ ID NO: 19484 - DNA, 29 bp, Homo sapiens
tccccggcctcctgttgggcccagctcgg

SEQ ID NO: 19485 - DNA, 20 bp, Homo sapiens
cagcctcccaaattgctggg

SEQ ID NO: 19486 - DNA, 22 bp, Homo sapiens
cccttggccccctccctccggg

SEQ ID NO: 19487 - DNA, 23 bp, Homo sapiens
ccttggtctcccaaaatgctggg

SEQ ID NO: 19488 - DNA, 23 bp, Homo sapiens
cctcggcctcccgagtagttggg

SEQ ID NO: 19489 - DNA, 23 bp, Homo sapiens
cccccggccctttcctcctgtgg

SEQ ID NO: 19490 - DNA, 24 bp, Homo sapiens
tcctcagcctcccaagcagctggg

SEQ ID NO: 19491 - DNA, 19 bp, Homo sapiens
ccctgcccccctcccgcct

SEQ ID NO: 19492 - DNA, 21 bp, Homo sapiens
tcctaggaggtccgagctggg

SEQ ID NO: 19493 - DNA, 18 bp, Homo sapiens
tccctgggcccaagctgg

SEQ ID NO: 19494 - DNA, 19 bp, Homo sapiens
cccccggccccctccccgg

SEQ ID NO: 19495 - DNA, 22 bp, Homo sapiens
tccccgagcctcctcctccagg

SEQ ID NO: 19496 - DNA, 24 bp, Homo sapiens
cccggccctcttctcgtggttggg

SEQ ID NO: 19497 - DNA, 17 bp, Homo sapiens
ccggtcccctcccgccg

SEQ ID NO: 19498 - DNA, 20 bp, Homo sapiens
cggcctcccaaactgctggg

SEQ ID NO: 19499 - DNA, 18 bp, Homo sapiens
ggcccctccctgaactag

SEQ ID NO: 19500 - DNA, 24 bp, Homo sapiens
tctccacgcaccttccgagctggg

SEQ ID NO: 19501 - DNA, 19 bp, Homo sapiens
tccccagctccttcgctgg

SEQ ID NO: 19502 - DNA, 17 bp, Homo sapiens
ggcgcttccgagctggg

SEQ ID NO: 19503 - DNA, 21 bp, Homo sapiens
tcccacggctccacggctggg

SEQ ID NO: 19504 - DNA, 20 bp, Homo sapiens
ccccggcctcctccgaaggg

SEQ ID NO: 19505 - DNA, 22 bp, Homo sapiens
cctcggcctccaaagagctggg

SEQ ID NO: 19506 - DNA, 22 bp, Homo sapiens
tccccgatcccctttccgccgg

SEQ ID NO: 19507 - DNA, 23 bp, Homo sapiens
tccccgttctctcatgggctggg

SEQ ID NO: 19508 - DNA, 26 bp, Homo sapiens
ccctcggtctctagccccgggctggg

SEQ ID NO: 19509 - DNA, 25 bp, Homo sapiens
ccccggcctcctccgcagggctggg

SEQ ID NO: 19510 - DNA, 24 bp, Homo sapiens
tcctcagcctcccgagtagctggg

SEQ ID NO: 19511 - DNA, 64 bp, Equine herpesvirus 2
gctgtgcggcacggacggcgacgcggctgagatactcactgacgtgctgaccaacactgacagc

SEQ ID NO: 19512 - DNA, 24 bp, Equine herpesvirus 2
tgacgtgctgaccaacactgacag

SEQ ID NO: 19513 - DNA, 22 bp, Homo sapiens
gtgggtgggccggcactgacag

SEQ ID NO: 19514 - DNA, 24 bp, Homo sapiens
tgacgtgcgtggtcatggctgcag

SEQ ID NO: 19515 - DNA, 19 bp, Homo sapiens
gaagcactgatactgacag

SEQ ID NO: 19516 - DNA, 22 bp, Homo sapiens
gtgctaaatctagcactgacag

SEQ ID NO: 19517 - DNA, 22 bp, Homo sapiens
tgctgtcacacagcactgacag

SEQ ID NO: 19518 - DNA, 21 bp, Homo sapiens
tgactgaccaagtgctggcag

SEQ ID NO: 19519 - DNA, 15 bp, Homo sapiens
gtgctaaccacaaca

SEQ ID NO: 19520 - DNA, 20 bp, Homo sapiens
gcgtgacaaggcactgacag

SEQ ID NO: 19521 - DNA, 21 bp, Homo sapiens
tgatatctgcaacactggcag

SEQ ID NO: 19522 - DNA, 22 bp, Homo sapiens
tgctgggccttaatactgacag

SEQ ID NO: 19523 - DNA, 20 bp, Homo sapiens
tgaggcaaagaccaacactg

SEQ ID NO: 19524 - DNA, 21 bp, Homo sapiens
tgacatgtgagggagcactga

SEQ ID NO: 19525 - DNA, 20 bp, Homo sapiens
acgggggccaacactgacag

SEQ ID NO: 19526 - DNA, 22 bp, Homo sapiens
cgtgcgtggctggcactggcag

SEQ ID NO: 19527 - DNA, 19 bp, Homo sapiens
cgatggtcaacactgacag

SEQ ID NO: 19528 - DNA, 66 bp, Equine herpesvirus 2
cggtcaacaccttctctgacctcgcgggcatgtttggcacttccgcgtggctggggcgggtccccg

SEQ ID NO: 19529 - DNA, 19 bp, Equine herpesvirus 2
tggctggggcgggtccccg

SEQ ID NO: 19530 - DNA, 17 bp, Homo sapiens
tggctgagggggccccg

SEQ ID NO: 19531 - DNA, 17 bp, Homo sapiens
tggcggccgggtccccg

SEQ ID NO: 19532 - DNA, 17 bp, Homo sapiens
tggcagccaggtccccg

SEQ ID NO: 19533 - DNA, 17 bp, Homo sapiens
tggcgtccgggtccccg

SEQ ID NO: 19534 - DNA, 18 bp, Homo sapiens
tggcgtgagcagtccccg

SEQ ID NO: 19535 - DNA, 15 bp, Homo sapiens
ggctgggagcccccg

SEQ ID NO: 19536 - DNA, 16 bp, Homo sapiens
tggctggggcggcccg

SEQ ID NO: 19537 - DNA, 15 bp, Homo sapiens
tggctggggcccccg

SEQ ID NO: 19538 - DNA, 21 bp, Homo sapiens
tggctagagccgctgggttcc

SEQ ID NO: 19539 - DNA, 17 bp, Homo sapiens
agtgcggcgggtcctcg

SEQ ID NO: 19540 - DNA, 20 bp, Homo sapiens
ggctggggtcccacaccccg

SEQ ID NO: 19541 - DNA, 19 bp, Homo sapiens
ggctggggtcggtgggtcc

SEQ ID NO: 19542 - DNA, 18 bp, Homo sapiens
ggctggggccaagccccg

SEQ ID NO: 19543 - DNA, 20 bp, Homo sapiens
ggctgggtacactgggtccc

SEQ ID NO: 19544 - DNA, 22 bp, Homo sapiens
tggctgaggggtgttttccccg

SEQ ID NO: 19545 - DNA, 15 bp, Homo sapiens
ggctgaaggtccccg

SEQ ID NO: 19546 - DNA, 18 bp, Homo sapiens
ggctaggctgggtccccg

SEQ ID NO: 19547 - DNA, 19 bp, Homo sapiens
ggccgcctgcgggtccccg

SEQ ID NO: 19548 - DNA, 16 bp, Homo sapiens
cggcccggggtccccg

SEQ ID NO: 19549 - DNA, 20 bp, Homo sapiens
tggctggaggtgctaccccg

SEQ ID NO: 19550 - DNA, 19 bp, Homo sapiens
ggctggaagagagtccccg

SEQ ID NO: 19551 - DNA, 21 bp, Homo sapiens
tgggtggggcggctcattccg

SEQ ID NO: 19552 - DNA, 19 bp, Homo sapiens
ggctgggggaggatccccg

SEQ ID NO: 19553 - DNA, 20 bp, Homo sapiens
tggctggggagaggagaccc

SEQ ID NO: 19554 - DNA, 21 bp, Homo sapiens
tggctggggctgtttcaagtc

SEQ ID NO: 19555 - DNA, 21 bp, Homo sapiens
tggctgagggcagctgccccg

SEQ ID NO: 19556 - DNA, 17 bp, Homo sapiens
ggctggggaggttcccg

SEQ ID NO: 19557 - DNA, 18 bp, Homo sapiens
ggctggggtaggtctccg

SEQ ID NO: 19558 - DNA, 20 bp, Homo sapiens
tggctgggtgccttctcccc

SEQ ID NO: 19559 - DNA, 20 bp, Homo sapiens
ggctggggcggccaaacccg

SEQ ID NO: 19560 - DNA, 16 bp, Homo sapiens
tggcggggggatcacc

SEQ ID NO: 19561 - DNA, 19 bp, Homo sapiens
tggctgaggggcacggccc

SEQ ID NO: 19562 - DNA, 21 bp, Homo sapiens
tggcggggcggccggtcctcg

SEQ ID NO: 19563 - DNA, 18 bp, Homo sapiens
tggctggggcgccctccg

SEQ ID NO: 19564 - DNA, 15 bp, Homo sapiens
ggctggggggccccg

SEQ ID NO: 19565 - DNA, 19 bp, Homo sapiens
agcgtgcggcgggttcccg

SEQ ID NO: 19566 - DNA, 18 bp, Homo sapiens
ggctggggtgggcaaccg

SEQ ID NO: 19567 - DNA, 17 bp, Homo sapiens
ggctgaagcagtcttcg

SEQ ID NO: 19568 - DNA, 18 bp, Homo sapiens
tggctgaggggctggccc

SEQ ID NO: 19569 - DNA, 16 bp, Homo sapiens
ggctggagaatccccg

SEQ ID NO: 19570 - DNA, 15 bp, Homo sapiens
ggcgaagggtccccg

SEQ ID NO: 19571 - DNA, 16 bp, Homo sapiens
ggctgggcaacctccg

SEQ ID NO: 19572 - DNA, 18 bp, Homo sapiens
gcttggggcgggtcctcg

SEQ ID NO: 19573 - DNA, 21 bp, Homo sapiens
tagctggggacagtgtcttcg

SEQ ID NO: 19574 - DNA, 19 bp, Homo sapiens
ggctgggggtgacgccccg

SEQ ID NO: 19575 - DNA, 19 bp, Homo sapiens
tggctgggcagttcttccg

SEQ ID NO: 19576 - DNA, 18 bp, Homo sapiens
tagctggggcaatcttcg

SEQ ID NO: 19577 - DNA, 18 bp, Homo sapiens
tggcggggcggggaaccg

SEQ ID NO: 19578 - DNA, 21 bp, Homo sapiens
tggccggggtccacgaccccg

SEQ ID NO: 19579 - DNA, 18 bp, Homo sapiens
gccgatcaggggtccccg

SEQ ID NO: 19580 - DNA, 18 bp, Homo sapiens
tggctgggggaggccccg

SEQ ID NO: 19581 - DNA, 16 bp, Homo sapiens
tggctgggggctcccc

SEQ ID NO: 19582 - DNA, 18 bp, Homo sapiens
tggcaggggcggcctccg

SEQ ID NO: 19583 - DNA, 21 bp, Homo sapiens
tggctaggccgtccgtcctcg

SEQ ID NO: 19584 - DNA, 17 bp, Homo sapiens
tgcctggggcggtcccc

SEQ ID NO: 19585 - DNA, 17 bp, Homo sapiens
ggctggcgcggtccccg

SEQ ID NO: 19586 - DNA, 17 bp, Homo sapiens
tgactgggggacccccg

SEQ ID NO: 19587 - DNA, 22 bp, Homo sapiens
ggctgggcagagtgggtccccg

SEQ ID NO: 19588 - DNA, 19 bp, Homo sapiens
tgcctgcgctgggtccccg

SEQ ID NO: 19589 - DNA, 18 bp, Homo sapiens
ggctggggtggagacccc

SEQ ID NO: 19590 - DNA, 16 bp, Homo sapiens
ggctgggggtctcccg

SEQ ID NO: 19591 - DNA, 18 bp, Homo sapiens
tggctggagcactggccc

SEQ ID NO: 19592 - DNA, 18 bp, Homo sapiens
ggccggggcgggtctccg

SEQ ID NO: 19593 - DNA, 17 bp, Homo sapiens
ggctgaagaagtcctcg

SEQ ID NO: 19594 - DNA, 19 bp, Homo sapiens
gcgagcccccgggtccccg

SEQ ID NO: 19595 - DNA, 15 bp, Homo sapiens
cggctcgggtccccg

SEQ ID NO: 19596 - DNA, 16 bp, Homo sapiens
ggctggggatcctccg

SEQ ID NO: 19597 - DNA, 16 bp, Homo sapiens
ggctgggcggtccccg

SEQ ID NO: 19598 - DNA, 19 bp, Homo sapiens
ggctgatcgcgggtccccg

SEQ ID NO: 19599 - DNA, 19 bp, Homo sapiens
tgtttggggcgaccccacc

SEQ ID NO: 19600 - DNA, 18 bp, Homo sapiens
tggctgtccgggtccccg

SEQ ID NO: 19601 - DNA, 18 bp, Homo sapiens
gctggggcggcacctccg

SEQ ID NO: 19602 - DNA, 18 bp, Homo sapiens
tggctgggggcggaggtc

SEQ ID NO: 19603 - DNA, 19 bp, Homo sapiens
tggcgggaacaagttcccg

SEQ ID NO: 19604 - DNA, 19 bp, Homo sapiens
tggcgggaggtggtccccg

SEQ ID NO: 19605 - DNA, 20 bp, Homo sapiens
ggctggggcaggtaatcccg

SEQ ID NO: 19606 - DNA, 15 bp, Homo sapiens
ggctgggcagccccg

SEQ ID NO: 19607 - DNA, 17 bp, Homo sapiens
tggctgggggcgccccc

SEQ ID NO: 19608 - DNA, 16 bp, Homo sapiens
tggactgggaatcccc

SEQ ID NO: 19609 - DNA, 18 bp, Homo sapiens
tggctgggtccatgtccc

SEQ ID NO: 19610 - DNA, 16 bp, Homo sapiens
ggctgggaatccctcg

SEQ ID NO: 19611 - DNA, 18 bp, Homo sapiens
tgagtcactgggtccccg

SEQ ID NO: 19612 - DNA, 19 bp, Homo sapiens
tggctggggggcctcaccc

SEQ ID NO: 19613 - DNA, 17 bp, Homo sapiens
tgacttaggggtctccg

SEQ ID NO: 19614 - DNA, 17 bp, Homo sapiens
tggccggctcatccccg

SEQ ID NO: 19615 - DNA, 22 bp, Homo sapiens
tggtgggggggaggggttcccg

SEQ ID NO: 19616 - DNA, 20 bp, Homo sapiens
tgacgggtcgcgggtccccg

SEQ ID NO: 19617 - DNA, 18 bp, Homo sapiens
tggcgacgaaggtcctcg

SEQ ID NO: 19618 - DNA, 18 bp, Homo sapiens
gctgggacttggtctccg

SEQ ID NO: 19619 - DNA, 17 bp, Homo sapiens
tgtctgggggagccccc

SEQ ID NO: 19620 - DNA, 19 bp, Homo sapiens
tgactgaaggctgggtccc

SEQ ID NO: 19621 - DNA, 20 bp, Homo sapiens
tagctgggactgcgtctccg

SEQ ID NO: 19622 - DNA, 17 bp, Homo sapiens
tggccggggagtcctcg

SEQ ID NO: 19623 - DNA, 19 bp, Homo sapiens
tggatgccgcaggtccccg

SEQ ID NO: 19624 - DNA, 17 bp, Homo sapiens
tggcggggggtgccccc

SEQ ID NO: 19625 - DNA, 18 bp, Homo sapiens
tggctggtggcagcagtc

SEQ ID NO: 19626 - DNA, 16 bp, Homo sapiens
tgcctggaagtccccg

SEQ ID NO: 19627 - DNA, 17 bp, Homo sapiens
tagctgaagggtccccg

SEQ ID NO: 19628 - DNA, 18 bp, Homo sapiens
tggctggggaggggaccc

SEQ ID NO: 19629 - DNA, 20 bp, Homo sapiens
ggctggggtcatgccctccg

SEQ ID NO: 19630 - DNA, 18 bp, Homo sapiens
tgttggggtcaggccccg

SEQ ID NO: 19631 - DNA, 18 bp, Homo sapiens
tggctgaggaggacttcc

SEQ ID NO: 19632 - DNA, 18 bp, Homo sapiens
tgcctggggccgtcctcg

SEQ ID NO: 19633 - DNA, 19 bp, Homo sapiens
tggctggggctatcacacc

SEQ ID NO: 19634 - DNA, 16 bp, Homo sapiens
tggctgggtcggcccg

SEQ ID NO: 19635 - DNA, 18 bp, Homo sapiens
tggcaggggctgatcccc

SEQ ID NO: 19636 - DNA, 15 bp, Homo sapiens
ggctggggcagcccg

SEQ ID NO: 19637 - DNA, 16 bp, Homo sapiens
tggccgggcgtcctcg

SEQ ID NO: 19638 - DNA, 19 bp, Homo sapiens
tgactggggtcaggacccc

SEQ ID NO: 19639 - DNA, 20 bp, Homo sapiens
tggctgtggcggggcctccg

SEQ ID NO: 19640 - DNA, 18 bp, Homo sapiens
tgtctggggcagccctcg

SEQ ID NO: 19641 - DNA, 17 bp, Homo sapiens
cgggaagcgggtccccg

SEQ ID NO: 19642 - DNA, 21 bp, Homo sapiens
tgactggggcagcttcctccg

SEQ ID NO: 19643 - DNA, 17 bp, Homo sapiens
tggctgagccttccccg

SEQ ID NO: 19644 - DNA, 16 bp, Homo sapiens
tgcctggggcggcccc

SEQ ID NO: 19645 - DNA, 17 bp, Homo sapiens
tggctggggaagtctcc

SEQ ID NO: 19646 - DNA, 16 bp, Homo sapiens
ggctgggggggccccg

SEQ ID NO: 19647 - DNA, 21 bp, Homo sapiens
ggctggggtggatgtggtccc

SEQ ID NO: 19648 - DNA, 17 bp, Homo sapiens
tggctgagatgtcctcg

SEQ ID NO: 19649 - DNA, 19 bp, Homo sapiens
ggcccggggcgggtctccg

SEQ ID NO: 19650 - DNA, 18 bp, Homo sapiens
gctgaggcggggtctccg

SEQ ID NO: 19651 - DNA, 16 bp, Homo sapiens
tggctgagtggccccg

SEQ ID NO: 19652 - DNA, 16 bp, Homo sapiens
tggctggggagccccg

SEQ ID NO: 19653 - DNA, 21 bp, Homo sapiens
tggctggagagccagtctccg

SEQ ID NO: 19654 - DNA, 16 bp, Homo sapiens
gggaggcgggtcctcg

SEQ ID NO: 19655 - DNA, 17 bp, Homo sapiens
tggcggggcaggccccc

SEQ ID NO: 19656 - DNA, 23 bp, Homo sapiens
tggctgggggagggtggtctccg

SEQ ID NO: 19657 - DNA, 19 bp, Homo sapiens
tgtctgggagaacctcccg

SEQ ID NO: 19658 - DNA, 19 bp, Homo sapiens
ggctggggctgtgaatccc

SEQ ID NO: 19659 - DNA, 18 bp, Homo sapiens
tggctgggagggctgtcc

SEQ ID NO: 19660 - DNA, 19 bp, Homo sapiens
tggctgaggcatccaaccg

SEQ ID NO: 19661 - DNA, 17 bp, Homo sapiens
ggctctacgggtccccg

SEQ ID NO: 19662 - DNA, 24 bp, Homo sapiens
ggcccagtgggggtgggtccccgc

SEQ ID NO: 19663 - DNA, 18 bp, Homo sapiens
ggcgtggtggcgggtccc

SEQ ID NO: 19664 - DNA, 18 bp, Homo sapiens
tggctggggtcaggatcc

SEQ ID NO: 19665 - DNA, 20 bp, Homo sapiens
tagctgggattacaggttcc

SEQ ID NO: 19666 - DNA, 16 bp, Homo sapiens
tggctgaggcctcccc

SEQ ID NO: 19667 - DNA, 17 bp, Homo sapiens
tggtggggctccagccg

SEQ ID NO: 19668 - DNA, 20 bp, Homo sapiens
tggctggagccaggtgttcc

SEQ ID NO: 19669 - DNA, 17 bp, Homo sapiens
tggcgcggaggtccccg

SEQ ID NO: 19670 - DNA, 24 bp, Homo sapiens
tggctccgcgcggtgggtccccgc

SEQ ID NO: 19671 - DNA, 17 bp, Homo sapiens
tggctgggcctcccccg

SEQ ID NO: 19672 - DNA, 16 bp, Homo sapiens
tggctgaggacacccg

SEQ ID NO: 19673 - DNA, 20 bp, Homo sapiens
tggctggggccgctcctccg

SEQ ID NO: 19674 - DNA, 18 bp, Homo sapiens
tgggtgggggatgccccg

SEQ ID NO: 19675 - DNA, 16 bp, Homo sapiens
tggcgggggcagcccg

SEQ ID NO: 19676 - DNA, 20 bp, Homo sapiens
tggctgggctgccagcctcc

SEQ ID NO: 19677 - DNA, 18 bp, Homo sapiens
ggctgggacaggggtccc

SEQ ID NO: 19678 - DNA, 19 bp, Homo sapiens
ggtgggtggcgggtccccg

SEQ ID NO: 19679 - DNA, 22 bp, Homo sapiens
tagctgggcctgtttgggtccc

SEQ ID NO: 19680 - DNA, 17 bp, Homo sapiens
tggctgggagacacccg

SEQ ID NO: 19681 - DNA, 16 bp, Homo sapiens
tggctgatggtccccg

SEQ ID NO: 19682 - DNA, 16 bp, Homo sapiens
ggctggaaaatcctcg

SEQ ID NO: 19683 - DNA, 18 bp, Homo sapiens
tggctgggccaaaacccc

SEQ ID NO: 19684 - DNA, 21 bp, Homo sapiens
tggcgtggggcgaggcctccg

SEQ ID NO: 19685 - DNA, 16 bp, Homo sapiens
ggctggccagtccccg

SEQ ID NO: 19686 - DNA, 17 bp, Homo sapiens
ggctcacagggtccccg

SEQ ID NO: 19687 - DNA, 19 bp, Homo sapiens
tggctgggagagattctcc

SEQ ID NO: 19688 - DNA, 17 bp, Homo sapiens
tggctgggagtctaccc

SEQ ID NO: 19689 - DNA, 15 bp, Homo sapiens
tggctgggccccccg

SEQ ID NO: 19690 - DNA, 19 bp, Homo sapiens
ggctctagctgggtcctcg

SEQ ID NO: 19691 - DNA, 21 bp, Homo sapiens
tgactggggagcttgggtccc

SEQ ID NO: 19692 - DNA, 21 bp, Homo sapiens
tgttggggcgaggcctcctcg

SEQ ID NO: 19693 - DNA, 20 bp, Homo sapiens
tggctgggctgccagcatcc

SEQ ID NO: 19694 - DNA, 19 bp, Homo sapiens
gctgggactgaggttcccg

SEQ ID NO: 19695 - DNA, 19 bp, Homo sapiens
tgactgggggtgtcttccg

SEQ ID NO: 19696 - DNA, 19 bp, Homo sapiens
tggctggggcatgcatccc

SEQ ID NO: 19697 - DNA, 19 bp, Homo sapiens
tggctgtggggggtccccg

SEQ ID NO: 19698 - DNA, 18 bp, Homo sapiens
tggctgggatggccttcc

SEQ ID NO: 19699 - DNA, 19 bp, Homo sapiens
tgtccggtgcgggtccccg

SEQ ID NO: 19700 - DNA, 21 bp, Homo sapiens
tggctggcggccgtgtctccg

SEQ ID NO: 19701 - DNA, 19 bp, Homo sapiens
tggctgggctctcaggtcc

SEQ ID NO: 19702 - DNA, 16 bp, Homo sapiens
tggctgagcatccccg

SEQ ID NO: 19703 - DNA, 18 bp, Homo sapiens
ggctggggcatagtcccc

SEQ ID NO: 19704 - DNA, 15 bp, Homo sapiens
tggccggggtccccg

SEQ ID NO: 19705 - DNA, 19 bp, Homo sapiens
tggctggagctgcccttcc

SEQ ID NO: 19706 - DNA, 18 bp, Homo sapiens
cggctcactgggtccccg

SEQ ID NO: 19707 - DNA, 62 bp, Melanoplus sanguinipes entomopoxvirus
ataatctatattattattttctatttgacttgctaaatttacaattgatgatatttttttat

SEQ ID NO: 19708 - DNA, 24 bp, Melanoplus sanguinipes entomopoxvirus
tctatattattattttctatttga

SEQ ID NO: 19709 - DNA, 18 bp, Homo sapiens
tcattattttctgtttga

SEQ ID NO: 19710 - DNA, 21 bp, Homo sapiens
ctatacatgattttctatttg

SEQ ID NO: 19711 - DNA, 20 bp, Homo sapiens
atattattcatttctatttg

SEQ ID NO: 19712 - DNA, 25 bp, Homo sapiens
tctatatttgtacagccctatttga

SEQ ID NO: 19713 - DNA, 28 bp, Homo sapiens
tatattattatttttctgcatatttgat

SEQ ID NO: 19714 - DNA, 23 bp, Homo sapiens
tattattattttcttttttttga

SEQ ID NO: 19715 - DNA, 23 bp, Homo sapiens
tctatattataattttcctctga

SEQ ID NO: 19716 - DNA, 23 bp, Homo sapiens
tcaatattatatattctatttga

SEQ ID NO: 19717 - DNA, 20 bp, Homo sapiens
tactggcattttctatttga

SEQ ID NO: 19718 - DNA, 61 bp, Pea enation mosaic virus
tcaaaggtcaagccggtagcggcgttccctacgctgctttctcaggccggaagaccaatga

SEQ ID NO: 19719 - DNA, 24 bp, Pea enation mosaic virus
aaggtcaagccggtagcggcgttc

SEQ ID NO: 19720 - DNA, 24 bp, Homo sapiens
aggtcaaacactgcggcggcgttc

SEQ ID NO: 19721 - DNA, 19 bp, Homo sapiens
aggtcaggctggcggcggc

SEQ ID NO: 19722 - DNA, 17 bp, Homo sapiens
aggcgaagagcggcgtt

SEQ ID NO: 19723 - DNA, 21 bp, Homo sapiens
aaggtcaaccacctaggtgtt

SEQ ID NO: 19724 - DNA, 61 bp, Pea enation mosaic virus
tgtggccaggatgctcttccgagaccaaaatgaagaggagctcctccaacacatggccata

SEQ ID NO: 19725 - DNA, 24 bp, Pea enation mosaic virus
ggagctcctccaacacatggccat

SEQ ID NO: 19726 - DNA, 20 bp, Homo sapiens
gcagctcctccgacgcagcc

SEQ ID NO: 19727 - DNA, 20 bp, Homo sapiens
ggagttcctccaaaagaacc

SEQ ID NO: 19728 - DNA, 18 bp, Homo sapiens
ggagctcctgcagcacat

SEQ ID NO: 19729 - DNA, 18 bp, Homo sapiens
gaagctcctcctgctggc

SEQ ID NO: 19730 - DNA, 17 bp, Homo sapiens
ggagtcctccaatgcca

SEQ ID NO: 19731 - DNA, 21 bp, Homo sapiens
ggagctcctgcagcgacgcat

SEQ ID NO: 19732 - DNA, 17 bp, Homo sapiens
gggctcctccatctggc

SEQ ID NO: 19733 - DNA, 19 bp, Homo sapiens
ggagctcctgctgatggcc

SEQ ID NO: 19734 - DNA, 20 bp, Homo sapiens
ggagatcttccaacacagac

SEQ ID NO: 19735 - DNA, 15 bp, Homo sapiens
ggagctcctccagcc

SEQ ID NO: 19736 - DNA, 18 bp, Homo sapiens
gggctcctcctggcatgg

SEQ ID NO: 19737 - DNA, 23 bp, Homo sapiens
ggagctcccccagcgactccggc

SEQ ID NO: 19738 - DNA, 16 bp, Homo sapiens
agagctcctccaagcc

SEQ ID NO: 19739 - DNA, 21 bp, Homo sapiens
gggtttctccgacacatggac

SEQ ID NO: 19740 - DNA, 17 bp, Homo sapiens
ggagctcctctaagcca

SEQ ID NO: 19741 - DNA, 22 bp, Homo sapiens
agagctcctccaggtcggccat

SEQ ID NO: 19742 - DNA, 25 bp, Homo sapiens
ggagctcctcctgcaaaagagccat

SEQ ID NO: 19743 - DNA, 19 bp, Homo sapiens
ggagttctcccagcactga

SEQ ID NO: 19744 - DNA, 20 bp, Homo sapiens
ggagctccccaagccagggc

SEQ ID NO: 19745 - DNA, 21 bp, Homo sapiens
ggagctccctcagtcactccc

SEQ ID NO: 19746 - DNA, 18 bp, Homo sapiens
ggagctcctccagccatg

SEQ ID NO: 19747 - DNA, 15 bp, Homo sapiens
ggagcccctctggcc

SEQ ID NO: 19748 - DNA, 20 bp, Homo sapiens
ggagctcctccagctccagg

SEQ ID NO: 19749 - DNA, 18 bp, Homo sapiens
ggagctccgtcggcatgg

SEQ ID NO: 19750 - DNA, 116 bp, Melanoplus sanguinipes entomopoxvirus
gcgtctgtattaaatatttctaaatttttaggtaataatatattttttaattgtaacttatctataatactatttatatgtaattcttttaaatttactaatatctttaaagatgt

SEQ ID NO: 19751 - DNA, 24 bp, Melanoplus sanguinipes entomopoxvirus
tctaaatttttaggtaataatata

SEQ ID NO: 19752 - DNA, 19 bp, Homo sapiens
atttacaagtaataatata

SEQ ID NO: 19753 - DNA, 22 bp, Homo sapiens
tctaaattcttcacataatata

SEQ ID NO: 19754 - DNA, 19 bp, Homo sapiens
ctaatccaggtaataatat

SEQ ID NO: 19755 - DNA, 22 bp, Homo sapiens
taaatttttaggtaataaaata

SEQ ID NO: 19756 - DNA, 19 bp, Homo sapiens
tctgtatttttaagtaata

SEQ ID NO: 19757 - DNA, 23 bp, Homo sapiens
tctgaatttttaggtacaaaata

SEQ ID NO: 19758 - DNA, 64 bp, Pea enation mosaic virus
acctctccaggtatacagaagagcgggagttttaacacctcctcaacgaactctcggatgaggt

SEQ ID NO: 19759 - DNA, 24 bp, Pea enation mosaic virus
cctcaacgaactctcggatgaggt

SEQ ID NO: 19760 - DNA, 16 bp, Homo sapiens
acgagctggatgaggt

SEQ ID NO: 19761 - DNA, 19 bp, Homo sapiens
tcaacgaattttaagaggt

SEQ ID NO: 19762 - DNA, 15 bp, Homo sapiens
cctcaacaacatgag

SEQ ID NO: 19763 - DNA, 17 bp, Homo sapiens
ctcagggacagatgagg

SEQ ID NO: 19764 - DNA, 19 bp, Homo sapiens
tcagccgacagaatgaggt

SEQ ID NO: 19765 - DNA, 21 bp, Homo sapiens
ctcagcgcaacttgaagaggt

SEQ ID NO: 19766 - DNA, 19 bp, Homo sapiens
cctcaacaaccctatgagg

SEQ ID NO: 19767 - DNA, 19 bp, Homo sapiens
cctgggtgaactctcaagg

SEQ ID NO: 19768 - DNA, 19 bp, Homo sapiens
tcgacgagatccaggaggt

SEQ ID NO: 19769 - DNA, 19 bp, Homo sapiens
tcagcgaccgtgatgaggt

SEQ ID NO: 19770 - DNA, 69 bp, Pea enation mosaic virus
tgggggttgagtacttgggaccctccttatccaagtgaaaattagataaggaaaacccaagaccctcca

SEQ ID NO: 19771 - DNA, 23 bp, Pea enation mosaic virus
taaggaaaacccaagaccctcca

SEQ ID NO: 19772 - DNA, 19 bp, Homo sapiens
aaggaagacagaccctcca

SEQ ID NO: 19773 - DNA, 17 bp, Homo sapiens
taagaaaaagaccttcc

SEQ ID NO: 19774 - DNA, 25 bp, Homo sapiens
taagaaaagcctcaactctcctcca

SEQ ID NO: 19775 - DNA, 15 bp, Homo sapiens
aggaaaaccaccctc

SEQ ID NO: 19776 - DNA, 21 bp, Homo sapiens
ggccaggcccaagactctcca

SEQ ID NO: 19777 - DNA, 16 bp, Homo sapiens
aaggaaaacctgaccc

SEQ ID NO: 19778 - DNA, 21 bp, Homo sapiens
taaggaaagctgagactcccc

SEQ ID NO: 19779 - DNA, 17 bp, Homo sapiens
aaggaaaatgactctcc

SEQ ID NO: 19780 - DNA, 22 bp, Homo sapiens
taaggaaacaccctaattgcct

SEQ ID NO: 19781 - DNA, 19 bp, Homo sapiens
aaggaaaattcaaaatcca

SEQ ID NO: 19782 - DNA, 22 bp, Homo sapiens
caaggaaaacttgtcagctcca

SEQ ID NO: 19783 - DNA, 20 bp, Homo sapiens
taaggaaaatacaaggggcc

SEQ ID NO: 19784 - DNA, 20 bp, Homo sapiens
aggaggcccaggaccctcca

SEQ ID NO: 19785 - DNA, 16 bp, Homo sapiens
aagaccaagaccctcc

SEQ ID NO: 19786 - DNA, 21 bp, Homo sapiens
taaggaaaatacaacaattcc

SEQ ID NO: 19787 - DNA, 22 bp, Homo sapiens
agcttcccctcaagaccctcca

SEQ ID NO: 19788 - DNA, 20 bp, Homo sapiens
tgagaaaacccagaaagcca

SEQ ID NO: 19789 - DNA, 21 bp, Homo sapiens
taaggaaaaccttgaacactc

SEQ ID NO: 19790 - DNA, 24 bp, Homo sapiens
aggagaacccaagtggctcctcca

SEQ ID NO: 19791 - DNA, 18 bp, Homo sapiens
ggaagccacaacccttca

SEQ ID NO: 19792 - DNA, 22 bp, Homo sapiens
taaggaacaacaaaacccttca

SEQ ID NO: 19793 - DNA, 19 bp, Homo sapiens
aagaaaaccattccttcca

SEQ ID NO: 19794 - DNA, 16 bp, Homo sapiens
aagaaaatccaactcc

SEQ ID NO: 19795 - DNA, 17 bp, Homo sapiens
taaagaaagccacctcc

SEQ ID NO: 19796 - DNA, 19 bp, Homo sapiens
aaggagcacagaccctcca

SEQ ID NO: 19797 - DNA, 20 bp, Homo sapiens
taaagaaaatccaagttcct

SEQ ID NO: 19798 - DNA, 17 bp, Homo sapiens
taaggaaaaacctcctc

SEQ ID NO: 19799 - DNA, 20 bp, Homo sapiens
aggaaaactagctccttcca

SEQ ID NO: 19800 - DNA, 18 bp, Homo sapiens
aaaataacccaagattct

SEQ ID NO: 19801 - DNA, 25 bp, Homo sapiens
taagaaaaaccctcttaatcctcca

SEQ ID NO: 19802 - DNA, 23 bp, Homo sapiens
aaggagagagtgaagaccctcca

SEQ ID NO: 19803 - DNA, 20 bp, Homo sapiens
taaggaaaacctgaacactc

SEQ ID NO: 19804 - DNA, 25 bp, Homo sapiens
taaagaaaactcaggatctcccctc

SEQ ID NO: 19805 - DNA, 17 bp, Homo sapiens
aaggaaaacttaacccc

SEQ ID NO: 19806 - DNA, 25 bp, Homo sapiens
taaggaaatgctcaccgactccctc

SEQ ID NO: 19807 - DNA, 21 bp, Homo sapiens
aaggaaaaccccacctctcca

SEQ ID NO: 19808 - DNA, 20 bp, Homo sapiens
taaggaaagctgagaacctc

SEQ ID NO: 19809 - DNA, 25 bp, Homo sapiens
taaggaaaaccaaaaaataccttca

SEQ ID NO: 19810 - DNA, 21 bp, Homo sapiens
taaggaacacccaagactccc

SEQ ID NO: 19811 - DNA, 15 bp, Homo sapiens
caaggaaaaagccct

SEQ ID NO: 19812 - DNA, 17 bp, Homo sapiens
caaggaaaactaagctc

SEQ ID NO: 19813 - DNA, 20 bp, Homo sapiens
taaggaaaactacagatgct

SEQ ID NO: 19814 - DNA, 16 bp, Homo sapiens
aagaaaaccacctctc

SEQ ID NO: 19815 - DNA, 17 bp, Homo sapiens
taaagaaaaaaaccctc

SEQ ID NO: 19816 - DNA, 18 bp, Homo sapiens
aaggaaaaaagcatcctc

SEQ ID NO: 19817 - DNA, 19 bp, Homo sapiens
aaggaaaatcataaccctc

SEQ ID NO: 19818 - DNA, 20 bp, Homo sapiens
aagaaaatccaaggagctcc

SEQ ID NO: 19819 - DNA, 21 bp, Homo sapiens
taaggaaagctgcagccccca

SEQ ID NO: 19820 - DNA, 17 bp, Homo sapiens
aagaaaacccaagtctc

SEQ ID NO: 19821 - DNA, 18 bp, Homo sapiens
aggagaagccaccctcca

SEQ ID NO: 19822 - DNA, 18 bp, Homo sapiens
aggagactccaaaccctc

SEQ ID NO: 19823 - DNA, 15 bp, Homo sapiens
aggaaaacccaatcc

SEQ ID NO: 19824 - DNA, 25 bp, Homo sapiens
taaggaaaaaccaaggacaattcca

SEQ ID NO: 19825 - DNA, 20 bp, Homo sapiens
aggagccgcgagaccctcca

SEQ ID NO: 19826 - DNA, 21 bp, Homo sapiens
caaggaaagccgggttctcca

SEQ ID NO: 19827 - DNA, 18 bp, Homo sapiens
aaggggacccaccctcca

SEQ ID NO: 19828 - DNA, 21 bp, Homo sapiens
taaggaaaatccatggtgcct

SEQ ID NO: 19829 - DNA, 18 bp, Homo sapiens
gacactcaagaccctcca

SEQ ID NO: 19830 - DNA, 17 bp, Homo sapiens
caaggaaaacctgatcc

SEQ ID NO: 19831 - DNA, 19 bp, Homo sapiens
aaggaaaattcaaggtcct

SEQ ID NO: 19832 - DNA, 22 bp, Homo sapiens
aagggggaacccaagcactctc

SEQ ID NO: 19833 - DNA, 18 bp, Homo sapiens
aagaaaacccacaaaact

SEQ ID NO: 19834 - DNA, 21 bp, Homo sapiens
taaggaaagcccaacatcctc

SEQ ID NO: 19835 - DNA, 17 bp, Homo sapiens
aggcccaggaccctcca

SEQ ID NO: 19836 - DNA, 21 bp, Homo sapiens
aaggaaaatttaagtggccct

SEQ ID NO: 19837 - DNA, 18 bp, Homo sapiens
aaggagggccaccctcca

SEQ ID NO: 19838 - DNA, 22 bp, Homo sapiens
gggacccaactgggaccctcca

SEQ ID NO: 19839 - DNA, 19 bp, Homo sapiens
aggaaaaccttcctcttcc

SEQ ID NO: 19840 - DNA, 22 bp, Homo sapiens
caaggaaagcccagggaacccc

SEQ ID NO: 19841 - DNA, 16 bp, Homo sapiens
aggaaaacccaggtcc

SEQ ID NO: 19842 - DNA, 61 bp, Pea enation mosaic virus
cccggtgattcaggactgcccctatttgacatgaagatgaatgtcgtcgcagtccaccggg

SEQ ID NO: 19843 - DNA, 18 bp, Pea enation mosaic virus
tcgtcgcagtccaccggg

SEQ ID NO: 19844 - DNA, 17 bp, Homo sapiens
tcctctgccccaccggg

SEQ ID NO: 19845 - DNA, 16 bp, Homo sapiens
tcgccgcagttccggg

SEQ ID NO: 19846 - DNA, 20 bp, Homo sapiens
tcgcgcgagcacgtaccggg

SEQ ID NO: 19847 - DNA, 21 bp, Homo sapiens
cgtcgcagtcgagcgactggg

SEQ ID NO: 19848 - DNA, 15 bp, Homo sapiens
tcgtgctccaccggg

SEQ ID NO: 19849 - DNA, 17 bp, Homo sapiens
tcgccgcagcgcccggg

SEQ ID NO: 19850 - DNA, 18 bp, Homo sapiens
atcgaagtctccaccggg

SEQ ID NO: 19851 - DNA, 16 bp, Homo sapiens
tcggcgcagccccggg

SEQ ID NO: 19852 - DNA, 17 bp, Homo sapiens
tcctcgccgccaccggg

SEQ ID NO: 19853 - DNA, 20 bp, Homo sapiens
tcattgcagtccagcctggg

SEQ ID NO: 19854 - DNA, 16 bp, Homo sapiens
ccgtcgcagccccggg

SEQ ID NO: 19855 - DNA, 18 bp, Homo sapiens
tcgcagccccaaaccggg

SEQ ID NO: 19856 - DNA, 17 bp, Homo sapiens
tctcgcagtctccatgg

SEQ ID NO: 19857 - DNA, 18 bp, Homo sapiens
cctcagaagtccaccggg

SEQ ID NO: 19858 - DNA, 17 bp, Homo sapiens
tcatcgcaggccgcggg

SEQ ID NO: 19859 - DNA, 16 bp, Homo sapiens
tcgtccaccacgcggg

SEQ ID NO: 19860 - DNA, 18 bp, Homo sapiens
ccatcagggtccaccggg

SEQ ID NO: 19861 - DNA, 17 bp, Homo sapiens
tcggcagggccaccggg

SEQ ID NO: 19862 - DNA, 17 bp, Homo sapiens
tcgcccaccacactggg

SEQ ID NO: 19863 - DNA, 16 bp, Homo sapiens
tcctcactccaccggg

SEQ ID NO: 19864 - DNA, 72 bp, Fowlpox virus
tatagatatttacggagtatatgaactgtataccgatttacagaatttgtatttggtacgtaagtatgtata

SEQ ID NO: 19865 - DNA, 23 bp, Fowlpox virus
tatttggtacgtaagtatgtata

SEQ ID NO: 19866 - DNA, 17 bp, Homo sapiens
catttggtatgtatgta

SEQ ID NO: 19867 - DNA, 17 bp, Homo sapiens
atttggtatgtaacatg

SEQ ID NO: 19868 - DNA, 19 bp, Homo sapiens
taatatgtgagtatgtata

SEQ ID NO: 19869 - DNA, 23 bp, Homo sapiens
tattcggtgcgtatttgggtata

SEQ ID NO: 19870 - DNA, 17 bp, Homo sapiens
tatttggtagtaaaatg

SEQ ID NO: 19871 - DNA, 19 bp, Homo sapiens
tctgaatgtaggtatgtat

SEQ ID NO: 19872 - DNA, 20 bp, Homo sapiens
ttagcacaggagtatgtata

SEQ ID NO: 19873 - DNA, 21 bp, Homo sapiens
tatttgtatgtatgtatgtat

SEQ ID NO: 19874 - DNA, 20 bp, Homo sapiens
tgttacagtaagtatgtata

SEQ ID NO: 19875 - DNA, 17 bp, Homo sapiens
tatttggtggtaagcat

SEQ ID NO: 19876 - DNA, 19 bp, Homo sapiens
tataagtatgtaagtatgt

SEQ ID NO: 19877 - DNA, 67 bp, Human papillomavirus type 27
gtgatattgtggggtcgtgatgatattgactgtctgttggtgattctcaccctcattggcttattat

SEQ ID NO: 19878 - DNA, 24 bp, Human papillomavirus type 27
ttgtggggtcgtgatgatattgac

SEQ ID NO: 19879 - DNA, 17 bp, Homo sapiens
tggggttgcaatattga

SEQ ID NO: 19880 - DNA, 20 bp, Homo sapiens
ttgtggggtctataattgat

SEQ ID NO: 19881 - DNA, 68 bp, Human herpesvirus 4
gaggagctgccggttgccatttttcaagctgctaaaccacgagtggcagcaggcctaagaagctcctc

SEQ ID NO: 19882 - DNA, 22 bp, Human herpesvirus 4
cagcaggcctaagaagctcctc

SEQ ID NO: 19883 - DNA, 21 bp, Homo sapiens
cagcagagctttcaactcctc

SEQ ID NO: 19884 - DNA, 18 bp, Homo sapiens
gcaggccctgggctcctc

SEQ ID NO: 19885 - DNA, 22 bp, Homo sapiens
cagcagttctcttcagctcctc

SEQ ID NO: 19886 - DNA, 16 bp, Homo sapiens
cagaaggcaagctcct

SEQ ID NO: 19887 - DNA, 22 bp, Homo sapiens
acaggcctgggggaatggcctc

SEQ ID NO: 19888 - DNA, 17 bp, Homo sapiens
agtaggccaagaaattc

SEQ ID NO: 19889 - DNA, 18 bp, Homo sapiens
gcaggcctgagcttcctc

SEQ ID NO: 19890 - DNA, 17 bp, Homo sapiens
cagaggcctaaggacct

SEQ ID NO: 19891 - DNA, 15 bp, Homo sapiens
cagcaggccaagctc

SEQ ID NO: 19892 - DNA, 20 bp, Homo sapiens
cagcaggccttggccgcctc

SEQ ID NO: 19893 - DNA, 15 bp, Homo sapiens
gcaggcccagctcct

SEQ ID NO: 19894 - DNA, 18 bp, Homo sapiens
gcaggcagagagctcctc

SEQ ID NO: 19895 - DNA, 18 bp, Homo sapiens
cagcaggctagcccactc

SEQ ID NO: 19896 - DNA, 21 bp, Homo sapiens
ggttctgaaaagaagctcctc

SEQ ID NO: 19897 - DNA, 21 bp, Homo sapiens
gccgggcctgcttagctcctc

SEQ ID NO: 19898 - DNA, 16 bp, Homo sapiens
caggggcccagctcct

SEQ ID NO: 19899 - DNA, 17 bp, Homo sapiens
gccagacggaagctcct

SEQ ID NO: 19900 - DNA, 23 bp, Homo sapiens
cagcaggccatgggaccttcctc

SEQ ID NO: 19901 - DNA, 24 bp, Homo sapiens
cagcaggctgagtatgggctcctc

SEQ ID NO: 19902 - DNA, 21 bp, Homo sapiens
aacaggtccgaaaagctcttc

SEQ ID NO: 19903 - DNA, 22 bp, Homo sapiens
cagcaggcccaggagccggctc

SEQ ID NO: 19904 - DNA, 20 bp, Homo sapiens
cagcgcgccgccagctcctc

SEQ ID NO: 19905 - DNA, 18 bp, Homo sapiens
agcagggtagagctcctc

SEQ ID NO: 19906 - DNA, 17 bp, Homo sapiens
gcaggcaggagctcctc

SEQ ID NO: 19907 - DNA, 24 bp, Homo sapiens
gcaggcctttccctgaggcttctc

SEQ ID NO: 19908 - DNA, 17 bp, Homo sapiens
caggtaggccagctcct

SEQ ID NO: 19909 - DNA, 18 bp, Homo sapiens
gcaggcccaggaggactc

SEQ ID NO: 19910 - DNA, 21 bp, Homo sapiens
cagctggttccaaagctcctc

SEQ ID NO: 19911 - DNA, 17 bp, Homo sapiens
caacaggcccagttcct

SEQ ID NO: 19912 - DNA, 16 bp, Homo sapiens
cagcaggccggagctc

SEQ ID NO: 19913 - DNA, 19 bp, Homo sapiens
caggggcctaaggtaactc

SEQ ID NO: 19914 - DNA, 18 bp, Homo sapiens
cagcaggccagcttaccc

SEQ ID NO: 19915 - DNA, 19 bp, Homo sapiens
gcaaagcaggaagctcctc

SEQ ID NO: 19916 - DNA, 15 bp, Homo sapiens
caggcctgagcccct

SEQ ID NO: 19917 - DNA, 16 bp, Homo sapiens
cagcaggctccctcct

SEQ ID NO: 19918 - DNA, 20 bp, Homo sapiens
agaaaaaaaaagaagctcct

SEQ ID NO: 19919 - DNA, 21 bp, Homo sapiens
cagcaggcctgggcgctgctc

SEQ ID NO: 19920 - DNA, 17 bp, Homo sapiens
caggagccaaagctcct

SEQ ID NO: 19921 - DNA, 17 bp, Homo sapiens
gcaggcctggccacctc

SEQ ID NO: 19922 - DNA, 16 bp, Homo sapiens
cagcaggcgagctcct

SEQ ID NO: 19923 - DNA, 21 bp, Homo sapiens
gcaggcctggagcagcttctc

SEQ ID NO: 19924 - DNA, 23 bp, Homo sapiens
cagtgggcccaagtgctgacctc

SEQ ID NO: 19925 - DNA, 19 bp, Homo sapiens
cagcagcctaagggaacct

SEQ ID NO: 19926 - DNA, 21 bp, Homo sapiens
cagcagcctaagaacgccctc

SEQ ID NO: 19927 - DNA, 16 bp, Homo sapiens
cagcaggccagagctc

SEQ ID NO: 19928 - DNA, 18 bp, Homo sapiens
acaggcctggacctcctc

SEQ ID NO: 19929 - DNA, 23 bp, Homo sapiens
cagcaggccagggatgcagcctc

SEQ ID NO: 19930 - DNA, 18 bp, Homo sapiens
cagcaggcccaggagctc

SEQ ID NO: 19931 - DNA, 16 bp, Homo sapiens
cagtcaggaagctcct

SEQ ID NO: 19932 - DNA, 17 bp, Homo sapiens
caacaggccttcctcct

SEQ ID NO: 19933 - DNA, 22 bp, Homo sapiens
gcatgcctaagaacacaacctc

SEQ ID NO: 19934 - DNA, 17 bp, Homo sapiens
cagcagacctggcttct

SEQ ID NO: 19935 - DNA, 17 bp, Homo sapiens
cagcagcagcagctcct

SEQ ID NO: 19936 - DNA, 17 bp, Homo sapiens
cagcaggcccaggaact

SEQ ID NO: 19937 - DNA, 22 bp, Homo sapiens
cagcaggctgcccaggctcctc

SEQ ID NO: 19938 - DNA, 20 bp, Homo sapiens
cagcaggcactggtcccact

SEQ ID NO: 19939 - DNA, 20 bp, Homo sapiens
cagcagttactaagctcctc

SEQ ID NO: 19940 - DNA, 22 bp, Homo sapiens
cagcttccctgggaagctcctc

SEQ ID NO: 19941 - DNA, 16 bp, Homo sapiens
cagcagcccagctcct

SEQ ID NO: 19942 - DNA, 21 bp, Homo sapiens
cagtgggttcaacaactcctc

SEQ ID NO: 19943 - DNA, 17 bp, Homo sapiens
cagcagcagaagctcct

SEQ ID NO: 19944 - DNA, 20 bp, Homo sapiens
cagcaggcccaaccctgcct

SEQ ID NO: 19945 - DNA, 17 bp, Homo sapiens
gcggctcggagctcctc

SEQ ID NO: 19946 - DNA, 18 bp, Homo sapiens
agcaggcctgcactcctc

SEQ ID NO: 19947 - DNA, 16 bp, Homo sapiens
cagcagcctaacccct

SEQ ID NO: 19948 - DNA, 19 bp, Homo sapiens
gcaggtccttgagctcctc

SEQ ID NO: 19949 - DNA, 20 bp, Homo sapiens
gcagacaccctcagctcctc

SEQ ID NO: 19950 - DNA, 19 bp, Homo sapiens
aagcccaagggggctcctc

SEQ ID NO: 19951 - DNA, 21 bp, Homo sapiens
gcagagtagcagaagctcctc

SEQ ID NO: 19952 - DNA, 19 bp, Homo sapiens
gcgacccaagaggctcctc

SEQ ID NO: 19953 - DNA, 19 bp, Homo sapiens
cagaggcctaatagattct

SEQ ID NO: 19954 - DNA, 20 bp, Homo sapiens
gcggctgcgggaagctcctc

SEQ ID NO: 19955 - DNA, 19 bp, Homo sapiens
caacaggcctaaggcacct

SEQ ID NO: 19956 - DNA, 17 bp, Homo sapiens
cagcagctcctgctcct

SEQ ID NO: 19957 - DNA, 20 bp, Homo sapiens
agtacttaaaagaagctcct

SEQ ID NO: 19958 - DNA, 21 bp, Homo sapiens
cagcttttaaagaagcttctc

SEQ ID NO: 19959 - DNA, 18 bp, Homo sapiens
acaggcctggaacaccct

SEQ ID NO: 19960 - DNA, 20 bp, Homo sapiens
gctggggaaaggagctcctc

SEQ ID NO: 19961 - DNA, 17 bp, Homo sapiens
gcacccaggagctcctc

SEQ ID NO: 19962 - DNA, 17 bp, Homo sapiens
cagaggagaaagctcct

SEQ ID NO: 19963 - DNA, 18 bp, Homo sapiens
gcagagctggagctcctc

SEQ ID NO: 19964 - DNA, 20 bp, Homo sapiens
gcaggcctaggaggggactc

SEQ ID NO: 19965 - DNA, 18 bp, Homo sapiens
cagcaagctaaagttcct

SEQ ID NO: 19966 - DNA, 19 bp, Homo sapiens
cagaggaaaagaagctcct

SEQ ID NO: 19967 - DNA, 20 bp, Homo sapiens
cagccaggtctgggaagtct

SEQ ID NO: 19968 - DNA, 23 bp, Homo sapiens
cagcaggcccaagccaacgtctc

SEQ ID NO: 19969 - DNA, 18 bp, Homo sapiens
cagcaggcctcaagactc

SEQ ID NO: 19970 - DNA, 15 bp, Homo sapiens
cagcggcctaagctc

SEQ ID NO: 19971 - DNA, 22 bp, Homo sapiens
cagcaggctagaccaggcttct

SEQ ID NO: 19972 - DNA, 17 bp, Homo sapiens
cagctggcctgagagct

SEQ ID NO: 19973 - DNA, 20 bp, Homo sapiens
cagaggtagacgagctcctc

SEQ ID NO: 19974 - DNA, 16 bp, Homo sapiens
cagcaggccggctcct

SEQ ID NO: 19975 - DNA, 21 bp, Homo sapiens
cagcaggcccaagagaagctc

SEQ ID NO: 19976 - DNA, 20 bp, Homo sapiens
caatcaggaggaagctcctc

SEQ ID NO: 19977 - DNA, 18 bp, Homo sapiens
caggcctaagaaatcctc

SEQ ID NO: 19978 - DNA, 17 bp, Homo sapiens
cagcagtctaagaagct

SEQ ID NO: 19979 - DNA, 20 bp, Homo sapiens
cagcaggctgggagctgcct

SEQ ID NO: 19980 - DNA, 16 bp, Homo sapiens
cagaggcctaagggct

SEQ ID NO: 19981 - DNA, 21 bp, Homo sapiens
cagcaggcctgggcaaaactc

SEQ ID NO: 19982 - DNA, 20 bp, Homo sapiens
agcagggctgagaagatact

SEQ ID NO: 19983 - DNA, 16 bp, Homo sapiens
acaggaccaagctcct

SEQ ID NO: 19984 - DNA, 16 bp, Homo sapiens
cagcagactagctcct

SEQ ID NO: 19985 - DNA, 15 bp, Homo sapiens
cagcaggcccgctct

SEQ ID NO: 19986 - DNA, 16 bp, Homo sapiens
caacaggcccgcttct

SEQ ID NO: 19987 - DNA, 21 bp, Homo sapiens
cagctcgggaggaagctcctc

SEQ ID NO: 19988 - DNA, 19 bp, Homo sapiens
caacaggcctgggacactc

SEQ ID NO: 19989 - DNA, 18 bp, Homo sapiens
cagcaggttaggaaactc

SEQ ID NO: 19990 - DNA, 19 bp, Homo sapiens
gcaggcaggggaagctcct

SEQ ID NO: 19991 - DNA, 17 bp, Homo sapiens
gcgggccagagctcctc

SEQ ID NO: 19992 - DNA, 17 bp, Homo sapiens
agcaggctcagctcctc

SEQ ID NO: 19993 - DNA, 19 bp, Homo sapiens
caataggcaaaagctcttc

SEQ ID NO: 19994 - DNA, 22 bp, Homo sapiens
cagcaagcacctctggctcttc

SEQ ID NO: 19995 - DNA, 19 bp, Homo sapiens
agcactgggtaagaagctc

SEQ ID NO: 19996 - DNA, 18 bp, Homo sapiens
gcaggcctacccctcctc

SEQ ID NO: 19997 - DNA, 16 bp, Homo sapiens
cagcacggcagctcct

SEQ ID NO: 19998 - DNA, 23 bp, Homo sapiens
cagcaggccgaagaaggcggcct

SEQ ID NO: 19999 - DNA, 23 bp, Homo sapiens
caacaggcctagtgctgcttctc

SEQ ID NO: 20000 - DNA, 17 bp, Homo sapiens
gcgcctgggagctcctc

SEQ ID NO: 20001 - DNA, 19 bp, Homo sapiens
cagcatgtcccagctcctc

SEQ ID NO: 20002 - DNA, 24 bp, Homo sapiens
cagtggcctaagatccatttcctc

SEQ ID NO: 20003 - DNA, 20 bp, Homo sapiens
cagcgcctcagaagctcttc

SEQ ID NO: 20004 - DNA, 21 bp, Homo sapiens
caggaaacagaggagctcctc

SEQ ID NO: 20005 - DNA, 21 bp, Homo sapiens
cagcagcttgttaagctcctc

SEQ ID NO: 20006 - DNA, 18 bp, Homo sapiens
gctggctaccagctcctc

SEQ ID NO: 20007 - DNA, 17 bp, Homo sapiens
cagcaggccctgctcct

SEQ ID NO: 20008 - DNA, 15 bp, Homo sapiens
gcaggaagagctcct

SEQ ID NO: 20009 - DNA, 18 bp, Homo sapiens
gctggcgctgaagctcct

SEQ ID NO: 20010 - DNA, 18 bp, Homo sapiens
cagcaggccaagtttctc

SEQ ID NO: 20011 - DNA, 17 bp, Homo sapiens
cagaggtttaaaaaact

SEQ ID NO: 20012 - DNA, 16 bp, Homo sapiens
acaggcctgaagacct

SEQ ID NO: 20013 - DNA, 20 bp, Homo sapiens
agcggcgacagaagctcttc

SEQ ID NO: 20014 - DNA, 16 bp, Homo sapiens
cagcatagaagctcct

SEQ ID NO: 20015 - DNA, 16 bp, Homo sapiens
cagcaagcaggctcct

SEQ ID NO: 20016 - DNA, 16 bp, Homo sapiens
cagcaggcccaggctc

SEQ ID NO: 20017 - DNA, 19 bp, Homo sapiens
agcagaactgaggctcctc

SEQ ID NO: 20018 - DNA, 21 bp, Homo sapiens
cagcaggccaggacctgcctc

SEQ ID NO: 20019 - DNA, 16 bp, Homo sapiens
cagcaggctcaaggct

SEQ ID NO: 20020 - DNA, 18 bp, Homo sapiens
cagcaagcctagatgtct

SEQ ID NO: 20021 - DNA, 18 bp, Homo sapiens
gcgggcgcctagctcctc

SEQ ID NO: 20022 - DNA, 17 bp, Homo sapiens
cagcaggaccagctcct

SEQ ID NO: 20023 - DNA, 23 bp, Homo sapiens
cagcaggcttgggaccagccctc

SEQ ID NO: 20024 - DNA, 17 bp, Homo sapiens
cagcaggcctagggcct

SEQ ID NO: 20025 - DNA, 22 bp, Homo sapiens
cagcagactgaaaaagttcttc

SEQ ID NO: 20026 - DNA, 16 bp, Homo sapiens
caaaaaagaagctcct

SEQ ID NO: 20027 - DNA, 20 bp, Homo sapiens
acaggcctgctttactcctc

SEQ ID NO: 20028 - DNA, 18 bp, Homo sapiens
acaggcctgctcgtcctc

SEQ ID NO: 20029 - DNA, 22 bp, Homo sapiens
acagagctttaagaagcttctc

SEQ ID NO: 20030 - DNA, 16 bp, Homo sapiens
agcaggccagagcacc

SEQ ID NO: 20031 - DNA, 22 bp, Homo sapiens
cagaggctctcaggagctcctc

SEQ ID NO: 20032 - DNA, 19 bp, Homo sapiens
caggcccagggagcttctc

SEQ ID NO: 20033 - DNA, 17 bp, Homo sapiens
gcaggtctggaagctcc

SEQ ID NO: 20034 - DNA, 18 bp, Homo sapiens
acaggacttgagctcctc

SEQ ID NO: 20035 - DNA, 17 bp, Homo sapiens
cagcaggccttggccct

SEQ ID NO: 20036 - DNA, 22 bp, Homo sapiens
cagagggaagctcaagctcctc

SEQ ID NO: 20037 - DNA, 17 bp, Homo sapiens
cagcagccccagctcct

SEQ ID NO: 20038 - DNA, 20 bp, Homo sapiens
cagcaggcctgggcatgcct

SEQ ID NO: 20039 - DNA, 22 bp, Homo sapiens
cagacaggactcaaagctcttc

SEQ ID NO: 20040 - DNA, 24 bp, Homo sapiens
cagcaggcccagggctgcctcctc

SEQ ID NO: 20041 - DNA, 17 bp, Homo sapiens
cagcaggccagaaagtc

SEQ ID NO: 20042 - DNA, 17 bp, Homo sapiens
gcaggcgtgagctcctc

SEQ ID NO: 20043 - DNA, 18 bp, Homo sapiens
gcaggcctgagcctcctc

SEQ ID NO: 20044 - DNA, 22 bp, Homo sapiens
cagcaggctgaagagaggggct

SEQ ID NO: 20045 - DNA, 16 bp, Homo sapiens
cagagaagaagctcct

SEQ ID NO: 20046 - DNA, 22 bp, Homo sapiens
cagaaggcactagaagctcctc

SEQ ID NO: 20047 - DNA, 20 bp, Homo sapiens
tgacaggcctgagggtcctc

SEQ ID NO: 20048 - DNA, 21 bp, Homo sapiens
aacatgaataagaagctcttc

SEQ ID NO: 20049 - DNA, 17 bp, Homo sapiens
cagcaggctgaaaactc

SEQ ID NO: 20050 - DNA, 22 bp, Homo sapiens
agcaggccgcgggaagctcctc

SEQ ID NO: 20051 - DNA, 19 bp, Homo sapiens
gcaggctggaaggcttctc

SEQ ID NO: 20052 - DNA, 18 bp, Homo sapiens
caggcctggagcttcctc

SEQ ID NO: 20053 - DNA, 19 bp, Homo sapiens
cagcaggccctaggtgctc

SEQ ID NO: 20054 - DNA, 19 bp, Homo sapiens
cagccggcttaaggcccct

SEQ ID NO: 20055 - DNA, 19 bp, Homo sapiens
cagcaggcacaggctcttc

SEQ ID NO: 20056 - DNA, 63 bp, Infectious hypodermal and hematopoietic necrosis virus
tgttagccaacaacgacatccgtgtaccagaaatcttagcttggataatcatcgtagcagaca

SEQ ID NO: 20057 - DNA, 24 bp, Infectious hypodermal and hematopoietic necrosis virus
tagccaacaacgacatccgtgtac

SEQ ID NO: 20058 - DNA, 17 bp, Homo sapiens
tagccaacaatgcatgt

SEQ ID NO: 20059 - DNA, 19 bp, Homo sapiens
gccagcaatctacccgtgt

SEQ ID NO: 20060 - DNA, 18 bp, Homo sapiens
gccaacaatatcctggta

SEQ ID NO: 20061 - DNA, 23 bp, Homo sapiens
tagccaacatggtgaaaccctgt

SEQ ID NO: 20062 - DNA, 20 bp, Homo sapiens
gccagcaactgtcccgtgta

SEQ ID NO: 20063 - DNA, 18 bp, Homo sapiens
tagcaacaacgacaacat

SEQ ID NO: 20064 - DNA, 23 bp, Homo sapiens
tagccaacatggtgagaccctgt

SEQ ID NO: 20065 - DNA, 64 bp, Infectious hypodermal and hematopoietic necrosis virus
tctcttcgaagaacccagaatcagtcaaataacagtggacgacttcaaactccttttcgaagga

SEQ ID NO: 20066 - DNA, 24 bp, Infectious hypodermal and hematopoietic necrosis virus
tcgaagaacccagaatcagtcaaa

SEQ ID NO: 20067 - DNA, 23 bp, Homo sapiens
gaagaatctcagcatcagtcaaa

SEQ ID NO: 20068 - DNA, 24 bp, Homo sapiens
tcaaagaactcagaactataatca

SEQ ID NO: 20069 - DNA, 19 bp, Homo sapiens
tcaaagaacctagaataag

SEQ ID NO: 20070 - DNA, 19 bp, Homo sapiens
gaagagctccacagtcaaa

SEQ ID NO: 20071 - DNA, 23 bp, Homo sapiens
tcgtaagaaaggtatcagtcaaa

SEQ ID NO: 20072 - DNA, 18 bp, Homo sapiens
tcaaggcaaaatcagtca

SEQ ID NO: 20073 - DNA, 22 bp, Homo sapiens
gaaaattacaatatcagtcaaa

SEQ ID NO: 20074 - DNA, 17 bp, Homo sapiens
tcaagaacccagaacag

SEQ ID NO: 20075 - DNA, 18 bp, Homo sapiens
gaaaacccaggaacacaa

SEQ ID NO: 20076 - DNA, 21 bp, Homo sapiens
tcaaagagcctggaccaatca

SEQ ID NO: 20077 - DNA, 21 bp, Homo sapiens
tcaaacctccaggatcagtca

SEQ ID NO: 20078 - DNA, 22 bp, Homo sapiens
tcgaagaatataaaacttcagt

SEQ ID NO: 20079 - DNA, 26 bp, Homo sapiens
tcaagaaccccaccttgttggtcaaa

SEQ ID NO: 20080 - DNA, 19 bp, Homo sapiens
gaaggctccagccagtcaa

SEQ ID NO: 20081 - DNA, 21 bp, Homo sapiens
tcaaagaatccagagtcctca

SEQ ID NO: 20082 - DNA, 78 bp, Human herpesvirus 4
cccgtggggggtcttagtggaagtgacgtgctgtgaatacaggtccatagcaccgctatccactatgtctcgcccggg

SEQ ID NO: 20083 - DNA, 24 bp, Human herpesvirus 4
tagcaccgctatccactatgtctc

SEQ ID NO: 20084 - DNA, 24 bp, Homo sapiens
tagcaccgttaatctcgagggtct

SEQ ID NO: 20085 - DNA, 23 bp, Homo sapiens
cagcgcccgggccgctatgtctc

SEQ ID NO: 20086 - DNA, 21 bp, Homo sapiens
gcattgctacccacctaagtc

SEQ ID NO: 20087 - DNA, 17 bp, Homo sapiens
cagcacctccactatgt

SEQ ID NO: 20088 - DNA, 19 bp, Homo sapiens
tagcatcctgcttatgtct

SEQ ID NO: 20089 - DNA, 22 bp, Homo sapiens
gcccaaaatatccactgtgtct

SEQ ID NO: 20090 - DNA, 24 bp, Homo sapiens
taacatcagctgtcattatgtctc

SEQ ID NO: 20091 - DNA, 21 bp, Homo sapiens
tagcaccgtcatttacagttc

SEQ ID NO: 20092 - DNA, 20 bp, Homo sapiens
gcgccgctgccgtctacatc

SEQ ID NO: 20093 - DNA, 22 bp, Homo sapiens
tagcaccgtgtcccctgctctc

SEQ ID NO: 20094 - DNA, 20 bp, Homo sapiens
accccttttcactgtgtctc

SEQ ID NO: 20095 - DNA, 19 bp, Homo sapiens
acaatgctgtccactatgt

SEQ ID NO: 20096 - DNA, 24 bp, Homo sapiens
tagcaatccaaatcgttatgtctc

SEQ ID NO: 20097 - DNA, 17 bp, Homo sapiens
gctgctatccatatttc

SEQ ID NO: 20098 - DNA, 24 bp, Homo sapiens
tagcgtcgttagttgctatatctc

SEQ ID NO: 20099 - DNA, 93 bp, Human herpesvirus 6
gtgtggagtctgttgagaatgccatgctatagtcataggattcaaaattgaacttgtttgttagttgtgtaaaatctttatagttattcatac

SEQ ID NO: 20100 - DNA, 24 bp, Human herpesvirus 6
gagaatgccatgctatagtcatag

SEQ ID NO: 20101 - DNA, 23 bp, Homo sapiens
gagaaagtgtgtgatagtcatag

SEQ ID NO: 20102 - DNA, 26 bp, Homo sapiens
gagaatgcagtgctgtacaatactag

SEQ ID NO: 20103 - DNA, 20 bp, Homo sapiens
gagaggccatgctgtgacat

SEQ ID NO: 20104 - DNA, 18 bp, Homo sapiens
gaggatgctctgccatag

SEQ ID NO: 20105 - DNA, 18 bp, Homo sapiens
gatgccatgtcaacatag

SEQ ID NO: 20106 - DNA, 21 bp, Homo sapiens
gagaatgcttgcctctaccat

SEQ ID NO: 20107 - DNA, 22 bp, Homo sapiens
aagggtgccagagcagtcatag

SEQ ID NO: 20108 - DNA, 78 bp, Human herpesvirus 4
tgtgccgcttggagggaaacatgaccacctgaagtctgttaaccaggtcagtggttttgtttccttgatagagacaca

SEQ ID NO: 20109 - DNA, 24 bp, Human herpesvirus 4
tcagtggttttgtttccttgatag

SEQ ID NO: 20110 - DNA, 21 bp, Homo sapiens
ccagtggttttgttttacttg

SEQ ID NO: 20111 - DNA, 17 bp, Homo sapiens
atggtttattcttgata

SEQ ID NO: 20112 - DNA, 20 bp, Homo sapiens
agtggtttgtttctctgtag

SEQ ID NO: 20113 - DNA, 22 bp, Homo sapiens
tcagtgtttttgtttctctcaa

SEQ ID NO: 20114 - DNA, 17 bp, Homo sapiens
agtggttttgttttttg

SEQ ID NO: 20115 - DNA, 18 bp, Homo sapiens
gtggtttttttctccttg

SEQ ID NO: 20116 - DNA, 18 bp, Homo sapiens
agggttttgtttctaaac

SEQ ID NO: 20117 - DNA, 19 bp, Homo sapiens
gtggtggtggtccttgata

SEQ ID NO: 20118 - DNA, 18 bp, Homo sapiens
agtggttttgttatttaa

SEQ ID NO: 20119 - DNA, 17 bp, Homo sapiens
atgtcctttccttgata

SEQ ID NO: 20120 - DNA, 19 bp, Homo sapiens
ccagtggtggttcttggta

SEQ ID NO: 20121 - DNA, 92 bp, Human herpesvirus 6
tttgatcggtgtagattttgttgtatttggttgaattctggtgtcgaatagaatttatctgtatggtccgcaaagtctatggcgggttcagg

SEQ ID NO: 20122 - DNA, 24 bp, Human herpesvirus 6
gattttgttgtatttggttgaatt

SEQ ID NO: 20123 - DNA, 19 bp, Homo sapiens
gattttgtttaatatttgg

SEQ ID NO: 20124 - DNA, 22 bp, Homo sapiens
gattttgattgtatcttgggtt

SEQ ID NO: 20125 - DNA, 19 bp, Homo sapiens
gattttgttgagttcagtt

SEQ ID NO: 20126 - DNA, 21 bp, Homo sapiens
aattttgttgtatctgatatg

SEQ ID NO: 20127 - DNA, 20 bp, Homo sapiens
gattttgtgtatatgtgtga

SEQ ID NO: 20128 - DNA, 64 bp, Human herpesvirus 4
ctttagtgggaactagtgggagtgctgtgcctcgggtacccctatcctataggtcctaccggag

SEQ ID NO: 20129 - DNA, 24 bp, Human herpesvirus 4
tacccctatcctataggtcctacc

SEQ ID NO: 20130 - DNA, 23 bp, Homo sapiens
cctatcctgtacttctttctgcc

SEQ ID NO: 20131 - DNA, 22 bp, Homo sapiens
ccctatctccacaggtcctgcc

SEQ ID NO: 20132 - DNA, 20 bp, Homo sapiens
cccatcctgggttctctgcc

SEQ ID NO: 20133 - DNA, 24 bp, Homo sapiens
cctaccctatcatttggttctacc

SEQ ID NO: 20134 - DNA, 23 bp, Homo sapiens
cccctggtcctacatcacctacc

SEQ ID NO: 20135 - DNA, 21 bp, Homo sapiens
tacttctatcccaatccagtc

SEQ ID NO: 20136 - DNA, 23 bp, Homo sapiens
ccaagacatctgtgggtcctacc

SEQ ID NO: 20137 - DNA, 21 bp, Homo sapiens
ccaatccacaagtggttctac

SEQ ID NO: 20138 - DNA, 18 bp, Homo sapiens
tacccctgtacatcctac

SEQ ID NO: 20139 - DNA, 20 bp, Homo sapiens
cccattctatctcagatgcc

SEQ ID NO: 20140 - DNA, 17 bp, Homo sapiens
ctatcctactagttacc

SEQ ID NO: 20141 - DNA, 17 bp, Homo sapiens
cttcctatagaaacacc

SEQ ID NO: 20142 - DNA, 24 bp, Homo sapiens
acccctattctggatcagtttacc

SEQ ID NO: 20143 - DNA, 15 bp, Homo sapiens
cccccatcctccctc

SEQ ID NO: 20144 - DNA, 17 bp, Homo sapiens
cttccttgggtcctacc

SEQ ID NO: 20145 - DNA, 19 bp, Homo sapiens
ctattctaacagtcctacc

SEQ ID NO: 20146 - DNA, 17 bp, Homo sapiens
ccctacccaggtcctac

SEQ ID NO: 20147 - DNA, 23 bp, Homo sapiens
tacttcatcctatggtaaaggtc

SEQ ID NO: 20148 - DNA, 19 bp, Homo sapiens
cttccctgcaggtcctgcc

SEQ ID NO: 20149 - DNA, 20 bp, Homo sapiens
cccctatccaaactcctgcc

SEQ ID NO: 20150 - DNA, 17 bp, Homo sapiens
cctaccctctaatctac

SEQ ID NO: 20151 - DNA, 19 bp, Homo sapiens
cttgcctataggtcctgcc

SEQ ID NO: 20152 - DNA, 16 bp, Homo sapiens
tacccctctcggtcct

SEQ ID NO: 20153 - DNA, 20 bp, Homo sapiens
ccctcatcctatgtcgggcc

SEQ ID NO: 20154 - DNA, 17 bp, Homo sapiens
cccctattttataaacc

SEQ ID NO: 20155 - DNA, 19 bp, Homo sapiens
cctatcctggaagattacc

SEQ ID NO: 20156 - DNA, 21 bp, Homo sapiens
tacttccatcctatataaatc

SEQ ID NO: 20157 - DNA, 22 bp, Homo sapiens
cctctatactataggtcctacc

SEQ ID NO: 20158 - DNA, 101 bp, Human herpesvirus 4
aggcattgttaacctttggtggaacctagtgttagtgttgtgctgtaaataagtgtccagcgcaccactagtcaccaggtgtcaccggaggctacttgcct

SEQ ID NO: 20159 - DNA, 24 bp, Human herpesvirus 4
aacctttggtggaacctagtgtta

SEQ ID NO: 20160 - DNA, 19 bp, Homo sapiens
cctttggctggaactggtg

SEQ ID NO: 20161 - DNA, 19 bp, Homo sapiens
ctttgctggagctcttgtt

SEQ ID NO: 20162 - DNA, 16 bp, Homo sapiens
accttggtttagtgtt

SEQ ID NO: 20163 - DNA, 19 bp, Homo sapiens
ccttggtggggccatcgct

SEQ ID NO: 20164 - DNA, 17 bp, Homo sapiens
acctttggtggggcagt

SEQ ID NO: 20165 - DNA, 18 bp, Homo sapiens
acttttggtggatgctgc

SEQ ID NO: 20166 - DNA, 16 bp, Homo sapiens
ctttggtggaaaagta

SEQ ID NO: 20167 - DNA, 22 bp, Homo sapiens
aacctttggaaaattagtgtta

SEQ ID NO: 20168 - DNA, 20 bp, Homo sapiens
ctttaattcatctagtgtta

SEQ ID NO: 20169 - DNA, 19 bp, Homo sapiens
cctcttcagcttagtgtta

SEQ ID NO: 20170 - DNA, 20 bp, Homo sapiens
tttggtggaggctaatgtta

SEQ ID NO: 20171 - DNA, 102 bp, Human herpesvirus 4
ggggctctgtaacatttggtgggacctgatgctgctggtgtgctgtaaataagtgcctagcacatcacgtaggcaccaggtgtcaccagggctacttgcctc

SEQ ID NO: 20172 - DNA, 24 bp, Human herpesvirus 4
atgctgctggtgtgctgtaaataa

SEQ ID NO: 20173 - DNA, 22 bp, Homo sapiens
atggtgctaatattgtagataa

SEQ ID NO: 20174 - DNA, 24 bp, Homo sapiens
atgccgctggtgtgccagctcata

SEQ ID NO: 20175 - DNA, 19 bp, Homo sapiens
tgctgctgtgtgtcaccat

SEQ ID NO: 20176 - DNA, 22 bp, Homo sapiens
atgtgctgatgcctgtagataa

SEQ ID NO: 20177 - DNA, 19 bp, Homo sapiens
atgatgctggtgtgaataa

SEQ ID NO: 20178 - DNA, 19 bp, Homo sapiens
atgctgtggtgtttggaaa

SEQ ID NO: 20179 - DNA, 20 bp, Homo sapiens
tgctggtggtggtggaggta

SEQ ID NO: 20180 - DNA, 20 bp, Homo sapiens
tgctgccttacactgtgaat

SEQ ID NO: 20181 - DNA, 21 bp, Homo sapiens
tgctgctgtgggtgtgagtaa

SEQ ID NO: 20182 - DNA, 22 bp, Homo sapiens
atgacacactgtgctgtagata

SEQ ID NO: 20183 - DNA, 20 bp, Homo sapiens
tgctgttagtgtgtccataa

SEQ ID NO: 20184 - DNA, 17 bp, Homo sapiens
atgtgctggtgtgttat

SEQ ID NO: 20185 - DNA, 23 bp, Homo sapiens
atgttacttaacactgtaaataa

SEQ ID NO: 20186 - DNA, 19 bp, Homo sapiens
atgctgctggttggagcaa

SEQ ID NO: 20187 - DNA, 18 bp, Homo sapiens
tgctgctggaggtaagta

SEQ ID NO: 20188 - DNA, 24 bp, Homo sapiens
tgtttctggtgttattgtagataa

SEQ ID NO: 20189 - DNA, 19 bp, Homo sapiens
ctgctggtgacgaaaataa

SEQ ID NO: 20190 - DNA, 18 bp, Homo sapiens
tgttgcttggttgtaaat

SEQ ID NO: 20191 - DNA, 16 bp, Homo sapiens
tgctagtgctgtgaat

SEQ ID NO: 20192 - DNA, 20 bp, Homo sapiens
atgcatgttggtgtgcatgt

SEQ ID NO: 20193 - DNA, 17 bp, Homo sapiens
tgcatgttctgtaaata

SEQ ID NO: 20194 - DNA, 17 bp, Homo sapiens
tgctgcttgtggagcaa

SEQ ID NO: 20195 - DNA, 24 bp, Homo sapiens
atgctgctggtgtgccagctcata

SEQ ID NO: 20196 - DNA, 18 bp, Homo sapiens
tgctgctctctgtaaata

SEQ ID NO: 20197 - DNA, 23 bp, Homo sapiens
atcctgttgtctcactgtaaata

SEQ ID NO: 20198 - DNA, 15 bp, Homo sapiens
tgctaatctgtaaat

SEQ ID NO: 20199 - DNA, 18 bp, Homo sapiens
atgctgctggtgaaataa

SEQ ID NO: 20200 - DNA, 19 bp, Homo sapiens
acgctgctggtaaaggctg

SEQ ID NO: 20201 - DNA, 18 bp, Homo sapiens
atgttgctgctgtaaata

SEQ ID NO: 20202 - DNA, 18 bp, Homo sapiens
tgctgctgagtgtggggt

SEQ ID NO: 20203 - DNA, 22 bp, Homo sapiens
tgctgctggttgtagagctgta

SEQ ID NO: 20204 - DNA, 61 bp, Human herpesvirus 4
ggcaggtggagtgggacacagttagagaacattagtcctctggtccctatctccacccgcc

SEQ ID NO: 20205 - DNA, 22 bp, Human herpesvirus 4
ctggtccctatctccacccgcc

SEQ ID NO: 20206 - DNA, 18 bp, Homo sapiens
ctgatgccctccacctgc

SEQ ID NO: 20207 - DNA, 18 bp, Homo sapiens
ctggttccaccacccgcc

SEQ ID NO: 20208 - DNA, 23 bp, Homo sapiens
ctggatttcctcacccacctgcc

SEQ ID NO: 20209 - DNA, 19 bp, Homo sapiens
tggtcccttatctgtagcc

SEQ ID NO: 20210 - DNA, 20 bp, Homo sapiens
ctggttctatcccttttgcc

SEQ ID NO: 20211 - DNA, 18 bp, Homo sapiens
tggcccctatttcctgcc

SEQ ID NO: 20212 - DNA, 21 bp, Homo sapiens
ctggatccgcgcccacctgcc

SEQ ID NO: 20213 - DNA, 17 bp, Homo sapiens
ctagcctcttcacccgc

SEQ ID NO: 20214 - DNA, 22 bp, Homo sapiens
ctagtccccctggctacctgcc

SEQ ID NO: 20215 - DNA, 18 bp, Homo sapiens
ggtccccatccgcccgcc

SEQ ID NO: 20216 - DNA, 21 bp, Homo sapiens
ctggtccccatctctgcagcc

SEQ ID NO: 20217 - DNA, 19 bp, Homo sapiens
ctggtcccctttacccgcc

SEQ ID NO: 20218 - DNA, 16 bp, Homo sapiens
ggccccgccccacccg

SEQ ID NO: 20219 - DNA, 20 bp, Homo sapiens
ctgatccctggccaccgtcc

SEQ ID NO: 20220 - DNA, 22 bp, Homo sapiens
ccggtcccccgctccgtccgcc

SEQ ID NO: 20221 - DNA, 18 bp, Homo sapiens
cggtttttctcacccgcc

SEQ ID NO: 20222 - DNA, 18 bp, Homo sapiens
ctggtccccttgcccgcc

SEQ ID NO: 20223 - DNA, 22 bp, Homo sapiens
ggtctccacccctccgcccgcc

SEQ ID NO: 20224 - DNA, 20 bp, Homo sapiens
ctgttcccctcacacccgcc

SEQ ID NO: 20225 - DNA, 23 bp, Homo sapiens
ctggtgtcttcctgccacccgcc

SEQ ID NO: 20226 - DNA, 17 bp, Homo sapiens
ctagtcccaccacctgc

SEQ ID NO: 20227 - DNA, 20 bp, Homo sapiens
cggtccccaagttgcccgcc

SEQ ID NO: 20228 - DNA, 16 bp, Homo sapiens
ctggtcccgcccccgc

SEQ ID NO: 20229 - DNA, 19 bp, Homo sapiens
ctggtcccgcccgcccgcc

SEQ ID NO: 20230 - DNA, 16 bp, Homo sapiens
ctggtcccgctcccgc

SEQ ID NO: 20231 - DNA, 19 bp, Homo sapiens
ctgctccaccccgcccgcc

SEQ ID NO: 20232 - DNA, 24 bp, Homo sapiens
ctgatccctagaaagtcacctgcc

SEQ ID NO: 20233 - DNA, 18 bp, Homo sapiens
ctggtctccacacccgcc

SEQ ID NO: 20234 - DNA, 20 bp, Homo sapiens
ctggcccccctatcgcccgc

SEQ ID NO: 20235 - DNA, 21 bp, Homo sapiens
ccggtcccaggcccacctgcc

SEQ ID NO: 20236 - DNA, 16 bp, Homo sapiens
ctggtcccacacccgc

SEQ ID NO: 20237 - DNA, 20 bp, Homo sapiens
ctggtgcccgcccgcccgcc

SEQ ID NO: 20238 - DNA, 19 bp, Homo sapiens
ctggtccccatctggtgcc

SEQ ID NO: 20239 - DNA, 20 bp, Homo sapiens
ctgctctccactcacccgcc

SEQ ID NO: 20240 - DNA, 21 bp, Homo sapiens
ctgctcctcacctcacccgcc

SEQ ID NO: 20241 - DNA, 19 bp, Homo sapiens
ctggcttccagcacccgcc

SEQ ID NO: 20242 - DNA, 20 bp, Homo sapiens
ggtcgcttcctccacccgcc

SEQ ID NO: 20243 - DNA, 23 bp, Homo sapiens
ctggtccctggctccaagcctgc

SEQ ID NO: 20244 - DNA, 21 bp, Homo sapiens
ctggtcccttccttctctgcc

SEQ ID NO: 20245 - DNA, 27 bp, Homo sapiens
tggtccctgtcccttgaccactcgccg

SEQ ID NO: 20246 - DNA, 20 bp, Homo sapiens
tggttcccatctcaggtgcc

SEQ ID NO: 20247 - DNA, 17 bp, Homo sapiens
ctggccctacctccacc

SEQ ID NO: 20248 - DNA, 18 bp, Homo sapiens
tggtccctatctgggacc

SEQ ID NO: 20249 - DNA, 22 bp, Homo sapiens
ctggtcctcacgtccacccgcc

SEQ ID NO: 20250 - DNA, 20 bp, Homo sapiens
ctagtccccaaatcacctgc

SEQ ID NO: 20251 - DNA, 17 bp, Homo sapiens
ctggccccgacacccgc

SEQ ID NO: 20252 - DNA, 19 bp, Homo sapiens
ctggtgccacgccacccgc

SEQ ID NO: 20253 - DNA, 19 bp, Homo sapiens
ggtcctgtcctccacctgc

SEQ ID NO: 20254 - DNA, 19 bp, Homo sapiens
ctggcaaacttcacccgcc

SEQ ID NO: 20255 - DNA, 19 bp, Homo sapiens
ctggtcccaaactcctgcc

SEQ ID NO: 20256 - DNA, 18 bp, Homo sapiens
gtctcatttccacccgcc

SEQ ID NO: 20257 - DNA, 16 bp, Homo sapiens
tggtccctatacccgc

SEQ ID NO: 20258 - DNA, 18 bp, Homo sapiens
ggtcccccaccctctgcc

SEQ ID NO: 20259 - DNA, 20 bp, Homo sapiens
ctggtccctgccctcacagc

SEQ ID NO: 20260 - DNA, 19 bp, Homo sapiens
ctggctacacctgcccgcc

SEQ ID NO: 20261 - DNA, 20 bp, Homo sapiens
ctcgttcctatctcagggcc

SEQ ID NO: 20262 - DNA, 19 bp, Homo sapiens
ggtcccctcccctgctcgc

SEQ ID NO: 20263 - DNA, 20 bp, Homo sapiens
ctgttccacccacgcccgcc

SEQ ID NO: 20264 - DNA, 18 bp, Homo sapiens
tggtcccttcttcagggc

SEQ ID NO: 20265 - DNA, 21 bp, Homo sapiens
ctggatccctatcgccccgcc

SEQ ID NO: 20266 - DNA, 17 bp, Homo sapiens
ctgctccctccacctgc

SEQ ID NO: 20267 - DNA, 18 bp, Homo sapiens
ctggtcccttctccaccc

SEQ ID NO: 20268 - DNA, 20 bp, Homo sapiens
ctggccctccacagcttgcc

SEQ ID NO: 20269 - DNA, 21 bp, Homo sapiens
tggtcccccagagtcacccgc

SEQ ID NO: 20270 - DNA, 18 bp, Homo sapiens
ctggactctccacctgcc

SEQ ID NO: 20271 - DNA, 17 bp, Homo sapiens
ctggtccctactctcgc

SEQ ID NO: 20272 - DNA, 21 bp, Homo sapiens
ctggtccccgtccccctgcgc

SEQ ID NO: 20273 - DNA, 20 bp, Homo sapiens
ctggtcccgtctcttctgcc

SEQ ID NO: 20274 - DNA, 18 bp, Homo sapiens
ctgctccccaccacctgc

SEQ ID NO: 20275 - DNA, 17 bp, Homo sapiens
ctgcgcctctccacccg

SEQ ID NO: 20276 - DNA, 19 bp, Homo sapiens
ctggctcccagcacccgcc

SEQ ID NO: 20277 - DNA, 17 bp, Homo sapiens
gtccctacacacgcgcc

SEQ ID NO: 20278 - DNA, 19 bp, Homo sapiens
ctggcccccggcacccgcc

SEQ ID NO: 20279 - DNA, 17 bp, Homo sapiens
gtccctacctcacctgc

SEQ ID NO: 20280 - DNA, 18 bp, Homo sapiens
tggccccttctatctcac

SEQ ID NO: 20281 - DNA, 19 bp, Homo sapiens
tgctccccattcgcctgcc

SEQ ID NO: 20282 - DNA, 21 bp, Homo sapiens
ctggcttgctccccattcgcc

SEQ ID NO: 20283 - DNA, 20 bp, Homo sapiens
ggtctccaccctccacctgc

SEQ ID NO: 20284 - DNA, 18 bp, Homo sapiens
tggcccctgtactccccg

SEQ ID NO: 20285 - DNA, 19 bp, Homo sapiens
ggtccccagcacacccgcc

SEQ ID NO: 20286 - DNA, 21 bp, Homo sapiens
ctggtccctgcctctcactgc

SEQ ID NO: 20287 - DNA, 22 bp, Homo sapiens
ctgggtcccatcaacacccgcc

SEQ ID NO: 20288 - DNA, 17 bp, Homo sapiens
ctggacccaccacccgc

SEQ ID NO: 20289 - DNA, 20 bp, Homo sapiens
ctggtccccacgcccccgcc

SEQ ID NO: 20290 - DNA, 18 bp, Homo sapiens
ctggcccctgaccccacc

SEQ ID NO: 20291 - DNA, 22 bp, Homo sapiens
ctgatctcgtgatccacccgcc

SEQ ID NO: 20292 - DNA, 18 bp, Homo sapiens
tgggcctcctccacccgc

SEQ ID NO: 20293 - DNA, 17 bp, Homo sapiens
ctggcccctgtacccgc

SEQ ID NO: 20294 - DNA, 29 bp, Homo sapiens
ctggtccccatcctcctctccacctgccg

SEQ ID NO: 20295 - DNA, 78 bp, Human papillomavirus type 90
caagcctgctgctcaattgtatatattcctcttgtgttgtagtgtgcaatagtagtatgtatcctgttgtagtacgtg

SEQ ID NO: 20296 - DNA, 24 bp, Human papillomavirus type 90
tgtatatattcctcttgtgttgta

SEQ ID NO: 20297 - DNA, 20 bp, Homo sapiens
tgtatatatttcccttacat

SEQ ID NO: 20298 - DNA, 22 bp, Homo sapiens
tatatatgttcttctggctgta

SEQ ID NO: 20299 - DNA, 21 bp, Homo sapiens
tgtatataatcctgatttgta

SEQ ID NO: 20300 - DNA, 20 bp, Homo sapiens
tgtgaatattcctctctgtg

SEQ ID NO: 20301 - DNA, 19 bp, Homo sapiens
tgtatatattattcttata

SEQ ID NO: 20302 - DNA, 20 bp, Homo sapiens
tatatattccttttaaatta

SEQ ID NO: 20303 - DNA, 23 bp, Homo sapiens
tgtatatattcttagtgtttgta

SEQ ID NO: 20304 - DNA, 18 bp, Homo sapiens
tatatattcctttttgtg

SEQ ID NO: 20305 - DNA, 23 bp, Homo sapiens
tgtatatatttttctttccagta

SEQ ID NO: 20306 - DNA, 88 bp, Chimpanzee cytomegalovirus
gtcgtgcagtcccagcgagcgcagcggtaccaggtaacgcggacacgtgtcacaaaacgtctgcaccgcctgtcgggccagcacgtac

SEQ ID NO: 20307 - DNA, 24 bp, Chimpanzee cytomegalovirus
tcacaaaacgtctgcaccgcctgt

SEQ ID NO: 20308 - DNA, 21 bp, Homo sapiens
aaaacgtctgataaggcctgt

SEQ ID NO: 20309 - DNA, 20 bp, Homo sapiens
acaaaacgactgcctcctgt

SEQ ID NO: 20310 - DNA, 21 bp, Homo sapiens
tcacaggcacctgccgcctgt

SEQ ID NO: 20311 - DNA, 26 bp, Homo sapiens
tcctgagacgtctgctgaacctctgt

SEQ ID NO: 20312 - DNA, 17 bp, Homo sapiens
tccaaaacgtctggctg

SEQ ID NO: 20313 - DNA, 61 bp, Canine adenovirus
ggtaagttaacagagttttttataaaaatctggtatgattctataagcttgttaactagct

SEQ ID NO: 20314 - DNA, 24 bp, Canine adenovirus
taagttaacagagttttttataaa

SEQ ID NO: 20315 - DNA, 19 bp, Homo sapiens
taagttaacaggtttctca

SEQ ID NO: 20316 - DNA, 17 bp, Homo sapiens
taagttaaggagttttt

SEQ ID NO: 20317 - DNA, 22 bp, Homo sapiens
aattaacaggatcgtttataaa

SEQ ID NO: 20318 - DNA, 60 bp, Canine adenovirus
atttagtttcacactccactagccaagtgagttccgggttgttggggtcgaagactagat

SEQ ID NO: 20319 - DNA, 18 bp, Canine adenovirus
tggggtcgaagactagat

SEQ ID NO: 20320 - DNA, 19 bp, Homo sapiens
tagaatcacaggactggat

SEQ ID NO: 20321 - DNA, 16 bp, Homo sapiens
tggggtcagacctgat

SEQ ID NO: 20322 - DNA, 18 bp, Homo sapiens
tggtggtcctgactagat

SEQ ID NO: 20323 - DNA, 17 bp, Homo sapiens
tggaatctggactagat

SEQ ID NO: 20324 - DNA, 15 bp, Homo sapiens
tggggtcaaccagat

SEQ ID NO: 20325 - DNA, 19 bp, Homo sapiens
tggggtcagccaagcagat

SEQ ID NO: 20326 - DNA, 17 bp, Homo sapiens
tggtgtaatgactagat

SEQ ID NO: 20327 - DNA, 16 bp, Homo sapiens
tggggccagactggat

SEQ ID NO: 20328 - DNA, 17 bp, Homo sapiens
tggggccggaaggagat

SEQ ID NO: 20329 - DNA, 18 bp, Homo sapiens
tggggtcaaagaccaaat

SEQ ID NO: 20330 - DNA, 19 bp, Homo sapiens
tggggtcaggaggacatag

SEQ ID NO: 20331 - DNA, 16 bp, Homo sapiens
tggggtcagagccgac

SEQ ID NO: 20332 - DNA, 18 bp, Homo sapiens
ggggtcgaggagacagat

SEQ ID NO: 20333 - DNA, 18 bp, Homo sapiens
tggagtcagggactggat

SEQ ID NO: 20334 - DNA, 61 bp, Chimpanzee cytomegalovirus
gccgcagggcacctggccggcgtgccgccgaagggccgctatcagggcctcgagctgcggc

SEQ ID NO: 20335 - DNA, 22 bp, Chimpanzee cytomegalovirus
tatcagggcctcgagctgcggc

SEQ ID NO: 20336 - DNA, 23 bp, Homo sapiens
taccagggtgagagggctgtggc

SEQ ID NO: 20337 - DNA, 19 bp, Homo sapiens
tatcggggccccggagccg

SEQ ID NO: 20338 - DNA, 17 bp, Homo sapiens
tatcagggtcagtgtgg

SEQ ID NO: 20339 - DNA, 18 bp, Homo sapiens
tcagggcctcagcctggc

SEQ ID NO: 20340 - DNA, 17 bp, Homo sapiens
ccggggcctcgccgggc

SEQ ID NO: 20341 - DNA, 20 bp, Homo sapiens
tcagagtttgcagctgcggc

SEQ ID NO: 20342 - DNA, 16 bp, Homo sapiens
atcggggcctcgaggc

SEQ ID NO: 20343 - DNA, 20 bp, Homo sapiens
taccagggctttggcctggc

SEQ ID NO: 20344 - DNA, 20 bp, Homo sapiens
ggcgcccggtgagctgcggc

SEQ ID NO: 20345 - DNA, 22 bp, Homo sapiens
tatcagggtcttgtagactgag

SEQ ID NO: 20346 - DNA, 18 bp, Homo sapiens
cagggcggcgggctgcgg

SEQ ID NO: 20347 - DNA, 21 bp, Homo sapiens
tatcagggtctgtgcctgggc

SEQ ID NO: 20348 - DNA, 19 bp, Homo sapiens
ccagggcctctctcctggc

SEQ ID NO: 20349 - DNA, 19 bp, Homo sapiens
tcagggccttggctgtggc

SEQ ID NO: 20350 - DNA, 15 bp, Homo sapiens
cagggccccctgcgg

SEQ ID NO: 20351 - DNA, 20 bp, Homo sapiens
catcagggcacatcttgtgg

SEQ ID NO: 20352 - DNA, 18 bp, Homo sapiens
tcagggccccactgcggc

SEQ ID NO: 20353 - DNA, 17 bp, Homo sapiens
cagggcctctgcctggc

SEQ ID NO: 20354 - DNA, 21 bp, Homo sapiens
tatcagagtcttgaatcaggc

SEQ ID NO: 20355 - DNA, 20 bp, Homo sapiens
agggcctcaactctctgtgg

SEQ ID NO: 20356 - DNA, 19 bp, Homo sapiens
tatcagggacttgatcctg

SEQ ID NO: 20357 - DNA, 20 bp, Homo sapiens
atcagggcaggcactgcggc

SEQ ID NO: 20358 - DNA, 16 bp, Homo sapiens
cagggccttgaccagg

SEQ ID NO: 20359 - DNA, 19 bp, Homo sapiens
tcagaggaccaagctgtgg

SEQ ID NO: 20360 - DNA, 19 bp, Homo sapiens
tatcagggccccgctgggg

SEQ ID NO: 20361 - DNA, 17 bp, Homo sapiens
cagggcctaaatgcggc

SEQ ID NO: 20362 - DNA, 114 bp, Chimpanzee cytomegalovirus
gctgcggctggtgctgcagctgctgctggaaaaccgacggcgtctgcgccgcaagctgcgtcggcgcctgcgccggatgtaccggcacttcgtccagctgcagcgcgccgcggc

SEQ ID NO: 20363 - DNA, 24 bp, Chimpanzee cytomegalovirus
ctgcagctgctgctggaaaaccga

SEQ ID NO: 20364 - DNA, 19 bp, Homo sapiens
ctgcagctgctttggtcca

SEQ ID NO: 20365 - DNA, 19 bp, Homo sapiens
ctgcagctactgcgggccg

SEQ ID NO: 20366 - DNA, 18 bp, Homo sapiens
tgagctgctgctgtcacg

SEQ ID NO: 20367 - DNA, 22 bp, Homo sapiens
gcggctgctgcttggcagtcga

SEQ ID NO: 20368 - DNA, 18 bp, Homo sapiens
ctgtagctgctgctggaa

SEQ ID NO: 20369 - DNA, 19 bp, Homo sapiens
ctggcggctgctggggccg

SEQ ID NO: 20370 - DNA, 19 bp, Homo sapiens
cagctacttgggaggccga

SEQ ID NO: 20371 - DNA, 19 bp, Homo sapiens
ctgcagctgttctgcctgg

SEQ ID NO: 20372 - DNA, 22 bp, Homo sapiens
ctgcgctgctgaggaggggccg

SEQ ID NO: 20373 - DNA, 19 bp, Homo sapiens
ctgctgttgctgctgctgg

SEQ ID NO: 20374 - DNA, 23 bp, Homo sapiens
ctgctgctgctgctgcgcgccga

SEQ ID NO: 20375 - DNA, 21 bp, Homo sapiens
tgtagctgctgctggccacca

SEQ ID NO: 20376 - DNA, 15 bp, Homo sapiens
cagctgctgtagccg

SEQ ID NO: 20377 - DNA, 18 bp, Homo sapiens
ccgcagctgctgcgccgg

SEQ ID NO: 20378 - DNA, 18 bp, Homo sapiens
ctgcagcttctgaaaccg

SEQ ID NO: 20379 - DNA, 22 bp, Homo sapiens
ctgcaactggaacggaaagtcg

SEQ ID NO: 20380 - DNA, 18 bp, Homo sapiens
ctgggctgccgggagccg

SEQ ID NO: 20381 - DNA, 16 bp, Homo sapiens
ctgagctgctgtgacc

SEQ ID NO: 20382 - DNA, 18 bp, Homo sapiens
gctgccgctgggggaccg

SEQ ID NO: 20383 - DNA, 18 bp, Homo sapiens
ctgctgctgctgctgcga

SEQ ID NO: 20384 - DNA, 17 bp, Homo sapiens
ctgtgctgctgtgaaac

SEQ ID NO: 20385 - DNA, 22 bp, Homo sapiens
gcggctgctgctagggagtcga

SEQ ID NO: 20386 - DNA, 20 bp, Homo sapiens
tgagctgctgggcaagaccg

SEQ ID NO: 20387 - DNA, 18 bp, Homo sapiens
ctgctgctgctgctgccg

SEQ ID NO: 20388 - DNA, 21 bp, Homo sapiens
ctgctgctgctgctgctgccg

SEQ ID NO: 20389 - DNA, 20 bp, Homo sapiens
ctgccgctgcagcagagccg

SEQ ID NO: 20390 - DNA, 23 bp, Homo sapiens
gcagctgcacctcggggagtcga

SEQ ID NO: 20391 - DNA, 21 bp, Homo sapiens
ctgcagctccctcaagactgg

SEQ ID NO: 20392 - DNA, 19 bp, Homo sapiens
ctgcagctgcttctgccgg

SEQ ID NO: 20393 - DNA, 19 bp, Homo sapiens
ctgcactgccgggggccgg

SEQ ID NO: 20394 - DNA, 18 bp, Homo sapiens
ctgcagctccagggctgg

SEQ ID NO: 20395 - DNA, 20 bp, Homo sapiens
tgcagctgctgttgctctgg

SEQ ID NO: 20396 - DNA, 18 bp, Homo sapiens
ctgctggctgctgctccg

SEQ ID NO: 20397 - DNA, 18 bp, Homo sapiens
ctgcaactgctaggggaa

SEQ ID NO: 20398 - DNA, 18 bp, Homo sapiens
ctgcagcagtaaaaaccg

SEQ ID NO: 20399 - DNA, 19 bp, Homo sapiens
acttgctgctgcaaactga

SEQ ID NO: 20400 - DNA, 18 bp, Homo sapiens
ctacagctgcagggctga

SEQ ID NO: 20401 - DNA, 19 bp, Homo sapiens
cagctgcttcaagaaaccg

SEQ ID NO: 20402 - DNA, 20 bp, Homo sapiens
ctggagctgtccggggctgg

SEQ ID NO: 20403 - DNA, 21 bp, Homo sapiens
ctgcagctggcagggggctgg

SEQ ID NO: 20404 - DNA, 18 bp, Homo sapiens
ctgcagctgtttcactga

SEQ ID NO: 20405 - DNA, 19 bp, Homo sapiens
ctgcggctgcggctgcccg

SEQ ID NO: 20406 - DNA, 19 bp, Homo sapiens
ctgctgctgtaactgctgg

SEQ ID NO: 20407 - DNA, 19 bp, Homo sapiens
ctgcaattgctgctgctgg

SEQ ID NO: 20408 - DNA, 20 bp, Homo sapiens
ctccagctgtcccagaaccg

SEQ ID NO: 20409 - DNA, 27 bp, Homo sapiens
ctgcatctgctgctgtgcagaaactga

SEQ ID NO: 20410 - DNA, 18 bp, Homo sapiens
tgagctgctgctggtccg

SEQ ID NO: 20411 - DNA, 16 bp, Homo sapiens
ctgcagctgcgggaaa

SEQ ID NO: 20412 - DNA, 21 bp, Homo sapiens
ctgtggctgctgctggatcac

SEQ ID NO: 20413 - DNA, 21 bp, Homo sapiens
ctgcagctcctcaagggccga

SEQ ID NO: 20414 - DNA, 23 bp, Homo sapiens
ccgcagctgctccactgagctgg

SEQ ID NO: 20415 - DNA, 22 bp, Homo sapiens
ctgcagctgcagctgggcccca

SEQ ID NO: 20416 - DNA, 18 bp, Homo sapiens
tgcagctgctgtttctgg

SEQ ID NO: 20417 - DNA, 24 bp, Homo sapiens
ctgcagctgccttctgaaggctgg

SEQ ID NO: 20418 - DNA, 18 bp, Homo sapiens
ctgcagctggctggctgg

SEQ ID NO: 20419 - DNA, 21 bp, Homo sapiens
ctgctgctgctgctggcgcga

SEQ ID NO: 20420 - DNA, 21 bp, Homo sapiens
tgctgctgctcagctgggccg

SEQ ID NO: 20421 - DNA, 15 bp, Homo sapiens
ctgcagctctaaacc

SEQ ID NO: 20422 - DNA, 19 bp, Homo sapiens
ctgcagccgcgggagccgg

SEQ ID NO: 20423 - DNA, 19 bp, Homo sapiens
gcagttgctgctaataaac

SEQ ID NO: 20424 - DNA, 19 bp, Homo sapiens
gctgctgcctctgaagccg

SEQ ID NO: 20425 - DNA, 18 bp, Homo sapiens
ctgcgctgctgtcaccaa

SEQ ID NO: 20426 - DNA, 23 bp, Homo sapiens
ctgtggctgctgcctgggtccaa

SEQ ID NO: 20427 - DNA, 20 bp, Homo sapiens
ctgagcttatcttggaaaac

SEQ ID NO: 20428 - DNA, 19 bp, Homo sapiens
tgcaagaactggaaaaccg

SEQ ID NO: 20429 - DNA, 22 bp, Homo sapiens
ctgcagctgctgccgggaggcc

SEQ ID NO: 20430 - DNA, 18 bp, Homo sapiens
gcagctgctgcagtagaa

SEQ ID NO: 20431 - DNA, 19 bp, Homo sapiens
gcggctgccgccggagccg

SEQ ID NO: 20432 - DNA, 28 bp, Homo sapiens
ctgcagctacagggttgatcggttttcc

SEQ ID NO: 20433 - DNA, 20 bp, Homo sapiens
ctgcagtgccagaaggctga

SEQ ID NO: 20434 - DNA, 18 bp, Homo sapiens
ctgcagctgctctcttgg

SEQ ID NO: 20435 - DNA, 20 bp, Homo sapiens
ctgctgttgctgctgcttgg

SEQ ID NO: 20436 - DNA, 17 bp, Homo sapiens
ctgagctgctgttggaa

SEQ ID NO: 20437 - DNA, 19 bp, Homo sapiens
tgcatctgctgctgggcca

SEQ ID NO: 20438 - DNA, 18 bp, Homo sapiens
ctgtgtgctgctgctgga

SEQ ID NO: 20439 - DNA, 23 bp, Homo sapiens
ctggagctgctgctggctatccc

SEQ ID NO: 20440 - DNA, 22 bp, Homo sapiens
ctgcagctgcttctggatgccg

SEQ ID NO: 20441 - DNA, 28 bp, Homo sapiens
ctgcggcttgggagcgctgggaggccga

SEQ ID NO: 20442 - DNA, 18 bp, Homo sapiens
ctgctgctgctgtgctgg

SEQ ID NO: 20443 - DNA, 19 bp, Homo sapiens
ctgcagctgtgtttgctgg

SEQ ID NO: 20444 - DNA, 17 bp, Homo sapiens
tgcagctgcagctgacc

SEQ ID NO: 20445 - DNA, 18 bp, Homo sapiens
tgcagctgtctgggctgg

SEQ ID NO: 20446 - DNA, 21 bp, Homo sapiens
gctccggctgctgggaaaccg

SEQ ID NO: 20447 - DNA, 18 bp, Homo sapiens
ctgcagcagctgctggaa

SEQ ID NO: 20448 - DNA, 22 bp, Homo sapiens
ctgctgttgctgctgaactcca

SEQ ID NO: 20449 - DNA, 19 bp, Homo sapiens
ctgctgctgttgctgctga

SEQ ID NO: 20450 - DNA, 18 bp, Homo sapiens
ctgcactgctgctgctgg

SEQ ID NO: 20451 - DNA, 18 bp, Homo sapiens
ctgcagctcttttagaaa

SEQ ID NO: 20452 - DNA, 23 bp, Homo sapiens
tgaagctgtccctgggggaaccg

SEQ ID NO: 20453 - DNA, 25 bp, Homo sapiens
ctgccagttggcccacggaaggccg

SEQ ID NO: 20454 - DNA, 16 bp, Homo sapiens
gctgctctggaaaacg

SEQ ID NO: 20455 - DNA, 24 bp, Homo sapiens
ctgcagctcttggcctgagactgg

SEQ ID NO: 20456 - DNA, 24 bp, Homo sapiens
ccgcagcgccacctgggaaactga

SEQ ID NO: 20457 - DNA, 19 bp, Homo sapiens
gcagctgcccggagaaccg

SEQ ID NO: 20458 - DNA, 19 bp, Homo sapiens
ctgtgctgctgaccagccg

SEQ ID NO: 20459 - DNA, 19 bp, Homo sapiens
ctgcgctgtccggggctgg

SEQ ID NO: 20460 - DNA, 19 bp, Homo sapiens
ccgtagctgctgccgaccg

SEQ ID NO: 20461 - DNA, 22 bp, Homo sapiens
ctgcagctccttggtgagctgg

SEQ ID NO: 20462 - DNA, 19 bp, Homo sapiens
ctgcagctgttgctgctgg

SEQ ID NO: 20463 - DNA, 21 bp, Homo sapiens
tgcagctgctgtgacgactgg

SEQ ID NO: 20464 - DNA, 20 bp, Homo sapiens
ctgctgctgctgctgtcgcc

SEQ ID NO: 20465 - DNA, 21 bp, Homo sapiens
ctacagctggagggaaaccga

SEQ ID NO: 20466 - DNA, 23 bp, Homo sapiens
ctgaagctgctgctggagaagcg

SEQ ID NO: 20467 - DNA, 17 bp, Homo sapiens
tgcagctgctctgcccg

SEQ ID NO: 20468 - DNA, 19 bp, Homo sapiens
ctgctgttgctgctactgg

SEQ ID NO: 20469 - DNA, 18 bp, Homo sapiens
ctacggctgctgggctga

SEQ ID NO: 20470 - DNA, 19 bp, Homo sapiens
ctgcagctgcaagggccgg

SEQ ID NO: 20471 - DNA, 19 bp, Homo sapiens
ctgagctgctggggactgg

SEQ ID NO: 20472 - DNA, 21 bp, Homo sapiens
ctggtagctgctgcgggccga

SEQ ID NO: 20473 - DNA, 18 bp, Homo sapiens
ctgagctgctggggctga

SEQ ID NO: 20474 - DNA, 18 bp, Homo sapiens
ctgcaactgctgctgtga

SEQ ID NO: 20475 - DNA, 22 bp, Homo sapiens
ctgcagccgctgctcacccccg

SEQ ID NO: 20476 - DNA, 18 bp, Homo sapiens
ctgagctgccagaactgg

SEQ ID NO: 20477 - DNA, 24 bp, Homo sapiens
ctgcagctgctgttgtacacccga

SEQ ID NO: 20478 - DNA, 17 bp, Homo sapiens
cagacactttggaaaac

SEQ ID NO: 20479 - DNA, 20 bp, Homo sapiens
ctgcagctgcctagggctgg

SEQ ID NO: 20480 - DNA, 19 bp, Homo sapiens
ctgtactgcctgaagaccg

SEQ ID NO: 20481 - DNA, 20 bp, Homo sapiens
ctgccagctgctcagcagga

SEQ ID NO: 20482 - DNA, 22 bp, Homo sapiens
ctgggctgctatggaaaactga

SEQ ID NO: 20483 - DNA, 16 bp, Homo sapiens
ctgcagctgcagctcc

SEQ ID NO: 20484 - DNA, 23 bp, Homo sapiens
tgctgaggctgctgggaggccga

SEQ ID NO: 20485 - DNA, 21 bp, Homo sapiens
ctgtggatgctgctgaccccg

SEQ ID NO: 20486 - DNA, 17 bp, Homo sapiens
ctgcgctgctgaaggaa

SEQ ID NO: 20487 - DNA, 68 bp, Canine adenovirus
ttctaagtgtgcaggtgtgagtaactttgaaaaaagacccgcaaaactcacacttttgcattggggaa

SEQ ID NO: 20488 - DNA, 20 bp, Canine adenovirus
cacacttttgcattggggaa

SEQ ID NO: 20489 - DNA, 19 bp, Homo sapiens
caactaagcacttggggaa

SEQ ID NO: 20490 - DNA, 20 bp, Homo sapiens
cacattatgctccttgggga

SEQ ID NO: 20491 - DNA, 18 bp, Homo sapiens
cacacctttgctctagaa

SEQ ID NO: 20492 - DNA, 19 bp, Homo sapiens
cacacttttccttctggaa

SEQ ID NO: 20493 - DNA, 16 bp, Homo sapiens
acactctttgcaggga

SEQ ID NO: 20494 - DNA, 19 bp, Homo sapiens
cacacttctagtcgcggga

SEQ ID NO: 20495 - DNA, 17 bp, Homo sapiens
caccctttcctggggaa

SEQ ID NO: 20496 - DNA, 20 bp, Homo sapiens
cacacccccacagttgggga

SEQ ID NO: 20497 - DNA, 18 bp, Homo sapiens
cacattcatgctggggaa

SEQ ID NO: 20498 - DNA, 18 bp, Homo sapiens
cacactgggcctggggaa

SEQ ID NO: 20499 - DNA, 16 bp, Homo sapiens
acacctttttcgggaa

SEQ ID NO: 20500 - DNA, 19 bp, Homo sapiens
acatttttggcaccaggga

SEQ ID NO: 20501 - DNA, 16 bp, Homo sapiens
cacattttgcttagag

SEQ ID NO: 20502 - DNA, 15 bp, Homo sapiens
cacactttgctggaa

SEQ ID NO: 20503 - DNA, 20 bp, Homo sapiens
cactggagcccattggggaa

SEQ ID NO: 20504 - DNA, 19 bp, Homo sapiens
cacacatttgcttcaagga

SEQ ID NO: 20505 - DNA, 19 bp, Homo sapiens
cacacctttgcacttctga

SEQ ID NO: 20506 - DNA, 19 bp, Homo sapiens
acacttttgtttaagggaa

SEQ ID NO: 20507 - DNA, 20 bp, Homo sapiens
cacactttgcagtccaggaa

SEQ ID NO: 20508 - DNA, 18 bp, Homo sapiens
catacttttaattgggaa

SEQ ID NO: 20509 - DNA, 18 bp, Homo sapiens
acacttttaggaaaggaa

SEQ ID NO: 20510 - DNA, 19 bp, Homo sapiens
cacagttttgtcattagaa

SEQ ID NO: 20511 - DNA, 18 bp, Homo sapiens
cacacttttatttaagga

SEQ ID NO: 20512 - DNA, 19 bp, Homo sapiens
caccttttgcaaaacggag

SEQ ID NO: 20513 - DNA, 19 bp, Homo sapiens
catttttgcattgtcagga

SEQ ID NO: 20514 - DNA, 20 bp, Homo sapiens
cacactttctctccagggaa

SEQ ID NO: 20515 - DNA, 19 bp, Homo sapiens
cacactgtttgacttggga

SEQ ID NO: 20516 - DNA, 20 bp, Homo sapiens
cacattttgcataataggga

SEQ ID NO: 20517 - DNA, 18 bp, Homo sapiens
cacttctgcaaggtgggg

SEQ ID NO: 20518 - DNA, 17 bp, Homo sapiens
cacactacattggggaa

SEQ ID NO: 20519 - DNA, 20 bp, Homo sapiens
cacttttagtacagacgggg

SEQ ID NO: 20520 - DNA, 19 bp, Homo sapiens
cacacttctgtaaacagag

SEQ ID NO: 20521 - DNA, 19 bp, Homo sapiens
cacgcctggctctggggaa

SEQ ID NO: 20522 - DNA, 19 bp, Homo sapiens
cttattacatgttggggaa

SEQ ID NO: 20523 - DNA, 18 bp, Homo sapiens
cacattttgcatttttga

SEQ ID NO: 20524 - DNA, 16 bp, Homo sapiens
cacacttctccgggaa

SEQ ID NO: 20525 - DNA, 17 bp, Homo sapiens
cacactttgacaaggag

SEQ ID NO: 20526 - DNA, 18 bp, Homo sapiens
acattttgtccttgggga

SEQ ID NO: 20527 - DNA, 16 bp, Homo sapiens
cacactttggcaagag

SEQ ID NO: 20528 - DNA, 15 bp, Homo sapiens
cacactttcgtggga

SEQ ID NO: 20529 - DNA, 21 bp, Homo sapiens
cacatcttaaactttggggaa

SEQ ID NO: 20530 - DNA, 21 bp, Homo sapiens
cacactctttgcgcatctcag

SEQ ID NO: 20531 - DNA, 16 bp, Homo sapiens
cacgctttattgggaa

SEQ ID NO: 20532 - DNA, 19 bp, Homo sapiens
cacaatatctgttggggaa

SEQ ID NO: 20533 - DNA, 18 bp, Homo sapiens
caccctgtaattggggaa

SEQ ID NO: 20534 - DNA, 20 bp, Homo sapiens
cacatttctgcatcttggga

SEQ ID NO: 20535 - DNA, 22 bp, Homo sapiens
acacttttccatctaatgggga

SEQ ID NO: 20536 - DNA, 18 bp, Homo sapiens
acattttaaacattgggg

SEQ ID NO: 20537 - DNA, 19 bp, Homo sapiens
acactgtgagcctggggaa

SEQ ID NO: 20538 - DNA, 18 bp, Homo sapiens
acactttatgcgtcgggg

SEQ ID NO: 20539 - DNA, 19 bp, Homo sapiens
cagacttttgctgcaggaa

SEQ ID NO: 20540 - DNA, 18 bp, Homo sapiens
ctcctgcgtgttggggaa

SEQ ID NO: 20541 - DNA, 17 bp, Homo sapiens
cacatttctgactggag

SEQ ID NO: 20542 - DNA, 17 bp, Homo sapiens
cacactttcaatgggaa

SEQ ID NO: 20543 - DNA, 19 bp, Homo sapiens
cacattctttgcagtgggg

SEQ ID NO: 20544 - DNA, 18 bp, Homo sapiens
cacagttttgcatatggg

SEQ ID NO: 20545 - DNA, 19 bp, Homo sapiens
cacttctgctgaccaggaa

SEQ ID NO: 20546 - DNA, 19 bp, Homo sapiens
caacttttgcagtattgag

SEQ ID NO: 20547 - DNA, 16 bp, Homo sapiens
acacttttaaagggaa

SEQ ID NO: 20548 - DNA, 20 bp, Homo sapiens
cagccagatacgttggggaa

SEQ ID NO: 20549 - DNA, 18 bp, Homo sapiens
cacttttgtcttggggaa

SEQ ID NO: 20550 - DNA, 18 bp, Homo sapiens
cacattctttactgggaa

SEQ ID NO: 20551 - DNA, 18 bp, Homo sapiens
acacttgtgtgcactggg

SEQ ID NO: 20552 - DNA, 17 bp, Homo sapiens
taacatttgctggggaa

SEQ ID NO: 20553 - DNA, 20 bp, Homo sapiens
acatgttttgttctggggaa

SEQ ID NO: 20554 - DNA, 17 bp, Homo sapiens
cacacctttgtgtagaa

SEQ ID NO: 20555 - DNA, 19 bp, Homo sapiens
cacatttttccactaggaa

SEQ ID NO: 20556 - DNA, 21 bp, Homo sapiens
cacaccttttgctaaccagga

SEQ ID NO: 20557 - DNA, 17 bp, Homo sapiens
cacactgttgcccggag

SEQ ID NO: 20558 - DNA, 18 bp, Homo sapiens
cattttacacatggggaa

SEQ ID NO: 20559 - DNA, 18 bp, Homo sapiens
ccttgctagattggggaa

SEQ ID NO: 20560 - DNA, 19 bp, Homo sapiens
acatttctgctctggggaa

SEQ ID NO: 20561 - DNA, 17 bp, Homo sapiens
acactttgcaccaagaa

SEQ ID NO: 20562 - DNA, 16 bp, Homo sapiens
cacacctttgtggcaa

SEQ ID NO: 20563 - DNA, 19 bp, Homo sapiens
cacacctttgtccactggg

SEQ ID NO: 20564 - DNA, 19 bp, Homo sapiens
cgacttccgctattgggga

SEQ ID NO: 20565 - DNA, 17 bp, Homo sapiens
cacattttgcaaaggga

SEQ ID NO: 20566 - DNA, 18 bp, Homo sapiens
cacattttgcatttggga

SEQ ID NO: 20567 - DNA, 20 bp, Homo sapiens
cacacttttgcaacaaagga

SEQ ID NO: 20568 - DNA, 19 bp, Homo sapiens
tgactttagccttggggaa

SEQ ID NO: 20569 - DNA, 19 bp, Homo sapiens
cacattttggatttgggaa

SEQ ID NO: 20570 - DNA, 18 bp, Homo sapiens
acactttttccctgggaa

SEQ ID NO: 20571 - DNA, 17 bp, Homo sapiens
cagacttttgcttaaga

SEQ ID NO: 20572 - DNA, 19 bp, Homo sapiens
acactttttggccaaggga

SEQ ID NO: 20573 - DNA, 17 bp, Homo sapiens
cagcttggcctggggaa

SEQ ID NO: 20574 - DNA, 16 bp, Homo sapiens
cacacctttgcaggga

SEQ ID NO: 20575 - DNA, 15 bp, Homo sapiens
acactgcttggggaa

SEQ ID NO: 20576 - DNA, 18 bp, Homo sapiens
cacactttctgtttaggg

SEQ ID NO: 20577 - DNA, 20 bp, Homo sapiens
acacttttgttgatctggaa

SEQ ID NO: 20578 - DNA, 17 bp, Homo sapiens
cacactcttggttggag

SEQ ID NO: 20579 - DNA, 18 bp, Homo sapiens
caccttttgcagcccgag

SEQ ID NO: 20580 - DNA, 16 bp, Homo sapiens
acacttttcctgggga

SEQ ID NO: 20581 - DNA, 19 bp, Homo sapiens
cacactgttgagatcggaa

SEQ ID NO: 20582 - DNA, 18 bp, Homo sapiens
taacttcccactggggaa

SEQ ID NO: 20583 - DNA, 18 bp, Homo sapiens
caccgcaagattggggaa

SEQ ID NO: 20584 - DNA, 17 bp, Homo sapiens
cacacttctgaatggag

SEQ ID NO: 20585 - DNA, 18 bp, Homo sapiens
cattttgttattggggaa

SEQ ID NO: 20586 - DNA, 18 bp, Homo sapiens
cacacttttgtcattggg

SEQ ID NO: 20587 - DNA, 20 bp, Homo sapiens
caccttttgtgcttggggaa

SEQ ID NO: 20588 - DNA, 19 bp, Homo sapiens
cacactttatgatgaggaa

SEQ ID NO: 20589 - DNA, 18 bp, Homo sapiens
acattacagtttggggaa

SEQ ID NO: 20590 - DNA, 21 bp, Homo sapiens
cacacttttaggctgagggga

SEQ ID NO: 20591 - DNA, 17 bp, Homo sapiens
acacttttcactgggaa

SEQ ID NO: 20592 - DNA, 17 bp, Homo sapiens
caccttctacatggggg

SEQ ID NO: 20593 - DNA, 20 bp, Homo sapiens
cactcttgggatttggggaa

SEQ ID NO: 20594 - DNA, 17 bp, Homo sapiens
caccttcaaccttgggg

SEQ ID NO: 20595 - DNA, 19 bp, Homo sapiens
cacactttttggctccgag

SEQ ID NO: 20596 - DNA, 17 bp, Homo sapiens
acactcttgcccaggaa

SEQ ID NO: 20597 - DNA, 19 bp, Homo sapiens
acactttcagtctggggaa

SEQ ID NO: 20598 - DNA, 18 bp, Homo sapiens
cagcttctacatggggaa

SEQ ID NO: 20599 - DNA, 19 bp, Homo sapiens
caccttttgtgctttggaa

SEQ ID NO: 20600 - DNA, 15 bp, Homo sapiens
cacactcttccggga

SEQ ID NO: 20601 - DNA, 17 bp, Homo sapiens
cacacatttaacgggaa

SEQ ID NO: 20602 - DNA, 19 bp, Homo sapiens
cacatttttgtccttggag

SEQ ID NO: 20603 - DNA, 16 bp, Homo sapiens
cacacttattggggaa

SEQ ID NO: 20604 - DNA, 18 bp, Homo sapiens
tgacttttgcagttaggg

SEQ ID NO: 20605 - DNA, 18 bp, Homo sapiens
cacatctttgctattgag

SEQ ID NO: 20606 - DNA, 16 bp, Homo sapiens
cacactccttggggaa

SEQ ID NO: 20607 - DNA, 20 bp, Homo sapiens
cacatgtttgtatctgggga

SEQ ID NO: 20608 - DNA, 16 bp, Homo sapiens
cacatttttattggga

SEQ ID NO: 20609 - DNA, 16 bp, Homo sapiens
acactctcttggggaa

SEQ ID NO: 20610 - DNA, 18 bp, Homo sapiens
catacttaggcctgggga

SEQ ID NO: 20611 - DNA, 20 bp, Homo sapiens
acacgtttttgagatgggaa

SEQ ID NO: 20612 - DNA, 23 bp, Homo sapiens
acacttttatctcaattggggaa

SEQ ID NO: 20613 - DNA, 20 bp, Homo sapiens
cacactgtttaagagtgggg

SEQ ID NO: 20614 - DNA, 17 bp, Homo sapiens
cacacctataattgggg

SEQ ID NO: 20615 - DNA, 15 bp, Homo sapiens
cacactttgtgggga

SEQ ID NO: 20616 - DNA, 17 bp, Homo sapiens
cactgggcattggggaa

SEQ ID NO: 20617 - DNA, 18 bp, Homo sapiens
acactcagccttggggaa

SEQ ID NO: 20618 - DNA, 16 bp, Homo sapiens
cacatcttcctgggga

SEQ ID NO: 20619 - DNA, 20 bp, Homo sapiens
cacacttttttgtgcaaggg

SEQ ID NO: 20620 - DNA, 19 bp, Homo sapiens
cattttacataatggggaa

SEQ ID NO: 20621 - DNA, 17 bp, Homo sapiens
cactccagcctggggaa

SEQ ID NO: 20622 - DNA, 19 bp, Homo sapiens
cacacttttagaatgggaa

SEQ ID NO: 20623 - DNA, 18 bp, Homo sapiens
cacttttgtgacattgga

SEQ ID NO: 20624 - DNA, 17 bp, Homo sapiens
acaatttggctggggaa

SEQ ID NO: 20625 - DNA, 19 bp, Homo sapiens
cacacttctgtggctctgg

SEQ ID NO: 20626 - DNA, 18 bp, Homo sapiens
acacttttgtaaaaggaa

SEQ ID NO: 20627 - DNA, 19 bp, Homo sapiens
cacacttttatattttggg

SEQ ID NO: 20628 - DNA, 20 bp, Homo sapiens
cacactgtttgtaaactgga

SEQ ID NO: 20629 - DNA, 22 bp, Homo sapiens
cacactttggcatctctctgaa

SEQ ID NO: 20630 - DNA, 19 bp, Homo sapiens
acttttgcagtcttgggga

SEQ ID NO: 20631 - DNA, 18 bp, Homo sapiens
cacacatcctctggggaa

SEQ ID NO: 20632 - DNA, 18 bp, Homo sapiens
acaattttgtattgagaa

SEQ ID NO: 20633 - DNA, 18 bp, Homo sapiens
cacactgttgctctggaa

SEQ ID NO: 20634 - DNA, 18 bp, Homo sapiens
cacactgttgcactccag

SEQ ID NO: 20635 - DNA, 20 bp, Homo sapiens
caacttttgcctcaagggaa

SEQ ID NO: 20636 - DNA, 21 bp, Homo sapiens
cacactttttgatgtctgggg

SEQ ID NO: 20637 - DNA, 20 bp, Homo sapiens
cacactttgcagattgggaa

SEQ ID NO: 20638 - DNA, 21 bp, Homo sapiens
cacacttctgtagtgctggaa

SEQ ID NO: 20639 - DNA, 19 bp, Homo sapiens
acatttctgcactgtttga

SEQ ID NO: 20640 - DNA, 20 bp, Homo sapiens
cacacttttcacctgctgaa

SEQ ID NO: 20641 - DNA, 18 bp, Homo sapiens
acattattgcattaggga

SEQ ID NO: 20642 - DNA, 15 bp, Homo sapiens
cacattctttgggga

SEQ ID NO: 20643 - DNA, 17 bp, Homo sapiens
cacaattttgcatggaa

SEQ ID NO: 20644 - DNA, 17 bp, Homo sapiens
cacagttttactgggga

SEQ ID NO: 20645 - DNA, 20 bp, Homo sapiens
cacattctatctctggggaa

SEQ ID NO: 20646 - DNA, 18 bp, Homo sapiens
acactttctgccctaggg

SEQ ID NO: 20647 - DNA, 18 bp, Homo sapiens
ctgctacaagttggggaa

SEQ ID NO: 20648 - DNA, 20 bp, Homo sapiens
caccttttgtatatgcggaa

SEQ ID NO: 20649 - DNA, 19 bp, Homo sapiens
cacacttctgctgctggag

SEQ ID NO: 20650 - DNA, 18 bp, Homo sapiens
cacacttttgttctggaa

SEQ ID NO: 20651 - DNA, 18 bp, Homo sapiens
cacacatttgaataggga

SEQ ID NO: 20652 - DNA, 18 bp, Homo sapiens
cattctggcactggggaa

SEQ ID NO: 20653 - DNA, 17 bp, Homo sapiens
caccctttctcggggaa

SEQ ID NO: 20654 - DNA, 18 bp, Homo sapiens
cacacatttgcctccggg

SEQ ID NO: 20655 - DNA, 20 bp, Homo sapiens
caacttttgcaatcagggaa

SEQ ID NO: 20656 - DNA, 20 bp, Homo sapiens
acactttctgccctagggaa

SEQ ID NO: 20657 - DNA, 16 bp, Homo sapiens
acactcttgttgggaa

SEQ ID NO: 20658 - DNA, 16 bp, Homo sapiens
cacactttgattgggg

SEQ ID NO: 20659 - DNA, 18 bp, Homo sapiens
cacacttgtgtgaccgag

SEQ ID NO: 20660 - DNA, 18 bp, Homo sapiens
cacactttctgcatgtgg

SEQ ID NO: 20661 - DNA, 15 bp, Homo sapiens
cacattttgctggag

SEQ ID NO: 20662 - DNA, 19 bp, Homo sapiens
acatttcttgacaagggga

SEQ ID NO: 20663 - DNA, 17 bp, Homo sapiens
cacttttcaccagggaa

SEQ ID NO: 20664 - DNA, 16 bp, Homo sapiens
cactttgcatggggaa

SEQ ID NO: 20665 - DNA, 19 bp, Homo sapiens
cacactcttgccagcagaa

SEQ ID NO: 20666 - DNA, 19 bp, Homo sapiens
acatttttgcattgcagga

SEQ ID NO: 20667 - DNA, 17 bp, Homo sapiens
catccttctttggggaa

SEQ ID NO: 20668 - DNA, 18 bp, Homo sapiens
cagcttcagcttggggaa

SEQ ID NO: 20669 - DNA, 16 bp, Homo sapiens
cacttttggtgaggaa

SEQ ID NO: 20670 - DNA, 18 bp, Homo sapiens
caaacttttgccttagag

SEQ ID NO: 20671 - DNA, 19 bp, Homo sapiens
cacatttctatacagggaa

SEQ ID NO: 20672 - DNA, 18 bp, Homo sapiens
cactcttggagctgggga

SEQ ID NO: 20673 - DNA, 19 bp, Homo sapiens
cacactcttgtggctagaa

SEQ ID NO: 20674 - DNA, 20 bp, Homo sapiens
cacactttgtccatctggaa

SEQ ID NO: 20675 - DNA, 17 bp, Homo sapiens
cacactttcaatgggga

SEQ ID NO: 20676 - DNA, 18 bp, Homo sapiens
cattttgcagatggggaa

SEQ ID NO: 20677 - DNA, 18 bp, Homo sapiens
cagacctttattggggaa

SEQ ID NO: 20678 - DNA, 19 bp, Homo sapiens
cacacatttgctcacagaa

SEQ ID NO: 20679 - DNA, 19 bp, Homo sapiens
cacttttgcatcctgtggg

SEQ ID NO: 20680 - DNA, 18 bp, Homo sapiens
acactttttgataaggaa

SEQ ID NO: 20681 - DNA, 19 bp, Homo sapiens
cacaagatttattggggaa

SEQ ID NO: 20682 - DNA, 18 bp, Homo sapiens
cacatttctgcaaaagaa

SEQ ID NO: 20683 - DNA, 17 bp, Homo sapiens
caaactctcttggggaa

SEQ ID NO: 20684 - DNA, 77 bp, Human papillomavirus type 90
gtaaatatatgtaaactgtgtacagtgcggaacgttaagggacatctgttgtatacagtgtggagacctttatttgc

SEQ ID NO: 20685 - DNA, 24 bp, Human papillomavirus type 90
tacagtgtggagacctttatttgc

SEQ ID NO: 20686 - DNA, 21 bp, Homo sapiens
acagaaattgacctttatttg

SEQ ID NO: 20687 - DNA, 21 bp, Homo sapiens
gtgtggagacctctctattgc

SEQ ID NO: 20688 - DNA, 21 bp, Homo sapiens
cactgagggatttttatttgc

SEQ ID NO: 20689 - DNA, 21 bp, Homo sapiens
cacagtgtgggggccgcctgc

SEQ ID NO: 20690 - DNA, 22 bp, Homo sapiens
tacagtgtggaattctggttgc

SEQ ID NO: 20691 - DNA, 17 bp, Homo sapiens
tacagtgtggaggctct

SEQ ID NO: 20692 - DNA, 20 bp, Homo sapiens
taagtgtggggattcatctg

SEQ ID NO: 20693 - DNA, 17 bp, Homo sapiens
tacaggtggaggccttt

SEQ ID NO: 20694 - DNA, 19 bp, Homo sapiens
gtggcagcgcctttatttg

SEQ ID NO: 20695 - DNA, 21 bp, Homo sapiens
gtgcattttgtctttatttgc

SEQ ID NO: 20696 - DNA, 16 bp, Homo sapiens
cagtgtggggatttac

SEQ ID NO: 20697 - DNA, 19 bp, Homo sapiens
cagtgtggggagctgttgc

SEQ ID NO: 20698 - DNA, 23 bp, Homo sapiens
acagtgccttaatttttatttgc

SEQ ID NO: 20699 - DNA, 23 bp, Homo sapiens
tacagtgtgaggttcagcattgc

SEQ ID NO: 20700 - DNA, 22 bp, Homo sapiens
atatggaaacacttttatttgc

SEQ ID NO: 20701 - DNA, 18 bp, Homo sapiens
gtgtggagaccaatttgc

SEQ ID NO: 20702 - DNA, 24 bp, Homo sapiens
tacagtgtggatgttggccacttg

SEQ ID NO: 20703 - DNA, 20 bp, Homo sapiens
gcagggtgatgtttatttgc

SEQ ID NO: 20704 - DNA, 18 bp, Homo sapiens
tacggtgtactttatttg

SEQ ID NO: 20705 - DNA, 17 bp, Homo sapiens
caggtggcttttatttg

SEQ ID NO: 20706 - DNA, 16 bp, Homo sapiens
cagtgttctttatttg

SEQ ID NO: 20707 - DNA, 19 bp, Homo sapiens
tgagtgtttcctttatttg

SEQ ID NO: 20708 - DNA, 23 bp, Homo sapiens
tacagtgtggagctctctccctg

SEQ ID NO: 20709 - DNA, 68 bp, Chimpanzee cytomegalovirus
gcggccgtcgagatgacgctcgcacttgaggcgacacaggcaccagagcggcaggtcgatgacgctgc

SEQ ID NO: 20710 - DNA, 24 bp, Chimpanzee cytomegalovirus
ccagagcggcaggtcgatgacgct

SEQ ID NO: 20711 - DNA, 24 bp, Homo sapiens
cagagcggctgggcggttggcgct

SEQ ID NO: 20712 - DNA, 20 bp, Homo sapiens
cagggcggcaggtcatagct

SEQ ID NO: 20713 - DNA, 18 bp, Homo sapiens
gaggacctcgatgacgct

SEQ ID NO: 20714 - DNA, 18 bp, Homo sapiens
ccagggctgggatggtgc

SEQ ID NO: 20715 - DNA, 18 bp, Homo sapiens
gcgggagacgatgacgct

SEQ ID NO: 20716 - DNA, 18 bp, Homo sapiens
cagggcaggagatgacgc

SEQ ID NO: 20717 - DNA, 17 bp, Homo sapiens
gcggcaggtcgtgggct

SEQ ID NO: 20718 - DNA, 18 bp, Homo sapiens
gagcagcaggtccccgct

SEQ ID NO: 20719 - DNA, 20 bp, Homo sapiens
cagagtggcaggtcactgct

SEQ ID NO: 20720 - DNA, 24 bp, Homo sapiens
ccagggctgcaggttcaagatgct

SEQ ID NO: 20721 - DNA, 21 bp, Homo sapiens
ccggagccgcaggtcggtgac

SEQ ID NO: 20722 - DNA, 21 bp, Homo sapiens
ccagggcgacagagcgacgct

SEQ ID NO: 20723 - DNA, 26 bp, Homo sapiens
ccggggcggcaggcgcacgggacgct

SEQ ID NO: 20724 - DNA, 71 bp, Human papillomavirus type 90
taccttacccattgtacctatatgtattgtatacacagtgtatgtagacacatgtagtgggtttgtgggtg

SEQ ID NO: 20725 - DNA, 24 bp, Human papillomavirus type 90
acccattgtacctatatgtattgt

SEQ ID NO: 20726 - DNA, 20 bp, Homo sapiens
acccatatgtacctttttgt

SEQ ID NO: 20727 - DNA, 18 bp, Homo sapiens
tgtccacatatgtattgt

SEQ ID NO: 20728 - DNA, 18 bp, Homo sapiens
tgtagatatatgtattgt

SEQ ID NO: 20729 - DNA, 21 bp, Homo sapiens
acccactgtatttatttatgt

SEQ ID NO: 20730 - DNA, 20 bp, Homo sapiens
acccattgtaatttatttgt

SEQ ID NO: 20731 - DNA, 19 bp, Homo sapiens
ccacttccatatgtgttgt

SEQ ID NO: 20732 - DNA, 19 bp, Homo sapiens
cccattttacctatgtact

SEQ ID NO: 20733 - DNA, 23 bp, Homo sapiens
ctatacatttttatatgtattgt

SEQ ID NO: 20734 - DNA, 20 bp, Homo sapiens
cccattgtgctgtgccctgc

SEQ ID NO: 20735 - DNA, 61 bp, Chimpanzee cytomegalovirus
ggagtatacgtaggctaggaagacaaagtaaggcttggtcatcaccagccgcttaaacacc

SEQ ID NO: 20736 - DNA, 24 bp, Chimpanzee cytomegalovirus
tatacgtaggctaggaagacaaag

SEQ ID NO: 20737 - DNA, 23 bp, Homo sapiens
tatacatagggtcaaaggcaaag

SEQ ID NO: 20738 - DNA, 23 bp, Homo sapiens
tatacatattaccgaaggcaaag

SEQ ID NO: 20739 - DNA, 18 bp, Homo sapiens
gtatggcaggaagatgaa

SEQ ID NO: 20740 - DNA, 19 bp, Homo sapiens
tgacgtccaggaagatgaa

SEQ ID NO: 20741 - DNA, 23 bp, Homo sapiens
cataattatctaggaaggtaaag

SEQ ID NO: 20742 - DNA, 18 bp, Homo sapiens
gtagtgtagaaagataaa

SEQ ID NO: 20743 - DNA, 18 bp, Homo sapiens
gcccctaggaaggcaaag

SEQ ID NO: 20744 - DNA, 17 bp, Homo sapiens
tatgcataggctggaga

SEQ ID NO: 20745 - DNA, 20 bp, Homo sapiens
cgcccaggaggaagacgaag

SEQ ID NO: 20746 - DNA, 60 bp, Human herpesvirus 5
ggcggtgggtctcgggccaaacgccgtcgtagacgacgcgctccgaaaaacgacgccgcc

SEQ ID NO: 20747 - DNA, 23 bp, Human herpesvirus 5
gcgctccgaaaaacgacgccgcc

SEQ ID NO: 20748 - DNA, 18 bp, Homo sapiens
gcgctccgaagcgacgcc

SEQ ID NO: 20749 - DNA, 22 bp, Homo sapiens
gcgccccgggaccctcgccgcc

SEQ ID NO: 20750 - DNA, 15 bp, Homo sapiens
gctccgaaagaacca

SEQ ID NO: 20751 - DNA, 25 bp, Homo sapiens
gcgctccagcagctctggcgccgcc

SEQ ID NO: 20752 - DNA, 17 bp, Homo sapiens
gcgctccaagagctcgc

SEQ ID NO: 20753 - DNA, 17 bp, Homo sapiens
gcgctccgcgccgccgc

SEQ ID NO: 20754 - DNA, 21 bp, Homo sapiens
gcgctccggcgccatggccgc

SEQ ID NO: 20755 - DNA, 25 bp, Homo sapiens
gcgctccgggaagccggggtgcgcc

SEQ ID NO: 20756 - DNA, 22 bp, Homo sapiens
gcgctccgtgggcgcaggccgc

SEQ ID NO: 20757 - DNA, 15 bp, Homo sapiens
gcgcccacgacgccg

SEQ ID NO: 20758 - DNA, 18 bp, Homo sapiens
cgctccgagagacgcagc

SEQ ID NO: 20759 - DNA, 19 bp, Homo sapiens
gcgctccgcggaacgaacc

SEQ ID NO: 20760 - DNA, 20 bp, Homo sapiens
gcgctccggcggcgccagcc

SEQ ID NO: 20761 - DNA, 20 bp, Homo sapiens
acgctccgggaaaccgcagc

SEQ ID NO: 20762 - DNA, 17 bp, Homo sapiens
cgctctgaccacgccgc

SEQ ID NO: 20763 - DNA, 20 bp, Homo sapiens
gcgctccgcctcgcgccgcc

SEQ ID NO: 20764 - DNA, 17 bp, Homo sapiens
gcgcgccggacaccgcc

SEQ ID NO: 20765 - DNA, 18 bp, Homo sapiens
gcgctccgagacgcctgc

SEQ ID NO: 20766 - DNA, 22 bp, Homo sapiens
gctccgaagggtggacgacgcc

SEQ ID NO: 20767 - DNA, 27 bp, Homo sapiens
gcgctccgggaccacggcggcgctgcc

SEQ ID NO: 20768 - DNA, 20 bp, Homo sapiens
gcgctccgggcaaacctcgc

SEQ ID NO: 20769 - DNA, 23 bp, Homo sapiens
gcgctccggagtccggcgtcgcc

SEQ ID NO: 20770 - DNA, 24 bp, Homo sapiens
gcctccaacgccggcggcgctgcc

SEQ ID NO: 20771 - DNA, 20 bp, Homo sapiens
gcgctccggctcccgccgcc

SEQ ID NO: 20772 - DNA, 24 bp, Homo sapiens
gcgctccgggacgacggcgacgcc

SEQ ID NO: 20773 - DNA, 15 bp, Homo sapiens
gctccgaaaagccgc

SEQ ID NO: 20774 - DNA, 17 bp, Homo sapiens
gcgactccgaacgccgc

SEQ ID NO: 20775 - DNA, 20 bp, Homo sapiens
gccctccatgcgacgccgcc

SEQ ID NO: 20776 - DNA, 17 bp, Homo sapiens
gcgcccgctgacgccgc

SEQ ID NO: 20777 - DNA, 21 bp, Homo sapiens
acgctccggaaggcggcgccg

SEQ ID NO: 20778 - DNA, 21 bp, Homo sapiens
gcgctatggcgagacgccgcc

SEQ ID NO: 20779 - DNA, 17 bp, Homo sapiens
gcactccacgatgctgc

SEQ ID NO: 20780 - DNA, 16 bp, Homo sapiens
gcctccgaaaaggccg

SEQ ID NO: 20781 - DNA, 17 bp, Homo sapiens
gcgccccgaagagccgc

SEQ ID NO: 20782 - DNA, 17 bp, Homo sapiens
gcgccccgcgacgccgc

SEQ ID NO: 20783 - DNA, 17 bp, Homo sapiens
gcgctccgaggactgcc

SEQ ID NO: 20784 - DNA, 21 bp, Homo sapiens
gcgctccaaagacaccgtgcc

SEQ ID NO: 20785 - DNA, 24 bp, Homo sapiens
gcgctccacccccgcggcgtcgcc

SEQ ID NO: 20786 - DNA, 23 bp, Homo sapiens
gcgtcccgggaggagacgccgcc

SEQ ID NO: 20787 - DNA, 20 bp, Homo sapiens
gcgctccgagacgggtgcgc

SEQ ID NO: 20788 - DNA, 21 bp, Homo sapiens
gcgccccgggctcccgccgcc

SEQ ID NO: 20789 - DNA, 22 bp, Homo sapiens
gcctccgggtcctaacgccgcc

SEQ ID NO: 20790 - DNA, 66 bp, Infectious spleen and kidney necrosis virus
gcacaccaggctcttggcccaccagagacactgtcacgtgtttgctgaacggccactctagtgtgt

SEQ ID NO: 20791 - DNA, 24 bp, Infectious spleen and kidney necrosis virus
tttgctgaacggccactctagtgt

SEQ ID NO: 20792 - DNA, 21 bp, Homo sapiens
tttcctgttgtgctctagtgt

SEQ ID NO: 20793 - DNA, 19 bp, Homo sapiens
tttgctcagtgacctagtg

SEQ ID NO: 20794 - DNA, 24 bp, Homo sapiens
tttgctgaggggccatggccaggt

SEQ ID NO: 20795 - DNA, 21 bp, Homo sapiens
tttgctgagtgcctactgtgt

SEQ ID NO: 20796 - DNA, 101 bp, Infectious spleen and kidney necrosis virus
gcccgtaccactgccatcgccctttggatacatgcgcacacacatggcatacccattgcgatgtgtgtaaaacaccggagacagaaccatgggtagcgggc

SEQ ID NO: 20797 - DNA, 24 bp, Infectious spleen and kidney necrosis virus
cgatgtgtgtaaaacaccggagac

SEQ ID NO: 20798 - DNA, 18 bp, Homo sapiens
gagtgtgtaagggccaga

SEQ ID NO: 20799 - DNA, 18 bp, Homo sapiens
aatgtgtgtaaaatcagg

SEQ ID NO: 20800 - DNA, 19 bp, Homo sapiens
gatgtgtgcaaggtaccaa

SEQ ID NO: 20801 - DNA, 15 bp, Homo sapiens
gatgtgtgtaagaga

SEQ ID NO: 20802 - DNA, 22 bp, Homo sapiens
cgctgtggcttggacaccggag

SEQ ID NO: 20803 - DNA, 21 bp, Homo sapiens
tgtgtttaaaacaccctagga

SEQ ID NO: 20804 - DNA, 20 bp, Homo sapiens
tgtgtgtaaatagctggaga

SEQ ID NO: 20805 - DNA, 21 bp, Homo sapiens
gatgtggtgggcccgggggac

SEQ ID NO: 20806 - DNA, 20 bp, Homo sapiens
gaaagtatgaaacactggag

SEQ ID NO: 20807 - DNA, 23 bp, Homo sapiens
tgtgcaaagtggatactggagac

SEQ ID NO: 20808 - DNA, 16 bp, Homo sapiens
atgtgtgtaaaagaaa

SEQ ID NO: 20809 - DNA, 21 bp, Homo sapiens
atgtgtgtggaacaaagcaga

SEQ ID NO: 20810 - DNA, 22 bp, Homo sapiens
cgaggtgggctcacaccggaga

SEQ ID NO: 20811 - DNA, 19 bp, Homo sapiens
tgtgtgctggacactggag

SEQ ID NO: 20812 - DNA, 18 bp, Homo sapiens
gagtgtgtaacaaaggag

SEQ ID NO: 20813 - DNA, 20 bp, Homo sapiens
tgtgtgctaaggccggagac

SEQ ID NO: 20814 - DNA, 17 bp, Homo sapiens
gatgtgtgtagaggaaa

SEQ ID NO: 20815 - DNA, 18 bp, Homo sapiens
gatcatgagcactggaga

SEQ ID NO: 20816 - DNA, 20 bp, Homo sapiens
gtttgtaggacactggggac

SEQ ID NO: 20817 - DNA, 18 bp, Homo sapiens
atgtgtgtgaagcatgga

SEQ ID NO: 20818 - DNA, 17 bp, Homo sapiens
tgtgtgtaagaaccaga

SEQ ID NO: 20819 - DNA, 17 bp, Homo sapiens
gtgtgcaacatcggaga

SEQ ID NO: 20820 - DNA, 19 bp, Homo sapiens
gatgtgctggacaccggag

SEQ ID NO: 20821 - DNA, 23 bp, Homo sapiens
tgtgtgtagaccagtgtggagac

SEQ ID NO: 20822 - DNA, 17 bp, Homo sapiens
gatgtgtgtaaggtaga

SEQ ID NO: 20823 - DNA, 60 bp, Infectious spleen and kidney necrosis virus
ggtagcgggcagtccgacgacacggccaccagccagacaagggtgccattctgcgttgcc

SEQ ID NO: 20824 - DNA, 24 bp, Infectious spleen and kidney necrosis virus
agacaagggtgccattctgcgttg

SEQ ID NO: 20825 - DNA, 19 bp, Homo sapiens
agacaagggtttcatcatg

SEQ ID NO: 20826 - DNA, 19 bp, Homo sapiens
agcaagggccttctgcgtt

SEQ ID NO: 20827 - DNA, 22 bp, Homo sapiens
agacgggggtttctccacgttg

SEQ ID NO: 20828 - DNA, 23 bp, Homo sapiens
aaacaagggtgtggcgagcgttg

SEQ ID NO: 20829 - DNA, 21 bp, Homo sapiens
agacaagggtgctttcccctg

SEQ ID NO: 20830 - DNA, 20 bp, Homo sapiens
aggcaaggctgccattcagc

SEQ ID NO: 20831 - DNA, 24 bp, Homo sapiens
agatgggggtctctcactgcgttg

SEQ ID NO: 20832 - DNA, 75 bp, Infectious spleen and kidney necrosis virus
tgcctgtctctccatgttaaggttgttgacgctggcttcaagagccttgatacgatctgtggccctcttcaggca

SEQ ID NO: 20833 - DNA, 24 bp, Infectious spleen and kidney necrosis virus
aagagccttgatacgatctgtggc

SEQ ID NO: 20834 - DNA, 23 bp, Homo sapiens
aagggccattgtgcttctgtggc

SEQ ID NO: 20835 - DNA, 24 bp, Homo sapiens
aggcgtctgcagacggtctgtggc

SEQ ID NO: 20836 - DNA, 24 bp, Homo sapiens
aagagccttgatgtcaagaagagc

SEQ ID NO: 20837 - DNA, 23 bp, Homo sapiens
aagagtctgtgacatctttgtgg

SEQ ID NO: 20838 - DNA, 24 bp, Homo sapiens
aagaatccgaagatgatctgtggc

SEQ ID NO: 20839 - DNA, 21 bp, Homo sapiens
aacagtactgatgatctgtgg

SEQ ID NO: 20840 - DNA, 22 bp, Homo sapiens
aagtgccttccaggatctgtgg

SEQ ID NO: 20841 - DNA, 22 bp, Homo sapiens
aagagccttggatggaggtggc

SEQ ID NO: 20842 - DNA, 18 bp, Homo sapiens
agggcctgggacctgtgg

SEQ ID NO: 20843 - DNA, 23 bp, Homo sapiens
aagagccttgactatgaagaggc

SEQ ID NO: 20844 - DNA, 18 bp, Homo sapiens
gcctaagcgatctgtggc

SEQ ID NO: 20845 - DNA, 24 bp, Homo sapiens
aagagcctttgtgtctgctgtggc

SEQ ID NO: 20846 - DNA, 16 bp, Homo sapiens
aaaagccttgatgctg

SEQ ID NO: 20847 - DNA, 20 bp, Homo sapiens
gaggctttaagatctgtggc

SEQ ID NO: 20848 - DNA, 25 bp, Homo sapiens
agagccttgggacggcagggatggc

SEQ ID NO: 20849 - DNA, 23 bp, Homo sapiens
aagtgctttgtcatttctgtggc

SEQ ID NO: 20850 - DNA, 22 bp, Homo sapiens
gagccttgctgctggactgtgg

SEQ ID NO: 20851 - DNA, 19 bp, Homo sapiens
agggctttggtatctgtgg

SEQ ID NO: 20852 - DNA, 19 bp, Homo sapiens
gagctttgatacgaaacgc

SEQ ID NO: 20853 - DNA, 16 bp, Homo sapiens
agagccttgactgcgg

SEQ ID NO: 20854 - DNA, 19 bp, Homo sapiens
gagccttggagtgcagggc

SEQ ID NO: 20855 - DNA, 19 bp, Homo sapiens
gccttgataacggccgggc

SEQ ID NO: 20856 - DNA, 17 bp, Homo sapiens
gagccttggagctctgg

SEQ ID NO: 20857 - DNA, 100 bp, Human herpesvirus 5
cggcagttacctgttgtatcgcaaggctcacgtggagctgtcactctccagcaacaaggtgcaacacgtggaagccgtgctgcgacaggtgtacacgccg

SEQ ID NO: 20858 - DNA, 24 bp, Human herpesvirus 5
tacctgttgtatcgcaaggctcac

SEQ ID NO: 20859 - DNA, 20 bp, Homo sapiens
ctgtgtgtctgtaaggctca

SEQ ID NO: 20860 - DNA, 20 bp, Homo sapiens
tacctgttgtggtgccatca

SEQ ID NO: 20861 - DNA, 24 bp, Homo sapiens
tacctgttctgttggctaaactca

SEQ ID NO: 20862 - DNA, 19 bp, Homo sapiens
tgttgtatccctggctcac

SEQ ID NO: 20863 - DNA, 21 bp, Homo sapiens
tacctgtcacattgcaaggct

SEQ ID NO: 20864 - DNA, 19 bp, Homo sapiens
ttgttcggcaaaggctcac

SEQ ID NO: 20865 - DNA, 21 bp, Homo sapiens
cctgttgtattgtacacttca

SEQ ID NO: 20866 - DNA, 20 bp, Homo sapiens
tacctgttgagtgacaggct

SEQ ID NO: 20867 - DNA, 20 bp, Homo sapiens
ccttccttagtcgcaaggct

SEQ ID NO: 20868 - DNA, 21 bp, Homo sapiens
ccttgttgtatcatacagctc

SEQ ID NO: 20869 - DNA, 73 bp, Rat cytomegalovirus
gccacacgtccaactgcttcccgaacgtctcgttatatagtgcgacggacaaaaccagttcccggacgtgggc

SEQ ID NO: 20870 - DNA, 24 bp, Rat cytomegalovirus
acggacaaaaccagttcccggacg

SEQ ID NO: 20871 - DNA, 17 bp, Homo sapiens
cggacaaagcctgcggc

SEQ ID NO: 20872 - DNA, 22 bp, Homo sapiens
gatgaaaccctcgtcccggacg

SEQ ID NO: 20873 - DNA, 24 bp, Homo sapiens
cagacaaaatcacaaccctctgga

SEQ ID NO: 20874 - DNA, 16 bp, Homo sapiens
cgggcaaaaccaggga

SEQ ID NO: 20875 - DNA, 19 bp, Homo sapiens
ggcagccagctgttcccgg

SEQ ID NO: 20876 - DNA, 20 bp, Homo sapiens
gggtaagaccagttcagaga

SEQ ID NO: 20877 - DNA, 18 bp, Homo sapiens
ggacaaaccagttcccaa

SEQ ID NO: 20878 - DNA, 18 bp, Homo sapiens
cggacaaagcgcagcggc

SEQ ID NO: 20879 - DNA, 23 bp, Homo sapiens
ggacaaaacctaatagtcttgga

SEQ ID NO: 20880 - DNA, 20 bp, Homo sapiens
acagacgaaaccaacatgga

SEQ ID NO: 20881 - DNA, 17 bp, Homo sapiens
cggacaaacccaggcga

SEQ ID NO: 20882 - DNA, 18 bp, Homo sapiens
ggacaaaacagctcccgg

SEQ ID NO: 20883 - DNA, 19 bp, Homo sapiens
acggacgggaccagctccc

SEQ ID NO: 20884 - DNA, 18 bp, Homo sapiens
acaggcagaaccagttgg

SEQ ID NO: 20885 - DNA, 22 bp, Homo sapiens
acaggcaaaaccaggggcagga

SEQ ID NO: 20886 - DNA, 98 bp, Equine rhinovirus 3
gtttgagtgtggtagcgctgtgtgagttggcggtggaaccccctcgtggtgacacgagcccccgtggccaaaagcccagtgtttacagcacctctcac

SEQ ID NO: 20887 - DNA, 24 bp, Equine rhinovirus 3
tgagtgtggtagcgctgtgtgagt

SEQ ID NO: 20888 - DNA, 21 bp, Homo sapiens
tgagtgtgtgtgagtgtgagt

SEQ ID NO: 20889 - DNA, 25 bp, Homo sapiens
tgagtgtgtgtgagtgtgtgtgagt

SEQ ID NO: 20890 - DNA, 17 bp, Homo sapiens
gaggaggtgctgtgtgg

SEQ ID NO: 20891 - DNA, 19 bp, Homo sapiens
tgggtgtggtggtgcctgt

SEQ ID NO: 20892 - DNA, 17 bp, Homo sapiens
tgactgtgactgtgtgg

SEQ ID NO: 20893 - DNA, 17 bp, Homo sapiens
gcgtgtgcctgtgtgag

SEQ ID NO: 20894 - DNA, 23 bp, Homo sapiens
tgggtgtggtagtgcgcacttgt

SEQ ID NO: 20895 - DNA, 19 bp, Homo sapiens
tgggtgtggtggcgtgcac

SEQ ID NO: 20896 - DNA, 22 bp, Homo sapiens
tgggtgtggtggtgcatgcctg

SEQ ID NO: 20897 - DNA, 21 bp, Homo sapiens
tgatgccagtgctgtgtgggt

SEQ ID NO: 20898 - DNA, 17 bp, Homo sapiens
tgggtgtggtggcgtgt

SEQ ID NO: 20899 - DNA, 22 bp, Homo sapiens
tgggtgtggtggcgcatgcctg

SEQ ID NO: 20900 - DNA, 18 bp, Homo sapiens
tagtaagtgctgtgtgag

SEQ ID NO: 20901 - DNA, 19 bp, Homo sapiens
tgggtgtggtggcgcgtgc

SEQ ID NO: 20902 - DNA, 18 bp, Homo sapiens
tgaggtggtagtgtaaat

SEQ ID NO: 20903 - DNA, 18 bp, Homo sapiens
tgagtgtgcatgtgtgag

SEQ ID NO: 20904 - DNA, 24 bp, Homo sapiens
tgagtgtggcggcggcccatgggt

SEQ ID NO: 20905 - DNA, 21 bp, Homo sapiens
tgggtgtggaaacatgtgagt

SEQ ID NO: 20906 - DNA, 22 bp, Homo sapiens
tgggtgtggtagtgcatgcctg

SEQ ID NO: 20907 - DNA, 23 bp, Homo sapiens
tgggtgtggtggcacgcaccagt

SEQ ID NO: 20908 - DNA, 19 bp, Homo sapiens
tgggtgtggtggcgcatgc

SEQ ID NO: 20909 - DNA, 22 bp, Homo sapiens
tgagtgtggtggtgcatgcctg

SEQ ID NO: 20910 - DNA, 22 bp, Homo sapiens
tgggtgtggtggtgcgtgcctg

SEQ ID NO: 20911 - DNA, 17 bp, Homo sapiens
tgagtgacgctgtgtgg

SEQ ID NO: 20912 - DNA, 112 bp, Equine rhinovirus 3
aagaagattactcttgatgcttggctctcagaaagaatggcacctcaaagttttgagacccgattcttttgagtcgagaaccttacccccaacccttgagattgcttttctt

SEQ ID NO: 20913 - DNA, 24 bp, Equine rhinovirus 3
agacccgattcttttgagtcgaga

SEQ ID NO: 20914 - DNA, 22 bp, Homo sapiens
agacttattctttctttggaga

SEQ ID NO: 20915 - DNA, 23 bp, Homo sapiens
agactggattctttcttatgaga

SEQ ID NO: 20916 - DNA, 19 bp, Homo sapiens
aggcccgcttcttttggcc

SEQ ID NO: 20917 - DNA, 21 bp, Homo sapiens
agactccgttctttcatgaga

SEQ ID NO: 20918 - DNA, 19 bp, Homo sapiens
aggcctgattctcttggcc

SEQ ID NO: 20919 - DNA, 21 bp, Homo sapiens
aggcccggtcctcccgcgtcg

SEQ ID NO: 20920 - DNA, 130 bp, Rat cytomegalovirus
cgggaggaccgccgacgccgtgtccggaagcctcgtcggagcagagggccaggtgtttatatagcagcagatagagatccttggaccgaaaccttcgacccgcgtaccgtagcaggagcggcgcctcccg

SEQ ID NO: 20921 - DNA, 24 bp, Rat cytomegalovirus
taccgtagcaggagcggcgcctcc

SEQ ID NO: 20922 - DNA, 19 bp, Homo sapiens
tactgtagcaggaagtcct

SEQ ID NO: 20923 - DNA, 21 bp, Homo sapiens
gcagccatgggtggcgcctcc

SEQ ID NO: 20924 - DNA, 22 bp, Homo sapiens
ccgagtacaagccggcgcctcc

SEQ ID NO: 20925 - DNA, 19 bp, Homo sapiens
tacctggcctcggcgcctc

SEQ ID NO: 20926 - DNA, 18 bp, Homo sapiens
ccgtgcaggagccgaggc

SEQ ID NO: 20927 - DNA, 19 bp, Homo sapiens
ccgcagcagggaagcctcc

SEQ ID NO: 20928 - DNA, 20 bp, Homo sapiens
taccgtaggggagcatgagc

SEQ ID NO: 20929 - DNA, 17 bp, Homo sapiens
ccgtagcaggacaacct

SEQ ID NO: 20930 - DNA, 20 bp, Homo sapiens
ccgggtggggcggcgcctcc

SEQ ID NO: 20931 - DNA, 18 bp, Homo sapiens
gtagcaggccagctctcc

SEQ ID NO: 20932 - DNA, 21 bp, Homo sapiens
cgagccagggagcggcgcctc

SEQ ID NO: 20933 - DNA, 16 bp, Homo sapiens
gtggcaggcagcgcct

SEQ ID NO: 20934 - DNA, 19 bp, Homo sapiens
ccaagggggcggcgcctcc

SEQ ID NO: 20935 - DNA, 92 bp, Rat cytomegalovirus
tcgctgaacaaattgtatcctctcagggcctcctccgcgtcgttgatgtaggcacaggaccccgctgaggaagacgcgaggttctttagcga

SEQ ID NO: 20936 - DNA, 24 bp, Rat cytomegalovirus
caggaccccgctgaggaagacgcg

SEQ ID NO: 20937 - DNA, 19 bp, Homo sapiens
aggagcttgctgaggaaaa

SEQ ID NO: 20938 - DNA, 22 bp, Homo sapiens
ggaccccgctcggggagaggcg

SEQ ID NO: 20939 - DNA, 19 bp, Homo sapiens
gacccggaaggaagacgcg

SEQ ID NO: 20940 - DNA, 18 bp, Homo sapiens
ggaccccagtgggaggcg

SEQ ID NO: 20941 - DNA, 19 bp, Homo sapiens
ggctccgccgagagccgcg

SEQ ID NO: 20942 - DNA, 27 bp, Homo sapiens
caggtctccgctgaatgggcggacgcg

SEQ ID NO: 20943 - DNA, 20 bp, Homo sapiens
caggtccccactggtgggga

SEQ ID NO: 20944 - DNA, 19 bp, Homo sapiens
caggacccccttgggaggc

SEQ ID NO: 20945 - DNA, 21 bp, Homo sapiens
ggcttcggggacgaagacgcg

SEQ ID NO: 20946 - DNA, 20 bp, Homo sapiens
caggctttgctgaggacaca

SEQ ID NO: 20947 - DNA, 18 bp, Homo sapiens
caggaccccggtgggcgc

SEQ ID NO: 20948 - DNA, 22 bp, Homo sapiens
ggaccccgtaggcaggggcgcg

SEQ ID NO: 20949 - DNA, 16 bp, Homo sapiens
gggccccaccgggaga

SEQ ID NO: 20950 - DNA, 66 bp, Rat cytomegalovirus
gcgaggcacgtctcacggtgtttttcaccccgagctttaatatatatagaaacacgtttatttcgc

SEQ ID NO: 20951 - DNA, 24 bp, Rat cytomegalovirus
cccgagctttaatatatatagaaa

SEQ ID NO: 20952 - DNA, 19 bp, Homo sapiens
cccgagtttaattacagaa

SEQ ID NO: 20953 - DNA, 20 bp, Homo sapiens
agcttcaagatatatagaaa

SEQ ID NO: 20954 - DNA, 22 bp, Homo sapiens
cccagctttaatatctaccaga

SEQ ID NO: 20955 - DNA, 21 bp, Homo sapiens
aacaaaaaatatatatagaaa

SEQ ID NO: 20956 - DNA, 21 bp, Homo sapiens
cccagctgaaatatatagaaa

SEQ ID NO: 20957 - DNA, 19 bp, Homo sapiens
ccgagcttcttcatgtaga

SEQ ID NO: 20958 - DNA, 18 bp, Homo sapiens
cctaagcaatatatagaa

SEQ ID NO: 20959 - DNA, 17 bp, Homo sapiens
cgagaatatatatagaa

SEQ ID NO: 20960 - DNA, 20 bp, Homo sapiens
agttttgatacatatagaaa

SEQ ID NO: 20961 - DNA, 19 bp, Homo sapiens
gagctttaatgtgcataaa

SEQ ID NO: 20962 - DNA, 19 bp, Homo sapiens
gctctttactatatagaaa

SEQ ID NO: 20963 - DNA, 21 bp, Homo sapiens
cccaaatcttgatatatatag

SEQ ID NO: 20964 - DNA, 22 bp, Homo sapiens
ccagagttttaatattaataga

SEQ ID NO: 20965 - DNA, 22 bp, Homo sapiens
gactttaatatattctaagaaa

SEQ ID NO: 20966 - DNA, 18 bp, Homo sapiens
gagctttatataatagaa

SEQ ID NO: 20967 - DNA, 21 bp, Homo sapiens
gagtttcatcatatatagaaa

SEQ ID NO: 20968 - DNA, 18 bp, Homo sapiens
gaaacttaatatatatag

SEQ ID NO: 20969 - DNA, 80 bp, Bovine immunodeficiency virus
agtggaatgttctaccacaaggatgggtatgtagccctgccatttatcagactaccacccagaagattatagaaaacatt

SEQ ID NO: 20970 - DNA, 24 bp, Bovine immunodeficiency virus
ccacccagaagattatagaaaaca

SEQ ID NO: 20971 - DNA, 17 bp, Homo sapiens
ccagtccagaagacaga

SEQ ID NO: 20972 - DNA, 18 bp, Homo sapiens
ccagaagaattaaaaaca

SEQ ID NO: 20973 - DNA, 17 bp, Homo sapiens
cacccagagaaaaaaac

SEQ ID NO: 20974 - DNA, 20 bp, Homo sapiens
ccacccaaaagaaaagaaaa

SEQ ID NO: 20975 - DNA, 18 bp, Homo sapiens
cccaggagggcacaaaaa

SEQ ID NO: 20976 - DNA, 21 bp, Homo sapiens
ccatctgaagatcatcaaaaa

SEQ ID NO: 20977 - DNA, 22 bp, Homo sapiens
ccacccagaaaaacaggagaca

SEQ ID NO: 20978 - DNA, 21 bp, Homo sapiens
cacctgagagtgcagaaaaca

SEQ ID NO: 20979 - DNA, 20 bp, Homo sapiens
cccaacctattgtagaaaac

SEQ ID NO: 20980 - DNA, 24 bp, Homo sapiens
ccactgggggactgacagaaaaca

SEQ ID NO: 20981 - DNA, 18 bp, Homo sapiens
ccagatttttatagaaaa

SEQ ID NO: 20982 - DNA, 19 bp, Homo sapiens
ccaccagaaaataagaaaa

SEQ ID NO: 20983 - DNA, 18 bp, Homo sapiens
ccagaagatctaaaaaca

SEQ ID NO: 20984 - DNA, 20 bp, Homo sapiens
catccagaagaaaaccaaga

SEQ ID NO: 20985 - DNA, 17 bp, Homo sapiens
caccagaagatagaaaa

SEQ ID NO: 20986 - DNA, 17 bp, Homo sapiens
cagaagttaagaaaaca

SEQ ID NO: 20987 - DNA, 17 bp, Homo sapiens
ccacccagagggcacag

SEQ ID NO: 20988 - DNA, 16 bp, Homo sapiens
ccacccaggagacaga

SEQ ID NO: 20989 - DNA, 21 bp, Homo sapiens
gaagattacaccaagaaaaca

SEQ ID NO: 20990 - DNA, 18 bp, Homo sapiens
cccccagaagggcataga

SEQ ID NO: 20991 - DNA, 19 bp, Homo sapiens
ccacccaaagccatgaaaa

SEQ ID NO: 20992 - DNA, 17 bp, Homo sapiens
ccagccagaagactcag

SEQ ID NO: 20993 - DNA, 18 bp, Homo sapiens
ccaggagaactatagaaa

SEQ ID NO: 20994 - DNA, 22 bp, Homo sapiens
cacccagagcataggaaaaaca

SEQ ID NO: 20995 - DNA, 22 bp, Homo sapiens
cccattaacattatagaaaaca

SEQ ID NO: 20996 - DNA, 17 bp, Homo sapiens
ccagagaaaagaaaaca

SEQ ID NO: 20997 - DNA, 18 bp, Homo sapiens
cagaagacacagaagaca

SEQ ID NO: 20998 - DNA, 18 bp, Homo sapiens
ccacccaagaagaaaata

SEQ ID NO: 20999 - DNA, 16 bp, Homo sapiens
ccatcagaagattcag

SEQ ID NO: 21000 - DNA, 19 bp, Homo sapiens
ccaggaaacaaagaaaaca

SEQ ID NO: 21001 - DNA, 20 bp, Homo sapiens
ccacccagagaatgaagaaa

SEQ ID NO: 21002 - DNA, 17 bp, Homo sapiens
cagagacatagaaaaca

SEQ ID NO: 21003 - DNA, 20 bp, Homo sapiens
cacccacaaagaagggaaca

SEQ ID NO: 21004 - DNA, 16 bp, Homo sapiens
ccacccagggacctag

SEQ ID NO: 21005 - DNA, 18 bp, Homo sapiens
ccacccaaagattaggga

SEQ ID NO: 21006 - DNA, 17 bp, Homo sapiens
ccaggagataaaaaaca

SEQ ID NO: 21007 - DNA, 18 bp, Homo sapiens
ccaggaacacagaaaaca

SEQ ID NO: 21008 - DNA, 17 bp, Homo sapiens
cacccagaacaggaaac

SEQ ID NO: 21009 - DNA, 21 bp, Homo sapiens
ccacagaaacactaggaaaca

SEQ ID NO: 21010 - DNA, 19 bp, Homo sapiens
acttagaaaattataaaaa

SEQ ID NO: 21011 - DNA, 22 bp, Homo sapiens
cccagaaaacaactggaggaca

SEQ ID NO: 21012 - DNA, 16 bp, Homo sapiens
cacccagaaggcagaa

SEQ ID NO: 21013 - DNA, 18 bp, Homo sapiens
ccagtgatatagaaaaca

SEQ ID NO: 21014 - DNA, 16 bp, Homo sapiens
cccagaagccagaaaa

SEQ ID NO: 21015 - DNA, 15 bp, Homo sapiens
ccaccagaagaagaa

SEQ ID NO: 21016 - DNA, 17 bp, Homo sapiens
cacacagaagactagaa

SEQ ID NO: 21017 - DNA, 26 bp, Homo sapiens
ccacccagaggtgctctgagaaaaca

SEQ ID NO: 21018 - DNA, 22 bp, Homo sapiens
ccatttagaagatcttccagaa

SEQ ID NO: 21019 - DNA, 23 bp, Homo sapiens
tgacccagaaggaacagggaaca

SEQ ID NO: 21020 - DNA, 18 bp, Homo sapiens
ccagaagaagtaaaaaac

SEQ ID NO: 21021 - DNA, 23 bp, Homo sapiens
caaccattgctttatagaaaaca

SEQ ID NO: 21022 - DNA, 20 bp, Homo sapiens
ccacccaggacatgcccaga

SEQ ID NO: 21023 - DNA, 22 bp, Homo sapiens
accctgaagcataaagaaaaca

SEQ ID NO: 21024 - DNA, 19 bp, Homo sapiens
ccaccacagagggcaaaga

SEQ ID NO: 21025 - DNA, 20 bp, Homo sapiens
ccgcccagaaatacccaaaa

SEQ ID NO: 21026 - DNA, 21 bp, Homo sapiens
ccacccaggggaaccacagaa

SEQ ID NO: 21027 - DNA, 17 bp, Homo sapiens
cacccaaatatagaaaa

SEQ ID NO: 21028 - DNA, 15 bp, Homo sapiens
cccccaggattacag

SEQ ID NO: 21029 - DNA, 17 bp, Homo sapiens
ccacccagagaattcag

SEQ ID NO: 21030 - DNA, 19 bp, Homo sapiens
ccaccagaagaaaaagaaa

SEQ ID NO: 21031 - DNA, 19 bp, Homo sapiens
catccagaagattctggaa

SEQ ID NO: 21032 - DNA, 21 bp, Homo sapiens
ccacccggcagagagaaaaca

SEQ ID NO: 21033 - DNA, 18 bp, Homo sapiens
cacccgggagccacagaa

SEQ ID NO: 21034 - DNA, 21 bp, Homo sapiens
ccacccaggccaaagaaaaca

SEQ ID NO: 21035 - DNA, 21 bp, Homo sapiens
cacccagaagcagagaagaca

SEQ ID NO: 21036 - DNA, 22 bp, Homo sapiens
taacctaggagagaacagaaaa

SEQ ID NO: 21037 - DNA, 16 bp, Homo sapiens
ccagaaacacagaaaa

SEQ ID NO: 21038 - DNA, 16 bp, Homo sapiens
cccagaagagcagaaa

SEQ ID NO: 21039 - DNA, 19 bp, Homo sapiens
ccagtcagaattagaaaac

SEQ ID NO: 21040 - DNA, 18 bp, Homo sapiens
cctcccagaaggtttcag

SEQ ID NO: 21041 - DNA, 21 bp, Homo sapiens
acccagaagagacctggaaaa

SEQ ID NO: 21042 - DNA, 19 bp, Homo sapiens
ccattcagaagatcaaaga

SEQ ID NO: 21043 - DNA, 17 bp, Homo sapiens
accacagaagacaaaac

SEQ ID NO: 21044 - DNA, 17 bp, Homo sapiens
agaagattgaaaaaaca

SEQ ID NO: 21045 - DNA, 20 bp, Homo sapiens
ccaccaggaagattaaggaa

SEQ ID NO: 21046 - DNA, 16 bp, Homo sapiens
cctccagttatagaaa

SEQ ID NO: 21047 - DNA, 22 bp, Homo sapiens
ccacccagagcactacggaaaa

SEQ ID NO: 21048 - DNA, 16 bp, Homo sapiens
cagagaatagaaaaca

SEQ ID NO: 21049 - DNA, 20 bp, Homo sapiens
ccacccagaagcagcatgga

SEQ ID NO: 21050 - DNA, 18 bp, Homo sapiens
cctcccagaaacggaaaa

SEQ ID NO: 21051 - DNA, 20 bp, Homo sapiens
acctagaataagagaaaaca

SEQ ID NO: 21052 - DNA, 21 bp, Homo sapiens
ccgcccaaccaccatagaaaa

SEQ ID NO: 21053 - DNA, 18 bp, Homo sapiens
cactgcagaagaaaaaac

SEQ ID NO: 21054 - DNA, 17 bp, Homo sapiens
ccaccaggagatcatag

SEQ ID NO: 21055 - DNA, 18 bp, Homo sapiens
catcccgaaggctcacaa

SEQ ID NO: 21056 - DNA, 20 bp, Homo sapiens
cccttcagatgccatagaaa

SEQ ID NO: 21057 - DNA, 17 bp, Homo sapiens
ccacccagcaagcagaa

SEQ ID NO: 21058 - DNA, 19 bp, Homo sapiens
ccgcccagaaggatacgaa

SEQ ID NO: 21059 - DNA, 22 bp, Homo sapiens
caatcagaaaactttagaaaac

SEQ ID NO: 21060 - DNA, 15 bp, Homo sapiens
cccagaagaaaaaac

SEQ ID NO: 21061 - DNA, 16 bp, Homo sapiens
ccaggaagagaaaaca

SEQ ID NO: 21062 - DNA, 22 bp, Homo sapiens
ccatctgcagaaacagaaaaca

SEQ ID NO: 21063 - DNA, 17 bp, Homo sapiens
cccccagaagaaaaaac

SEQ ID NO: 21064 - DNA, 20 bp, Homo sapiens
ccagattaccatagaagaca

SEQ ID NO: 21065 - DNA, 20 bp, Homo sapiens
cctccaggcgacatagaaaa

SEQ ID NO: 21066 - DNA, 16 bp, Homo sapiens
cccccagaagagagaa

SEQ ID NO: 21067 - DNA, 23 bp, Homo sapiens
ccttccaggggttaaagaaaaca

SEQ ID NO: 21068 - DNA, 20 bp, Homo sapiens
catccagaagaaaatcaaga

SEQ ID NO: 21069 - DNA, 17 bp, Homo sapiens
cccagggccacagaaaa

SEQ ID NO: 21070 - DNA, 18 bp, Homo sapiens
acccagcaggcacagaaa

SEQ ID NO: 21071 - DNA, 17 bp, Homo sapiens
ccacccaggtgaagaaa

SEQ ID NO: 21072 - DNA, 17 bp, Homo sapiens
ccaccacagaaaacaga

SEQ ID NO: 21073 - DNA, 17 bp, Homo sapiens
ccacccaggagccagaa

SEQ ID NO: 21074 - DNA, 69 bp, Bovine immunodeficiency virus
ctgcagcagtatattggtgtgaaggaaggactaagtcaaaggtatttccaggaaccaatcaacaggcgg

SEQ ID NO: 21075 - DNA, 24 bp, Bovine immunodeficiency virus
tttccaggaaccaatcaacaggcg

SEQ ID NO: 21076 - DNA, 15 bp, Homo sapiens
tccccaatcaacagg

SEQ ID NO: 21077 - DNA, 22 bp, Homo sapiens
tttctgggaaccaagtttcaag

SEQ ID NO: 21078 - DNA, 18 bp, Homo sapiens
tttccaggaattaaacag

SEQ ID NO: 21079 - DNA, 18 bp, Homo sapiens
ttcccaggagccagaagc

SEQ ID NO: 21080 - DNA, 18 bp, Homo sapiens
tttccaggagtcagcaag

SEQ ID NO: 21081 - DNA, 20 bp, Homo sapiens
tccaggaagacaagtgggcg

SEQ ID NO: 21082 - DNA, 22 bp, Homo sapiens
tctccaggagctgccaaaggcg

SEQ ID NO: 21083 - DNA, 21 bp, Homo sapiens
tttccaggaatctgtcaaagg

SEQ ID NO: 21084 - DNA, 26 bp, Homo sapiens
tttccaagaaccaagggctgcaggcg

SEQ ID NO: 21085 - DNA, 18 bp, Homo sapiens
ttcccaggagctcacagg

SEQ ID NO: 21086 - DNA, 19 bp, Homo sapiens
tttccaagagcaaggcagg

SEQ ID NO: 21087 - DNA, 21 bp, Homo sapiens
tttccaggaacctagtccaca

SEQ ID NO: 21088 - DNA, 20 bp, Homo sapiens
tttccaagattcacaacagg

SEQ ID NO: 21089 - DNA, 20 bp, Homo sapiens
tttccaggaatcatttccac

SEQ ID NO: 21090 - DNA, 23 bp, Homo sapiens
cttccaggggccgtctgcaggcg

SEQ ID NO: 21091 - DNA, 18 bp, Homo sapiens
ttccaggagcctacaggc

SEQ ID NO: 21092 - DNA, 20 bp, Homo sapiens
ttccaggaattccagacagg

SEQ ID NO: 21093 - DNA, 23 bp, Homo sapiens
cttccaggaaaagctgcagtagg

SEQ ID NO: 21094 - DNA, 120 bp, Fowl adenovirus D
tctatgcatatgcatgagagattcatgcatatgaatgagagtctcatccatattcataaacctcatccatattcatgagcctctcatgcatatgcatgtttttacatgcatatgcatgga

SEQ ID NO: 21095 - DNA, 24 bp, Fowl adenovirus D
ttcatgagcctctcatgcatatgc

SEQ ID NO: 21096 - DNA, 19 bp, Homo sapiens
ttcatgatatgtgcatatg

SEQ ID NO: 21097 - DNA, 25 bp, Homo sapiens
atgagcctttgttgtggtgcatgtg

SEQ ID NO: 21098 - DNA, 17 bp, Homo sapiens
tcatgaccatgcatgtg

SEQ ID NO: 21099 - DNA, 19 bp, Homo sapiens
atgagcctttacaaattgc

SEQ ID NO: 21100 - DNA, 18 bp, Homo sapiens
atgatggcatgcatatgc

SEQ ID NO: 21101 - DNA, 23 bp, Homo sapiens
ttcataagttttcaattatatgc

SEQ ID NO: 21102 - DNA, 18 bp, Homo sapiens
tcatgggcctctcactgc

SEQ ID NO: 21103 - DNA, 18 bp, Homo sapiens
atgagccttctgatgtgc

SEQ ID NO: 21104 - DNA, 22 bp, Homo sapiens
tcacatcaatcttgtgcatatg

SEQ ID NO: 21105 - DNA, 21 bp, Homo sapiens
ttcataaaaaatatgcatatg

SEQ ID NO: 21106 - DNA, 60 bp, Bovine immunodeficiency virus
acttacatagtgacaacgggccgtgctttactgcacacaggatagaaaatctatgtaagt

SEQ ID NO: 21107 - DNA, 24 bp, Bovine immunodeficiency virus
tacatagtgacaacgggccgtgct

SEQ ID NO: 21108 - DNA, 22 bp, Homo sapiens
tacgtattgacaacatggatgt

SEQ ID NO: 21109 - DNA, 16 bp, Homo sapiens
cacgtagtgacagctg

SEQ ID NO: 21110 - DNA, 28 bp, Homo sapiens
catagtaacaacatttgttagcacggcc

SEQ ID NO: 21111 - DNA, 20 bp, Homo sapiens
acagtgacacaaatgttgtg

SEQ ID NO: 21112 - DNA, 18 bp, Homo sapiens
taatagtgacgatggtgc

SEQ ID NO: 21113 - DNA, 18 bp, Homo sapiens
tacatggtgggaaccatg

SEQ ID NO: 21114 - DNA, 23 bp, Homo sapiens
tacatagtaacagcataattgct

SEQ ID NO: 21115 - DNA, 63 bp, Macaca mulatta rhadinovirus
cattcggataggttaatggttgggtcgcgcagaccggataaagcctgcaacgtattctgagtg

SEQ ID NO: 21116 - DNA, 24 bp, Macaca mulatta rhadinovirus
taggttaatggttgggtcgcgcag

SEQ ID NO: 21117 - DNA, 22 bp, Homo sapiens
taagcgaggttgggttgtgcag

SEQ ID NO: 21118 - DNA, 119 bp, Macaca mulatta rhadinovirus
caactgcgtttcaatgcattgaatcttctttacgtagtcgtctcgttctttctcaaggttagaaattgtatcgaactgctcgttgatctggttcgtcaggcatttgaacacggtatttg

SEQ ID NO: 21119 - DNA, 24 bp, Macaca mulatta rhadinovirus
tcaatgcattgaatcttctttacg

SEQ ID NO: 21120 - DNA, 16 bp, Homo sapiens
tcaacgcatttcttta

SEQ ID NO: 21121 - DNA, 18 bp, Homo sapiens
tcaatgcaattgaatctt

SEQ ID NO: 21122 - DNA, 17 bp, Homo sapiens
gcattgatgtctttacg

SEQ ID NO: 21123 - DNA, 67 bp, Macaca mulatta rhadinovirus
tcctcaacaacgtctgttatgccgctcactgttttgttctccgcgagctttatcagcaagtttagga

SEQ ID NO: 21124 - DNA, 24 bp, Macaca mulatta rhadinovirus
tccgcgagctttatcagcaagttt

SEQ ID NO: 21125 - DNA, 21 bp, Homo sapiens
cgcagctttatcattctgttt

SEQ ID NO: 21126 - DNA, 17 bp, Homo sapiens
gagctttattacatgtt

SEQ ID NO: 21127 - DNA, 15 bp, Homo sapiens
tcccgagcagcaagt

SEQ ID NO: 21128 - DNA, 64 bp, Macaca mulatta rhadinovirus
gcacgtgctaccgaccagcgcttttagaggcgcggtatttagtaactgacataactttgcgtgc

SEQ ID NO: 21129 - DNA, 24 bp, Macaca mulatta rhadinovirus
tatttagtaactgacataactttg

SEQ ID NO: 21130 - DNA, 17 bp, Homo sapiens
gtaattgcacaactttg

SEQ ID NO: 21131 - DNA, 22 bp, Homo sapiens
tacttagtaggcaataactttg

SEQ ID NO: 21132 - DNA, 18 bp, Homo sapiens
tatttaataactggtata

SEQ ID NO: 21133 - DNA, 18 bp, Homo sapiens
tttagtaagtgtaacttt

SEQ ID NO: 21134 - DNA, 65 bp, Beet mild yellowing virus
gcaccgcaagccacgtacattgtacctcaaaagaggaatatgacgaatggccgagatgctggtgc

SEQ ID NO: 21135 - DNA, 24 bp, Beet mild yellowing virus
gccacgtacattgtacctcaaaag

SEQ ID NO: 21136 - DNA, 18 bp, Homo sapiens
gccatgtgtattgcaccc

SEQ ID NO: 21137 - DNA, 24 bp, Homo sapiens
gccgttgtcactgagcctcaaaag

SEQ ID NO: 21138 - DNA, 18 bp, Homo sapiens
gctgcatacattgtgtca

SEQ ID NO: 21139 - DNA, 22 bp, Homo sapiens
acatacttttgtaccttgaaag

SEQ ID NO: 21140 - DNA, 22 bp, Homo sapiens
gccatgatgacagcctcaaaag

SEQ ID NO: 21141 - DNA, 18 bp, Homo sapiens
gccacttctgtctcaaaa

SEQ ID NO: 21142 - DNA, 21 bp, Homo sapiens
gccactgcacccggcctcaaa

SEQ ID NO: 21143 - DNA, 23 bp, Homo sapiens
catgtggattgtaccacgaaaag

SEQ ID NO: 21144 - DNA, 23 bp, Homo sapiens
gccaagtgtcctattctcaaaag

SEQ ID NO: 21145 - DNA, 19 bp, Homo sapiens
gtcccaccctcctcaaaag

SEQ ID NO: 21146 - DNA, 20 bp, Homo sapiens
gccacgtatcattcctgcaa

SEQ ID NO: 21147 - DNA, 16 bp, Homo sapiens
gtacatacctcaaaag

SEQ ID NO: 21148 - DNA, 17 bp, Homo sapiens
gtacattaccccaaaag

SEQ ID NO: 21149 - DNA, 19 bp, Homo sapiens
cctgtacattgtacttctc

SEQ ID NO: 21150 - DNA, 21 bp, Homo sapiens
ccacttcatgtgcctcaaaag

SEQ ID NO: 21151 - DNA, 84 bp, Beet mild yellowing virus
ggcaaccttgaagttctgacgaactatcttgcagcttgtttctcaattttaaacgagctgagatccgatcaagaactcgttgcc

SEQ ID NO: 21152 - DNA, 24 bp, Beet mild yellowing virus
ttgaagttctgacgaactatcttg

SEQ ID NO: 21153 - DNA, 22 bp, Homo sapiens
ttaaagttttggaaacatcttg

SEQ ID NO: 21154 - DNA, 15 bp, Homo sapiens
ctgaagttctgaacc

SEQ ID NO: 21155 - DNA, 19 bp, Homo sapiens
ttgaagctctggtgcctat

SEQ ID NO: 21156 - DNA, 70 bp, Beet mild yellowing virus
gttcacatgattccggcatcgagtgttgcaaaatcgaaagcaactttctttgctctgtcggatggtgaat

SEQ ID NO: 21157 - DNA, 24 bp, Beet mild yellowing virus
tccggcatcgagtgttgcaaaatc

SEQ ID NO: 21158 - DNA, 17 bp, Homo sapiens
ggcttctgctgcaaaat

SEQ ID NO: 21159 - DNA, 16 bp, Homo sapiens
tccagcatttgcaaaa

SEQ ID NO: 21160 - DNA, 16 bp, Homo sapiens
cagtatcaattgcaaa

SEQ ID NO: 21161 - DNA, 15 bp, Homo sapiens
ggctcagtgcaaaat

SEQ ID NO: 21162 - DNA, 21 bp, Homo sapiens
tccgacattcaaaattgtaaa

SEQ ID NO: 21163 - DNA, 18 bp, Homo sapiens
tccagcattgagtggcaa

SEQ ID NO: 21164 - DNA, 20 bp, Homo sapiens
ggcaccgaagacacagaatc

SEQ ID NO: 21165 - DNA, 16 bp, Homo sapiens
tccagcattgattaca

SEQ ID NO: 21166 - DNA, 66 bp, Beet mild yellowing virus
cgagaggaaacaaactgtcttggaacaatttccttgaagattttaaaacggcagttttctctctcg

SEQ ID NO: 21167 - DNA, 24 bp, Beet mild yellowing virus
gaggaaacaaactgtcttggaaca

SEQ ID NO: 21168 - DNA, 20 bp, Homo sapiens
gagaaaacaaacttcacagg

SEQ ID NO: 21169 - DNA, 25 bp, Homo sapiens
gaggaaaccaggactctgtttggaa

SEQ ID NO: 21170 - DNA, 18 bp, Homo sapiens
ggaaacaaaatatttgga

SEQ ID NO: 21171 - DNA, 19 bp, Homo sapiens
gaggaaacgaacttccttg

SEQ ID NO: 21172 - DNA, 17 bp, Homo sapiens
gaggaaacaaattgtgg

SEQ ID NO: 21173 - DNA, 21 bp, Homo sapiens
gaggaaacacattcataccgg

SEQ ID NO: 21174 - DNA, 18 bp, Homo sapiens
gaggaaaaaattgtccca

SEQ ID NO: 21175 - DNA, 19 bp, Homo sapiens
ggaaacaaacgtggagaca

SEQ ID NO: 21176 - DNA, 22 bp, Homo sapiens
aggactgtatactgtcttggaa

SEQ ID NO: 21177 - DNA, 19 bp, Homo sapiens
gaggaaacaagttggctcg

SEQ ID NO: 21178 - DNA, 17 bp, Homo sapiens
gaggcaaactgttcccg

SEQ ID NO: 21179 - DNA, 20 bp, Homo sapiens
gagacagatgggctggaaca

SEQ ID NO: 21180 - DNA, 24 bp, Homo sapiens
gagggcagcacccatcttgggaca

SEQ ID NO: 21181 - DNA, 19 bp, Homo sapiens
gagaaagcaaactggaagg

SEQ ID NO: 21182 - DNA, 22 bp, Homo sapiens
gagagaacaaactggcccagga

SEQ ID NO: 21183 - DNA, 18 bp, Homo sapiens
gagggcaaactgcccagg

SEQ ID NO: 21184 - DNA, 18 bp, Homo sapiens
gaggaaacagacgcaaac

SEQ ID NO: 21185 - DNA, 19 bp, Homo sapiens
gagaaaataactttggaac

SEQ ID NO: 21186 - DNA, 18 bp, Homo sapiens
gaggaaacaagcggggga

SEQ ID NO: 21187 - DNA, 20 bp, Homo sapiens
gaggaaactgagggatggaa

SEQ ID NO: 21188 - DNA, 24 bp, Homo sapiens
gaagaaacaaagaaaagtgggaca

SEQ ID NO: 21189 - DNA, 23 bp, Homo sapiens
gaggaaacgagtgtgtccaggga

SEQ ID NO: 21190 - DNA, 16 bp, Homo sapiens
gaggagacagtctgaa

SEQ ID NO: 21191 - DNA, 18 bp, Homo sapiens
gagtgaacaaactgagga

SEQ ID NO: 21192 - DNA, 19 bp, Homo sapiens
gaggaacagcacttggaac

SEQ ID NO: 21193 - DNA, 19 bp, Homo sapiens
gaggagcagaggccctgga

SEQ ID NO: 21194 - DNA, 20 bp, Homo sapiens
gaggggagaactccctggaa

SEQ ID NO: 21195 - DNA, 23 bp, Homo sapiens
aaaaaccaaactgtcttggaaca

SEQ ID NO: 21196 - DNA, 21 bp, Homo sapiens
gaggagcgggcgtccggaaca

SEQ ID NO: 21197 - DNA, 19 bp, Homo sapiens
aggaggcagactgacctaa

SEQ ID NO: 21198 - DNA, 16 bp, Homo sapiens
ggaaacaaactccgga

SEQ ID NO: 21199 - DNA, 18 bp, Homo sapiens
gagaaaacaggctgggga

SEQ ID NO: 21200 - DNA, 23 bp, Homo sapiens
gaggtgaattttgttttggaaca

SEQ ID NO: 21201 - DNA, 19 bp, Homo sapiens
gagtgagacaccatcttgg

SEQ ID NO: 21202 - DNA, 15 bp, Homo sapiens
gaagaaacaacttgg

SEQ ID NO: 21203 - DNA, 16 bp, Homo sapiens
ggaaacaaagtctggg

SEQ ID NO: 21204 - DNA, 15 bp, Homo sapiens
ggaaaaactgtcaga

SEQ ID NO: 21205 - DNA, 18 bp, Homo sapiens
aaggggacaaactgtcct

SEQ ID NO: 21206 - DNA, 24 bp, Homo sapiens
gaggaaatcagggcccctggaaca

SEQ ID NO: 21207 - DNA, 21 bp, Homo sapiens
gagaaggcagcgcttggaaca

SEQ ID NO: 21208 - DNA, 23 bp, Homo sapiens
aggaaacaaaaacttttgggaca

SEQ ID NO: 21209 - DNA, 18 bp, Homo sapiens
gagaaaacaagcatggaa

SEQ ID NO: 21210 - DNA, 17 bp, Homo sapiens
aggaaacagtatgttgg

SEQ ID NO: 21211 - DNA, 21 bp, Homo sapiens
agaaacaatgaccttttggaa

SEQ ID NO: 21212 - DNA, 19 bp, Homo sapiens
gaggaaacagctgtagaga

SEQ ID NO: 21213 - DNA, 17 bp, Homo sapiens
gagtaaacaaactgtgg

SEQ ID NO: 21214 - DNA, 20 bp, Homo sapiens
gaggaaaaaagctgccttgg

SEQ ID NO: 21215 - DNA, 21 bp, Homo sapiens
gaggaaacaaagtcagaagga

SEQ ID NO: 21216 - DNA, 25 bp, Homo sapiens
gaggtaaacgaccatccttggaaca

SEQ ID NO: 21217 - DNA, 17 bp, Homo sapiens
gaggaaaacccttggaa

SEQ ID NO: 21218 - DNA, 15 bp, Homo sapiens
gagaacatgtcttgg

SEQ ID NO: 21219 - DNA, 19 bp, Homo sapiens
gagaagcaaaccactggga

SEQ ID NO: 21220 - DNA, 19 bp, Homo sapiens
agaaacaaatggtgtggaa

SEQ ID NO: 21221 - DNA, 20 bp, Homo sapiens
gaggaaacggtctccaggga

SEQ ID NO: 21222 - DNA, 18 bp, Homo sapiens
gaggaaacagactgagaa

SEQ ID NO: 21223 - DNA, 15 bp, Homo sapiens
gagaaagtcttggaa

SEQ ID NO: 21224 - DNA, 19 bp, Homo sapiens
aggaaacaaccctttttgg

SEQ ID NO: 21225 - DNA, 17 bp, Homo sapiens
gaggaaacaattttaga

SEQ ID NO: 21226 - DNA, 17 bp, Homo sapiens
gggaaacaaaccagggg

SEQ ID NO: 21227 - DNA, 19 bp, Homo sapiens
gaggaagaagctgccttgg

SEQ ID NO: 21228 - DNA, 19 bp, Homo sapiens
gaggaaaccgaggtctgga

SEQ ID NO: 21229 - DNA, 18 bp, Homo sapiens
gaggaaacaagtgtgtcc

SEQ ID NO: 21230 - DNA, 19 bp, Homo sapiens
gaggaaagagctgcctcgg

SEQ ID NO: 21231 - DNA, 18 bp, Homo sapiens
gggaaacagactgtctca

SEQ ID NO: 21232 - DNA, 63 bp, Beet mild yellowing virus
gagtggcagctacaacacctcctcgtctaactctagaattcgagtgatggccgcttaccactc

SEQ ID NO: 21233 - DNA, 24 bp, Beet mild yellowing virus
tacaacacctcctcgtctaactct

SEQ ID NO: 21234 - DNA, 22 bp, Homo sapiens
tacagttttcctcatctgctct

SEQ ID NO: 21235 - DNA, 22 bp, Homo sapiens
cagcacctcccaggttagctct

SEQ ID NO: 21236 - DNA, 19 bp, Homo sapiens
tacggccctccccgcgact

SEQ ID NO: 21237 - DNA, 19 bp, Homo sapiens
tacagcaccccctttgctc

SEQ ID NO: 21238 - DNA, 20 bp, Homo sapiens
cagccacctgctctaactct

SEQ ID NO: 21239 - DNA, 16 bp, Homo sapiens
caacatcttccaactc

SEQ ID NO: 21240 - DNA, 15 bp, Homo sapiens
cacctcccccaactc

SEQ ID NO: 21241 - DNA, 20 bp, Homo sapiens
tacaacactccttgtaccct

SEQ ID NO: 21242 - DNA, 18 bp, Homo sapiens
tacagaacttcctcatct

SEQ ID NO: 21243 - DNA, 17 bp, Homo sapiens
acacctcctcgggctct

SEQ ID NO: 21244 - DNA, 20 bp, Homo sapiens
tacaaccctttaatccaact

SEQ ID NO: 21245 - DNA, 20 bp, Homo sapiens
tacagtctttccatctaact

SEQ ID NO: 21246 - DNA, 18 bp, Homo sapiens
tacaacacttctctccct

SEQ ID NO: 21247 - DNA, 20 bp, Homo sapiens
acctcctcgtagctggctct

SEQ ID NO: 21248 - DNA, 17 bp, Homo sapiens
caacacctggctagctc

SEQ ID NO: 21249 - DNA, 66 bp, Beet mild yellowing virus
ggtgagctccccaagttttacttctctaaacaaaaaggatgctcggattggggcacgaagctcacc

SEQ ID NO: 21250 - DNA, 24 bp, Beet mild yellowing virus
ccccaagttttacttctctaaaca

SEQ ID NO: 21251 - DNA, 19 bp, Homo sapiens
ccatgtcaaacacttctct

SEQ ID NO: 21252 - DNA, 18 bp, Homo sapiens
ccaagttgtctctaaaca

SEQ ID NO: 21253 - DNA, 18 bp, Homo sapiens
ccaagttttatttcaaac

SEQ ID NO: 21254 - DNA, 18 bp, Homo sapiens
ccccaagtgccattttct

SEQ ID NO: 21255 - DNA, 18 bp, Homo sapiens
cccaagttttgcttcact

SEQ ID NO: 21256 - DNA, 21 bp, Homo sapiens
ccccaagtttggtaccaaaca

SEQ ID NO: 21257 - DNA, 15 bp, Homo sapiens
ccccaagtcctctct

SEQ ID NO: 21258 - DNA, 19 bp, Homo sapiens
cccgagccttttctaaaca

SEQ ID NO: 21259 - DNA, 21 bp, Homo sapiens
gtttcacaatttctctaaaca

SEQ ID NO: 21260 - DNA, 21 bp, Homo sapiens
gcttgtatacttttctaaaca

SEQ ID NO: 21261 - DNA, 15 bp, Homo sapiens
cccaagtttcatcca

SEQ ID NO: 21262 - DNA, 18 bp, Homo sapiens
ccaggttttctttcccta

SEQ ID NO: 21263 - DNA, 18 bp, Homo sapiens
ccctagtccctgctctct

SEQ ID NO: 21264 - DNA, 22 bp, Homo sapiens
cctaagtcttattccaagctaa

SEQ ID NO: 21265 - DNA, 18 bp, Homo sapiens
ccaagtcttttctctaaa

SEQ ID NO: 21266 - DNA, 19 bp, Homo sapiens
cccttaagcattctctaaa

SEQ ID NO: 21267 - DNA, 19 bp, Homo sapiens
ccccaaatttttccttaaa

SEQ ID NO: 21268 - DNA, 23 bp, Homo sapiens
ccaagtctttgctattgtaaaca

SEQ ID NO: 21269 - DNA, 21 bp, Homo sapiens
ccgatctaaattctctaaaca

SEQ ID NO: 21270 - DNA, 15 bp, Homo sapiens
caagtttcctctaaa

SEQ ID NO: 21271 - DNA, 19 bp, Homo sapiens
cccaaatccagtttctaaa

SEQ ID NO: 21272 - DNA, 18 bp, Homo sapiens
cccaagtcttacaccaaa

SEQ ID NO: 21273 - DNA, 18 bp, Homo sapiens
cctccagttcccacctct

SEQ ID NO: 21274 - DNA, 20 bp, Homo sapiens
ccctgagttttccttcccca

SEQ ID NO: 21275 - DNA, 19 bp, Homo sapiens
cccaagtttttttgctcca

SEQ ID NO: 21276 - DNA, 19 bp, Homo sapiens
ccctaggtttagcttctct

SEQ ID NO: 21277 - DNA, 19 bp, Homo sapiens
ccaatcagctctctaaaca

SEQ ID NO: 21278 - DNA, 21 bp, Homo sapiens
ccccacaaacttttttaaaca

SEQ ID NO: 21279 - DNA, 21 bp, Homo sapiens
ccaacttaaaatctctaaaca

SEQ ID NO: 21280 - DNA, 19 bp, Homo sapiens
aagttttattctgtaaaca

SEQ ID NO: 21281 - DNA, 22 bp, Homo sapiens
caggtcttacctcttctagaca

SEQ ID NO: 21282 - DNA, 20 bp, Homo sapiens
ccctgagctttgtttctcca

SEQ ID NO: 21283 - DNA, 22 bp, Homo sapiens
gcttctagtatttctctaaaca

SEQ ID NO: 21284 - DNA, 21 bp, Homo sapiens
ccaagttttgcatactgaaca

SEQ ID NO: 21285 - DNA, 18 bp, Homo sapiens
cccagcattttctctaaa

SEQ ID NO: 21286 - DNA, 20 bp, Homo sapiens
ccctaagctttactttccta

SEQ ID NO: 21287 - DNA, 15 bp, Homo sapiens
ccaaatttctctaaa

SEQ ID NO: 21288 - DNA, 19 bp, Homo sapiens
ccctggagttgctctaaac

SEQ ID NO: 21289 - DNA, 20 bp, Homo sapiens
ccccggtttatatctctaaa

SEQ ID NO: 21290 - DNA, 25 bp, Homo sapiens
cccaagttcttgcttcttttgaaca

SEQ ID NO: 21291 - DNA, 123 bp, Human adenovirus F
caggctaaaacaaaggaggcgatttgggagggataacggttgttttccaccagggggtcgaccttttctagggtgtgaaggcaaaggtcatcttcttctgcatccataaaggtaattggtttg

SEQ ID NO: 21292 - DNA, 24 bp, Human adenovirus F
tgtgaaggcaaaggtcatcttctt

SEQ ID NO: 21293 - DNA, 19 bp, Homo sapiens
gtgagacaaaggtcatctt

SEQ ID NO: 21294 - DNA, 19 bp, Homo sapiens
tgaaggaagttatcttctt

SEQ ID NO: 21295 - DNA, 27 bp, Homo sapiens
tatgaaggtaaattcaaatgttttctt

SEQ ID NO: 21296 - DNA, 19 bp, Homo sapiens
tgtggaggaagggcaactt

SEQ ID NO: 21297 - DNA, 24 bp, Homo sapiens
tgttaaggcactacacatcttctt

SEQ ID NO: 21298 - DNA, 18 bp, Homo sapiens
gtgaaggcaatctcttct

SEQ ID NO: 21299 - DNA, 18 bp, Homo sapiens
tgaaggcagaggcctctt

SEQ ID NO: 21300 - DNA, 23 bp, Homo sapiens
tggaaggtgcccaggatcttctt

SEQ ID NO: 21301 - DNA, 18 bp, Homo sapiens
tggaaggtgaaggcttct

SEQ ID NO: 21302 - DNA, 22 bp, Homo sapiens
tgtggaggagaggggacttctt

SEQ ID NO: 21303 - DNA, 24 bp, Homo sapiens
tgtgaaggcaaaaggtcacagcct

SEQ ID NO: 21304 - DNA, 23 bp, Homo sapiens
tgtggggcagggaaacatttctt

SEQ ID NO: 21305 - DNA, 18 bp, Homo sapiens
tgtgaaaggcaaaatggt

SEQ ID NO: 21306 - DNA, 19 bp, Homo sapiens
tgtgggtggcagaggtcac

SEQ ID NO: 21307 - DNA, 19 bp, Homo sapiens
tgtgaaagcaggatttctt

SEQ ID NO: 21308 - DNA, 60 bp, Camelpox virus
tgcctgagagtaaacattgacggataaaacaaaaatgccccgcataactctatcatggca

SEQ ID NO: 21309 - DNA, 24 bp, Camelpox virus
tgagagtaaacattgacggataaa

SEQ ID NO: 21310 - DNA, 15 bp, Homo sapiens
tggagtagacagata

SEQ ID NO: 21311 - DNA, 18 bp, Homo sapiens
tgagaggaacattgaggg

SEQ ID NO: 21312 - DNA, 18 bp, Homo sapiens
tgagagcaggtgcagata

SEQ ID NO: 21313 - DNA, 24 bp, Homo sapiens
tgagaataaatgtaaatggataaa

SEQ ID NO: 21314 - DNA, 19 bp, Homo sapiens
tgagagcaggcactgaggg

SEQ ID NO: 21315 - DNA, 18 bp, Homo sapiens
tgagagtaaaattgtaga

SEQ ID NO: 21316 - DNA, 21 bp, Homo sapiens
taagagtaaatatgccatgga

SEQ ID NO: 21317 - DNA, 23 bp, Homo sapiens
tgagagcagaaagcctggataaa

SEQ ID NO: 21318 - DNA, 21 bp, Homo sapiens
tgagagtaaacatactcataa

SEQ ID NO: 21319 - DNA, 21 bp, Homo sapiens
tgagagtagactcttaataaa

SEQ ID NO: 21320 - DNA, 21 bp, Homo sapiens
tgagaataaacattgtatagg

SEQ ID NO: 21321 - DNA, 19 bp, Homo sapiens
tgggaggggcgacagataa

SEQ ID NO: 21322 - DNA, 20 bp, Homo sapiens
tgaggataaacattcttgga

SEQ ID NO: 21323 - DNA, 21 bp, Homo sapiens
tgagagcaagcaaagaggata

SEQ ID NO: 21324 - DNA, 17 bp, Homo sapiens
tgaggtaaacagataga

SEQ ID NO: 21325 - DNA, 22 bp, Homo sapiens
tgagagtagtgactgtgatgga

SEQ ID NO: 21326 - DNA, 24 bp, Homo sapiens
tgaggagtggagactgcggataaa

SEQ ID NO: 21327 - DNA, 19 bp, Homo sapiens
tgaaagtgaacactgatag

SEQ ID NO: 21328 - DNA, 18 bp, Homo sapiens
tgagagtggagacagaca

SEQ ID NO: 21329 - DNA, 20 bp, Homo sapiens
tgagagcagccagtgggtaa

SEQ ID NO: 21330 - DNA, 20 bp, Homo sapiens
tgaggctaaacactgggtgg

SEQ ID NO: 21331 - DNA, 76 bp, African swine fever virus
tcttaaccaaatgttggaagatcatttttttacctgctttaaaggcctgaagggtgtcggttggcaaggctattga

SEQ ID NO: 21332 - DNA, 24 bp, African swine fever virus
tggaagatcatttttttacctgct

SEQ ID NO: 21333 - DNA, 22 bp, Homo sapiens
tggggattcctttttacctgct

SEQ ID NO: 21334 - DNA, 20 bp, Homo sapiens
tgggtgaggctttttacctg

SEQ ID NO: 21335 - DNA, 26 bp, Homo sapiens
tggaagctcattttttaaacactgct

SEQ ID NO: 21336 - DNA, 17 bp, Homo sapiens
tggaggacattttttta

SEQ ID NO: 21337 - DNA, 15 bp, Homo sapiens
tggaagatcattttg

SEQ ID NO: 21338 - DNA, 19 bp, Homo sapiens
tggaggatatttttttcct

SEQ ID NO: 21339 - DNA, 24 bp, Homo sapiens
tggcagatcattcaaagctatctg

SEQ ID NO: 21340 - DNA, 25 bp, Homo sapiens
tgaaagaaacttttttttacctgct

SEQ ID NO: 21341 - DNA, 24 bp, Homo sapiens
tgggtgaatgattttttacctgct

SEQ ID NO: 21342 - DNA, 18 bp, Homo sapiens
gactcatttttttacctg

SEQ ID NO: 21343 - DNA, 19 bp, Homo sapiens
tggaagattattctattgc

SEQ ID NO: 21344 - DNA, 19 bp, Homo sapiens
ggcagcgattttttacctg

SEQ ID NO: 21345 - DNA, 18 bp, Homo sapiens
tggaggagcattccctgc

SEQ ID NO: 21346 - DNA, 23 bp, Homo sapiens
tggaagattttccctcgtttgct

SEQ ID NO: 21347 - DNA, 24 bp, Homo sapiens
tggagtgtcatttttttggtagct

SEQ ID NO: 21348 - DNA, 17 bp, Homo sapiens
tggggatcattttttac

SEQ ID NO: 21349 - DNA, 25 bp, Homo sapiens
ggaagatcgttttaccacttctgct

SEQ ID NO: 21350 - DNA, 23 bp, Homo sapiens
tgggaatcattcttatgcttgct

SEQ ID NO: 21351 - DNA, 73 bp, Human adenovirus F
gcaagcccattctgccagttggggattggcggctagaaaaccgcgccatagctggagggcaaaatgggcttgc

SEQ ID NO: 21352 - DNA, 24 bp, Human adenovirus F
tgccagttggggattggcggctag

SEQ ID NO: 21353 - DNA, 21 bp, Homo sapiens
tgctggtgggggcctcgggct

SEQ ID NO: 21354 - DNA, 21 bp, Homo sapiens
tgtcagttgagggttctcgct

SEQ ID NO: 21355 - DNA, 18 bp, Homo sapiens
tgccagcttggggattga

SEQ ID NO: 21356 - DNA, 20 bp, Homo sapiens
tgctattggcaatccggcgg

SEQ ID NO: 21357 - DNA, 69 bp, Human adenovirus F
ggctcccatccacgtgtaggtttcgacgtcgtaggtgacaaagaggcgttcgacgcgaggatgagagcc

SEQ ID NO: 21358 - DNA, 24 bp, Human adenovirus F
cacgtgtaggtttcgacgtcgtag

SEQ ID NO: 21359 - DNA, 18 bp, Homo sapiens
gtgttttcggcgtcgtag

SEQ ID NO: 21360 - DNA, 70 bp, Human adenovirus F
ttgacttgcaggagacgggtaagggccgatgccaggcggcgatgaaacttgatttccattggtgagttgg

SEQ ID NO: 21361 - DNA, 24 bp, Human adenovirus F
caggagacgggtaagggccgatgc

SEQ ID NO: 21362 - DNA, 18 bp, Homo sapiens
caggagactggtgagtcc

SEQ ID NO: 21363 - DNA, 19 bp, Homo sapiens
gaggataaagggctgatgc

SEQ ID NO: 21364 - DNA, 19 bp, Homo sapiens
cagcagacaggggccgatg

SEQ ID NO: 21365 - DNA, 22 bp, Homo sapiens
gggacgggactcagggccgatg

SEQ ID NO: 21366 - DNA, 24 bp, Homo sapiens
ggagacgggcgaggtggcgcatcg

SEQ ID NO: 21367 - DNA, 21 bp, Homo sapiens
ggtgacaggaagggccggtgc

SEQ ID NO: 21368 - DNA, 19 bp, Homo sapiens
caggaagatgaggctgatg

SEQ ID NO: 21369 - DNA, 19 bp, Homo sapiens
caggaggagggtaaggcca

SEQ ID NO: 21370 - DNA, 20 bp, Homo sapiens
agaggtgggtgaggaggagc

SEQ ID NO: 21371 - DNA, 19 bp, Homo sapiens
tgagagacgggcctggtgc

SEQ ID NO: 21372 - DNA, 20 bp, Homo sapiens
ggagacggaggggctggtgc

SEQ ID NO: 21373 - DNA, 21 bp, Homo sapiens
ggagacaggtgggaggactgc

SEQ ID NO: 21374 - DNA, 17 bp, Homo sapiens
gggaggcaggactgatg

SEQ ID NO: 21375 - DNA, 22 bp, Homo sapiens
caggagacgggtggggaatagc

SEQ ID NO: 21376 - DNA, 22 bp, Homo sapiens
aggggatgggggagggagaagc

SEQ ID NO: 21377 - DNA, 20 bp, Homo sapiens
ggctacatgaagggctgatg

SEQ ID NO: 21378 - DNA, 19 bp, Homo sapiens
gagacgggtggtccagtgc

SEQ ID NO: 21379 - DNA, 21 bp, Homo sapiens
agggggtgggtaaggggctgc

SEQ ID NO: 21380 - DNA, 21 bp, Homo sapiens
caggaggctggtgaagggtgc

SEQ ID NO: 21381 - DNA, 20 bp, Homo sapiens
cagtagatgggtggccaatg

SEQ ID NO: 21382 - DNA, 21 bp, Homo sapiens
caggagaccctggggctgatg

SEQ ID NO: 21383 - DNA, 20 bp, Homo sapiens
ggcggacgggaagccgatgc

SEQ ID NO: 21384 - DNA, 19 bp, Homo sapiens
cagggggtgggcacaggtg

SEQ ID NO: 21385 - DNA, 106 bp, Camelpox virus
ttctaactcttaacatttttatttatttaaaatgatacctttgttatttattttattctattttgcgaacggtatcgaatagcataagtttgaaacgagtgaagaa

SEQ ID NO: 21386 - DNA, 24 bp, Camelpox virus
tcgaatagcataagtttgaaacga

SEQ ID NO: 21387 - DNA, 20 bp, Homo sapiens
gaataacattcttgaaatga

SEQ ID NO: 21388 - DNA, 18 bp, Homo sapiens
tcgaattgcatagtgaga

SEQ ID NO: 21389 - DNA, 78 bp, Human adenovirus F
gcgtaggattcgcgcaacttttgcaccagggcggcggtaacaagcacatccagggcacagtaatcaagggtttcacgc

SEQ ID NO: 21390 - DNA, 24 bp, Human adenovirus F
aacttttgcaccagggcggcggta

SEQ ID NO: 21391 - DNA, 16 bp, Homo sapiens
ctcgcggggcggcggt

SEQ ID NO: 21392 - DNA, 18 bp, Homo sapiens
acttttgcttgcagtggt

SEQ ID NO: 21393 - DNA, 16 bp, Homo sapiens
ttttgcacacagtggt

SEQ ID NO: 21394 - DNA, 19 bp, Homo sapiens
aactcttgcaccacgtggt

SEQ ID NO: 21395 - DNA, 72 bp, Camelpox virus
gaagaagttatagacaaattattcattctaaaactataaaaacagaatgatacgatactatatgtattcttc

SEQ ID NO: 21396 - DNA, 24 bp, Camelpox virus
tgatacgatactatatgtattctt

SEQ ID NO: 21397 - DNA, 24 bp, Homo sapiens
tggtactatgctatatatatcctc

SEQ ID NO: 21398 - DNA, 18 bp, Homo sapiens
gatgctagcatgtattct

SEQ ID NO: 21399 - DNA, 20 bp, Homo sapiens
gatactacagtagatgtatt

SEQ ID NO: 21400 - DNA, 114 bp, Fowlpox virus
ctatcgtatggataaatatattctagaatacaaaaatatggtctaatctcgctactggataaatcgaaaaatactttttattatatacatatagtctattaaacaaaatgatag

SEQ ID NO: 21401 - DNA, 24 bp, Fowlpox virus
tctagaatacaaaaatatggtcta

SEQ ID NO: 21402 - DNA, 18 bp, Homo sapiens
tctagaatactgaaatac

SEQ ID NO: 21403 - DNA, 19 bp, Homo sapiens
tagaacacaaaaagtttct

SEQ ID NO: 21404 - DNA, 18 bp, Homo sapiens
tctagaatgcacaatggt

SEQ ID NO: 21405 - DNA, 20 bp, Homo sapiens
tccatcataaaaaatatggt

SEQ ID NO: 21406 - DNA, 19 bp, Homo sapiens
tctggaatgcaaatatggt

SEQ ID NO: 21407 - DNA, 21 bp, Homo sapiens
tctaacttagaatatggtcta

SEQ ID NO: 21408 - DNA, 22 bp, Homo sapiens
tagaaacaaaaatcacaaatct

SEQ ID NO: 21409 - DNA, 17 bp, Homo sapiens
taaaatacaaaaatggc

SEQ ID NO: 21410 - DNA, 18 bp, Homo sapiens
ctagaatacaggacttgg

SEQ ID NO: 21411 - DNA, 19 bp, Homo sapiens
gaatgcaggaatacagtct

SEQ ID NO: 21412 - DNA, 19 bp, Homo sapiens
cagaatacaagaaaatagt

SEQ ID NO: 21413 - DNA, 20 bp, Homo sapiens
tctagaatacaaaaagtagt

SEQ ID NO: 21414 - DNA, 22 bp, Homo sapiens
tctagaatataaaaacgttcta

SEQ ID NO: 21415 - DNA, 18 bp, Homo sapiens
tctagaatgcacaggcct

SEQ ID NO: 21416 - DNA, 16 bp, Homo sapiens
cagaatacaagagtct

SEQ ID NO: 21417 - DNA, 18 bp, Homo sapiens
tctagaacacaaaagggt

SEQ ID NO: 21418 - DNA, 17 bp, Homo sapiens
agaatacaaaaataggc

SEQ ID NO: 21419 - DNA, 19 bp, Homo sapiens
tctagaataccagaaacat

SEQ ID NO: 21420 - DNA, 18 bp, Homo sapiens
tctagaataaataggtct

SEQ ID NO: 21421 - DNA, 15 bp, Homo sapiens
ctagaatacaaaatc

SEQ ID NO: 21422 - DNA, 19 bp, Homo sapiens
aaataagaaaatatggtct

SEQ ID NO: 21423 - DNA, 90 bp, Beet chlorosis virus
gtcactagagacagcttggcgaaggggccagccaccatttacacttttggtgataatggatggactctttcacaagcctcgattagtggc

SEQ ID NO: 21424 - DNA, 24 bp, Beet chlorosis virus
atggatggactctttcacaagcct

SEQ ID NO: 21425 - DNA, 19 bp, Homo sapiens
gggtggactcttggagcct

SEQ ID NO: 21426 - DNA, 21 bp, Homo sapiens
tggatggatcaacataggcct

SEQ ID NO: 21427 - DNA, 21 bp, Homo sapiens
tgggtggattccacctcaggc

SEQ ID NO: 21428 - DNA, 23 bp, Homo sapiens
atgggtgggccccccacgagtct

SEQ ID NO: 21429 - DNA, 24 bp, Homo sapiens
tggactggactcttttgtaggcct

SEQ ID NO: 21430 - DNA, 21 bp, Homo sapiens
tgaatggactctttgacacct

SEQ ID NO: 21431 - DNA, 22 bp, Homo sapiens
tgggtggactcctggccgcagc

SEQ ID NO: 21432 - DNA, 18 bp, Homo sapiens
atggagtgggctctggcc

SEQ ID NO: 21433 - DNA, 16 bp, Homo sapiens
atggatgatttcaagc

SEQ ID NO: 21434 - DNA, 16 bp, Homo sapiens
atggaaggacacaagc

SEQ ID NO: 21435 - DNA, 24 bp, Homo sapiens
gggtggactctggggggtgagcct

SEQ ID NO: 21436 - DNA, 17 bp, Homo sapiens
atggatgatacacaagc

SEQ ID NO: 21437 - DNA, 23 bp, Homo sapiens
atggatgggtattttctcagcct

SEQ ID NO: 21438 - DNA, 17 bp, Homo sapiens
tggctggactctttcca

SEQ ID NO: 21439 - DNA, 19 bp, Homo sapiens
atggaagggcctgtaagcc

SEQ ID NO: 21440 - DNA, 78 bp, Fowlpox virus
gtttaacaatgggatatagatgacactaaagaatactattgtgaacaacatggtatgaattatctaactccgttagac

SEQ ID NO: 21441 - DNA, 24 bp, Fowlpox virus
tagatgacactaaagaatactatt

SEQ ID NO: 21442 - DNA, 18 bp, Homo sapiens
tagatgacattgaaaaat

SEQ ID NO: 21443 - DNA, 20 bp, Homo sapiens
cagatggttcacagaatact

SEQ ID NO: 21444 - DNA, 75 bp, Molluscum contagiosum virus
ggcgccggcggccggcaccggaagcaagcatttctaactgcgcgagctggtagcggcgccggcggcacgggcgcc

SEQ ID NO: 21445 - DNA, 24 bp, Molluscum contagiosum virus
ggccggcaccggaagcaagcattt

SEQ ID NO: 21446 - DNA, 19 bp, Homo sapiens
ggccggcaccggggccagc

SEQ ID NO: 21447 - DNA, 23 bp, Homo sapiens
ggcctggtgtgttacaagcattt

SEQ ID NO: 21448 - DNA, 61 bp, Human herpesvirus 4
gcccgacccccgggcgcccccaaactttgtccagatgtccaggggtccccgagggtgaggc

SEQ ID NO: 21449 - DNA, 24 bp, Human herpesvirus 4
tgtccaggggtccccgagggtgag

SEQ ID NO: 21450 - DNA, 16 bp, Homo sapiens
tgtccaggcgggggtg

SEQ ID NO: 21451 - DNA, 22 bp, Homo sapiens
tgtccaggggttcactggcaag

SEQ ID NO: 21452 - DNA, 18 bp, Homo sapiens
ggtgtccctgagggtgag

SEQ ID NO: 21453 - DNA, 25 bp, Homo sapiens
tgtcgggggagaaggtgagggtgag

SEQ ID NO: 21454 - DNA, 19 bp, Homo sapiens
tgttcagggatccccggcg

SEQ ID NO: 21455 - DNA, 20 bp, Homo sapiens
tgtccaggggactggaggtg

SEQ ID NO: 21456 - DNA, 15 bp, Homo sapiens
tgtccaggggcggtg

SEQ ID NO: 21457 - DNA, 24 bp, Homo sapiens
tggccaggggcagggcagggtgag

SEQ ID NO: 21458 - DNA, 22 bp, Homo sapiens
tgtccagggtctccacgctggg

SEQ ID NO: 21459 - DNA, 21 bp, Homo sapiens
tgtccagggtcccttcctggg

SEQ ID NO: 21460 - DNA, 18 bp, Homo sapiens
tgtccggggatccctgag

SEQ ID NO: 21461 - DNA, 16 bp, Homo sapiens
tgtccagggaagggtg

SEQ ID NO: 21462 - DNA, 18 bp, Homo sapiens
tgtccacgggtccctggg

SEQ ID NO: 21463 - DNA, 17 bp, Homo sapiens
tccaggggttcctggcg

SEQ ID NO: 21464 - DNA, 19 bp, Homo sapiens
tgcccagggatgggggtga

SEQ ID NO: 21465 - DNA, 18 bp, Homo sapiens
tgcctagtctgagggtga

SEQ ID NO: 21466 - DNA, 21 bp, Homo sapiens
tgtccaggggcaggcggggtg

SEQ ID NO: 21467 - DNA, 23 bp, Homo sapiens
tgtccaggggcttctggcctgag

SEQ ID NO: 21468 - DNA, 17 bp, Homo sapiens
tgccaggggctggggtg

SEQ ID NO: 21469 - DNA, 20 bp, Homo sapiens
tgccgggggttcctccggag

SEQ ID NO: 21470 - DNA, 20 bp, Homo sapiens
tgcccaggctggtgagggtg

SEQ ID NO: 21471 - DNA, 23 bp, Homo sapiens
tgtccaggggcccccaccaggag

SEQ ID NO: 21472 - DNA, 21 bp, Homo sapiens
gtccaggggtttgccggtgag

SEQ ID NO: 21473 - DNA, 20 bp, Homo sapiens
tgaccaggggtttccctggg

SEQ ID NO: 21474 - DNA, 18 bp, Homo sapiens
gtctgggttccgagggtg

SEQ ID NO: 21475 - DNA, 17 bp, Homo sapiens
gtccaggggctggggtg

SEQ ID NO: 21476 - DNA, 16 bp, Homo sapiens
tccaggggtccctggg

SEQ ID NO: 21477 - DNA, 21 bp, Homo sapiens
tgtccggggtcccttcccggg

SEQ ID NO: 21478 - DNA, 21 bp, Homo sapiens
tgttaggggtccttgttaggg

SEQ ID NO: 21479 - DNA, 18 bp, Homo sapiens
tgtcaggggtcccccggg

SEQ ID NO: 21480 - DNA, 24 bp, Homo sapiens
tgtccaggtgtctccactgttgag

SEQ ID NO: 21481 - DNA, 19 bp, Homo sapiens
agtcttctcccgagggtga

SEQ ID NO: 21482 - DNA, 20 bp, Homo sapiens
tgtccaggggcctcccaggg

SEQ ID NO: 21483 - DNA, 24 bp, Homo sapiens
tggccgggggtctccatacctggg

SEQ ID NO: 21484 - DNA, 23 bp, Homo sapiens
tgtccaggtgtctcactcttgag

SEQ ID NO: 21485 - DNA, 19 bp, Homo sapiens
tgtccaggggcctctcgag

SEQ ID NO: 21486 - DNA, 19 bp, Homo sapiens
tgtctggggagcagggtga

SEQ ID NO: 21487 - DNA, 17 bp, Homo sapiens
tgtccgagggcagggtg

SEQ ID NO: 21488 - DNA, 19 bp, Homo sapiens
gtccaggggtcctcggtag

SEQ ID NO: 21489 - DNA, 19 bp, Homo sapiens
tgttcaggggtccatggat

SEQ ID NO: 21490 - DNA, 17 bp, Homo sapiens
tgtccagggttcctgag

SEQ ID NO: 21491 - DNA, 78 bp, Feline foamy virus
atggacattgttatgttatagcttttaatggaaataaagtttggccttcacaagatttaatacaagatcaatgtccat

SEQ ID NO: 21492 - DNA, 24 bp, Feline foamy virus
tatgttatagcttttaatggaaat

SEQ ID NO: 21493 - DNA, 19 bp, Homo sapiens
tatgttatagcttacaaaa

SEQ ID NO: 21494 - DNA, 17 bp, Homo sapiens
gttataactttaatgga

SEQ ID NO: 21495 - DNA, 20 bp, Homo sapiens
tatgttatagtttccaaaga

SEQ ID NO: 21496 - DNA, 23 bp, Homo sapiens
tattttagcaacttaatggaaat

SEQ ID NO: 21497 - DNA, 22 bp, Homo sapiens
tgttgtagctttccctggaaat

SEQ ID NO: 21498 - DNA, 16 bp, Homo sapiens
gttattctaatggaaa

SEQ ID NO: 21499 - DNA, 19 bp, Homo sapiens
atgttatagtttttagaaa

SEQ ID NO: 21500 - DNA, 24 bp, Homo sapiens
tatgttatagtttttattaaaaat

SEQ ID NO: 21501 - DNA, 21 bp, Homo sapiens
atgtttagcattttaatggaa

SEQ ID NO: 21502 - DNA, 18 bp, Homo sapiens
tatgttataaaaatggaa

SEQ ID NO: 21503 - DNA, 83 bp, Feline foamy virus
tcctttgctcaagcatatataacaaaggtacttatgaaaaggaaaaagcaacctactttacgagatatagcttttccaaagga

SEQ ID NO: 21504 - DNA, 24 bp, Feline foamy virus
aaaggtacttatgaaaaggaaaaa

SEQ ID NO: 21505 - DNA, 19 bp, Homo sapiens
ggaggtacctacggagaaa

SEQ ID NO: 21506 - DNA, 22 bp, Homo sapiens
aaagggacttattcttgagaaa

SEQ ID NO: 21507 - DNA, 19 bp, Homo sapiens
agctacaatggaaaggaaa

SEQ ID NO: 21508 - DNA, 20 bp, Homo sapiens
aaaggtacttttgatacaga

SEQ ID NO: 21509 - DNA, 22 bp, Homo sapiens
aaaggggaggaaaaaggaaaaa

SEQ ID NO: 21510 - DNA, 18 bp, Homo sapiens
agggaccaatgaaaagga

SEQ ID NO: 21511 - DNA, 19 bp, Homo sapiens
ggcacttagtgaaaaggaa

SEQ ID NO: 21512 - DNA, 20 bp, Homo sapiens
aaaggatttatgaaacaaaa

SEQ ID NO: 21513 - DNA, 17 bp, Homo sapiens
aggcagaaaaaggaaaa

SEQ ID NO: 21514 - DNA, 24 bp, Homo sapiens
aaagatgcttaaaattaggaaaaa

SEQ ID NO: 21515 - DNA, 21 bp, Homo sapiens
aagggactgataaaggaaaaa

SEQ ID NO: 21516 - DNA, 19 bp, Homo sapiens
aaaggaaaaaaaaaggaaa

SEQ ID NO: 21517 - DNA, 21 bp, Homo sapiens
ggtacctcttgaaaagggaaa

SEQ ID NO: 21518 - DNA, 19 bp, Homo sapiens
aaaggttttatatgaaagg

SEQ ID NO: 21519 - DNA, 20 bp, Homo sapiens
aaaggaaaggaaaaaggaaa

SEQ ID NO: 21520 - DNA, 20 bp, Homo sapiens
aaaggaaagggaaaaggaaa

SEQ ID NO: 21521 - DNA, 21 bp, Homo sapiens
aaaggaaagggaaaaaggaaa

SEQ ID NO: 21522 - DNA, 19 bp, Homo sapiens
agtacttatgagaaaaaga

SEQ ID NO: 21523 - DNA, 22 bp, Homo sapiens
aaaggtcacttcaggaagggga

SEQ ID NO: 21524 - DNA, 19 bp, Homo sapiens
aaggcactgggaggaggaa

SEQ ID NO: 21525 - DNA, 16 bp, Homo sapiens
aaaggtagaaaaagga

SEQ ID NO: 21526 - DNA, 17 bp, Homo sapiens
aaagtgtaccaaaaagg

SEQ ID NO: 21527 - DNA, 16 bp, Homo sapiens
agaactgtgaaaagga

SEQ ID NO: 21528 - DNA, 19 bp, Homo sapiens
aggtaagaaaaaggaaaaa

SEQ ID NO: 21529 - DNA, 19 bp, Homo sapiens
gcttttatgaaaggggaaa

SEQ ID NO: 21530 - DNA, 21 bp, Homo sapiens
aaaggaggtcagaaaaggaaa

SEQ ID NO: 21531 - DNA, 20 bp, Homo sapiens
aaaggaactattaaaaggaa

SEQ ID NO: 21532 - DNA, 17 bp, Homo sapiens
ggtaagaaaaggaaaaa

SEQ ID NO: 21533 - DNA, 22 bp, Homo sapiens
aaaggcaggctcagaaggaaaa

SEQ ID NO: 21534 - DNA, 23 bp, Homo sapiens
aaggataacacagaaaggaaaaa

SEQ ID NO: 21535 - DNA, 18 bp, Homo sapiens
aaagatactaaagaagga

SEQ ID NO: 21536 - DNA, 19 bp, Homo sapiens
ggaggcagggaaaaaggaa

SEQ ID NO: 21537 - DNA, 23 bp, Homo sapiens
ggagggagaatgaagaggaaaaa

SEQ ID NO: 21538 - DNA, 20 bp, Homo sapiens
aaagggaaagaaaaaggaaa

SEQ ID NO: 21539 - DNA, 18 bp, Homo sapiens
aaagggaaaaaaaggaaa

SEQ ID NO: 21540 - DNA, 19 bp, Homo sapiens
agatatccctgaaaaggaa

SEQ ID NO: 21541 - DNA, 23 bp, Homo sapiens
aaaggtttcacgcaaaggaaaaa

SEQ ID NO: 21542 - DNA, 21 bp, Homo sapiens
agggttcatgggaaaggaaaa

SEQ ID NO: 21543 - DNA, 19 bp, Homo sapiens
ggtacaaaaaaaggaaaaa

SEQ ID NO: 21544 - DNA, 16 bp, Homo sapiens
aggtattgaaaaggaa

SEQ ID NO: 21545 - DNA, 20 bp, Homo sapiens
aaggctaacttggaaaagga

SEQ ID NO: 21546 - DNA, 18 bp, Homo sapiens
agacgtatgaaaggaaaa

SEQ ID NO: 21547 - DNA, 23 bp, Homo sapiens
ggaggaggatgaagaaggaaaaa

SEQ ID NO: 21548 - DNA, 19 bp, Homo sapiens
aagatgcttatgaaacaaa

SEQ ID NO: 21549 - DNA, 23 bp, Homo sapiens
tgagccccttgtgagaaggaaaa

SEQ ID NO: 21550 - DNA, 18 bp, Homo sapiens
aaaggaacttgaggagga

SEQ ID NO: 21551 - DNA, 22 bp, Homo sapiens
aaaggaaacgcaggaaaggaaa

SEQ ID NO: 21552 - DNA, 15 bp, Homo sapiens
aaaggaaaaaggaaa

SEQ ID NO: 21553 - DNA, 15 bp, Homo sapiens
aaaggcactgaagga

SEQ ID NO: 21554 - DNA, 20 bp, Homo sapiens
aaaggtacttgtttgaaagg

SEQ ID NO: 21555 - DNA, 20 bp, Homo sapiens
aaaggtcttatgagccaagg

SEQ ID NO: 21556 - DNA, 15 bp, Homo sapiens
aaaggtactaggaaa

SEQ ID NO: 21557 - DNA, 16 bp, Homo sapiens
aaaggtttaaaaagga

SEQ ID NO: 21558 - DNA, 23 bp, Homo sapiens
aggtactccccaaaaaaggaaaa

SEQ ID NO: 21559 - DNA, 18 bp, Homo sapiens
aagggtcagaaaaggaaa

SEQ ID NO: 21560 - DNA, 16 bp, Homo sapiens
ggtttaaaaaggaaaa

SEQ ID NO: 21561 - DNA, 18 bp, Homo sapiens
ggtactcatggaaaccag

SEQ ID NO: 21562 - DNA, 21 bp, Homo sapiens
aggcacttttatgaggaaaaa

SEQ ID NO: 21563 - DNA, 19 bp, Homo sapiens
ggtttatgaagaggaaaaa

SEQ ID NO: 21564 - DNA, 18 bp, Homo sapiens
aaaggtacaggaaaagga

SEQ ID NO: 21565 - DNA, 19 bp, Homo sapiens
aggtaggcaacaaaaggaa

SEQ ID NO: 21566 - DNA, 21 bp, Homo sapiens
aaagtggctacaaaaggaaaa

SEQ ID NO: 21567 - DNA, 19 bp, Homo sapiens
aaagatactaatggggaaa

SEQ ID NO: 21568 - DNA, 23 bp, Homo sapiens
aaaggtacttatcattttaaaaa

SEQ ID NO: 21569 - DNA, 22 bp, Homo sapiens
aaaagttactgaagaggaaaaa

SEQ ID NO: 21570 - DNA, 21 bp, Homo sapiens
aagggatggaaaaaaggaaaa

SEQ ID NO: 21571 - DNA, 17 bp, Homo sapiens
ggtacacaaaggaaaaa

SEQ ID NO: 21572 - DNA, 22 bp, Homo sapiens
aggctaagacgggaaggaaaaa

SEQ ID NO: 21573 - DNA, 23 bp, Homo sapiens
aaaggcacttcagggagagggaa

SEQ ID NO: 21574 - DNA, 16 bp, Homo sapiens
aaggtagtgaaaggaa

SEQ ID NO: 21575 - DNA, 21 bp, Homo sapiens
ggaggtactttgaaagtcaaa

SEQ ID NO: 21576 - DNA, 19 bp, Homo sapiens
aaggtacttaaaaaatagg

SEQ ID NO: 21577 - DNA, 21 bp, Homo sapiens
aaagggaaagggaaaaggaaa

SEQ ID NO: 21578 - DNA, 19 bp, Homo sapiens
aaggctgatgagaggaaaa

SEQ ID NO: 21579 - DNA, 18 bp, Homo sapiens
aaaggtaataaaaaggaa

SEQ ID NO: 21580 - DNA, 22 bp, Homo sapiens
aaaggagcttgtggggcaggaa

SEQ ID NO: 21581 - DNA, 16 bp, Homo sapiens
aggtaatgaaaaggaa

SEQ ID NO: 21582 - DNA, 22 bp, Homo sapiens
aggtgtgcacaaaaagggaaaa

SEQ ID NO: 21583 - DNA, 22 bp, Homo sapiens
aggctgaaatgaaaaggaaaaa

SEQ ID NO: 21584 - DNA, 16 bp, Homo sapiens
aggcacttaaaggaaa

SEQ ID NO: 21585 - DNA, 19 bp, Homo sapiens
aaggcaccagtggaaggga

SEQ ID NO: 21586 - DNA, 23 bp, Homo sapiens
aaagatataaccgaaaggaaaaa

SEQ ID NO: 21587 - DNA, 17 bp, Homo sapiens
aaaggtgctaaggaaaa

SEQ ID NO: 21588 - DNA, 20 bp, Homo sapiens
aaaggtggttaaaaaaaagg

SEQ ID NO: 21589 - DNA, 22 bp, Homo sapiens
ggtatctactgaagaggaaaaa

SEQ ID NO: 21590 - DNA, 27 bp, Homo sapiens
aaggttacttatgaatcttaaaaggaa

SEQ ID NO: 21591 - DNA, 17 bp, Homo sapiens
aaaggcacagaaaggaa

SEQ ID NO: 21592 - DNA, 21 bp, Homo sapiens
aaaagtacacagaaggaagga

SEQ ID NO: 21593 - DNA, 22 bp, Homo sapiens
ggagttaccagagaaaggaaaa

SEQ ID NO: 21594 - DNA, 25 bp, Homo sapiens
ggagatactcaactttggagaggaa

SEQ ID NO: 21595 - DNA, 19 bp, Homo sapiens
aaaggacttatgaccaagg

SEQ ID NO: 21596 - DNA, 18 bp, Homo sapiens
aaggcacttggagaagga

SEQ ID NO: 21597 - DNA, 19 bp, Homo sapiens
gtcttgtgaagaggaaaaa

SEQ ID NO: 21598 - DNA, 20 bp, Homo sapiens
ggtacttatgaaatctaagg

SEQ ID NO: 21599 - DNA, 20 bp, Homo sapiens
aaggcacttaaatgggaagg

SEQ ID NO: 21600 - DNA, 20 bp, Homo sapiens
aaaggtacaggaagggaaaa

SEQ ID NO: 21601 - DNA, 18 bp, Homo sapiens
aagtacttgtggcaaagg

SEQ ID NO: 21602 - DNA, 17 bp, Homo sapiens
ggaggtacaaaggaaaa

SEQ ID NO: 21603 - DNA, 23 bp, Homo sapiens
aaggtaactaacggaaggaaaaa

SEQ ID NO: 21604 - DNA, 21 bp, Homo sapiens
ggtgggaatgaaaagggaaaa

SEQ ID NO: 21605 - DNA, 19 bp, Homo sapiens
agggcttaggaaaggaaaa

SEQ ID NO: 21606 - DNA, 21 bp, Homo sapiens
aaggtacttgctgattagagg

SEQ ID NO: 21607 - DNA, 17 bp, Homo sapiens
aggtaccttgtgaagaa

SEQ ID NO: 21608 - DNA, 19 bp, Homo sapiens
aaaagtgaaaaaaggaaaa

SEQ ID NO: 21609 - DNA, 21 bp, Homo sapiens
aaggtgaagaaaaaggaaaaa

SEQ ID NO: 21610 - DNA, 21 bp, Homo sapiens
ggtatgactggaaaggaaaaa

SEQ ID NO: 21611 - DNA, 16 bp, Homo sapiens
aagtacaaaaaggaaa

SEQ ID NO: 21612 - DNA, 18 bp, Homo sapiens
aaaggtaactgaaggaaa

SEQ ID NO: 21613 - DNA, 18 bp, Homo sapiens
aaaggaaaaaaaaggaaa

SEQ ID NO: 21614 - DNA, 19 bp, Homo sapiens
agcactatgaaaagggaaa

SEQ ID NO: 21615 - DNA, 23 bp, Homo sapiens
aggtacttatgactcaatgagga

SEQ ID NO: 21616 - DNA, 21 bp, Homo sapiens
agggggaaaaaaaaggaaaaa

SEQ ID NO: 21617 - DNA, 22 bp, Homo sapiens
ggaagtacataggaaaaggaaa

SEQ ID NO: 21618 - DNA, 24 bp, Homo sapiens
aaaggaactggcacaaaggaaaaa

SEQ ID NO: 21619 - DNA, 17 bp, Homo sapiens
aaggtcctgaaaaggaa

SEQ ID NO: 21620 - DNA, 22 bp, Homo sapiens
ggaggtagagttggaaaggaaa

SEQ ID NO: 21621 - DNA, 19 bp, Homo sapiens
aagatactggaagaggaaa

SEQ ID NO: 21622 - DNA, 22 bp, Homo sapiens
aaggtgacagaatgaaggaaaa

SEQ ID NO: 21623 - DNA, 20 bp, Homo sapiens
aaaggtacttaggctcagaa

SEQ ID NO: 21624 - DNA, 17 bp, Homo sapiens
ggtgcccgaaaggaaaa

SEQ ID NO: 21625 - DNA, 18 bp, Homo sapiens
aaagtacttatggaaaga

SEQ ID NO: 21626 - DNA, 18 bp, Homo sapiens
ggcacccagaaggaagga

SEQ ID NO: 21627 - DNA, 20 bp, Homo sapiens
aaggcgtactgtaaggaaaa

SEQ ID NO: 21628 - DNA, 17 bp, Homo sapiens
ggtgcttataaggaaaa

SEQ ID NO: 21629 - DNA, 21 bp, Homo sapiens
aaaagtgacaaaaaaggaaaa

SEQ ID NO: 21630 - DNA, 19 bp, Homo sapiens
aaagataaaacaaaaagga

SEQ ID NO: 21631 - DNA, 18 bp, Homo sapiens
aaagtgtacatgaaaagg

SEQ ID NO: 21632 - DNA, 23 bp, Homo sapiens
aaaggcacttgtgaggcatagaa

SEQ ID NO: 21633 - DNA, 20 bp, Homo sapiens
aggaggatgaagaggaaaaa

SEQ ID NO: 21634 - DNA, 21 bp, Homo sapiens
ggtatatatgcacaggaaaaa

SEQ ID NO: 21635 - DNA, 60 bp, Human herpesvirus 5
cgctgtcgcagctctttcccggcctggctctgttggccgtgaccgagagcgtgcgcagcg

SEQ ID NO: 21636 - DNA, 24 bp, Human herpesvirus 5
tcgcagctctttcccggcctggct

SEQ ID NO: 21637 - DNA, 20 bp, Homo sapiens
tctagctcttttgaagatgg

SEQ ID NO: 21638 - DNA, 21 bp, Homo sapiens
tcggactctcctggcctggct

SEQ ID NO: 21639 - DNA, 18 bp, Homo sapiens
tcgggctgctggcctggc

SEQ ID NO: 21640 - DNA, 21 bp, Homo sapiens
gcagtccagcttggcctggct

SEQ ID NO: 21641 - DNA, 21 bp, Homo sapiens
tcccagctccctggcctggct

SEQ ID NO: 21642 - DNA, 24 bp, Homo sapiens
tctggcttctgggccggcctggct

SEQ ID NO: 21643 - DNA, 16 bp, Homo sapiens
tcccagctctgcctgg

SEQ ID NO: 21644 - DNA, 18 bp, Homo sapiens
tcccagcccttggcctgg

SEQ ID NO: 21645 - DNA, 21 bp, Homo sapiens
tctcagctccaaggcctggct

SEQ ID NO: 21646 - DNA, 20 bp, Homo sapiens
gcacgcgtcccggcctggct

SEQ ID NO: 21647 - DNA, 19 bp, Homo sapiens
gcagctcctgggtttggct

SEQ ID NO: 21648 - DNA, 17 bp, Homo sapiens
ccgggccctggcctggc

SEQ ID NO: 21649 - DNA, 25 bp, Homo sapiens
tcgcagcctttcgaagattctggct

SEQ ID NO: 21650 - DNA, 17 bp, Homo sapiens
gcagctctgtgcctggc

SEQ ID NO: 21651 - DNA, 23 bp, Homo sapiens
ccgcagccagtcccggcttggct

SEQ ID NO: 21652 - DNA, 22 bp, Homo sapiens
tcgcagctctgtctttggggct

SEQ ID NO: 21653 - DNA, 19 bp, Homo sapiens
tctcagctcttgctctggc

SEQ ID NO: 21654 - DNA, 20 bp, Homo sapiens
tcatagctttttcccgtccc

SEQ ID NO: 21655 - DNA, 21 bp, Homo sapiens
tcacagctcttttcatgggct

SEQ ID NO: 21656 - DNA, 23 bp, Homo sapiens
tcttagctctgccaggcctggct

SEQ ID NO: 21657 - DNA, 17 bp, Homo sapiens
gctcttagggcctggct

SEQ ID NO: 21658 - DNA, 69 bp, Feline foamy virus
ctgagaatactgaggattggggatggctggcatatactgactcttttccatcccccatctgtattgaag

SEQ ID NO: 21659 - DNA, 24 bp, Feline foamy virus
tgaggattggggatggctggcata

SEQ ID NO: 21660 - DNA, 18 bp, Homo sapiens
ggtggggacagtggctgg

SEQ ID NO: 21661 - DNA, 20 bp, Homo sapiens
tgggggttgggggtcgggtg

SEQ ID NO: 21662 - DNA, 19 bp, Homo sapiens
tgggggttgggggtggaac

SEQ ID NO: 21663 - DNA, 18 bp, Homo sapiens
agggttggggatgaactg

SEQ ID NO: 21664 - DNA, 22 bp, Homo sapiens
tgagaattggggatataaacat

SEQ ID NO: 21665 - DNA, 21 bp, Homo sapiens
tggggcttggggatgacccgc

SEQ ID NO: 21666 - DNA, 16 bp, Homo sapiens
tgaggttggggaggtg

SEQ ID NO: 21667 - DNA, 17 bp, Homo sapiens
tgggggttagggatgct

SEQ ID NO: 21668 - DNA, 18 bp, Homo sapiens
tggggattggggaggatg

SEQ ID NO: 21669 - DNA, 17 bp, Homo sapiens
ggaggggcatggctggc

SEQ ID NO: 21670 - DNA, 22 bp, Homo sapiens
tgggggtgggggatggagtctg

SEQ ID NO: 21671 - DNA, 18 bp, Homo sapiens
ggagctgatggctggcat

SEQ ID NO: 21672 - DNA, 18 bp, Homo sapiens
tggggatttgggattcca

SEQ ID NO: 21673 - DNA, 20 bp, Homo sapiens
tgaggatggggatgcaaaca

SEQ ID NO: 21674 - DNA, 22 bp, Homo sapiens
gagggataggggtggctggcat

SEQ ID NO: 21675 - DNA, 22 bp, Homo sapiens
tggggttggggacaaatgcata

SEQ ID NO: 21676 - DNA, 17 bp, Homo sapiens
aggattggggatggaga

SEQ ID NO: 21677 - DNA, 21 bp, Homo sapiens
tggggattgggtatttgcata

SEQ ID NO: 21678 - DNA, 15 bp, Homo sapiens
tgaggttgggtggtg

SEQ ID NO: 21679 - DNA, 18 bp, Homo sapiens
tgagggttggggatgatg

SEQ ID NO: 21680 - DNA, 20 bp, Homo sapiens
tgagggtgggggtgagggat

SEQ ID NO: 21681 - DNA, 17 bp, Homo sapiens
tgaggatggggggcggc

SEQ ID NO: 21682 - DNA, 96 bp, Feline foamy virus
atctggaagaaaaattatactctgtcatctgtattagcagaatgtgtaaatcaagccatggaatatggtatagatgaagtattatccaaactagat

SEQ ID NO: 21683 - DNA, 24 bp, Feline foamy virus
tctgtcatctgtattagcagaatg

SEQ ID NO: 21684 - DNA, 22 bp, Homo sapiens
tgctcattgagaaggcagaatg

SEQ ID NO: 21685 - DNA, 19 bp, Homo sapiens
tctgtcatttttattaagc

SEQ ID NO: 21686 - DNA, 17 bp, Homo sapiens
tctgtcattgtattagc

SEQ ID NO: 21687 - DNA, 21 bp, Homo sapiens
tcttcataaattagcagaatg

SEQ ID NO: 21688 - DNA, 16 bp, Homo sapiens
tgtcaccttgcagaat

SEQ ID NO: 21689 - DNA, 24 bp, Homo sapiens
tctgtaacaatgattagcagaatg

SEQ ID NO: 21690 - DNA, 18 bp, Homo sapiens
tctgtacgtctgtattag

SEQ ID NO: 21691 - DNA, 24 bp, Homo sapiens
tgtcttctgtatcagtcaggaatg

SEQ ID NO: 21692 - DNA, 18 bp, Homo sapiens
tctattgtctgtatttgc

SEQ ID NO: 21693 - DNA, 18 bp, Homo sapiens
tctgtcatcagtattaac

SEQ ID NO: 21694 - DNA, 19 bp, Homo sapiens
tctgtcatttgtgataaca

SEQ ID NO: 21695 - DNA, 19 bp, Homo sapiens
tctgtcatttgtgatgcaa

SEQ ID NO: 21696 - DNA, 22 bp, Homo sapiens
tcggtcattcatcagcaggatg

SEQ ID NO: 21697 - DNA, 16 bp, Homo sapiens
tgcatctgtaaagaat

SEQ ID NO: 21698 - DNA, 21 bp, Homo sapiens
tctgtcatcctggctggaatg

SEQ ID NO: 21699 - DNA, 20 bp, Homo sapiens
tcttcatctgtgtttcccag

SEQ ID NO: 21700 - DNA, 21 bp, Homo sapiens
tgttattttattagcaggatg

SEQ ID NO: 21701 - DNA, 131 bp, Feline foamy virus
ttacaatgtcaaacaaactaggaatctaaatacttccactgcatgggaaatatatttatattatgagatcatcattcctaccactatatatacacagaattggaatataaagaatctaggtcaccttgtaa

SEQ ID NO: 21702 - DNA, 24 bp, Feline foamy virus
taccactatatatacacagaattg

SEQ ID NO: 21703 - DNA, 20 bp, Homo sapiens
taccattatatatatacaga

SEQ ID NO: 21704 - DNA, 21 bp, Homo sapiens
cattactctatcacagaattg

SEQ ID NO: 21705 - DNA, 20 bp, Homo sapiens
ctttataaaacacagaattg

SEQ ID NO: 21706 - DNA, 18 bp, Homo sapiens
taccactagataagaatt

SEQ ID NO: 21707 - DNA, 18 bp, Homo sapiens
tacatttacacagaattg

SEQ ID NO: 21708 - DNA, 72 bp, Feline foamy virus
acagatgaatacttggaaattgaacccctaaagaatgggagttatttggttttatcaagtactacagactgt

SEQ ID NO: 21709 - DNA, 24 bp, Feline foamy virus
agttatttggttttatcaagtact

SEQ ID NO: 21710 - DNA, 18 bp, Homo sapiens
agttatatggttttacaa

SEQ ID NO: 21711 - DNA, 18 bp, Homo sapiens
gttatttggttctagcaa

SEQ ID NO: 21712 - DNA, 20 bp, Homo sapiens
tttggcttttatcaagtact

SEQ ID NO: 21713 - DNA, 20 bp, Homo sapiens
gttacttgaggtcaagtact

SEQ ID NO: 21714 - DNA, 22 bp, Homo sapiens
agtatttggccaattgggtact

SEQ ID NO: 21715 - DNA, 21 bp, Homo sapiens
atttgtttactatcaagtact

SEQ ID NO: 21716 - DNA, 22 bp, Homo sapiens
agttatttgacaatattaagta

SEQ ID NO: 21717 - DNA, 22 bp, Homo sapiens
agtatttactctgtcaagtact

SEQ ID NO: 21718 - DNA, 88 bp, Feline foamy virus
agtcgcaagggccaaggcagagcttctacgcttggaccttcacgaaggagactatccagagtggctgcagctccttggagaagcaact

SEQ ID NO: 21719 - DNA, 24 bp, Feline foamy virus
tcgcaagggccaaggcagagcttc

SEQ ID NO: 21720 - DNA, 18 bp, Homo sapiens
cgcaagggctgaggccag

SEQ ID NO: 21721 - DNA, 20 bp, Homo sapiens
gcaggggctgcaagagcttc

SEQ ID NO: 21722 - DNA, 27 bp, Homo sapiens
tcgcaaggggtggggagcaaggagctt

SEQ ID NO: 21723 - DNA, 16 bp, Homo sapiens
tcgcgggggcagggct

SEQ ID NO: 21724 - DNA, 19 bp, Homo sapiens
aagggccacgaggagcttc

SEQ ID NO: 21725 - DNA, 19 bp, Homo sapiens
gcaagggccaccctagctt

SEQ ID NO: 21726 - DNA, 20 bp, Homo sapiens
gcgggggcgcaaaactgctt

SEQ ID NO: 21727 - DNA, 20 bp, Homo sapiens
aagggccagggccaggactt

SEQ ID NO: 21728 - DNA, 19 bp, Homo sapiens
aagggaaccccagagcttc

SEQ ID NO: 21729 - DNA, 19 bp, Homo sapiens
gcactgagggcagagcttc

SEQ ID NO: 21730 - DNA, 19 bp, Homo sapiens
tcgcaagaggctgaggcag

SEQ ID NO: 21731 - DNA, 16 bp, Homo sapiens
aagggccaaggtgcct

SEQ ID NO: 21732 - DNA, 18 bp, Homo sapiens
cgcaaggatgcggagctt

SEQ ID NO: 21733 - DNA, 18 bp, Homo sapiens
tccaagggccggggtctt

SEQ ID NO: 21734 - DNA, 17 bp, Homo sapiens
agggtgaagcagagctt

SEQ ID NO: 21735 - DNA, 21 bp, Homo sapiens
tcgcagaggcttaagagtttc

SEQ ID NO: 21736 - DNA, 16 bp, Homo sapiens
gcaggggccaagggct

SEQ ID NO: 21737 - DNA, 20 bp, Homo sapiens
gcaaaaaaaggcagagcttc

SEQ ID NO: 21738 - DNA, 18 bp, Homo sapiens
tcataggggccagagctt

SEQ ID NO: 21739 - DNA, 24 bp, Homo sapiens
tctcagaagaaaaggcagagcttc

SEQ ID NO: 21740 - DNA, 18 bp, Homo sapiens
tccaagggcctagagctt

SEQ ID NO: 21741 - DNA, 22 bp, Homo sapiens
tcccaagaggcggcagagcttc

SEQ ID NO: 21742 - DNA, 21 bp, Homo sapiens
gcagggggttcacagagcttc

SEQ ID NO: 21743 - DNA, 20 bp, Homo sapiens
caggggcctcacagagcttc

SEQ ID NO: 21744 - DNA, 73 bp, Feline foamy virus
aggtaatttcataaaggacactgctggaggtatttttggaactgcctttagttttctgggatatgtaaaacct

SEQ ID NO: 21745 - DNA, 24 bp, Feline foamy virus
aaggacactgctggaggtattttt

SEQ ID NO: 21746 - DNA, 17 bp, Homo sapiens
ggagtgctgtgtatttt

SEQ ID NO: 21747 - DNA, 20 bp, Homo sapiens
agggtgctgttgggggcact

SEQ ID NO: 21748 - DNA, 22 bp, Homo sapiens
ggacgctgtggggagcattttt

SEQ ID NO: 21749 - DNA, 19 bp, Homo sapiens
ggacactgctcggggggca

SEQ ID NO: 21750 - DNA, 22 bp, Homo sapiens
agacactgttaacatagttttt

SEQ ID NO: 21751 - DNA, 22 bp, Homo sapiens
aggcattgctggactcattttt

SEQ ID NO: 21752 - DNA, 21 bp, Homo sapiens
aggacattcgtgtgtattttt

SEQ ID NO: 21753 - DNA, 22 bp, Homo sapiens
aaggagctgagacagtattttt

SEQ ID NO: 21754 - DNA, 18 bp, Homo sapiens
aagggcactgctgtgggt

SEQ ID NO: 21755 - DNA, 20 bp, Homo sapiens
aggagcactgctgggtattt

SEQ ID NO: 21756 - DNA, 21 bp, Homo sapiens
aggagttggggaggtattttt

SEQ ID NO: 21757 - DNA, 21 bp, Homo sapiens
ggaatacacttgggtattttt

SEQ ID NO: 21758 - DNA, 20 bp, Homo sapiens
ggatgtgtgagggtattttt

SEQ ID NO: 21759 - DNA, 23 bp, Homo sapiens
aggacactgcagagcacattttt

SEQ ID NO: 21760 - DNA, 18 bp, Homo sapiens
aaggacacgttgaagtgt

SEQ ID NO: 21761 - DNA, 16 bp, Homo sapiens
aggcaccaggtatttt

SEQ ID NO: 21762 - DNA, 21 bp, Homo sapiens
aaggatgctcttggaggtatt

SEQ ID NO: 21763 - DNA, 17 bp, Homo sapiens
ggaaacaaaggtatttt

SEQ ID NO: 21764 - DNA, 63 bp, Human papillomavirus type 7
atacagcaagacaaatgggcattaaacgtctgggccaccaggtggtgccaagtttagatgtgt

SEQ ID NO: 21765 - DNA, 18 bp, Human papillomavirus type 7
tgccaagtttagatgtgt

SEQ ID NO: 21766 - DNA, 18 bp, Homo sapiens
gccagattgtagatgtgt

SEQ ID NO: 21767 - DNA, 21 bp, Homo sapiens
tgctgagtttagaaccagtgt

SEQ ID NO: 21768 - DNA, 15 bp, Homo sapiens
tgccaagttctgcat

SEQ ID NO: 21769 - DNA, 17 bp, Homo sapiens
taccaagtccagtgtgt

SEQ ID NO: 21770 - DNA, 17 bp, Homo sapiens
tgccagctttaaatggt

SEQ ID NO: 21771 - DNA, 19 bp, Homo sapiens
tgccaaattttaaatgtgt

SEQ ID NO: 21772 - DNA, 18 bp, Homo sapiens
tgccatctccagatgtgt

SEQ ID NO: 21773 - DNA, 19 bp, Homo sapiens
tgccaagtgttggacgtgt

SEQ ID NO: 21774 - DNA, 16 bp, Homo sapiens
taccaagtccttgtgt

SEQ ID NO: 21775 - DNA, 18 bp, Homo sapiens
tggcaagctcaagtgtgt

SEQ ID NO: 21776 - DNA, 18 bp, Homo sapiens
tgccaagtccttctgtgt

SEQ ID NO: 21777 - DNA, 15 bp, Homo sapiens
tgcagccagatgtgt

SEQ ID NO: 21778 - DNA, 15 bp, Homo sapiens
tgccaagtgacatgt

SEQ ID NO: 21779 - DNA, 17 bp, Homo sapiens
cgcccgtgtagatgtgt

SEQ ID NO: 21780 - DNA, 18 bp, Homo sapiens
tgccaaatcttgctgtgt

SEQ ID NO: 21781 - DNA, 19 bp, Homo sapiens
taccacttcctaggtgtgt

SEQ ID NO: 21782 - DNA, 18 bp, Homo sapiens
taccaatgttagatgtgt

SEQ ID NO: 21783 - DNA, 18 bp, Homo sapiens
taccaagttcttcaatgt

SEQ ID NO: 21784 - DNA, 15 bp, Homo sapiens
taccagcaaatgtgt

SEQ ID NO: 21785 - DNA, 18 bp, Homo sapiens
tgctaaatttaggaatgt

SEQ ID NO: 21786 - DNA, 18 bp, Homo sapiens
tgctgggtctagacatgt

SEQ ID NO: 21787 - DNA, 18 bp, Homo sapiens
gccaggttccagatgtgt

SEQ ID NO: 21788 - DNA, 16 bp, Homo sapiens
taccagacagatgtgt

SEQ ID NO: 21789 - DNA, 20 bp, Homo sapiens
tgccaagttctggagtgtgt

SEQ ID NO: 21790 - DNA, 18 bp, Homo sapiens
tgtcatgtttagatgcat

SEQ ID NO: 21791 - DNA, 17 bp, Homo sapiens
tgccaagttccccatgt

SEQ ID NO: 21792 - DNA, 17 bp, Homo sapiens
tgccaagtgagttgtgt

SEQ ID NO: 21793 - DNA, 17 bp, Homo sapiens
tgccaaatttaatttgt

SEQ ID NO: 21794 - DNA, 18 bp, Homo sapiens
taccaagtttgaatatgt

SEQ ID NO: 21795 - DNA, 16 bp, Homo sapiens
tgccaggtttgagcgt

SEQ ID NO: 21796 - DNA, 17 bp, Homo sapiens
tgccaagcttaccatgt

SEQ ID NO: 21797 - DNA, 17 bp, Homo sapiens
tgtccaatcaaatgtgt

SEQ ID NO: 21798 - DNA, 21 bp, Homo sapiens
tgtcaagtttagaagcagtgt

SEQ ID NO: 21799 - DNA, 18 bp, Homo sapiens
gccaagtaagaaatgtgt

SEQ ID NO: 21800 - DNA, 126 bp, Cherry mottle leaf virus
gtggtattcaatgatttgaatttcagaagtgaaagttacccagtgagtgtcagggttgggaatatgtgcaggttctttgacagttttttgggttctgagattttcaagaatgaatcaaatgtctac

SEQ ID NO: 21801 - DNA, 24 bp, Cherry mottle leaf virus
tcaatgatttgaatttcagaagtg

SEQ ID NO: 21802 - DNA, 22 bp, Homo sapiens
tcatgatttacattcagaggtg

SEQ ID NO: 21803 - DNA, 17 bp, Homo sapiens
tcaaggatttgaaacag

SEQ ID NO: 21804 - DNA, 18 bp, Homo sapiens
tcaaagatttgcagaggt

SEQ ID NO: 21805 - DNA, 23 bp, Homo sapiens
tcaaatgatttccttcagaggtg

SEQ ID NO: 21806 - DNA, 21 bp, Homo sapiens
tgactatgaatttcaggggtg

SEQ ID NO: 21807 - DNA, 25 bp, Homo sapiens
tcaatgatcttgaaatacaggggtg

SEQ ID NO: 21808 - DNA, 22 bp, Homo sapiens
ccaatgatttgaacaatgagtg

SEQ ID NO: 21809 - DNA, 17 bp, Homo sapiens
aatgatttatcagaggt

SEQ ID NO: 21810 - DNA, 19 bp, Homo sapiens
tgatttgaatgattaagtg

SEQ ID NO: 21811 - DNA, 24 bp, Homo sapiens
tcaatgatttgtatctcctgggtg

SEQ ID NO: 21812 - DNA, 24 bp, Homo sapiens
tcaatgatttgcagcaaggaggtg

SEQ ID NO: 21813 - DNA, 18 bp, Homo sapiens
gatttgaaccagtaagtg

SEQ ID NO: 21814 - DNA, 19 bp, Homo sapiens
taatagaatttcaggagtg

SEQ ID NO: 21815 - DNA, 72 bp, Cherry mottle leaf virus
gcctctgatctcatgatacattggaatgagtttgcattcaagatcatgcctgatgacattggggatggaggc

SEQ ID NO: 21816 - DNA, 24 bp, Cherry mottle leaf virus
atcatgcctgatgacattggggat

SEQ ID NO: 21817 - DNA, 18 bp, Homo sapiens
atcagtgcatgttgggga

SEQ ID NO: 21818 - DNA, 17 bp, Homo sapiens
atgcctgatgagcgaag

SEQ ID NO: 21819 - DNA, 20 bp, Homo sapiens
tgtctggtgggtctggggat

SEQ ID NO: 21820 - DNA, 21 bp, Homo sapiens
atcagctgccttgttggggat

SEQ ID NO: 21821 - DNA, 20 bp, Homo sapiens
catgcctgatttatttgggg

SEQ ID NO: 21822 - DNA, 22 bp, Homo sapiens
atcatgccctggtgccagggat

SEQ ID NO: 21823 - DNA, 21 bp, Homo sapiens
atcatacctgatggtatgaag

SEQ ID NO: 21824 - DNA, 62 bp, Cherry mottle leaf virus
ctgccaattatgttcactggggggctttatcaatatcaattgatgcccttttcaaaaagcag

SEQ ID NO: 21825 - DNA, 19 bp, Cherry mottle leaf virus
tgcccttttcaaaaagcag

SEQ ID NO: 21826 - DNA, 18 bp, Homo sapiens
tgccacctcaaaaagcag

SEQ ID NO: 21827 - DNA, 20 bp, Homo sapiens
tgccctttccacttacacag

SEQ ID NO: 21828 - DNA, 20 bp, Homo sapiens
gcccctcgggcaggaagcag

SEQ ID NO: 21829 - DNA, 21 bp, Homo sapiens
tgccccttctcatcggggcag

SEQ ID NO: 21830 - DNA, 17 bp, Homo sapiens
tgccctttcaactgcag

SEQ ID NO: 21831 - DNA, 16 bp, Homo sapiens
tgtcctctccaagcag

SEQ ID NO: 21832 - DNA, 20 bp, Homo sapiens
tgcccttttccggggagcag

SEQ ID NO: 21833 - DNA, 18 bp, Homo sapiens
tgtccctttcatcaacag

SEQ ID NO: 21834 - DNA, 20 bp, Homo sapiens
taccctttccacttgagcag

SEQ ID NO: 21835 - DNA, 17 bp, Homo sapiens
tgcacttttaaaagcag

SEQ ID NO: 21836 - DNA, 18 bp, Homo sapiens
cccttctctaaggagcag

SEQ ID NO: 21837 - DNA, 15 bp, Homo sapiens
tgccccaaaaagcag

SEQ ID NO: 21838 - DNA, 19 bp, Homo sapiens
cttttcaagtctaaagcag

SEQ ID NO: 21839 - DNA, 20 bp, Homo sapiens
tgctctcttcaaagaggcag

SEQ ID NO: 21840 - DNA, 18 bp, Homo sapiens
tgctctcttcaaacacag

SEQ ID NO: 21841 - DNA, 17 bp, Homo sapiens
tgcccctcctcaagcag

SEQ ID NO: 21842 - DNA, 18 bp, Homo sapiens
tgccctttttcaattcag

SEQ ID NO: 21843 - DNA, 17 bp, Homo sapiens
gctcttctcaaaggcag

SEQ ID NO: 21844 - DNA, 19 bp, Homo sapiens
tgccttttcactttaacag

SEQ ID NO: 21845 - DNA, 21 bp, Homo sapiens
tgccctttttaactcctgcag

SEQ ID NO: 21846 - DNA, 18 bp, Homo sapiens
cctgcttcaaaagggcag

SEQ ID NO: 21847 - DNA, 20 bp, Homo sapiens
gcccaccccccaagaagcag

SEQ ID NO: 21848 - DNA, 18 bp, Homo sapiens
tgccctttccaatctcag

SEQ ID NO: 21849 - DNA, 17 bp, Homo sapiens
tgcccttctttaaaaca

SEQ ID NO: 21850 - DNA, 16 bp, Homo sapiens
tgcccttttaaaggca

SEQ ID NO: 21851 - DNA, 19 bp, Homo sapiens
tgccctttcaaaataacag

SEQ ID NO: 21852 - DNA, 17 bp, Homo sapiens
tgcccctccagaagcag

SEQ ID NO: 21853 - DNA, 21 bp, Homo sapiens
tgctctttcaaacagaagcag

SEQ ID NO: 21854 - DNA, 18 bp, Homo sapiens
cttctccataaaaagcag

SEQ ID NO: 21855 - DNA, 19 bp, Homo sapiens
gccaggtcgcaaaaagcag

SEQ ID NO: 21856 - DNA, 19 bp, Homo sapiens
tgccctcctttaaaagcag

SEQ ID NO: 21857 - DNA, 18 bp, Homo sapiens
cctctttcaaagaagcag

SEQ ID NO: 21858 - DNA, 18 bp, Homo sapiens
tgacctctccaagagcag

SEQ ID NO: 21859 - DNA, 18 bp, Homo sapiens
gcctcaccgcaaaagcag

SEQ ID NO: 21860 - DNA, 18 bp, Homo sapiens
gctcctccaaaggagcag

SEQ ID NO: 21861 - DNA, 20 bp, Homo sapiens
tgccctcttcgaactctcag

SEQ ID NO: 21862 - DNA, 21 bp, Homo sapiens
tgcccttcaatgtgaaagcag

SEQ ID NO: 21863 - DNA, 19 bp, Homo sapiens
taccccattcaaaaggcag

SEQ ID NO: 21864 - DNA, 20 bp, Homo sapiens
tggccttttcaaacacacag

SEQ ID NO: 21865 - DNA, 19 bp, Homo sapiens
taccctcccccaaaagcag

SEQ ID NO: 21866 - DNA, 19 bp, Homo sapiens
accacttttcaaaaagcag

SEQ ID NO: 21867 - DNA, 21 bp, Homo sapiens
gccctccccattagaaagcag

SEQ ID NO: 21868 - DNA, 21 bp, Homo sapiens
tgccctttatacagaaagcag

SEQ ID NO: 21869 - DNA, 19 bp, Homo sapiens
cccttctcacagaaagcag

SEQ ID NO: 21870 - DNA, 17 bp, Homo sapiens
tgccatttccaaagcag

SEQ ID NO: 21871 - DNA, 15 bp, Homo sapiens
acccccaaaaagcag

SEQ ID NO: 21872 - DNA, 17 bp, Homo sapiens
tgccctccagaaagcag

SEQ ID NO: 21873 - DNA, 17 bp, Homo sapiens
tgccctttcagaaggca

SEQ ID NO: 21874 - DNA, 16 bp, Homo sapiens
tgcattcaaaaagcag

SEQ ID NO: 21875 - DNA, 16 bp, Homo sapiens
tgtcctttcaaagcag

SEQ ID NO: 21876 - DNA, 16 bp, Homo sapiens
tgcctctccagagcag

SEQ ID NO: 21877 - DNA, 17 bp, Homo sapiens
gcccctggaaaaagcag

SEQ ID NO: 21878 - DNA, 17 bp, Homo sapiens
gcctttttccaaagcag

SEQ ID NO: 21879 - DNA, 19 bp, Homo sapiens
tgctccttcctggaagcag

SEQ ID NO: 21880 - DNA, 16 bp, Homo sapiens
tgcccttttgaagcag

SEQ ID NO: 21881 - DNA, 18 bp, Homo sapiens
tgcccttttcaggaaaag

SEQ ID NO: 21882 - DNA, 17 bp, Homo sapiens
tgccctccctcaagcag

SEQ ID NO: 21883 - DNA, 18 bp, Homo sapiens
tggccttttaaaaagcag

SEQ ID NO: 21884 - DNA, 23 bp, Homo sapiens
tacccttttgtttcaaagggcag

SEQ ID NO: 21885 - DNA, 19 bp, Homo sapiens
gccaggctccaaaaagcag

SEQ ID NO: 21886 - DNA, 21 bp, Homo sapiens
tgtccttttcaaaacaagcag

SEQ ID NO: 21887 - DNA, 18 bp, Homo sapiens
ccccttcctaaagagcag

SEQ ID NO: 21888 - DNA, 20 bp, Homo sapiens
gccctccctccaaaaggcag

SEQ ID NO: 21889 - DNA, 17 bp, Homo sapiens
tgctctctcaaaagcag

SEQ ID NO: 21890 - DNA, 18 bp, Homo sapiens
cccaaccttaaaaagcag

SEQ ID NO: 21891 - DNA, 19 bp, Homo sapiens
tgccctttccatatcacag

SEQ ID NO: 21892 - DNA, 19 bp, Homo sapiens
tgtccttttgtaaaagcag

SEQ ID NO: 21893 - DNA, 16 bp, Homo sapiens
tgccttccaaaagcag

SEQ ID NO: 21894 - DNA, 21 bp, Homo sapiens
gccccttcactcaagaggcag

SEQ ID NO: 21895 - DNA, 19 bp, Homo sapiens
gctccccctcagggagcag

SEQ ID NO: 21896 - DNA, 17 bp, Homo sapiens
tgccctctggaaagcag

SEQ ID NO: 21897 - DNA, 19 bp, Homo sapiens
tgcccctttcctccagcag

SEQ ID NO: 21898 - DNA, 19 bp, Homo sapiens
gccctcctcgcaagggcag

SEQ ID NO: 21899 - DNA, 19 bp, Homo sapiens
gccctccccagaaaggcag

SEQ ID NO: 21900 - DNA, 19 bp, Homo sapiens
tgccattcttcaaaagcag

SEQ ID NO: 21901 - DNA, 18 bp, Homo sapiens
tgtcctttccaagagcaa

SEQ ID NO: 21902 - DNA, 18 bp, Homo sapiens
gccttccaggaaaagcag

SEQ ID NO: 21903 - DNA, 19 bp, Homo sapiens
tgccctctggaaggagcag

SEQ ID NO: 21904 - DNA, 20 bp, Homo sapiens
cccttttcagcagaaagcag

SEQ ID NO: 21905 - DNA, 20 bp, Homo sapiens
tgccgttttcaaaggggcag

SEQ ID NO: 21906 - DNA, 18 bp, Homo sapiens
ccttttcagaaagggcag

SEQ ID NO: 21907 - DNA, 19 bp, Homo sapiens
gccttttcagcaaaggcag

SEQ ID NO: 21908 - DNA, 19 bp, Homo sapiens
tgtcctttccaggaagcag

SEQ ID NO: 21909 - DNA, 19 bp, Homo sapiens
tgtccctaagaaaaagcag

SEQ ID NO: 21910 - DNA, 19 bp, Homo sapiens
tgcccccaaaaaaaggcag

SEQ ID NO: 21911 - DNA, 21 bp, Homo sapiens
tacccttttcaaaaccatcag

SEQ ID NO: 21912 - DNA, 17 bp, Homo sapiens
accccttcagaaagcag

SEQ ID NO: 21913 - DNA, 21 bp, Homo sapiens
gccctcaaagttaaaaagcag

SEQ ID NO: 21914 - DNA, 17 bp, Homo sapiens
gccttcctcaaaggcag

SEQ ID NO: 21915 - DNA, 18 bp, Homo sapiens
tgcgccttataaaagcag

SEQ ID NO: 21916 - DNA, 17 bp, Homo sapiens
gctctcctcaaaggcag

SEQ ID NO: 21917 - DNA, 18 bp, Homo sapiens
tgctcccttaaaaagcag

SEQ ID NO: 21918 - DNA, 21 bp, Homo sapiens
tacccttttcaccctgagcag

SEQ ID NO: 21919 - DNA, 19 bp, Homo sapiens
ccttttcccaaaaaggcag

SEQ ID NO: 21920 - DNA, 19 bp, Homo sapiens
gccccactctgaaaagcag

SEQ ID NO: 21921 - DNA, 16 bp, Homo sapiens
gccctttcccaagcag

SEQ ID NO: 21922 - DNA, 16 bp, Homo sapiens
tgccctccaaaggcag

SEQ ID NO: 21923 - DNA, 75 bp, Cercopithecine herpesvirus 7
tggacaactactttttagcacaaatccagatatatcttcctttaaattgggtaccgaaggcgctgagtatttcca

SEQ ID NO: 21924 - DNA, 24 bp, Cercopithecine herpesvirus 7
tagcacaaatccagatatatcttc

SEQ ID NO: 21925 - DNA, 22 bp, Homo sapiens
tagcacaaatcaccatcaatat

SEQ ID NO: 21926 - DNA, 23 bp, Homo sapiens
agcccctcttcagatatattttc

SEQ ID NO: 21927 - DNA, 22 bp, Homo sapiens
gcactggttcaggcacaccttc

SEQ ID NO: 21928 - DNA, 21 bp, Homo sapiens
tagtccaaatccagacatttc

SEQ ID NO: 21929 - DNA, 21 bp, Homo sapiens
tagcacaagatgacatgtctt

SEQ ID NO: 21930 - DNA, 20 bp, Homo sapiens
tagtacatatccagatatat

SEQ ID NO: 21931 - DNA, 20 bp, Homo sapiens
gcacaacctgatatatcttc

SEQ ID NO: 21932 - DNA, 20 bp, Homo sapiens
agcacaaatgctgatgtctt

SEQ ID NO: 21933 - DNA, 19 bp, Homo sapiens
tagcacatatccagttctt

SEQ ID NO: 21934 - DNA, 20 bp, Homo sapiens
gcacaaatttcctttatctt

SEQ ID NO: 21935 - DNA, 18 bp, Homo sapiens
acacaacatgtatatctt

SEQ ID NO: 21936 - DNA, 23 bp, Homo sapiens
gcaggtcatccagatgtattttc

SEQ ID NO: 21937 - DNA, 19 bp, Homo sapiens
tagtaaaatccagcacctt

SEQ ID NO: 21938 - DNA, 24 bp, Homo sapiens
taccataaatccaggctactcttc

SEQ ID NO: 21939 - DNA, 131 bp, Macaca mulatta rhadinovirus
tgccaagaggacagataccagatgccataaaggggaaagagttccaccaaataaatccgtttttgtggtttgacggaggggcgttttggcaactgttcctctctgtggattttatgctgctctgtcccgca

SEQ ID NO: 21940 - DNA, 24 bp, Macaca mulatta rhadinovirus
aaggggaaagagttccaccaaata

SEQ ID NO: 21941 - DNA, 20 bp, Homo sapiens
aaggggaagagaaacacaca

SEQ ID NO: 21942 - DNA, 21 bp, Homo sapiens
agggaaatacagtaccaaata

SEQ ID NO: 21943 - DNA, 17 bp, Homo sapiens
ggtggagagagccccca

SEQ ID NO: 21944 - DNA, 20 bp, Homo sapiens
aaagaatccaagtttcacca

SEQ ID NO: 21945 - DNA, 19 bp, Homo sapiens
aaggagaaagcagaggcca

SEQ ID NO: 21946 - DNA, 15 bp, Homo sapiens
aggggaaagccccaa

SEQ ID NO: 21947 - DNA, 22 bp, Homo sapiens
aaggggaagagagtggcaaata

SEQ ID NO: 21948 - DNA, 19 bp, Homo sapiens
ggggaaagacactcaaata

SEQ ID NO: 21949 - DNA, 19 bp, Homo sapiens
aagggaaaagagaacaaat

SEQ ID NO: 21950 - DNA, 22 bp, Homo sapiens
aagggaagctggttaccaaata

SEQ ID NO: 21951 - DNA, 20 bp, Homo sapiens
agggtggaggttcaccaaat

SEQ ID NO: 21952 - DNA, 19 bp, Homo sapiens
aaggggaaaaaaattacca

SEQ ID NO: 21953 - DNA, 23 bp, Homo sapiens
aaggggaagttatacatcaaata

SEQ ID NO: 21954 - DNA, 19 bp, Homo sapiens
aagaggaaattctcatcaa

SEQ ID NO: 21955 - DNA, 22 bp, Homo sapiens
ggggagagaggtggactcaaat

SEQ ID NO: 21956 - DNA, 19 bp, Homo sapiens
aggagaaagagaagcaaat

SEQ ID NO: 21957 - DNA, 20 bp, Homo sapiens
ggggaaaattgttgccaaat

SEQ ID NO: 21958 - DNA, 19 bp, Homo sapiens
aaggaaaggagtttcacca

SEQ ID NO: 21959 - DNA, 23 bp, Homo sapiens
aggaggaaagaagagtactaaat

SEQ ID NO: 21960 - DNA, 16 bp, Homo sapiens
aagaggaaagtcacca

SEQ ID NO: 21961 - DNA, 20 bp, Homo sapiens
ggggaaaggtgattccaaat

SEQ ID NO: 21962 - DNA, 20 bp, Homo sapiens
aaggagaaaacctgccaaat

SEQ ID NO: 21963 - DNA, 19 bp, Homo sapiens
aaggggaaacaacccaaat

SEQ ID NO: 21964 - DNA, 15 bp, Homo sapiens
gggaattcaccaaat

SEQ ID NO: 21965 - DNA, 17 bp, Homo sapiens
ggggaagggttctccaa

SEQ ID NO: 21966 - DNA, 17 bp, Homo sapiens
aggggcttccaccaaat

SEQ ID NO: 21967 - DNA, 19 bp, Homo sapiens
aaggggaaaggaggctcca

SEQ ID NO: 21968 - DNA, 21 bp, Homo sapiens
aagggtggagttgcaccaaat

SEQ ID NO: 21969 - DNA, 19 bp, Homo sapiens
ggcggaaggagttttcccc

SEQ ID NO: 21970 - DNA, 19 bp, Homo sapiens
gggaaaagaaaacacaaat

SEQ ID NO: 21971 - DNA, 22 bp, Homo sapiens
agaggaaagagaaagacaaata

SEQ ID NO: 21972 - DNA, 17 bp, Homo sapiens
aggggaaaacaccaaat

SEQ ID NO: 21973 - DNA, 16 bp, Homo sapiens
ggggaaaacaccaaat

SEQ ID NO: 21974 - DNA, 16 bp, Homo sapiens
ggggaaagtaccaaat

SEQ ID NO: 21975 - DNA, 22 bp, Homo sapiens
aaggggagagacacttcaaata

SEQ ID NO: 21976 - DNA, 18 bp, Homo sapiens
agaggccagagaccaaat

SEQ ID NO: 21977 - DNA, 70 bp, Cercopithecine herpesvirus 7
ggcttaaatatttaatgcaatgtaaaagcttatgcttttaagtctttaagctgcattatcttccattgcc

SEQ ID NO: 21978 - DNA, 24 bp, Cercopithecine herpesvirus 7
tttaatgcaatgtaaaagcttatg

SEQ ID NO: 21979 - DNA, 18 bp, Homo sapiens
tttgatgcaatataaaaa

SEQ ID NO: 21980 - DNA, 20 bp, Homo sapiens
tacatctgtaaaagtttatg

SEQ ID NO: 21981 - DNA, 86 bp, Macaca mulatta rhadinovirus
aaacaaggaatgcatatggttgcgacacccgggtacgtccgcgtttgttcgggtatacaccgcgaccactgcgcattctgccgttt

SEQ ID NO: 21982 - DNA, 24 bp, Macaca mulatta rhadinovirus
aggaatgcatatggttgcgacacc

SEQ ID NO: 21983 - DNA, 18 bp, Homo sapiens
aggaatgcatgagtgtgc

SEQ ID NO: 21984 - DNA, 19 bp, Homo sapiens
aggaatgcagcaactgaca

SEQ ID NO: 21985 - DNA, 21 bp, Homo sapiens
aggaatgcagtgcactcggcg

SEQ ID NO: 21986 - DNA, 20 bp, Homo sapiens
ggaatgcataagtacaaaca

SEQ ID NO: 21987 - DNA, 21 bp, Homo sapiens
agaatgcatgaaatcggcacc

SEQ ID NO: 21988 - DNA, 18 bp, Homo sapiens
agagtgcatatggtgtac

SEQ ID NO: 21989 - DNA, 19 bp, Homo sapiens
aggaatgctggaatgacac

SEQ ID NO: 21990 - DNA, 19 bp, Homo sapiens
ggatgcatatgtacatacc

SEQ ID NO: 21991 - DNA, 16 bp, Homo sapiens
agggtgcatatgtgca

SEQ ID NO: 21992 - DNA, 19 bp, Homo sapiens
aggaatacatataggatac

SEQ ID NO: 21993 - DNA, 17 bp, Homo sapiens
aggaatgctattcaaca

SEQ ID NO: 21994 - DNA, 17 bp, Homo sapiens
aggaatgcattgaatac

SEQ ID NO: 21995 - DNA, 19 bp, Homo sapiens
ggaatgcagtatggcagca

SEQ ID NO: 21996 - DNA, 17 bp, Homo sapiens
agaaatgcatgtcgaca

SEQ ID NO: 21997 - DNA, 17 bp, Homo sapiens
ggaatgcagtggtgtga

SEQ ID NO: 21998 - DNA, 20 bp, Homo sapiens
ggaatgcatatggatgagca

SEQ ID NO: 21999 - DNA, 17 bp, Homo sapiens
ggaatgcaggtgcgcgc

SEQ ID NO: 22000 - DNA, 16 bp, Homo sapiens
ggaatgcaggtgtgcg

SEQ ID NO: 22001 - DNA, 21 bp, Homo sapiens
ggatgcatattctgttggtgc

SEQ ID NO: 22002 - DNA, 19 bp, Homo sapiens
agggacgcataactggcac

SEQ ID NO: 22003 - DNA, 19 bp, Homo sapiens
aggaatgcaatgttggtgc

SEQ ID NO: 22004 - DNA, 20 bp, Homo sapiens
aggaatgagtgtggttacaa

SEQ ID NO: 22005 - DNA, 18 bp, Homo sapiens
aggaatgcttataaggca

SEQ ID NO: 22006 - DNA, 84 bp, Macaca mulatta rhadinovirus
gttttggtaccctttctaatgcgccgaggagcgttccgatacccgggccgttgaacccacatccgcgagaaaccgtgcccgggc

SEQ ID NO: 22007 - DNA, 24 bp, Macaca mulatta rhadinovirus
taccctttctaatgcgccgaggag

SEQ ID NO: 22008 - DNA, 19 bp, Homo sapiens
cctctttctaaaccggagg

SEQ ID NO: 22009 - DNA, 20 bp, Homo sapiens
ccctttctgatgcatcagag

SEQ ID NO: 22010 - DNA, 19 bp, Homo sapiens
cctttctaatacccatagg

SEQ ID NO: 22011 - DNA, 25 bp, Homo sapiens
taccctttctgctgtgtatacccag

SEQ ID NO: 22012 - DNA, 17 bp, Homo sapiens
ccctttctgagccagag

SEQ ID NO: 22013 - DNA, 26 bp, Homo sapiens
ccctttctggtgctgcctcccaggag

SEQ ID NO: 22014 - DNA, 22 bp, Homo sapiens
taccccttctaatgttgatgag

SEQ ID NO: 22015 - DNA, 24 bp, Homo sapiens
ccctttctgtctaaagccgaggag

SEQ ID NO: 22016 - DNA, 18 bp, Homo sapiens
ctttctaacgcggaaaag

SEQ ID NO: 22017 - DNA, 23 bp, Homo sapiens
cccttcctgcacgtcctggggag

SEQ ID NO: 22018 - DNA, 18 bp, Homo sapiens
tacttttttaatgcgcga

SEQ ID NO: 22019 - DNA, 60 bp, Cercopithecine herpesvirus 7
tcccgtgtaccagtgtacctttctactatttaggttaagggtaaataaaggcacatgtaa

SEQ ID NO: 22020 - DNA, 24 bp, Cercopithecine herpesvirus 7
ttaagggtaaataaaggcacatgt

SEQ ID NO: 22021 - DNA, 20 bp, Homo sapiens
taaagtgtgaaggcacatgt

SEQ ID NO: 22022 - DNA, 18 bp, Homo sapiens
ttaagagtgtggcatatg

SEQ ID NO: 22023 - DNA, 16 bp, Homo sapiens
aggtagataacacatg

SEQ ID NO: 22024 - DNA, 25 bp, Homo sapiens
taagggtaagtgagagcgctcatgt

SEQ ID NO: 22025 - DNA, 21 bp, Homo sapiens
ggtatttgtaagggcacatgt

SEQ ID NO: 22026 - DNA, 60 bp, Cercopithecine herpesvirus 7
ccaggtttacagtttctaagcgtgttttgtcatcgtttattttttaaactgaccaactgg

SEQ ID NO: 22027 - DNA, 24 bp, Cercopithecine herpesvirus 7
tacagtttctaagcgtgttttgtc

SEQ ID NO: 22028 - DNA, 19 bp, Homo sapiens
cacagtttctaagcatgtc

SEQ ID NO: 22029 - DNA, 16 bp, Homo sapiens
tttctaactgttttgt

SEQ ID NO: 22030 - DNA, 20 bp, Homo sapiens
acagtttggcagtgttttgt

SEQ ID NO: 22031 - DNA, 21 bp, Homo sapiens
tacagtttttcatagtttgtc

SEQ ID NO: 22032 - DNA, 21 bp, Homo sapiens
tacgtttctttcttgttttgt

SEQ ID NO: 22033 - DNA, 24 bp, Homo sapiens
tgagtttctaggcccttattttgt

SEQ ID NO: 22034 - DNA, 16 bp, Homo sapiens
tacagcttctattttg

SEQ ID NO: 22035 - DNA, 20 bp, Homo sapiens
tacattctcctgtgttttgt

SEQ ID NO: 22036 - DNA, 22 bp, Homo sapiens
tacaatttctgagctgcactgt

SEQ ID NO: 22037 - DNA, 23 bp, Homo sapiens
cagtttctgaatgccacaatgtc

SEQ ID NO: 22038 - DNA, 18 bp, Homo sapiens
atttctaggccatcttgt

SEQ ID NO: 22039 - DNA, 21 bp, Homo sapiens
cagtttctaagcacaccatgt

SEQ ID NO: 22040 - DNA, 19 bp, Homo sapiens
atttctaaatacattttgt

SEQ ID NO: 22041 - DNA, 19 bp, Homo sapiens
tacagttttcatattttgt

SEQ ID NO: 22042 - DNA, 22 bp, Homo sapiens
cagtatttgagcttactttgtc

SEQ ID NO: 22043 - DNA, 21 bp, Homo sapiens
cacagttttgttttgttttgt

SEQ ID NO: 22044 - DNA, 21 bp, Homo sapiens
tacaatttctctggttttgtc

SEQ ID NO: 22045 - DNA, 15 bp, Homo sapiens
gtttctaatgtttgt

SEQ ID NO: 22046 - DNA, 24 bp, Homo sapiens
acagtttctggtggtgcttttgtc

SEQ ID NO: 22047 - DNA, 18 bp, Homo sapiens
cacagttttctgttttgt

SEQ ID NO: 22048 - DNA, 69 bp, Cercopithecine herpesvirus 7
gacaattacatcttcttctctgcagataccgactactcagggggctcgagaaacggagatttaacggtc

SEQ ID NO: 22049 - DNA, 24 bp, Cercopithecine herpesvirus 7
gggctcgagaaacggagatttaac

SEQ ID NO: 22050 - DNA, 15 bp, Homo sapiens
gggctcaggagactc

SEQ ID NO: 22051 - DNA, 17 bp, Homo sapiens
gggtcagatggagattt

SEQ ID NO: 22052 - DNA, 18 bp, Homo sapiens
ggactcgagggatgatct

SEQ ID NO: 22053 - DNA, 19 bp, Homo sapiens
gggctcggggacgggaaac

SEQ ID NO: 22054 - DNA, 60 bp, Sugarcane yellow leaf virus
ccgctcctgacgcgattgacctggaaccgtttacagaagatgtcccaggttgatttccag

SEQ ID NO: 22055 - DNA, 20 bp, Sugarcane yellow leaf virus
tgtcccaggttgatttccag

SEQ ID NO: 22056 - DNA, 16 bp, Homo sapiens
tcccaggtgtctccag

SEQ ID NO: 22057 - DNA, 18 bp, Homo sapiens
tcccaggttagagcccag

SEQ ID NO: 22058 - DNA, 18 bp, Homo sapiens
tggcccagactcttccag

SEQ ID NO: 22059 - DNA, 18 bp, Homo sapiens
tgttccggttaactccag

SEQ ID NO: 22060 - DNA, 20 bp, Homo sapiens
tgtcccagattactctccag

SEQ ID NO: 22061 - DNA, 18 bp, Homo sapiens
tgtccaggtgtggtccag

SEQ ID NO: 22062 - DNA, 16 bp, Homo sapiens
tcacctcgatttccag

SEQ ID NO: 22063 - DNA, 19 bp, Homo sapiens
tgcttgggctcatttccag

SEQ ID NO: 22064 - DNA, 17 bp, Homo sapiens
tgttcctggttttccag

SEQ ID NO: 22065 - DNA, 18 bp, Homo sapiens
tgtcccagactcatccag

SEQ ID NO: 22066 - DNA, 17 bp, Homo sapiens
tgtcccaggctgcacag

SEQ ID NO: 22067 - DNA, 15 bp, Homo sapiens
tgccccagggatcca

SEQ ID NO: 22068 - DNA, 19 bp, Homo sapiens
tgtcccaggtgccgacccc

SEQ ID NO: 22069 - DNA, 18 bp, Homo sapiens
gtcccaggtccccaccag

SEQ ID NO: 22070 - DNA, 19 bp, Homo sapiens
tggcccaggccatcttcag

SEQ ID NO: 22071 - DNA, 20 bp, Homo sapiens
tgttacagggctatttccag

SEQ ID NO: 22072 - DNA, 17 bp, Homo sapiens
tatcttttgatttccag

SEQ ID NO: 22073 - DNA, 16 bp, Homo sapiens
tccaaagaatttccag

SEQ ID NO: 22074 - DNA, 20 bp, Homo sapiens
tgccccaggtcctccctcag

SEQ ID NO: 22075 - DNA, 19 bp, Homo sapiens
tgtcccagaatccttccag

SEQ ID NO: 22076 - DNA, 17 bp, Homo sapiens
tcccagatcctttccag

SEQ ID NO: 22077 - DNA, 22 bp, Homo sapiens
tgtcccaaggtgtgcggtccag

SEQ ID NO: 22078 - DNA, 20 bp, Homo sapiens
tgccccagcccgctgtttcc

SEQ ID NO: 22079 - DNA, 17 bp, Homo sapiens
gttcctggaatttccag

SEQ ID NO: 22080 - DNA, 18 bp, Homo sapiens
tgtcctctaagtttccag

SEQ ID NO: 22081 - DNA, 17 bp, Homo sapiens
tgtctcagtacctccag

SEQ ID NO: 22082 - DNA, 17 bp, Homo sapiens
tgcctcagaacttccag

SEQ ID NO: 22083 - DNA, 17 bp, Homo sapiens
tgtcccagcttcctccc

SEQ ID NO: 22084 - DNA, 20 bp, Homo sapiens
gtcctccgccggatttccag

SEQ ID NO: 22085 - DNA, 20 bp, Homo sapiens
tgacctccagaggtttccag

SEQ ID NO: 22086 - DNA, 15 bp, Homo sapiens
tgcccaggccctcca

SEQ ID NO: 22087 - DNA, 19 bp, Homo sapiens
tgtgcctattcatttccag

SEQ ID NO: 22088 - DNA, 17 bp, Homo sapiens
gtctcaggcacctccag

SEQ ID NO: 22089 - DNA, 18 bp, Homo sapiens
tgtcccagctctgatttc

SEQ ID NO: 22090 - DNA, 20 bp, Homo sapiens
tgtcccaggtggcattgcag

SEQ ID NO: 22091 - DNA, 18 bp, Homo sapiens
tgtcccaattatttccag

SEQ ID NO: 22092 - DNA, 18 bp, Homo sapiens
gtcccaaagcatgttttc

SEQ ID NO: 22093 - DNA, 20 bp, Homo sapiens
tgtgcagtattgatttccag

SEQ ID NO: 22094 - DNA, 21 bp, Homo sapiens
tgtcccaggctcaaactccag

SEQ ID NO: 22095 - DNA, 18 bp, Homo sapiens
tgcttccagcacttccag

SEQ ID NO: 22096 - DNA, 18 bp, Homo sapiens
tctcaaagaaatttccag

SEQ ID NO: 22097 - DNA, 17 bp, Homo sapiens
tatccttgtatttccag

SEQ ID NO: 22098 - DNA, 19 bp, Homo sapiens
tgatccactgtatttccag

SEQ ID NO: 22099 - DNA, 16 bp, Homo sapiens
gtctcacaatttccag

SEQ ID NO: 22100 - DNA, 20 bp, Homo sapiens
tgtccctggggctcgtccag

SEQ ID NO: 22101 - DNA, 20 bp, Homo sapiens
tggcccttcccgatttccag

SEQ ID NO: 22102 - DNA, 17 bp, Homo sapiens
tgtcccagtcaacccag

SEQ ID NO: 22103 - DNA, 17 bp, Homo sapiens
tcccccaacatttccag

SEQ ID NO: 22104 - DNA, 19 bp, Homo sapiens
gttccaggtagatctccag

SEQ ID NO: 22105 - DNA, 15 bp, Homo sapiens
tgtccaggctgtcca

SEQ ID NO: 22106 - DNA, 18 bp, Homo sapiens
tcctagggcgacttccag

SEQ ID NO: 22107 - DNA, 17 bp, Homo sapiens
tggcccaggtcagccag

SEQ ID NO: 22108 - DNA, 15 bp, Homo sapiens
tgtccaggttgtcca

SEQ ID NO: 22109 - DNA, 20 bp, Homo sapiens
tgccccaggcccccctccag

SEQ ID NO: 22110 - DNA, 17 bp, Homo sapiens
tgccccaggggctccag

SEQ ID NO: 22111 - DNA, 18 bp, Homo sapiens
tctctaagtgatttccag

SEQ ID NO: 22112 - DNA, 19 bp, Homo sapiens
tgtcccagctgttgctcag

SEQ ID NO: 22113 - DNA, 15 bp, Homo sapiens
tgccccaggttgccc

SEQ ID NO: 22114 - DNA, 15 bp, Homo sapiens
tgtcccaggctccca

SEQ ID NO: 22115 - DNA, 21 bp, Homo sapiens
tgccccaaagaaaatttccag

SEQ ID NO: 22116 - DNA, 20 bp, Homo sapiens
tgcctcggctgaatttccag

SEQ ID NO: 22117 - DNA, 20 bp, Homo sapiens
tgccccaggtgctcacccag

SEQ ID NO: 22118 - DNA, 18 bp, Homo sapiens
tgttccaagttgaaccag

SEQ ID NO: 22119 - DNA, 17 bp, Homo sapiens
tgcccaggtttttccag

SEQ ID NO: 22120 - DNA, 20 bp, Homo sapiens
tatccttaaggcatttccag

SEQ ID NO: 22121 - DNA, 15 bp, Homo sapiens
tcccaggtcctccag

SEQ ID NO: 22122 - DNA, 18 bp, Homo sapiens
gtcccgggcctgttccag

SEQ ID NO: 22123 - DNA, 18 bp, Homo sapiens
tgtccctggaacctccag

SEQ ID NO: 22124 - DNA, 17 bp, Homo sapiens
gtttcaggtattcccag

SEQ ID NO: 22125 - DNA, 18 bp, Homo sapiens
tgtcttaggctgacgcag

SEQ ID NO: 22126 - DNA, 18 bp, Homo sapiens
tgccctgattatttccag

SEQ ID NO: 22127 - DNA, 17 bp, Homo sapiens
tcccacttgatttccag

SEQ ID NO: 22128 - DNA, 20 bp, Homo sapiens
tgtctccaggtaatttccag

SEQ ID NO: 22129 - DNA, 19 bp, Homo sapiens
tgttcctgccaacttccag

SEQ ID NO: 22130 - DNA, 18 bp, Homo sapiens
tgcccaggcctgttccag

SEQ ID NO: 22131 - DNA, 15 bp, Homo sapiens
tgtcccagttgacca

SEQ ID NO: 22132 - DNA, 18 bp, Homo sapiens
gtcccaggtccaacccag

SEQ ID NO: 22133 - DNA, 17 bp, Homo sapiens
tgcccaggtctttccag

SEQ ID NO: 22134 - DNA, 18 bp, Homo sapiens
tgtcccagttctatccag

SEQ ID NO: 22135 - DNA, 18 bp, Homo sapiens
tgcctttctgatttccag

SEQ ID NO: 22136 - DNA, 21 bp, Homo sapiens
tgtcccaggtacaacttccag

SEQ ID NO: 22137 - DNA, 17 bp, Homo sapiens
tgccccagtccttccag

SEQ ID NO: 22138 - DNA, 19 bp, Homo sapiens
tgtccccagtgatttccag

SEQ ID NO: 22139 - DNA, 16 bp, Homo sapiens
tgtcccagctgcttcc

SEQ ID NO: 22140 - DNA, 17 bp, Homo sapiens
tgtcctggattaatcca

SEQ ID NO: 22141 - DNA, 19 bp, Homo sapiens
tatcccacctaatttccag

SEQ ID NO: 22142 - DNA, 18 bp, Homo sapiens
tgttccaggctggtccag

SEQ ID NO: 22143 - DNA, 17 bp, Homo sapiens
tgtcccagagattccag

SEQ ID NO: 22144 - DNA, 18 bp, Homo sapiens
gtcccaggttgcctgcag

SEQ ID NO: 22145 - DNA, 17 bp, Homo sapiens
tgtcccagtgatcccag

SEQ ID NO: 22146 - DNA, 20 bp, Homo sapiens
tgcctgttgccgatttccag

SEQ ID NO: 22147 - DNA, 17 bp, Homo sapiens
tgtccggccaattccag

SEQ ID NO: 22148 - DNA, 17 bp, Homo sapiens
tgcccactgatttccag

SEQ ID NO: 22149 - DNA, 19 bp, Homo sapiens
tgcccactctcatttccag

SEQ ID NO: 22150 - DNA, 20 bp, Homo sapiens
tgtgccaggttgctcatcag

SEQ ID NO: 22151 - DNA, 20 bp, Homo sapiens
tgtcccaggctctgttccag

SEQ ID NO: 22152 - DNA, 17 bp, Homo sapiens
tgacccaggccttccag

SEQ ID NO: 22153 - DNA, 17 bp, Homo sapiens
tgcccaggttgatccag

SEQ ID NO: 22154 - DNA, 17 bp, Homo sapiens
tgtcctggtatctccag

SEQ ID NO: 22155 - DNA, 17 bp, Homo sapiens
gtctcagccacttccag

SEQ ID NO: 22156 - DNA, 18 bp, Homo sapiens
tgctcaggttgagtccag

SEQ ID NO: 22157 - DNA, 15 bp, Homo sapiens
tgcccaggttgtccc

SEQ ID NO: 22158 - DNA, 18 bp, Homo sapiens
tgtcccaggtccacacag

SEQ ID NO: 22159 - DNA, 16 bp, Homo sapiens
gtcccaggtcatccag

SEQ ID NO: 22160 - DNA, 18 bp, Homo sapiens
tgcccaaaccttgatttc

SEQ ID NO: 22161 - DNA, 20 bp, Homo sapiens
tgtccatgtcctctttccag

SEQ ID NO: 22162 - DNA, 17 bp, Homo sapiens
tgtcccagattggccag

SEQ ID NO: 22163 - DNA, 17 bp, Homo sapiens
tgtcccaggtcgaccag

SEQ ID NO: 22164 - DNA, 18 bp, Homo sapiens
tgtctaaggtattcccag

SEQ ID NO: 22165 - DNA, 17 bp, Homo sapiens
tgtcccagcttctccag

SEQ ID NO: 22166 - DNA, 19 bp, Homo sapiens
gtcccaggttggcatccag

SEQ ID NO: 22167 - DNA, 17 bp, Homo sapiens
tgtcccagtgcctccag

SEQ ID NO: 22168 - DNA, 16 bp, Homo sapiens
gtcccaggctgtccag

SEQ ID NO: 22169 - DNA, 16 bp, Homo sapiens
gtcccagggcctccag

SEQ ID NO: 22170 - DNA, 17 bp, Homo sapiens
tcccaggtcctcttcag

SEQ ID NO: 22171 - DNA, 20 bp, Homo sapiens
tgctcaggtaccacttccag

SEQ ID NO: 22172 - DNA, 18 bp, Homo sapiens
tgacccaggtcttgactc

SEQ ID NO: 22173 - DNA, 20 bp, Homo sapiens
tgcctgggttcgatttccag

SEQ ID NO: 22174 - DNA, 19 bp, Homo sapiens
tatcccagggaagctccag

SEQ ID NO: 22175 - DNA, 19 bp, Homo sapiens
tgtctgagtctatttccag

SEQ ID NO: 22176 - DNA, 21 bp, Homo sapiens
tgacccaaacccagtttccag

SEQ ID NO: 22177 - DNA, 17 bp, Homo sapiens
tgccccaggtttctcag

SEQ ID NO: 22178 - DNA, 17 bp, Homo sapiens
tggcccagaatttccag

SEQ ID NO: 22179 - DNA, 19 bp, Homo sapiens
tgccccagggtgtttccag

SEQ ID NO: 22180 - DNA, 19 bp, Homo sapiens
tgctcatcctcatttccag

SEQ ID NO: 22181 - DNA, 18 bp, Homo sapiens
gtcctgggtccaccccag

SEQ ID NO: 22182 - DNA, 15 bp, Homo sapiens
tgtcccaggtcctcc

SEQ ID NO: 22183 - DNA, 19 bp, Homo sapiens
tgtttgaagcgatttccag

SEQ ID NO: 22184 - DNA, 18 bp, Homo sapiens
gtcctcagaaatttccag

SEQ ID NO: 22185 - DNA, 17 bp, Homo sapiens
tgtcccagggactccag

SEQ ID NO: 22186 - DNA, 15 bp, Homo sapiens
tgccccaggccttcc

SEQ ID NO: 22187 - DNA, 17 bp, Homo sapiens
tgccccaggccctccag

SEQ ID NO: 22188 - DNA, 20 bp, Homo sapiens
tgtcccagtggctcttccag

SEQ ID NO: 22189 - DNA, 63 bp, Sugarcane yellow leaf virus
acgcccaaactcatcctggagtgcaaaaatctggatcttacaacacgagttcatccaattcca

SEQ ID NO: 22190 - DNA, 18 bp, Sugarcane yellow leaf virus
cgagttcatccaattcca

SEQ ID NO: 22191 - DNA, 15 bp, Homo sapiens
cgagctccaattcca

SEQ ID NO: 22192 - DNA, 18 bp, Homo sapiens
gagttggccccaattcca

SEQ ID NO: 22193 - DNA, 18 bp, Homo sapiens
cgagtccacggcagttcc

SEQ ID NO: 22194 - DNA, 18 bp, Homo sapiens
cgagtaaccccaattcca

SEQ ID NO: 22195 - DNA, 18 bp, Homo sapiens
cgagtccagcaatcttcc

SEQ ID NO: 22196 - DNA, 16 bp, Homo sapiens
cgtgctcccaattcca

SEQ ID NO: 22197 - DNA, 17 bp, Homo sapiens
ccagccatccaatttca

SEQ ID NO: 22198 - DNA, 20 bp, Homo sapiens
gagctcacagctgaattcca

SEQ ID NO: 22199 - DNA, 16 bp, Homo sapiens
caagctcccaattcca

SEQ ID NO: 22200 - DNA, 16 bp, Homo sapiens
cgaattcacaactcca

SEQ ID NO: 22201 - DNA, 15 bp, Homo sapiens
cgagtcacaattcca

SEQ ID NO: 22202 - DNA, 15 bp, Homo sapiens
caagtccaaattcca

SEQ ID NO: 22203 - DNA, 20 bp, Homo sapiens
caagttcattaaaaattcca

SEQ ID NO: 22204 - DNA, 20 bp, Homo sapiens
caagttcatcaacaagttcc

SEQ ID NO: 22205 - DNA, 17 bp, Homo sapiens
caatgcatccaattcca

SEQ ID NO: 22206 - DNA, 15 bp, Homo sapiens
cggcctccaattcca

SEQ ID NO: 22207 - DNA, 17 bp, Homo sapiens
caagtcatccaattcca

SEQ ID NO: 22208 - DNA, 18 bp, Homo sapiens
ccagttcatccaagccca

SEQ ID NO: 22209 - DNA, 16 bp, Homo sapiens
caggcttccaattcca

SEQ ID NO: 22210 - DNA, 16 bp, Homo sapiens
caagcccatgattcca

SEQ ID NO: 22211 - DNA, 18 bp, Homo sapiens
caagcccattcagttcca

SEQ ID NO: 22212 - DNA, 16 bp, Homo sapiens
caagttcaaaattcca

SEQ ID NO: 22213 - DNA, 15 bp, Homo sapiens
caagatccaattcca

SEQ ID NO: 22214 - DNA, 18 bp, Homo sapiens
cgtgtcctatcaattcca

SEQ ID NO: 22215 - DNA, 18 bp, Homo sapiens
cgtgtgacaccaattcca

SEQ ID NO: 22216 - DNA, 21 bp, Homo sapiens
ccagttcatcaattaattcca

SEQ ID NO: 22217 - DNA, 69 bp, Sugarcane yellow leaf virus
agcccgggttttgtttcaagcacaaaacaaaagagagatagctttgtggagagctatcccttcaaagcc

SEQ ID NO: 22218 - DNA, 24 bp, Sugarcane yellow leaf virus
gttttgtttcaagcacaaaacaaa

SEQ ID NO: 22219 - DNA, 19 bp, Homo sapiens
ttaacccgagcacaaaaca

SEQ ID NO: 22220 - DNA, 17 bp, Homo sapiens
ttttggtaagcacaaaa

SEQ ID NO: 22221 - DNA, 19 bp, Homo sapiens
gttttttaaacacaaaaca

SEQ ID NO: 22222 - DNA, 22 bp, Homo sapiens
gttatgtttatcacaaaacaaa

SEQ ID NO: 22223 - DNA, 18 bp, Homo sapiens
cctcaagcataaagcaaa

SEQ ID NO: 22224 - DNA, 27 bp, Homo sapiens
attttgtttcagtcacactgaaacaaa

SEQ ID NO: 22225 - DNA, 27 bp, Homo sapiens
attttgtttcagtcacattgaaacaaa

SEQ ID NO: 22226 - DNA, 21 bp, Homo sapiens
ttttcttttaagcacaaagca

SEQ ID NO: 22227 - DNA, 18 bp, Homo sapiens
tttgtttcagagcggcaa

SEQ ID NO: 22228 - DNA, 21 bp, Homo sapiens
attttgttaaaacaaaacaaa

SEQ ID NO: 22229 - DNA, 20 bp, Homo sapiens
gcacattcaagcacagaaca

SEQ ID NO: 22230 - DNA, 18 bp, Homo sapiens
gctttgtttcatgaaaca

SEQ ID NO: 22231 - DNA, 19 bp, Homo sapiens
tgctttcaagcataaaaca

SEQ ID NO: 22232 - DNA, 18 bp, Homo sapiens
tgcttaagtacaaaacaa

SEQ ID NO: 22233 - DNA, 18 bp, Homo sapiens
ttatttttaagcacaaaa

SEQ ID NO: 22234 - DNA, 18 bp, Homo sapiens
gttatgtttcaaatacaa

SEQ ID NO: 22235 - DNA, 21 bp, Homo sapiens
gtctcctcaagcacaggacaa

SEQ ID NO: 22236 - DNA, 21 bp, Homo sapiens
gtttagcactggcacaaaaca

SEQ ID NO: 22237 - DNA, 18 bp, Homo sapiens
gttttgtttcaagacaaa

SEQ ID NO: 22238 - DNA, 26 bp, Homo sapiens
ttttgtttcaaacattttgaaacaaa

SEQ ID NO: 22239 - DNA, 18 bp, Homo sapiens
attttgtttcacacaaaa

SEQ ID NO: 22240 - DNA, 17 bp, Homo sapiens
ttttgtttcaagacaaa

SEQ ID NO: 22241 - DNA, 20 bp, Homo sapiens
ccgttcaggcacaaaacaaa

SEQ ID NO: 22242 - DNA, 17 bp, Homo sapiens
gttttgttttgagacaa

SEQ ID NO: 22243 - DNA, 24 bp, Homo sapiens
gctttgtttcactataaagacaaa

SEQ ID NO: 22244 - DNA, 19 bp, Homo sapiens
attttgtttcaagaacaaa

SEQ ID NO: 22245 - DNA, 20 bp, Homo sapiens
gttttatcatcaaagacaaa

SEQ ID NO: 22246 - DNA, 19 bp, Homo sapiens
gttttgtgagcacaaaaca

SEQ ID NO: 22247 - DNA, 18 bp, Homo sapiens
gttttgtttttagcacaa

SEQ ID NO: 22248 - DNA, 19 bp, Homo sapiens
gctttgttttgggacacaa

SEQ ID NO: 22249 - DNA, 19 bp, Homo sapiens
attttgtttctggaaagca

SEQ ID NO: 22250 - DNA, 24 bp, Homo sapiens
gttttatttcattgtaaaaacaaa

SEQ ID NO: 22251 - DNA, 22 bp, Homo sapiens
gttttgcttttccacgaaacaa

SEQ ID NO: 22252 - DNA, 17 bp, Homo sapiens
gttttgttcaagctcaa

SEQ ID NO: 22253 - DNA, 24 bp, Homo sapiens
gttttgtttagagcaaccaccaaa

SEQ ID NO: 22254 - DNA, 21 bp, Homo sapiens
ctttgtttcgcagcacagaca

SEQ ID NO: 22255 - DNA, 18 bp, Homo sapiens
gttttgttttcagccaaa

SEQ ID NO: 22256 - DNA, 21 bp, Homo sapiens
ctgtttcaagtacaagacaaa

SEQ ID NO: 22257 - DNA, 19 bp, Homo sapiens
gttttacgacagcacaaaa

SEQ ID NO: 22258 - DNA, 91 bp, Cowpox virus
tacatttttctatgttacttttagttcgtatcagattatattctagagcttcctgactactaacgaaattaatatgatttggccaaatgta

SEQ ID NO: 22259 - DNA, 24 bp, Cowpox virus
tctatgttacttttagttcgtatc

SEQ ID NO: 22260 - DNA, 20 bp, Homo sapiens
tctgtgttactttctggctc

SEQ ID NO: 22261 - DNA, 18 bp, Homo sapiens
tccatgttatttttagtc

SEQ ID NO: 22262 - DNA, 17 bp, Homo sapiens
tctatgctacttgctgt

SEQ ID NO: 22263 - DNA, 21 bp, Homo sapiens
tatgtttcttttataggtatc

SEQ ID NO: 22264 - DNA, 19 bp, Homo sapiens
tctatgttacttttgaatc

SEQ ID NO: 22265 - DNA, 91 bp, Human herpesvirus 6
gctgggcctaattacgctgtccgcctgttccacgcgcgtgtcggctacgacacgctggagcagcttccacgcgacagatccgtctctcagc

SEQ ID NO: 22266 - DNA, 24 bp, Human herpesvirus 6
acgctgtccgcctgttccacgcgc

SEQ ID NO: 22267 - DNA, 20 bp, Homo sapiens
ctgtccgcccgcccgcgcgc

SEQ ID NO: 22268 - DNA, 16 bp, Homo sapiens
acgcgtccgcccacgc

SEQ ID NO: 22269 - DNA, 17 bp, Homo sapiens
ctgtctgcggttccacg

SEQ ID NO: 22270 - DNA, 18 bp, Homo sapiens
gctgtccgtctgtctcgc

SEQ ID NO: 22271 - DNA, 21 bp, Homo sapiens
acgctggttcgcctgacgcgc

SEQ ID NO: 22272 - DNA, 17 bp, Homo sapiens
cgcgtccgcctcccgcg

SEQ ID NO: 22273 - DNA, 18 bp, Homo sapiens
cgccgtccgcctgagcgc

SEQ ID NO: 22274 - DNA, 22 bp, Homo sapiens
acactgtctgtactccatgcgc

SEQ ID NO: 22275 - DNA, 20 bp, Homo sapiens
gctgcccggagttttcgcgc

SEQ ID NO: 22276 - DNA, 19 bp, Homo sapiens
acgctgcccgtagcgtgcg

SEQ ID NO: 22277 - DNA, 21 bp, Homo sapiens
cgttgctgcctgttcccgtgc

SEQ ID NO: 22278 - DNA, 16 bp, Homo sapiens
gctgttcctccacgcg

SEQ ID NO: 22279 - DNA, 63 bp, Human herpesvirus 6
ggctgacaggatcgtccccttggctcgtgatcctacaagggcagggggggtctctgttctgcc

SEQ ID NO: 22280 - DNA, 24 bp, Human herpesvirus 6
tgacaggatcgtccccttggctcg

SEQ ID NO: 22281 - DNA, 19 bp, Homo sapiens
tgataggatcgcccccttg

SEQ ID NO: 22282 - DNA, 21 bp, Homo sapiens
tgacaggatttttccatgttg

SEQ ID NO: 22283 - DNA, 19 bp, Homo sapiens
acagccactctttggctcg

SEQ ID NO: 22284 - DNA, 19 bp, Homo sapiens
tgcgggaacatccttggct

SEQ ID NO: 22285 - DNA, 18 bp, Homo sapiens
tggcaggttgtccccccg

SEQ ID NO: 22286 - DNA, 22 bp, Homo sapiens
tggcaggatcgttgcccttcac

SEQ ID NO: 22287 - DNA, 22 bp, Homo sapiens
tgacagggtcgtccctggcccg

SEQ ID NO: 22288 - DNA, 19 bp, Homo sapiens
tgaaaccatcctcttggct

SEQ ID NO: 22289 - DNA, 19 bp, Homo sapiens
taacaggattgtttccacg

SEQ ID NO: 22290 - DNA, 20 bp, Homo sapiens
gaagggttcagaccttggct

SEQ ID NO: 22291 - DNA, 19 bp, Homo sapiens
tgacaggatttccccaagc

SEQ ID NO: 22292 - DNA, 22 bp, Homo sapiens
tgacaggaatgtcctctacact

SEQ ID NO: 22293 - DNA, 18 bp, Homo sapiens
tgacaagggtccttggct

SEQ ID NO: 22294 - DNA, 19 bp, Homo sapiens
agatgtttccctttggctc

SEQ ID NO: 22295 - DNA, 69 bp, Human herpesvirus 6
cgtgccgggaccccgacaaggccttcttgccgacattactggcgagaagcgcccgacgcggcctggccg

SEQ ID NO: 22296 - DNA, 24 bp, Human herpesvirus 6
cgagaagcgcccgacgcggcctgg

SEQ ID NO: 22297 - DNA, 22 bp, Homo sapiens
cgagaagcgccccgcgtccccg

SEQ ID NO: 22298 - DNA, 16 bp, Homo sapiens
cgagagcgcccggcgg

SEQ ID NO: 22299 - DNA, 21 bp, Homo sapiens
cgggagcgaggagcggcctgg

SEQ ID NO: 22300 - DNA, 21 bp, Homo sapiens
cggggagcatctacggcctgg

SEQ ID NO: 22301 - DNA, 21 bp, Homo sapiens
gagaagcaccgtggggcctgg

SEQ ID NO: 22302 - DNA, 16 bp, Homo sapiens
cgagaagcacccgcct

SEQ ID NO: 22303 - DNA, 21 bp, Homo sapiens
cgggaagcctcgcgcgcctgg

SEQ ID NO: 22304 - DNA, 18 bp, Homo sapiens
aggggcgctcgcggcctg

SEQ ID NO: 22305 - DNA, 18 bp, Homo sapiens
gaggggcgctccggcctg

SEQ ID NO: 22306 - DNA, 20 bp, Homo sapiens
agaagcgcctgacttactgg

SEQ ID NO: 22307 - DNA, 17 bp, Homo sapiens
cgaggcgccgcggcctg

SEQ ID NO: 22308 - DNA, 22 bp, Homo sapiens
gagaggcgtccctgcagcctgg

SEQ ID NO: 22309 - DNA, 19 bp, Homo sapiens
gaagtgctacacagcctgg

SEQ ID NO: 22310 - DNA, 21 bp, Homo sapiens
cggggagcgcgggcggcctgg

SEQ ID NO: 22311 - DNA, 20 bp, Homo sapiens
gaggcgggtcagcggcctgg

SEQ ID NO: 22312 - DNA, 21 bp, Homo sapiens
gagaagccctgggcagcctgg

SEQ ID NO: 22313 - DNA, 22 bp, Homo sapiens
cgggaacgcccgactggcctgg

SEQ ID NO: 22314 - DNA, 19 bp, Homo sapiens
gaggctcgggccggcctgg

SEQ ID NO: 22315 - DNA, 21 bp, Homo sapiens
gaggagggggcggcggcctgg

SEQ ID NO: 22316 - DNA, 19 bp, Homo sapiens
gaggggccatgcggcctgg

SEQ ID NO: 22317 - DNA, 24 bp, Homo sapiens
ccaggagcgcccggcccagcctgg

SEQ ID NO: 22318 - DNA, 16 bp, Homo sapiens
agcgcccgggcgccgg

SEQ ID NO: 22319 - DNA, 21 bp, Homo sapiens
cggggaaagggcgcggcctgg

SEQ ID NO: 22320 - DNA, 22 bp, Homo sapiens
cggggaccccggtgcggcctgg

SEQ ID NO: 22321 - DNA, 18 bp, Homo sapiens
gagtggcatgcggcctgg

SEQ ID NO: 22322 - DNA, 17 bp, Homo sapiens
gaggagcgcgcagcctg

SEQ ID NO: 22323 - DNA, 20 bp, Homo sapiens
cgagaagcattcggtgccca

SEQ ID NO: 22324 - DNA, 23 bp, Homo sapiens
gaggggagggggacgcggcctgg

SEQ ID NO: 22325 - DNA, 19 bp, Homo sapiens
cgaggcgccgcgcggcctg

SEQ ID NO: 22326 - DNA, 19 bp, Homo sapiens
gagaagcgcttgacactgg

SEQ ID NO: 22327 - DNA, 21 bp, Homo sapiens
cggggagcgcccggccccccg

SEQ ID NO: 22328 - DNA, 26 bp, Homo sapiens
cgagaagcgtctcgtgtcgaatttgg

SEQ ID NO: 22329 - DNA, 21 bp, Homo sapiens
cgaggagagcccccagcctgg

SEQ ID NO: 22330 - DNA, 18 bp, Homo sapiens
gcgcgtgaggcggcctgg

SEQ ID NO: 22331 - DNA, 22 bp, Homo sapiens
ccagaagtggagggcggcctgg

SEQ ID NO: 22332 - DNA, 24 bp, Homo sapiens
cgagaagcggcccacgcggcctgg

SEQ ID NO: 22333 - DNA, 20 bp, Homo sapiens
gagaagcatcattggcctgg

SEQ ID NO: 22334 - DNA, 19 bp, Homo sapiens
cgagaggccgctcgacctg

SEQ ID NO: 22335 - DNA, 23 bp, Homo sapiens
cgggaaggcgaggggcggcctgg

SEQ ID NO: 22336 - DNA, 24 bp, Homo sapiens
cgaggagcgcccagtgcacgctgg

SEQ ID NO: 22337 - DNA, 22 bp, Homo sapiens
gaggagctgcccaccagcctgg

SEQ ID NO: 22338 - DNA, 80 bp, Human herpesvirus 6
ctgcatctgggatcgcgctcggagctctcccaccccgtgttggagtgggagagcacagagctggtcctgacggactggag

SEQ ID NO: 22339 - DNA, 24 bp, Human herpesvirus 6
tgggatcgcgctcggagctctccc

SEQ ID NO: 22340 - DNA, 19 bp, Homo sapiens
tgggatcgtggcgctttcc

SEQ ID NO: 22341 - DNA, 28 bp, Homo sapiens
tgggatcacgtttcttctgggagagctc

SEQ ID NO: 22342 - DNA, 16 bp, Homo sapiens
tgggacgcgggctctc

SEQ ID NO: 22343 - DNA, 21 bp, Homo sapiens
tggggtccagacagagctctc

SEQ ID NO: 22344 - DNA, 22 bp, Homo sapiens
cgggattcaggggagctcttcc

SEQ ID NO: 22345 - DNA, 19 bp, Homo sapiens
tgggatcatgctattctct

SEQ ID NO: 22346 - DNA, 23 bp, Homo sapiens
tgggatcctgcccaggctctccc

SEQ ID NO: 22347 - DNA, 20 bp, Homo sapiens
tgggatcctgctcggcgctc

SEQ ID NO: 22348 - DNA, 19 bp, Homo sapiens
tgggattgcctggaactct

SEQ ID NO: 22349 - DNA, 21 bp, Homo sapiens
tgggatcgtgctccagcttcc

SEQ ID NO: 22350 - DNA, 18 bp, Homo sapiens
aggatctcggagctttcc

SEQ ID NO: 22351 - DNA, 18 bp, Homo sapiens
tgggatcggtgcttctcc

SEQ ID NO: 22352 - DNA, 18 bp, Homo sapiens
tggggtctccaagctctc

SEQ ID NO: 22353 - DNA, 20 bp, Homo sapiens
tgggatcacgttttcctctc

SEQ ID NO: 22354 - DNA, 18 bp, Homo sapiens
tgggacgcggcgctctcc

SEQ ID NO: 22355 - DNA, 23 bp, Homo sapiens
tggggtcccgctgccgctctccc

SEQ ID NO: 22356 - DNA, 66 bp, Human herpesvirus 6
gcgggggggcgacgcagacgtacggcggcagaggccgacatgattcctgcccgtcgatccccctgt

SEQ ID NO: 22357 - DNA, 24 bp, Human herpesvirus 6
cgacatgattcctgcccgtcgatc

SEQ ID NO: 22358 - DNA, 18 bp, Homo sapiens
gacatgattcctcctgtc

SEQ ID NO: 22359 - DNA, 21 bp, Homo sapiens
cgacatgattctgaaggtgat

SEQ ID NO: 22360 - DNA, 18 bp, Homo sapiens
gacgtgatccctgctcgc

SEQ ID NO: 22361 - DNA, 20 bp, Homo sapiens
cgactgattcctgctacctc

SEQ ID NO: 22362 - DNA, 21 bp, Homo sapiens
gacatgatttctgcccaagtc

SEQ ID NO: 22363 - DNA, 21 bp, Homo sapiens
acgaaatccctgcctgttgat

SEQ ID NO: 22364 - DNA, 73 bp, Human herpesvirus 6
cctctgccaccgatgacgcccgtcgacgacgagccgtccgtccgccctcggtgtccgccaggtcccgcggagg

SEQ ID NO: 22365 - DNA, 24 bp, Human herpesvirus 6
tccgtccgccctcggtgtccgcca

SEQ ID NO: 22366 - DNA, 22 bp, Homo sapiens
cctgtccgtcgtccgtccgtca

SEQ ID NO: 22367 - DNA, 18 bp, Homo sapiens
tctgccctcggttcgcca

SEQ ID NO: 22368 - DNA, 17 bp, Homo sapiens
tcagtccgcccgtccgc

SEQ ID NO: 22369 - DNA, 22 bp, Homo sapiens
tccgtctgcccgcctgctcgcc

SEQ ID NO: 22370 - DNA, 21 bp, Homo sapiens
tccgcccgcccgggatccgcc

SEQ ID NO: 22371 - DNA, 16 bp, Homo sapiens
tccctccgccctccgc

SEQ ID NO: 22372 - DNA, 23 bp, Homo sapiens
tccgtcagtccgtccgtccgcca

SEQ ID NO: 22373 - DNA, 17 bp, Homo sapiens
tccgtccgccgtccgcc

SEQ ID NO: 22374 - DNA, 18 bp, Homo sapiens
gtccacccttcactgtgc

SEQ ID NO: 22375 - DNA, 23 bp, Homo sapiens
tccgccgccgggctcgtccgcca

SEQ ID NO: 22376 - DNA, 21 bp, Homo sapiens
gtttggctctgggatccgcca

SEQ ID NO: 22377 - DNA, 19 bp, Homo sapiens
tccgtccagctttgttccg

SEQ ID NO: 22378 - DNA, 23 bp, Homo sapiens
tcctctgttcccactgtccgcca

SEQ ID NO: 22379 - DNA, 15 bp, Homo sapiens
tcctccgccctccgc

SEQ ID NO: 22380 - DNA, 17 bp, Homo sapiens
ccgtccgctctagccgc

SEQ ID NO: 22381 - DNA, 23 bp, Homo sapiens
tccgtccgtccgttcgcccgtca

SEQ ID NO: 22382 - DNA, 22 bp, Homo sapiens
cccgtccgtccttgcctctgcc

SEQ ID NO: 22383 - DNA, 24 bp, Homo sapiens
tctttctgttctcagcctctgcca

SEQ ID NO: 22384 - DNA, 17 bp, Homo sapiens
cgtctgccctctgacca

SEQ ID NO: 22385 - DNA, 16 bp, Homo sapiens
cgtccgccctcgctcc

SEQ ID NO: 22386 - DNA, 19 bp, Homo sapiens
ccgtccgccctcgaggccg

SEQ ID NO: 22387 - DNA, 19 bp, Homo sapiens
tcctccgcccttgggtgcc

SEQ ID NO: 22388 - DNA, 23 bp, Homo sapiens
tcctctgttttccgtatccgcca

SEQ ID NO: 22389 - DNA, 22 bp, Homo sapiens
tccgtccgtcctggaaggtcca

SEQ ID NO: 22390 - DNA, 19 bp, Homo sapiens
ccgtctgcctttggttccg

SEQ ID NO: 22391 - DNA, 18 bp, Homo sapiens
gcccgccttggcctgcca

SEQ ID NO: 22392 - DNA, 19 bp, Homo sapiens
tctctccgccccctccgcc

SEQ ID NO: 22393 - DNA, 22 bp, Homo sapiens
tccgtccgccctcgtggctccg

SEQ ID NO: 22394 - DNA, 16 bp, Homo sapiens
tccgtccgtccgtccg

SEQ ID NO: 22395 - DNA, 21 bp, Homo sapiens
tccgtccgtccgttggtccca

SEQ ID NO: 22396 - DNA, 72 bp, Rana tigrina ranavirus
cgacatctgaggctcatacttaatctatcagacggtgttgtctgaaagattattacctctgagaggatatcg

SEQ ID NO: 22397 - DNA, 24 bp, Rana tigrina ranavirus
tgaaagattattacctctgagagg

SEQ ID NO: 22398 - DNA, 17 bp, Homo sapiens
gaaaggtctctgagagg

SEQ ID NO: 22399 - DNA, 20 bp, Homo sapiens
tgagagattttacctttacc

SEQ ID NO: 22400 - DNA, 22 bp, Homo sapiens
tggaagataaaacactgagagg

SEQ ID NO: 22401 - DNA, 17 bp, Homo sapiens
tgaaagatagtctgagg

SEQ ID NO: 22402 - DNA, 18 bp, Homo sapiens
tgaaggattttgcctctg

SEQ ID NO: 22403 - DNA, 23 bp, Homo sapiens
tggcagaagagccctctgagagg

SEQ ID NO: 22404 - DNA, 23 bp, Homo sapiens
tgacaaattttacttctgagagg

SEQ ID NO: 22405 - DNA, 21 bp, Homo sapiens
tgaggaagactttctgagagg

SEQ ID NO: 22406 - DNA, 17 bp, Homo sapiens
gagagaccctctgaggg

SEQ ID NO: 22407 - DNA, 20 bp, Homo sapiens
tgagagagctcctctgaggg

SEQ ID NO: 22408 - DNA, 20 bp, Homo sapiens
tgagagaagtttctgagagg

SEQ ID NO: 22409 - DNA, 18 bp, Homo sapiens
agaagtacctctgggagg

SEQ ID NO: 22410 - DNA, 20 bp, Homo sapiens
aggccactgcttctgagagg

SEQ ID NO: 22411 - DNA, 21 bp, Homo sapiens
gagagaaaaccctctgagagg

SEQ ID NO: 22412 - DNA, 29 bp, Homo sapiens
tgaaagattgttacattagcctctcagag

SEQ ID NO: 22413 - DNA, 23 bp, Homo sapiens
tgagaattattagctgtgggagg

SEQ ID NO: 22414 - DNA, 118 bp, Rana tigrina ranavirus
ggatagcaacatttataggttctctctgaaagaggtttaaggatagtaaaaatatggatagtaatcttaagatagatattatcttaatatatagtctttaccctctctcatgctctct

SEQ ID NO: 22415 - DNA, 24 bp, Rana tigrina ranavirus
tattatcttaatatatagtcttta

SEQ ID NO: 22416 - DNA, 20 bp, Homo sapiens
tattgctcttaatagtcttt

SEQ ID NO: 22417 - DNA, 21 bp, Homo sapiens
tattatcttaataattcttta

SEQ ID NO: 22418 - DNA, 22 bp, Homo sapiens
ttatcttcaattgcagtcttta

SEQ ID NO: 22419 - DNA, 22 bp, Homo sapiens
cattatcttagagaagtcttta

SEQ ID NO: 22420 - DNA, 68 bp, Human herpesvirus 6B
tgcgcatgaaaatatcattaaattgttttaaacattcttaaattcaatttaaaataatttttgtagca

SEQ ID NO: 22421 - DNA, 68 bp, Human herpesvirus 6B; identical to SEQ ID NO: 22420

SEQ ID NO: 22422 - DNA, 21 bp, Homo sapiens
tgagaatatcatttctgtttt

SEQ ID NO: 22423 - DNA, 24 bp, Homo sapiens
tgaaaacgtcattaaaatcagctt

SEQ ID NO: 22424 - DNA, 20 bp, Homo sapiens
aaaacatttaaattgtttta

SEQ ID NO: 22425 - DNA, 22 bp, Homo sapiens
tgaagaatcattaagcctgttt

SEQ ID NO: 22426 - DNA, 24 bp, Homo sapiens
tgaaaattatcattaatgatttta

SEQ ID NO: 22427 - DNA, 21 bp, Homo sapiens
gaaaatatcgttaccccattt

SEQ ID NO: 22428 - DNA, 20 bp, Homo sapiens
aaaattcacaaaattgtttt

SEQ ID NO: 22429 - DNA, 95 bp, Human herpesvirus 6B
tctcgttagcctgggtaggaaagacccaaccgcgatacccactgatctttaactttatgagaaaaacaggaattgcggtttcccccattagcaga

SEQ ID NO: 22430 - DNA, 24 bp, Human herpesvirus 6B
aggaattgcggtttcccccattag

SEQ ID NO: 22431 - DNA, 16 bp, Homo sapiens
gaattggctcccatta

SEQ ID NO: 22432 - DNA, 17 bp, Homo sapiens
ggaatacttcccccatt

SEQ ID NO: 22433 - DNA, 22 bp, Homo sapiens
aggagctggagatccccattag

SEQ ID NO: 22434 - DNA, 26 bp, Homo sapiens
agcaattacagtgttttcttcattag

SEQ ID NO: 22435 - DNA, 20 bp, Homo sapiens
ggaatatatttccccattag

SEQ ID NO: 22436 - DNA, 19 bp, Homo sapiens
agggactgtggctctcatt

SEQ ID NO: 22437 - DNA, 22 bp, Homo sapiens
ggaattgccttatcctcattag

SEQ ID NO: 22438 - DNA, 21 bp, Homo sapiens
agatgcagtttttcctattag

SEQ ID NO: 22439 - DNA, 64 bp, Camelpox virus
ggcggtatcggtacatatacgtaattcaccttcacaaaatacggagtcttcgataataatagcc

SEQ ID NO: 22440 - DNA, 24 bp, Camelpox virus
tatcggtacatatacgtaattcac

SEQ ID NO: 22441 - DNA, 18 bp, Homo sapiens
tatcggtactatgtaatt

SEQ ID NO: 22442 - DNA, 21 bp, Homo sapiens
ggaagtgtatatgtaattcac

SEQ ID NO: 22443 - DNA, 19 bp, Homo sapiens
ggtacataattgtgttcac

SEQ ID NO: 22444 - DNA, 18 bp, Homo sapiens
ggtacatacagaattcac

SEQ ID NO: 22445 - DNA, 16 bp, Homo sapiens
ggtacatatgtgttca

SEQ ID NO: 22446 - DNA, 23 bp, Homo sapiens
tcggtacatatatagggcttcac

SEQ ID NO: 22447 - DNA, 60 bp, Cereal yellow dwarf virus-RPV
gtcgctgaggaaatcacgaagaccattcagtcggtctacaatgatttcctgaagcttgac

SEQ ID NO: 22448 - DNA, 24 bp, Cereal yellow dwarf virus-RPV
tctacaatgatttcctgaagcttg

SEQ ID NO: 22449 - DNA, 19 bp, Homo sapiens
tcaataatgatttcttgaa

SEQ ID NO: 22450 - DNA, 21 bp, Homo sapiens
tctcaaagcccctggagcttg

SEQ ID NO: 22451 - DNA, 19 bp, Homo sapiens
tctcaaagtcctgaagttt

SEQ ID NO: 22452 - DNA, 24 bp, Homo sapiens
tctacatgattaagagaaagcttg

SEQ ID NO: 22453 - DNA, 19 bp, Homo sapiens
cagtgactccccaagcttg

SEQ ID NO: 22454 - DNA, 16 bp, Homo sapiens
tacaatgtcaaagctt

SEQ ID NO: 22455 - DNA, 18 bp, Homo sapiens
acgatttcctggagcttg

SEQ ID NO: 22456 - DNA, 22 bp, Homo sapiens
tctgccagctccctgaagcttg

SEQ ID NO: 22457 - DNA, 21 bp, Homo sapiens
tctcaatgattctgaagtttg

SEQ ID NO: 22458 - DNA, 15 bp, Homo sapiens
tccacaatgagaagt

SEQ ID NO: 22459 - DNA, 84 bp, Gallid herpesvirus 3
gggtcgcggcccgaaggcggagatgccgagctcggccagttcgatgccctcggtacccatcccccttccacccgtcggcgaccc

SEQ ID NO: 22460 - DNA, 24 bp, Gallid herpesvirus 3
tacccatcccccttccacccgtcg

SEQ ID NO: 22461 - DNA, 22 bp, Homo sapiens
cctcctgcttttctacccgtcg

SEQ ID NO: 22462 - DNA, 19 bp, Homo sapiens
cacctgttctccttccacc

SEQ ID NO: 22463 - DNA, 18 bp, Homo sapiens
tacccatcctccatcccg

SEQ ID NO: 22464 - DNA, 18 bp, Homo sapiens
cctcatcccctcccctgt

SEQ ID NO: 22465 - DNA, 17 bp, Homo sapiens
tcccccttccacacacg

SEQ ID NO: 22466 - DNA, 22 bp, Homo sapiens
tacttaccccccttctccttcg

SEQ ID NO: 22467 - DNA, 19 bp, Homo sapiens
ccatccccctttcaccacg

SEQ ID NO: 22468 - DNA, 23 bp, Homo sapiens
cccgcccgcgcacccgcccgtcg

SEQ ID NO: 22469 - DNA, 22 bp, Homo sapiens
cccacccccttccaccccctcg

SEQ ID NO: 22470 - DNA, 23 bp, Homo sapiens
cacccattcctagggcctcgtcg

SEQ ID NO: 22471 - DNA, 19 bp, Homo sapiens
taccctcccccttctgcac

SEQ ID NO: 22472 - DNA, 18 bp, Homo sapiens
ccatcccccaacccgtcg

SEQ ID NO: 22473 - DNA, 77 bp, Cereal yellow dwarf virus-RPV
gttctcccgttgctattgcaacatccccggacacaagtgtcccttctgggatgtctcagcaagacgtgatgcagaac

SEQ ID NO: 22474 - DNA, 24 bp, Cereal yellow dwarf virus-RPV
tgggatgtctcagcaagacgtgat

SEQ ID NO: 22475 - DNA, 22 bp, Homo sapiens
tggggggtctcagcactgtgat

SEQ ID NO: 22476 - DNA, 19 bp, Homo sapiens
tggggtgtcccagcacacg

SEQ ID NO: 22477 - DNA, 19 bp, Homo sapiens
tgggtgtttcagtagccgt

SEQ ID NO: 22478 - DNA, 20 bp, Homo sapiens
tggaatgttttagcagggac

SEQ ID NO: 22479 - DNA, 18 bp, Homo sapiens
ggatgtggtaagacgtga

SEQ ID NO: 22480 - DNA, 20 bp, Homo sapiens
tgggatgtctgtggcagaca

SEQ ID NO: 22481 - DNA, 23 bp, Homo sapiens
tgggatgtcccagcacctttgat

SEQ ID NO: 22482 - DNA, 25 bp, Homo sapiens
tgggatgtcatcagcgaagcgagtg

SEQ ID NO: 22483 - DNA, 65 bp, Cereal yellow dwarf virus-RPV
gatcgatcgcaccgtgcaagcgtacagcaattgcaaaactaatgtaccacggtgcacacgagatc

SEQ ID NO: 22484 - DNA, 21 bp, Cereal yellow dwarf virus-RPV
taccacggtgcacacgagatc

SEQ ID NO: 22485 - DNA, 21 bp, Homo sapiens
taccacggttcctacagagat

SEQ ID NO: 22486 - DNA, 18 bp, Homo sapiens
tactcggtacacgggatc

SEQ ID NO: 22487 - DNA, 18 bp, Homo sapiens
taccacggtgtgccagat

SEQ ID NO: 22488 - DNA, 16 bp, Homo sapiens
ccacacatacgagatc

SEQ ID NO: 22489 - DNA, 19 bp, Homo sapiens
ccacggtgcacctccgatc

SEQ ID NO: 22490 - DNA, 19 bp, Homo sapiens
ccaataggcacacgagatc

SEQ ID NO: 22491 - DNA, 79 bp, Variola virus
gattttttatgattttgtgcgacagtaatacatttttctatgttacttttagttcgtattagattatattctagagatt

SEQ ID NO: 22492 - DNA, 24 bp, Variola virus
ttagttcgtattagattatattct

SEQ ID NO: 22493 - DNA, 22 bp, Homo sapiens
ttagtttgtactaatacattct

SEQ ID NO: 22494 - DNA, 61 bp, Cereal yellow dwarf virus-RPV
tcggattatccaccgaggaccaagtcgaaagttttatcaatgtcctcgcggataccgctgg

SEQ ID NO: 22495 - DNA, 24 bp, Cereal yellow dwarf virus-RPV
accgaggaccaagtcgaaagtttt

SEQ ID NO: 22496 - DNA, 20 bp, Homo sapiens
gaggttatcatcaaagtttt

SEQ ID NO: 22497 - DNA, 22 bp, Homo sapiens
ccaggaccgacaggaaagtttt

SEQ ID NO: 22498 - DNA, 21 bp, Homo sapiens
accaagggtcggccaagtttt

SEQ ID NO: 22499 - DNA, 20 bp, Homo sapiens
cctgggactcccaaagtttt

SEQ ID NO: 22500 - DNA, 19 bp, Homo sapiens
gaggatctcataaagtttt

SEQ ID NO: 22501 - DNA, 62 bp, Cereal yellow dwarf virus-RPV
agcccggggtccaaaagagtgggtcgtacaacacgtcatctacgaactctaggatccgggtt

SEQ ID NO: 22502 - DNA, 24 bp, Cereal yellow dwarf virus-RPV
tccaaaagagtgggtcgtacaaca

SEQ ID NO: 22503 - DNA, 17 bp, Homo sapiens
tccgaaaagtgggagta

SEQ ID NO: 22504 - DNA, 17 bp, Homo sapiens
tccaagtggagtcatac

SEQ ID NO: 22505 - DNA, 20 bp, Homo sapiens
cctggaagagtgggccccca

SEQ ID NO: 22506 - DNA, 21 bp, Homo sapiens
caggaagagtggtcaaagcaa

SEQ ID NO: 22507 - DNA, 21 bp, Homo sapiens
tccaaaagggcgggaggagca

SEQ ID NO: 22508 - DNA, 19 bp, Homo sapiens
tccaaaaaggtgattggca

SEQ ID NO: 22509 - DNA, 19 bp, Homo sapiens
aaaagaatggagagcaaca

SEQ ID NO: 22510 - DNA, 17 bp, Homo sapiens
aagagtatgatacaaca

SEQ ID NO: 22511 - DNA, 18 bp, Homo sapiens
tccaaaagaggttccaca

SEQ ID NO: 22512 - DNA, 19 bp, Homo sapiens
tcctgagaggctgtacaac

SEQ ID NO: 22513 - DNA, 20 bp, Homo sapiens
tcacaggagagtgggtgtca

SEQ ID NO: 22514 - DNA, 18 bp, Homo sapiens
tccaaagagtgggtcgca

SEQ ID NO: 22515 - DNA, 21 bp, Homo sapiens
tccaaaagagatggtgttaca

SEQ ID NO: 22516 - DNA, 20 bp, Homo sapiens
aaaagatgttctgtacaaca

SEQ ID NO: 22517 - DNA, 20 bp, Homo sapiens
aaaaggtgaatagtacaaca

SEQ ID NO: 22518 - DNA, 16 bp, Homo sapiens
tcaaaaagagtgcaac

SEQ ID NO: 22519 - DNA, 18 bp, Homo sapiens
tccaagagagtgggcaat

SEQ ID NO: 22520 - DNA, 18 bp, Homo sapiens
tccaaaaggccaggtaca

SEQ ID NO: 22521 - DNA, 17 bp, Homo sapiens
tccgaagggtggacgac

SEQ ID NO: 22522 - DNA, 19 bp, Homo sapiens
tccagagggtgggaccaca

SEQ ID NO: 22523 - DNA, 20 bp, Homo sapiens
tccaaaaagtgggaagggca

SEQ ID NO: 22524 - DNA, 21 bp, Homo sapiens
caagggagtgaatgtgtacaa

SEQ ID NO: 22525 - DNA, 18 bp, Homo sapiens
tccagaaagtgaaacaac

SEQ ID NO: 22526 - DNA, 19 bp, Homo sapiens
tccggagcgggtgtgaaca

SEQ ID NO: 22527 - DNA, 20 bp, Homo sapiens
tccaaaagtgtgatgcaata

SEQ ID NO: 22528 - DNA, 19 bp, Homo sapiens
aaagatctgttgtacaaca

SEQ ID NO: 22529 - DNA, 19 bp, Homo sapiens
tccaggagggttgccaaca

SEQ ID NO: 22530 - DNA, 20 bp, Homo sapiens
tctaaaagagagagcacaac

SEQ ID NO: 22531 - DNA, 21 bp, Homo sapiens
cccaggggagtgggccggaca

SEQ ID NO: 22532 - DNA, 20 bp, Homo sapiens
caggaagggtgggtcattca

SEQ ID NO: 22533 - DNA, 18 bp, Homo sapiens
aaaagggtctgtacaaca

SEQ ID NO: 22534 - DNA, 23 bp, Homo sapiens
tccaaaagtgtgggccaagtcaa

SEQ ID NO: 22535 - DNA, 20 bp, Homo sapiens
caggagagtgggcacagaca

SEQ ID NO: 22536 - DNA, 68 bp, Cereal yellow dwarf virus-RPV
tgccctcgaagcgccagatacagatttgagcaagtataaagatctgggcttcaaagtcgaggttagca

SEQ ID NO: 22537 - DNA, 24 bp, Cereal yellow dwarf virus-RPV
tcgaagcgccagatacagatttga

SEQ ID NO: 22538 - DNA, 20 bp, Homo sapiens
tcgaagtccaggtacagact

SEQ ID NO: 22539 - DNA, 16 bp, Homo sapiens
gaaccttacagatttg

SEQ ID NO: 22540 - DNA, 19 bp, Homo sapiens
tcggagcatttcagatttg

SEQ ID NO: 22541 - DNA, 63 bp, Cereal yellow dwarf virus-RPV
aagcgttatcacactgcgacgtgctgacaaaacccacgttggttttgccgtgtgcattcgctt

SEQ ID NO: 22542 - DNA, 24 bp, Cereal yellow dwarf virus-RPV
tatcacactgcgacgtgctgacaa

SEQ ID NO: 22543 - DNA, 23 bp, Homo sapiens
tatcctactgcatgaactgacaa

SEQ ID NO: 22544 - DNA, 24 bp, Homo sapiens
tatcacactctggggactgtggtg

SEQ ID NO: 22545 - DNA, 16 bp, Homo sapiens
tcacacagcactgaca

SEQ ID NO: 22546 - DNA, 16 bp, Homo sapiens
tatcacactacctgcc

SEQ ID NO: 22547 - DNA, 16 bp, Homo sapiens
cacacctgtgctgaca

SEQ ID NO: 22548 - DNA, 18 bp, Homo sapiens
tcacactgtggcctgaca

SEQ ID NO: 22549 - DNA, 19 bp, Homo sapiens
tatcacactgtaccccata

SEQ ID NO: 22550 - DNA, 19 bp, Homo sapiens
tcacactgagatgtaagac

SEQ ID NO: 22551 - DNA, 17 bp, Homo sapiens
tatcacactgttgctga

SEQ ID NO: 22552 - DNA, 81 bp, Equine rhinitis B virus
gtggtagcgctgtgtgagttggcggtggatccccctcgtggtaacacgagcccccgtggccaaaagcccagtgtttacagc

SEQ ID NO: 22553 - DNA, 24 bp, Equine rhinitis B virus
ggtggatccccctcgtggtaacac

SEQ ID NO: 22554 - DNA, 18 bp, Homo sapiens
ggtggacctccttcagtg

SEQ ID NO: 22555 - DNA, 29 bp, Homo sapiens
gatggatcccctttgtcagtgtgttacca

SEQ ID NO: 22556 - DNA, 23 bp, Homo sapiens
ggttggtcctcctcatccgacac

SEQ ID NO: 22557 - DNA, 21 bp, Homo sapiens
ggtgcatctccgcacagtaac

SEQ ID NO: 22558 - DNA, 22 bp, Homo sapiens
ggaggatccccttctggcggta

SEQ ID NO: 22559 - DNA, 17 bp, Homo sapiens
gatggatctttcgtggt

SEQ ID NO: 22560 - DNA, 16 bp, Homo sapiens
ggtggaccttgtagca

SEQ ID NO: 22561 - DNA, 17 bp, Homo sapiens
gtggatcctctttggca

SEQ ID NO: 22562 - DNA, 21 bp, Homo sapiens
ggagggtccccttgacaacac

SEQ ID NO: 22563 - DNA, 22 bp, Homo sapiens
ggtggatcttcacttatgtggt

SEQ ID NO: 22564 - DNA, 21 bp, Homo sapiens
ggtgaatctcctgcctgacac

SEQ ID NO: 22565 - DNA, 21 bp, Homo sapiens
ggtggatccctcttactcaca

SEQ ID NO: 22566 - DNA, 19 bp, Homo sapiens
ggtagatccccctccaggc

SEQ ID NO: 22567 - DNA, 24 bp, Homo sapiens
gctggatccctttccctgtcgata

SEQ ID NO: 22568 - DNA, 19 bp, Homo sapiens
ggtgggatcccccgtggca

SEQ ID NO: 22569 - DNA, 19 bp, Homo sapiens
ggggtcccccatcatggta

SEQ ID NO: 22570 - DNA, 24 bp, Homo sapiens
ggagggtttccctcgcggtgacac

SEQ ID NO: 22571 - DNA, 18 bp, Homo sapiens
gctggatccctcgtgaca

SEQ ID NO: 22572 - DNA, 22 bp, Homo sapiens
ggtgaatcttccaaaactggca

SEQ ID NO: 22573 - DNA, 99 bp, Human herpesvirus 6B
tagcgaccaaatgcaacataaacttagacaatctatttatctccatgactatcggaacagacaaaattgtaaccacttcgttttgctccttcatcgcta

SEQ ID NO: 22574 - DNA, 24 bp, Human herpesvirus 6B
agacaaaattgtaaccacttcgtt

SEQ ID NO: 22575 - DNA, 19 bp, Homo sapiens
agacaagattgtaacacct

SEQ ID NO: 22576 - DNA, 19 bp, Homo sapiens
gacaaaactgtagtcacct

SEQ ID NO: 22577 - DNA, 20 bp, Homo sapiens
aaacaaaattgtaaccagcc

SEQ ID NO: 22578 - DNA, 23 bp, Homo sapiens
agcaaaactaaaaccattttgtt

SEQ ID NO: 22579 - DNA, 70 bp, Human herpesvirus 6
ggcgacacatttctagacaggctgttgaaaatggactactgttttacatattacccttcttcaaatcgcc

SEQ ID NO: 22580 - DNA, 24 bp, Human herpesvirus 6
tttacatattacccttcttcaaat

SEQ ID NO: 22581 - DNA, 21 bp, Homo sapiens
tttacatatttccccatttca

SEQ ID NO: 22582 - DNA, 17 bp, Homo sapiens
cacacacttcttcaaat

SEQ ID NO: 22583 - DNA, 24 bp, Homo sapiens
ttacatcagtctttttcttcaaat

SEQ ID NO: 22584 - DNA, 19 bp, Homo sapiens
atatcacctttttcttcaa

SEQ ID NO: 22585 - DNA, 17 bp, Homo sapiens
tctactgttcccttctt

SEQ ID NO: 22586 - DNA, 18 bp, Homo sapiens
tttacatacttcttcaaa

SEQ ID NO: 22587 - DNA, 94 bp, Meleagrid herpesvirus 1
ggtatatccctctaaatctgatgtttttgcatggacgaggtattgtgcccccgaccatgtaaaagttgtgattgtaggtcaggatccatatgcc

SEQ ID NO: 22588 - DNA, 24 bp, Meleagrid herpesvirus 1
tctaaatctgatgtttttgcatgg

SEQ ID NO: 22589 - DNA, 19 bp, Homo sapiens
tctagatctgatttttaca

SEQ ID NO: 22590 - DNA, 22 bp, Homo sapiens
tctaaatccaggttttgtgtgg

SEQ ID NO: 22591 - DNA, 19 bp, Homo sapiens
tctgcatctgatgttttca

SEQ ID NO: 22592 - DNA, 20 bp, Homo sapiens
tctaaatctgtatgtttttg

SEQ ID NO: 22593 - DNA, 18 bp, Homo sapiens
tctggatttttttgcatg

SEQ ID NO: 22594 - DNA, 22 bp, Homo sapiens
taaaactgaagtctttgcatgg

SEQ ID NO: 22595 - DNA, 22 bp, Homo sapiens
taaatttgagttcattacatgg

SEQ ID NO: 22596 - DNA, 80 bp, Tupaia herpesvirus
gtcgctgtccccggccgtgagcggagccgtgctctgggacggggaggcggcggccggggacgaagaagagaaggagcggc

SEQ ID NO: 22597 - DNA, 24 bp, Tupaia herpesvirus
tccccggccgtgagcggagccgtg

SEQ ID NO: 22598 - DNA, 19 bp, Homo sapiens
cctggccgtgacacccgtg

SEQ ID NO: 22599 - DNA, 20 bp, Homo sapiens
tccccggcctgggagccccg

SEQ ID NO: 22600 - DNA, 23 bp, Homo sapiens
gggcgtgagcaagctgagctgtg

SEQ ID NO: 22601 - DNA, 21 bp, Homo sapiens
gccctgagcagcggagccgtg

SEQ ID NO: 22602 - DNA, 19 bp, Homo sapiens
tcctcggctgtgacgccgc

SEQ ID NO: 22603 - DNA, 21 bp, Homo sapiens
tccccggctctgctggctgtg

SEQ ID NO: 22604 - DNA, 23 bp, Homo sapiens
tccccagctccagcggggccgtg

SEQ ID NO: 22605 - DNA, 21 bp, Homo sapiens
ccggcggcgcgcggagccgtg

SEQ ID NO: 22606 - DNA, 24 bp, Homo sapiens
tccctggccgccctcggagccgtg

SEQ ID NO: 22607 - DNA, 24 bp, Homo sapiens
tccccggcctcctgttgggctgtg

SEQ ID NO: 22608 - DNA, 22 bp, Homo sapiens
tccccggcctcctcaggctgtg

SEQ ID NO: 22609 - DNA, 19 bp, Homo sapiens
tccccagccggagggtcgt

SEQ ID NO: 22610 - DNA, 96 bp, Tupaia herpesvirus
gcttcgccgcggcccgcgaccgcgcgctgcgcgcggtgccgtggcggccggcgatggtggacacggtggcgggcgcggtggcggacgcggtggagc

SEQ ID NO: 22611 - DNA, 24 bp, Tupaia herpesvirus
gacacggtggcgggcgcggtggcg

SEQ ID NO: 22612 - DNA, 20 bp, Homo sapiens
gaccggtggcgggctcagcg

SEQ ID NO: 22613 - DNA, 18 bp, Homo sapiens
gcatggtggccacggtgg

SEQ ID NO: 22614 - DNA, 18 bp, Homo sapiens
ggcggcggtggcggtggc

SEQ ID NO: 22615 - DNA, 21 bp, Homo sapiens
ggagcggagggcgcggtggcg

SEQ ID NO: 22616 - DNA, 19 bp, Homo sapiens
cagaggcggcgcggtggcg

SEQ ID NO: 22617 - DNA, 18 bp, Homo sapiens
cacggtggggggagggtg

SEQ ID NO: 22618 - DNA, 19 bp, Homo sapiens
ggtggtggtggcggtggcg

SEQ ID NO: 22619 - DNA, 18 bp, Homo sapiens
ggtggcggtggcggtggc

SEQ ID NO: 22620 - DNA, 17 bp, Homo sapiens
ggtccgggtgcggtggc

SEQ ID NO: 22621 - DNA, 22 bp, Homo sapiens
gacacggtggtgggcacatcag

SEQ ID NO: 22622 - DNA, 22 bp, Homo sapiens
gaccgtggtggcagtggtggcg

SEQ ID NO: 22623 - DNA, 15 bp, Homo sapiens
cggtggcggcggtgg

SEQ ID NO: 22624 - DNA, 17 bp, Homo sapiens
gacaggtggcgggggcg

SEQ ID NO: 22625 - DNA, 16 bp, Homo sapiens
cacggtgcgaaggtgg

SEQ ID NO: 22626 - DNA, 20 bp, Homo sapiens
cggaacctggcgcggtggcg

SEQ ID NO: 22627 - DNA, 20 bp, Homo sapiens
cacagtggtggtcagggtgg

SEQ ID NO: 22628 - DNA, 17 bp, Homo sapiens
gacaggtggcgggcgcg

SEQ ID NO: 22629 - DNA, 18 bp, Homo sapiens
ggtgtggtggcggtggca

SEQ ID NO: 22630 - DNA, 22 bp, Homo sapiens
ggtggcggcggcggcggtggcg

SEQ ID NO: 22631 - DNA, 17 bp, Homo sapiens
gcacggtggggcggtgg

SEQ ID NO: 22632 - DNA, 18 bp, Homo sapiens
ggccgggggcgcggtggc

SEQ ID NO: 22633 - DNA, 19 bp, Homo sapiens
ggcggcggctgcgtggtgg

SEQ ID NO: 22634 - DNA, 24 bp, Homo sapiens
gacgcggcggtggcggcagtggcg

SEQ ID NO: 22635 - DNA, 22 bp, Homo sapiens
ggcggcggtggcggcggtggcg

SEQ ID NO: 22636 - DNA, 21 bp, Homo sapiens
catggtggcaggcgcctatag

SEQ ID NO: 22637 - DNA, 15 bp, Homo sapiens
ggcgcggggcggggc

SEQ ID NO: 22638 - DNA, 20 bp, Homo sapiens
cggtggcggtggcggtggcg

SEQ ID NO: 22639 - DNA, 20 bp, Homo sapiens
gacgcggggcgggccctgcg

SEQ ID NO: 22640 - DNA, 19 bp, Homo sapiens
gacgtggtggtgctggtgg

SEQ ID NO: 22641 - DNA, 17 bp, Homo sapiens
caggtggcgggtcggtg

SEQ ID NO: 22642 - DNA, 19 bp, Homo sapiens
gactggtggtggggaggcg

SEQ ID NO: 22643 - DNA, 16 bp, Homo sapiens
atgggggcgggtggca

SEQ ID NO: 22644 - DNA, 21 bp, Homo sapiens
ggtgggtggtgtccacggtgg

SEQ ID NO: 22645 - DNA, 19 bp, Homo sapiens
ggcgtgctggcgggcctcg

SEQ ID NO: 22646 - DNA, 20 bp, Homo sapiens
ggtggcggggtcaggtggcg

SEQ ID NO: 22647 - DNA, 22 bp, Homo sapiens
gacacgggggtggggtggggtg

SEQ ID NO: 22648 - DNA, 21 bp, Homo sapiens
cggtggtggtggcagcggtgg

SEQ ID NO: 22649 - DNA, 18 bp, Homo sapiens
cagcggtggtggcggtgg

SEQ ID NO: 22650 - DNA, 22 bp, Homo sapiens
ggcagcggtgatggcggtggcg

SEQ ID NO: 22651 - DNA, 20 bp, Homo sapiens
ggaatgaccgggcgcggtgg

SEQ ID NO: 22652 - DNA, 17 bp, Homo sapiens
ggggtgggcacagggcg

SEQ ID NO: 22653 - DNA, 16 bp, Homo sapiens
ggtggcgggaggggcg

SEQ ID NO: 22654 - DNA, 25 bp, Homo sapiens
gacgcgggtgcccgccgcggtggcg

SEQ ID NO: 22655 - DNA, 22 bp, Homo sapiens
gacacgctggcgggtagccgcg

SEQ ID NO: 22656 - DNA, 18 bp, Homo sapiens
gataccgtggcgggggcg

SEQ ID NO: 22657 - DNA, 18 bp, Homo sapiens
gacatggtggcaggtgcg

SEQ ID NO: 22658 - DNA, 18 bp, Homo sapiens
cggtggcgggagaaggcg

SEQ ID NO: 22659 - DNA, 19 bp, Homo sapiens
catggggcgggttggggcg

SEQ ID NO: 22660 - DNA, 18 bp, Homo sapiens
ggtgtcggcgcggtggcg

SEQ ID NO: 22661 - DNA, 22 bp, Homo sapiens
ggtggcctagggtgcggtggcg

SEQ ID NO: 22662 - DNA, 22 bp, Homo sapiens
ggtggcggtggtggcggtggcg

SEQ ID NO: 22663 - DNA, 18 bp, Homo sapiens
gaccggtggcgggtgcag

SEQ ID NO: 22664 - DNA, 19 bp, Homo sapiens
acggtggtagcactggtgg

SEQ ID NO: 22665 - DNA, 17 bp, Homo sapiens
gcacggtggtggtggtg

SEQ ID NO: 22666 - DNA, 18 bp, Homo sapiens
ggtggcgggttgtgggcg

SEQ ID NO: 22667 - DNA, 19 bp, Homo sapiens
gcaggtgaaggtgtggtgg

SEQ ID NO: 22668 - DNA, 18 bp, Homo sapiens
gtgactgggtgcggtggc

SEQ ID NO: 22669 - DNA, 21 bp, Homo sapiens
cacggtggcgggagcctatag

SEQ ID NO: 22670 - DNA, 24 bp, Homo sapiens
gacgcggggcgccagcaggtggcg

SEQ ID NO: 22671 - DNA, 18 bp, Homo sapiens
gacacggtggctggcgtg

SEQ ID NO: 22672 - DNA, 19 bp, Homo sapiens
cacggggcggggcggggcg

SEQ ID NO: 22673 - DNA, 20 bp, Homo sapiens
cgtgtggtgttgcagtggcg

SEQ ID NO: 22674 - DNA, 20 bp, Homo sapiens
gacacggtgggcgggccgtg

SEQ ID NO: 22675 - DNA, 21 bp, Homo sapiens
caggtggtgggtgctgtggcg

SEQ ID NO: 22676 - DNA, 19 bp, Homo sapiens
gtgggggtgggcggtggcg

SEQ ID NO: 22677 - DNA, 126 bp, Tupaia herpesvirus
ttcgtggcgggcggcctgatcctgctgggcgcgtgcgggctgacggtgtggctgtgccgccgcgcgcggcgggcgctcgacccgtcggcgctcgggcccggcgcggagaaggcggccctgctcgag

SEQ ID NO: 22678 - DNA, 24 bp, Tupaia herpesvirus
tcgggcccggcgcggagaaggcgg

SEQ ID NO: 22679 - DNA, 21 bp, Homo sapiens
tcgagcccgcccagggggcgg

SEQ ID NO: 22680 - DNA, 20 bp, Homo sapiens
gggcccgggtatggaggcgg

SEQ ID NO: 22681 - DNA, 21 bp, Homo sapiens
cgggcccggcggtgagggcgg

SEQ ID NO: 22682 - DNA, 24 bp, Homo sapiens
tcgggtcgggggctcagaaggcgg

SEQ ID NO: 22683 - DNA, 22 bp, Homo sapiens
ggcccgacgcagggggaggtgg

SEQ ID NO: 22684 - DNA, 20 bp, Homo sapiens
cgggcgcacggaggaggcgg

SEQ ID NO: 22685 - DNA, 22 bp, Homo sapiens
tcaggcccggtgcggaccccgg

SEQ ID NO: 22686 - DNA, 19 bp, Homo sapiens
gcaaggcgcggagggggcg

SEQ ID NO: 22687 - DNA, 16 bp, Homo sapiens
tcgcgcccggcggggc

SEQ ID NO: 22688 - DNA, 17 bp, Homo sapiens
gggcccggcccagggcg

SEQ ID NO: 22689 - DNA, 18 bp, Homo sapiens
tcgggcccggccgctgcg

SEQ ID NO: 22690 - DNA, 24 bp, Homo sapiens
ggttcggcgaaggcgagagggcgg

SEQ ID NO: 22691 - DNA, 19 bp, Homo sapiens
gggcccagcggggaggtgg

SEQ ID NO: 22692 - DNA, 24 bp, Homo sapiens
cggagcgcggcgcggaggaggcgg

SEQ ID NO: 22693 - DNA, 21 bp, Homo sapiens
gcggggctgcggagaaggcgg

SEQ ID NO: 22694 - DNA, 19 bp, Homo sapiens
gggctgctaaagaaggtgg

SEQ ID NO: 22695 - DNA, 22 bp, Homo sapiens
ccgggcgcctcggggaaggcgg

SEQ ID NO: 22696 - DNA, 20 bp, Homo sapiens
tcgggtcaggacggaggtgg

SEQ ID NO: 22697 - DNA, 22 bp, Homo sapiens
ggcggctgcgcggaggaggcgg

SEQ ID NO: 22698 - DNA, 16 bp, Homo sapiens
gggcctggagaaggcg

SEQ ID NO: 22699 - DNA, 22 bp, Homo sapiens
ggtcccggcgcgggtgtctcgg

SEQ ID NO: 22700 - DNA, 24 bp, Homo sapiens
ccgggcctggcgtgcgggaggcgg

SEQ ID NO: 22701 - DNA, 18 bp, Homo sapiens
tcaggctgaggagaaggg

SEQ ID NO: 22702 - DNA, 19 bp, Homo sapiens
ggcccggcctctggggcgg

SEQ ID NO: 22703 - DNA, 21 bp, Homo sapiens
gggcttgggctctgaaggcgg

SEQ ID NO: 22704 - DNA, 19 bp, Homo sapiens
tcgggtccggcgcggcgcg

SEQ ID NO: 22705 - DNA, 16 bp, Homo sapiens
cgggcccggctggggg

SEQ ID NO: 22706 - DNA, 17 bp, Homo sapiens
cgggcccggggaggtgg

SEQ ID NO: 22707 - DNA, 19 bp, Homo sapiens
tccggctcggcgcggggcg

SEQ ID NO: 22708 - DNA, 18 bp, Homo sapiens
ccgggccccagggagggg

SEQ ID NO: 22709 - DNA, 25 bp, Homo sapiens
gggtccggcgcgggaagcccggcgg

SEQ ID NO: 22710 - DNA, 18 bp, Homo sapiens
tcgggccggcgcgctgcg

SEQ ID NO: 22711 - DNA, 23 bp, Homo sapiens
ccaggacggcgcggggaaggcgg

SEQ ID NO: 22712 - DNA, 23 bp, Homo sapiens
ggtgcttcagtgggagaaggtgg

SEQ ID NO: 22713 - DNA, 21 bp, Homo sapiens
gggcccgggagcaggaggtgg

SEQ ID NO: 22714 - DNA, 21 bp, Homo sapiens
cgggcccggggccggaggtgg

SEQ ID NO: 22715 - DNA, 131 bp, Monkeypox virus
acattatatacattatatacattatatacattatatacattatatacattatatacattatatacattatatacattatatacattatatacattatatacattatatacattatatacattatatacatt

SEQ ID NO: 22716 - DNA, 24 bp, Monkeypox virus
tacattatatacattatatacatt

SEQ ID NO: 22717 - DNA, 20 bp, Homo sapiens
tacatatatacatacatata

SEQ ID NO: 22718 - DNA, 18 bp, Homo sapiens
tatatatattatatacac

SEQ ID NO: 22719 - DNA, 22 bp, Homo sapiens
cattatatacaaacattacatt

SEQ ID NO: 22720 - DNA, 25 bp, Homo sapiens
tacaaaacattacattatatacatt

SEQ ID NO: 22721 - DNA, 20 bp, Homo sapiens
cattatatacataaaatata

SEQ ID NO: 22722 - DNA, 26 bp, Homo sapiens
taattatatacaggattatatacatt

SEQ ID NO: 22723 - DNA, 23 bp, Homo sapiens
taccttatatacacatatacatt

SEQ ID NO: 22724 - DNA, 20 bp, Homo sapiens
tacattcatacatacatata

SEQ ID NO: 22725 - DNA, 22 bp, Homo sapiens
attatatatactttatacatta

SEQ ID NO: 22726 - DNA, 21 bp, Homo sapiens
tacattatagacaaatacata

SEQ ID NO: 22727 - DNA, 20 bp, Homo sapiens
tacattaatacatacatata

SEQ ID NO: 22728 - DNA, 18 bp, Homo sapiens
tacaatatatacatatat

SEQ ID NO: 22729 - DNA, 19 bp, Homo sapiens
ttatatacagatacacatt

SEQ ID NO: 22730 - DNA, 20 bp, Homo sapiens
catatacgactatatacatt

SEQ ID NO: 22731 - DNA, 19 bp, Homo sapiens
tacatatatacacacacat

SEQ ID NO: 22732 - DNA, 21 bp, Homo sapiens
catatatacacatatgtatac

SEQ ID NO: 22733 - DNA, 26 bp, Homo sapiens
tacattatttaatgttatatacatta

SEQ ID NO: 22734 - DNA, 19 bp, Homo sapiens
tacattgtaaacaccacat

SEQ ID NO: 22735 - DNA, 19 bp, Homo sapiens
tacatatatacacacatat

SEQ ID NO: 22736 - DNA, 24 bp, Homo sapiens
tacattatggtacaggcacacatt

SEQ ID NO: 22737 - DNA, 16 bp, Homo sapiens
ttatatacacacacat

SEQ ID NO: 22738 - DNA, 21 bp, Homo sapiens
cacattatatacattaaacat

SEQ ID NO: 22739 - DNA, 18 bp, Homo sapiens
tacatcatatacatatat

SEQ ID NO: 22740 - DNA, 22 bp, Homo sapiens
tatatactttattatatacatt

SEQ ID NO: 22741 - DNA, 18 bp, Homo sapiens
tacatcatatacgtatat

SEQ ID NO: 22742 - DNA, 23 bp, Homo sapiens
tacattaggttgaacattatata

SEQ ID NO: 22743 - DNA, 70 bp, Gallid herpesvirus 3
accccgctcctgggacaaatactccggaaacctccagggatcggaaatttatttagaaggggggtggggt

SEQ ID NO: 22744 - DNA, 17 bp, Gallid herpesvirus 3
tagaaggggggtggggt

SEQ ID NO: 22745 - DNA, 18 bp, Homo sapiens
gaaggaaggcagtggggt

SEQ ID NO: 22746 - DNA, 19 bp, Homo sapiens
caggagggggcggcttggt

SEQ ID NO: 22747 - DNA, 18 bp, Homo sapiens
agaaggggaagcaggggt

SEQ ID NO: 22748 - DNA, 21 bp, Homo sapiens
gaggggaggccaaggggggta

SEQ ID NO: 22749 - DNA, 18 bp, Homo sapiens
cagaatagagggtggggt

SEQ ID NO: 22750 - DNA, 18 bp, Homo sapiens
agaggggtggcctggggt

SEQ ID NO: 22751 - DNA, 19 bp, Homo sapiens
agaagggcagagttggggt

SEQ ID NO: 22752 - DNA, 19 bp, Homo sapiens
gaaggaataaaggtggggt

SEQ ID NO: 22753 - DNA, 18 bp, Homo sapiens
cagaagggggcaaaaggt

SEQ ID NO: 22754 - DNA, 18 bp, Homo sapiens
tagaagaggagagcaggt

SEQ ID NO: 22755 - DNA, 18 bp, Homo sapiens
tagagaggacaaaggggt

SEQ ID NO: 22756 - DNA, 18 bp, Homo sapiens
tagatgggggatgtgggg

SEQ ID NO: 22757 - DNA, 21 bp, Homo sapiens
cagaagaggtgggggtggggt

SEQ ID NO: 22758 - DNA, 18 bp, Homo sapiens
caggcagggggtggggta

SEQ ID NO: 22759 - DNA, 18 bp, Homo sapiens
agaaggggcgctcggggt

SEQ ID NO: 22760 - DNA, 18 bp, Homo sapiens
taggtgggggaatgaggt

SEQ ID NO: 22761 - DNA, 18 bp, Homo sapiens
agaagagaatggtggggt

SEQ ID NO: 22762 - DNA, 21 bp, Homo sapiens
cagaagggctgggcgtggggt

SEQ ID NO: 22763 - DNA, 20 bp, Homo sapiens
tagagaggagtgactggggt

SEQ ID NO: 22764 - DNA, 18 bp, Homo sapiens
taggcaggaggctggggt

SEQ ID NO: 22765 - DNA, 18 bp, Homo sapiens
tagaagggaggccttggt

SEQ ID NO: 22766 - DNA, 18 bp, Homo sapiens
cagagggggactgatggt

SEQ ID NO: 22767 - DNA, 18 bp, Homo sapiens
gaaaacagggggtggggt

SEQ ID NO: 22768 - DNA, 18 bp, Homo sapiens
taaaaggggagtgcgggt

SEQ ID NO: 22769 - DNA, 19 bp, Homo sapiens
taggtgggagcgctggggt

SEQ ID NO: 22770 - DNA, 20 bp, Homo sapiens
taaggagggggcacgggggt

SEQ ID NO: 22771 - DNA, 20 bp, Homo sapiens
agaaggggaagcagtggggt

SEQ ID NO: 22772 - DNA, 18 bp, Homo sapiens
gaaggggagggcaggggt

SEQ ID NO: 22773 - DNA, 18 bp, Homo sapiens
taaaagaagtggtggggt

SEQ ID NO: 22774 - DNA, 18 bp, Homo sapiens
cagaagggcatggagggt

SEQ ID NO: 22775 - DNA, 19 bp, Homo sapiens
agaaggaaaaaggtggggt

SEQ ID NO: 22776 - DNA, 20 bp, Homo sapiens
cagaggggggcctcgggggt

SEQ ID NO: 22777 - DNA, 19 bp, Homo sapiens
taggcgggggcgcggcggt

SEQ ID NO: 22778 - DNA, 18 bp, Homo sapiens
gaaggtaaaaagtggggt

SEQ ID NO: 22779 - DNA, 19 bp, Homo sapiens
aggaggggaagggtggggt

SEQ ID NO: 22780 - DNA, 19 bp, Homo sapiens
cagaaatcgggggtggggt

SEQ ID NO: 22781 - DNA, 19 bp, Homo sapiens
cagaaacaagaggtggggt

SEQ ID NO: 22782 - DNA, 20 bp, Homo sapiens
agaggggaaagcagtggggt

SEQ ID NO: 22783 - DNA, 18 bp, Homo sapiens
tagaggagaagtgcgggt

SEQ ID NO: 22784 - DNA, 19 bp, Homo sapiens
aaaggcaaaagggtggggt

SEQ ID NO: 22785 - DNA, 20 bp, Homo sapiens
tagggagggaagctaggggt

SEQ ID NO: 22786 - DNA, 19 bp, Homo sapiens
tacaaggtaggaatggggt

SEQ ID NO: 22787 - DNA, 21 bp, Homo sapiens
cagggggctctggggtggggt

SEQ ID NO: 22788 - DNA, 18 bp, Homo sapiens
gaaagcaaagggtggggt

SEQ ID NO: 22789 - DNA, 21 bp, Homo sapiens
gaaggggcagcgcgtggggta

SEQ ID NO: 22790 - DNA, 18 bp, Homo sapiens
tacaaggggactgatggt

SEQ ID NO: 22791 - DNA, 19 bp, Homo sapiens
tagcaagggcagctggggt

SEQ ID NO: 22792 - DNA, 20 bp, Homo sapiens
gagaggggggcagcaggggt

SEQ ID NO: 22793 - DNA, 17 bp, Homo sapiens
gaagggagggtggggta

SEQ ID NO: 22794 - DNA, 18 bp, Homo sapiens
gaagggacgggctggggt

SEQ ID NO: 22795 - DNA, 18 bp, Homo sapiens
agaaggggaaggaggggt

SEQ ID NO: 22796 - DNA, 16 bp, Homo sapiens
agagggaagtggggta

SEQ ID NO: 22797 - DNA, 18 bp, Homo sapiens
tagaaggggaaagagggt

SEQ ID NO: 22798 - DNA, 19 bp, Homo sapiens
tagaggtggggaatgaggt

SEQ ID NO: 22799 - DNA, 18 bp, Homo sapiens
caggaggggatggctggt

SEQ ID NO: 22800 - DNA, 19 bp, Homo sapiens
tagaggagggctcccaggt

SEQ ID NO: 22801 - DNA, 18 bp, Homo sapiens
cagagggaccagcggggt

SEQ ID NO: 22802 - DNA, 18 bp, Homo sapiens
cagaagggacctcagggt

SEQ ID NO: 22803 - DNA, 23 bp, Homo sapiens
agaaggggtatgggggtggggta

SEQ ID NO: 22804 - DNA, 18 bp, Homo sapiens
tagatgggggtgctgggt

SEQ ID NO: 22805 - DNA, 19 bp, Homo sapiens
agagggggggcacgggggt

SEQ ID NO: 22806 - DNA, 19 bp, Homo sapiens
agaagggaggaaatggggt

SEQ ID NO: 22807 - DNA, 19 bp, Homo sapiens
cagaaggaagcagtggggt

SEQ ID NO: 22808 - DNA, 18 bp, Homo sapiens
tagaaagggcagcagggt

SEQ ID NO: 22809 - DNA, 19 bp, Homo sapiens
tagaagtgggagtcagggt

SEQ ID NO: 22810 - DNA, 18 bp, Homo sapiens
cagagggtggggtggggt

SEQ ID NO: 22811 - DNA, 19 bp, Homo sapiens
gaggggagggaatggggta

SEQ ID NO: 22812 - DNA, 18 bp, Homo sapiens
agagggccagagtggggt

SEQ ID NO: 22813 - DNA, 18 bp, Homo sapiens
agaaagcagcggtggggt

SEQ ID NO: 22814 - DNA, 16 bp, Homo sapiens
gacagggggtggggta

SEQ ID NO: 22815 - DNA, 18 bp, Homo sapiens
tagaagtggcaggatggg

SEQ ID NO: 22816 - DNA, 19 bp, Homo sapiens
tacaaggaagaggtggggt

SEQ ID NO: 22817 - DNA, 18 bp, Homo sapiens
gaaggaagaaagtggggt

SEQ ID NO: 22818 - DNA, 19 bp, Homo sapiens
taaaagggcttgaaggggt

SEQ ID NO: 22819 - DNA, 16 bp, Homo sapiens
agatgggggtggggta

SEQ ID NO: 22820 - DNA, 20 bp, Homo sapiens
aaagtgggaaggggtggggt

SEQ ID NO: 22821 - DNA, 19 bp, Homo sapiens
cagaagtgagtggtggggt

SEQ ID NO: 22822 - DNA, 21 bp, Homo sapiens
tagaggagggaatcgcggggt

SEQ ID NO: 22823 - DNA, 19 bp, Homo sapiens
agagggagggcggtggggt

SEQ ID NO: 22824 - DNA, 19 bp, Homo sapiens
agaagatatggggtggggt

SEQ ID NO: 22825 - DNA, 21 bp, Homo sapiens
taggcaggggtgggacggggt

SEQ ID NO: 22826 - DNA, 16 bp, Homo sapiens
aagcgggggtggggta

SEQ ID NO: 22827 - DNA, 19 bp, Homo sapiens
taggcagggagggtggggt

SEQ ID NO: 22828 - DNA, 18 bp, Homo sapiens
gaagtgtgggggtggggt

SEQ ID NO: 22829 - DNA, 19 bp, Homo sapiens
agaacagggagggtggggt

SEQ ID NO: 22830 - DNA, 18 bp, Homo sapiens
gaaggaggggcacagggt

SEQ ID NO: 22831 - DNA, 19 bp, Homo sapiens
agagggcaaggggtggggt

SEQ ID NO: 22832 - DNA, 18 bp, Homo sapiens
cagtaaatggggtggggt

SEQ ID NO: 22833 - DNA, 18 bp, Homo sapiens
tagaggacaatttggggt

SEQ ID NO: 22834 - DNA, 103 bp, Vaccinia virus
ctgtgaccaagatagagagctcctttggtgaatccatctctatgtttcagtttaaccaagaaacagtcagctggtctaaaatttccatctctatctaatacag

SEQ ID NO: 22835 - DNA, 24 bp, Vaccinia virus
accaagatagagagctcctttggt

SEQ ID NO: 22836 - DNA, 18 bp, Homo sapiens
gatgcaaattcctttggt

SEQ ID NO: 22837 - DNA, 22 bp, Homo sapiens
accagggaggggttcctttggt

SEQ ID NO: 22838 - DNA, 17 bp, Homo sapiens
ccaagatagaagcaggg

SEQ ID NO: 22839 - DNA, 19 bp, Homo sapiens
accaagaaagagagctggg

SEQ ID NO: 22840 - DNA, 20 bp, Homo sapiens
caagggtgccttcctttggt

SEQ ID NO: 22841 - DNA, 22 bp, Homo sapiens
accaagatgaggggcgagaggt

SEQ ID NO: 22842 - DNA, 17 bp, Homo sapiens
caagacagagagctagg

SEQ ID NO: 22843 - DNA, 17 bp, Homo sapiens
gataggagcattttggt

SEQ ID NO: 22844 - DNA, 16 bp, Homo sapiens
caggatagagagctgg

SEQ ID NO: 22845 - DNA, 18 bp, Homo sapiens
aagataaagtcttttggt

SEQ ID NO: 22846 - DNA, 18 bp, Homo sapiens
ccaaggtagagggctcct

SEQ ID NO: 22847 - DNA, 19 bp, Homo sapiens
gataggtagttcctttggt

SEQ ID NO: 22848 - DNA, 63 bp, Human papillomavirus type 10
agaaaaccaggcagcgtttgtaacgctttggtataccagcgatacacagcgtactgaatttct

SEQ ID NO: 22849 - DNA, 21 bp, Human papillomavirus type 10
tacacagcgtactgaatttct

SEQ ID NO: 22850 - DNA, 20 bp, Homo sapiens
tacacatttataaaatttct

SEQ ID NO: 22851 - DNA, 17 bp, Homo sapiens
cacagccacgaatttct

SEQ ID NO: 22852 - DNA, 18 bp, Homo sapiens
acagtgcactgaaagtct

SEQ ID NO: 22853 - DNA, 20 bp, Homo sapiens
tacacactaaatgaatttct

SEQ ID NO: 22854 - DNA, 21 bp, Homo sapiens
cacacgtgtatctgaatttct

SEQ ID NO: 22855 - DNA, 20 bp, Homo sapiens
acacagcagactgggtttct

SEQ ID NO: 22856 - DNA, 21 bp, Homo sapiens
tacaccgcccgcggaatttct

SEQ ID NO: 22857 - DNA, 18 bp, Homo sapiens
acatagtgtactaaattt

SEQ ID NO: 22858 - DNA, 19 bp, Homo sapiens
tacacagcttcaattttct

SEQ ID NO: 22859 - DNA, 21 bp, Homo sapiens
cacacagcccaaagagtttct

SEQ ID NO: 22860 - DNA, 20 bp, Homo sapiens
acagcaaatgttgaatttct

SEQ ID NO: 22861 - DNA, 20 bp, Homo sapiens
tacacagcagtacctccttt

SEQ ID NO: 22862 - DNA, 21 bp, Homo sapiens
tacacagcataactttattct

SEQ ID NO: 22863 - DNA, 17 bp, Homo sapiens
tacacttctgaatttct

SEQ ID NO: 22864 - DNA, 15 bp, Homo sapiens
tacacagcagaattt

SEQ ID NO: 22865 - DNA, 15 bp, Homo sapiens
cacagcctgaatttc

SEQ ID NO: 22866 - DNA, 18 bp, Homo sapiens
cacaacgtgctatattct

SEQ ID NO: 22867 - DNA, 19 bp, Homo sapiens
acacgccgtctgaatttct

SEQ ID NO: 22868 - DNA, 18 bp, Homo sapiens
taccagccaagaatttct

SEQ ID NO: 22869 - DNA, 15 bp, Homo sapiens
acagcataaattcct

SEQ ID NO: 22870 - DNA, 18 bp, Homo sapiens
cacccttactgaatttct

SEQ ID NO: 22871 - DNA, 20 bp, Homo sapiens
tacactgtaccaaaatttct

SEQ ID NO: 22872 - DNA, 19 bp, Homo sapiens
tacaaaggcatgaatttct

SEQ ID NO: 22873 - DNA, 15 bp, Homo sapiens
cacagcgtacccttc

SEQ ID NO: 22874 - DNA, 18 bp, Homo sapiens
tacacagcatataaatct

SEQ ID NO: 22875 - DNA, 19 bp, Homo sapiens
acagacatgttgaatttct

SEQ ID NO: 22876 - DNA, 19 bp, Homo sapiens
gcatactggaatggtttct

SEQ ID NO: 22877 - DNA, 19 bp, Homo sapiens
cacgcagcactgaatttct

SEQ ID NO: 22878 - DNA, 18 bp, Homo sapiens
cacacagcgtactgtcct

SEQ ID NO: 22879 - DNA, 16 bp, Homo sapiens
acagagttgaatttct

SEQ ID NO: 22880 - DNA, 20 bp, Homo sapiens
cacagtttatatgaatttct

SEQ ID NO: 22881 - DNA, 21 bp, Homo sapiens
acagcgcatgaccgtatttct

SEQ ID NO: 22882 - DNA, 18 bp, Homo sapiens
cacccagcctgaatttct

SEQ ID NO: 22883 - DNA, 19 bp, Homo sapiens
caccatgacatgaatttct

SEQ ID NO: 22884 - DNA, 20 bp, Homo sapiens
cacagcgtggagaggtttct

SEQ ID NO: 22885 - DNA, 16 bp, Homo sapiens
tacacagtgaatttct

SEQ ID NO: 22886 - DNA, 17 bp, Homo sapiens
tacacagtgctaaactt

SEQ ID NO: 22887 - DNA, 75 bp, Human papillomavirus type 10
gcaatgccattgaagtgcatgtagctttacagcaattgcaagaaagtgcctatgcacacgaaccctggacattgc

SEQ ID NO: 22888 - DNA, 24 bp, Human papillomavirus type 10
aagaaagtgcctatgcacacgaac

SEQ ID NO: 22889 - DNA, 16 bp, Homo sapiens
agaaagtgtcgcaccg

SEQ ID NO: 22890 - DNA, 18 bp, Homo sapiens
aagaaatgcccacatgaa

SEQ ID NO: 22891 - DNA, 18 bp, Homo sapiens
aggaaatgcctgtgctca

SEQ ID NO: 22892 - DNA, 19 bp, Homo sapiens
agaatttttatgcacacga

SEQ ID NO: 22893 - DNA, 19 bp, Homo sapiens
aagaaagtgccgtgtgtac

SEQ ID NO: 22894 - DNA, 21 bp, Homo sapiens
aggcaggggccatgcacacga

SEQ ID NO: 22895 - DNA, 23 bp, Homo sapiens
agaacaaatcctatgcatgcgaa

SEQ ID NO: 22896 - DNA, 19 bp, Homo sapiens
aaagacacatgcacacgaa

SEQ ID NO: 22897 - DNA, 15 bp, Homo sapiens
gaaaaatgcacacga

SEQ ID NO: 22898 - DNA, 20 bp, Homo sapiens
agagaagtgcctgtgtctac

SEQ ID NO: 22899 - DNA, 18 bp, Homo sapiens
aagagagtgcctagggca

SEQ ID NO: 22900 - DNA, 19 bp, Homo sapiens
gaaagcgcagccgcgcacg

SEQ ID NO: 22901 - DNA, 16 bp, Homo sapiens
agaaaatgtgaacacg

SEQ ID NO: 22902 - DNA, 17 bp, Homo sapiens
agtgttatacacatgaa

SEQ ID NO: 22903 - DNA, 21 bp, Homo sapiens
aaggaagtgcctggcacagaa

SEQ ID NO: 22904 - DNA, 17 bp, Homo sapiens
agaaaacgtgcacatga

SEQ ID NO: 22905 - DNA, 22 bp, Homo sapiens
agaaagtgcctattttcttgaa

SEQ ID NO: 22906 - DNA, 21 bp, Homo sapiens
aagaaagcctggtgcgcatga

SEQ ID NO: 22907 - DNA, 16 bp, Homo sapiens
gaaggtgctgcacacg

SEQ ID NO: 22908 - DNA, 17 bp, Homo sapiens
aagaaagtgccagccga

SEQ ID NO: 22909 - DNA, 17 bp, Homo sapiens
agaaaacatgcacacga

SEQ ID NO: 22910 - DNA, 20 bp, Homo sapiens
agaaaatgcttatgacacaa

SEQ ID NO: 22911 - DNA, 77 bp, Human herpesvirus 7
tgtagtcctacaatcaagcgaggttgtagacgttacctacaatgaactacacctctaagcataacctgtcgggcaca

SEQ ID NO: 22912 - DNA, 24 bp, Human herpesvirus 7
cacctctaagcataacctgtcggg

SEQ ID NO: 22913 - DNA, 24 bp, Homo sapiens
cagctctaccaagggcctgttggg

SEQ ID NO: 22914 - DNA, 24 bp, Homo sapiens
cacctttaggcgagcactgccggg

SEQ ID NO: 22915 - DNA, 21 bp, Homo sapiens
cctctgagcgaaacccaacag

SEQ ID NO: 22916 - DNA, 21 bp, Homo sapiens
cacttctaagcagcccttggg

SEQ ID NO: 22917 - DNA, 21 bp, Homo sapiens
cacctctaagcatattctggg

SEQ ID NO: 22918 - DNA, 29 bp, Homo sapiens
cacctctaagccatgatttgcccgacagg

SEQ ID NO: 22919 - DNA, 17 bp, Homo sapiens
ctctaagcatggccagg

SEQ ID NO: 22920 - DNA, 19 bp, Homo sapiens
cctctgagcatagccacag

SEQ ID NO: 22921 - DNA, 23 bp, Homo sapiens
cacccctaagtgatgctgttggg

SEQ ID NO: 22922 - DNA, 19 bp, Homo sapiens
tctaaacataatttgtggg

SEQ ID NO: 22923 - DNA, 80 bp, Human herpesvirus 7
ttactattggactgtttatacttatcttcaaatgttcactcacagcagcgaaggggacactagaaaacactcccaagtag

SEQ ID NO: 22924 - DNA, 24 bp, Human herpesvirus 7
tggactgtttatacttatcttcaa

SEQ ID NO: 22925 - DNA, 17 bp, Homo sapiens
tggactgtttaaattat

SEQ ID NO: 22926 - DNA, 22 bp, Homo sapiens
tggattgtttacataatattca

SEQ ID NO: 22927 - DNA, 21 bp, Homo sapiens
tggctgtttattgatccttca

SEQ ID NO: 22928 - DNA, 19 bp, Homo sapiens
tggttgttgaacttatctt

SEQ ID NO: 22929 - DNA, 21 bp, Homo sapiens
tggactgttgctcctcttcaa

SEQ ID NO: 22930 - DNA, 16 bp, Homo sapiens
ggactgtttaaatctt

SEQ ID NO: 22931 - DNA, 20 bp, Homo sapiens
acatttatatttatcttcaa

SEQ ID NO: 22932 - DNA, 23 bp, Homo sapiens
tggcctgtttatactattttcaa

SEQ ID NO: 22933 - DNA, 21 bp, Homo sapiens
tgggctgtttattttcccatc

SEQ ID NO: 22934 - DNA, 22 bp, Homo sapiens
tggactatttgtgtaccttcaa

SEQ ID NO: 22935 - DNA, 68 bp, Human herpesvirus 7
taaccttagctctaactctgaccctaggcctaaccctaagcctaaccctaaccgtagctctaagttta

SEQ ID NO: 22936 - DNA, 24 bp, Human herpesvirus 7
tctaactctgaccctaggcctaac

SEQ ID NO: 22937 - DNA, 19 bp, Homo sapiens
tctaactctggcttctcct

SEQ ID NO: 22938 - DNA, 22 bp, Homo sapiens
cctaactctgattttgtcagac

SEQ ID NO: 22939 - DNA, 19 bp, Homo sapiens
tccagctctctgggcctaa

SEQ ID NO: 22940 - DNA, 23 bp, Homo sapiens
tctggctcctgaccctctctcct

SEQ ID NO: 22941 - DNA, 19 bp, Homo sapiens
tctaactcctgacctcagg

SEQ ID NO: 22942 - DNA, 21 bp, Homo sapiens
tctaacttgacccaacatggc

SEQ ID NO: 22943 - DNA, 20 bp, Homo sapiens
tccaactctgggtgtctgac

SEQ ID NO: 22944 - DNA, 19 bp, Homo sapiens
tctaactcaggccctgggc

SEQ ID NO: 22945 - DNA, 21 bp, Homo sapiens
tccagttctgaccctctgggc

SEQ ID NO: 22946 - DNA, 19 bp, Homo sapiens
taactttgatccaggccca

SEQ ID NO: 22947 - DNA, 22 bp, Homo sapiens
tctgctctgatcctctattaac

SEQ ID NO: 22948 - DNA, 21 bp, Homo sapiens
taactcaaaatcttaggccta

SEQ ID NO: 22949 - DNA, 18 bp, Homo sapiens
tctaaccctgggtctggc

SEQ ID NO: 22950 - DNA, 21 bp, Homo sapiens
tcagctctgaccttctctgac

SEQ ID NO: 22951 - DNA, 21 bp, Homo sapiens
tctaactcgtgaagcgggcct

SEQ ID NO: 22952 - DNA, 22 bp, Homo sapiens
ctgactttgaccccaaattaac

SEQ ID NO: 22953 - DNA, 20 bp, Homo sapiens
tctgactctggcctttgcct

SEQ ID NO: 22954 - DNA, 22 bp, Homo sapiens
tctgactctgactatatgaagc

SEQ ID NO: 22955 - DNA, 21 bp, Homo sapiens
tctgacccctgccctgggcct

SEQ ID NO: 22956 - DNA, 19 bp, Homo sapiens
tctgattctgcctctagac

SEQ ID NO: 22957 - DNA, 18 bp, Homo sapiens
tctagctctaatcctaaa

SEQ ID NO: 22958 - DNA, 22 bp, Homo sapiens
tagctctgaccttcaccaaggc

SEQ ID NO: 22959 - DNA, 19 bp, Homo sapiens
tctaactcggccctccggc

SEQ ID NO: 22960 - DNA, 19 bp, Homo sapiens
tctactctgacccacccta

SEQ ID NO: 22961 - DNA, 19 bp, Homo sapiens
tctaactcgtgacagttct

SEQ ID NO: 22962 - DNA, 18 bp, Homo sapiens
acgttgattaggcctaac

SEQ ID NO: 22963 - DNA, 17 bp, Homo sapiens
tctgctctgaccctaga

SEQ ID NO: 22964 - DNA, 19 bp, Homo sapiens
tcttagctctgccaggcct

SEQ ID NO: 22965 - DNA, 18 bp, Homo sapiens
tctgcttctgaccctcct

SEQ ID NO: 22966 - DNA, 18 bp, Homo sapiens
tctggccctgaccctggc

SEQ ID NO: 22967 - DNA, 60 bp, Human herpesvirus 7
gcagcgcggcgcacagagcgaaggcagcggctttcagactgtttgccaagcgcagtctgc

SEQ ID NO: 22968 - DNA, 24 bp, Human herpesvirus 7
agactgtttgccaagcgcagtctg

SEQ ID NO: 22969 - DNA, 20 bp, Homo sapiens
gactgtttgcttagaatctg

SEQ ID NO: 22970 - DNA, 21 bp, Homo sapiens
agactgtttgttgcccgtctg

SEQ ID NO: 22971 - DNA, 18 bp, Homo sapiens
ctgtttgctcagccactg

SEQ ID NO: 22972 - DNA, 23 bp, Homo sapiens
aggctgtttccctggacagtctg

SEQ ID NO: 22973 - DNA, 17 bp, Homo sapiens
aggctgtggcgcagtct

SEQ ID NO: 22974 - DNA, 21 bp, Homo sapiens
ctgtttgccagatgacccctg

SEQ ID NO: 22975 - DNA, 23 bp, Homo sapiens
gaatgtttgcccttctcagtctg

SEQ ID NO: 22976 - DNA, 18 bp, Homo sapiens
gactgtttgctaactggc

SEQ ID NO: 22977 - DNA, 18 bp, Homo sapiens
aaactgtttgtcaaaaac

SEQ ID NO: 22978 - DNA, 19 bp, Homo sapiens
agactgttggcgctagtct

SEQ ID NO: 22979 - DNA, 60 bp, Tupaia herpesvirus
gcgcgcctcgtcgaccgggcgaccggaccccgcgggcccgggtctcggtcgttcacgcgc

SEQ ID NO: 22980 - DNA, 24 bp, Tupaia herpesvirus
gcccgggtctcggtcgttcacgcg

SEQ ID NO: 22981 - DNA, 18 bp, Homo sapiens
gcctggtctcggcggcgc

SEQ ID NO: 22982 - DNA, 23 bp, Homo sapiens
gcccgggtctcggcttcgctgcg

SEQ ID NO: 22983 - DNA, 18 bp, Homo sapiens
cctcgggtctcggtctgc

SEQ ID NO: 22984 - DNA, 21 bp, Homo sapiens
gcccgggtccggccgggcgcg

SEQ ID NO: 22985 - DNA, 17 bp, Homo sapiens
ccgggtctcggaggcgc

SEQ ID NO: 22986 - DNA, 23 bp, Homo sapiens
ccgggtcttggtcgggacaagcg

SEQ ID NO: 22987 - DNA, 18 bp, Homo sapiens
gcccgggtctcgtgtgtt

SEQ ID NO: 22988 - DNA, 85 bp, Rat cytomegalovirus
gtccgaggtcctggtcgcattatcgtgggtgtgttcttcgtccagcatccaggccgctcgagacccgctggcgagggcctcggat

SEQ ID NO: 22989 - DNA, 24 bp, Rat cytomegalovirus
tcgtgggtgtgttcttcgtccagc

SEQ ID NO: 22990 - DNA, 16 bp, Homo sapiens
tcgtgggtggtcttcg

SEQ ID NO: 22991 - DNA, 20 bp, Homo sapiens
tgggggtgaagtcgtccagc

SEQ ID NO: 22992 - DNA, 24 bp, Homo sapiens
tcctgggtgtgaggcaagtctggc

SEQ ID NO: 22993 - DNA, 23 bp, Homo sapiens
tgtgtgtgctctttttgtctggc

SEQ ID NO: 22994 - DNA, 15 bp, Homo sapiens
gggtgtgttgcccag

SEQ ID NO: 22995 - DNA, 80 bp, Tupaia herpesvirus
ttcagtacgtagtagcttctcgaacagattcgttcgtttacaatgagccagttttttcagatggattttactgtggtgaa

SEQ ID NO: 22996 - DNA, 24 bp, Tupaia herpesvirus
tgagccagttttttcagatggatt

SEQ ID NO: 22997 - DNA, 19 bp, Homo sapiens
gagctggtttttcctttgg

SEQ ID NO: 22998 - DNA, 24 bp, Homo sapiens
tggctagtttggcactgatggatt

SEQ ID NO: 22999 - DNA, 19 bp, Homo sapiens
tgggccagttctttcagat

SEQ ID NO: 23000 - DNA, 22 bp, Homo sapiens
tggccagtttaaagcatggatt

SEQ ID NO: 23001 - DNA, 18 bp, Homo sapiens
tgagtcagtttttgtcag

SEQ ID NO: 23002 - DNA, 20 bp, Homo sapiens
tggctagttttctcttgtgg

SEQ ID NO: 23003 - DNA, 21 bp, Homo sapiens
tgaccagttttctactggatt

SEQ ID NO: 23004 - DNA, 21 bp, Homo sapiens
tgagcagttttcaggagatgg

SEQ ID NO: 23005 - DNA, 22 bp, Homo sapiens
gaacttttttttcagatggatt

SEQ ID NO: 23006 - DNA, 60 bp, Rat cytomegalovirus
gtccttctctgcttcttttctgtgttctcttgccttttttcacgggggctgaagaaggac

SEQ ID NO: 23007 - DNA, 24 bp, Rat cytomegalovirus
tctctgcttcttttctgtgttctc

SEQ ID NO: 23008 - DNA, 18 bp, Homo sapiens
tctccttctttttgctct

SEQ ID NO: 23009 - DNA, 21 bp, Homo sapiens
tctctccttttttttaatatt

SEQ ID NO: 23010 - DNA, 18 bp, Homo sapiens
tctgcttcttttataatc

SEQ ID NO: 23011 - DNA, 16 bp, Homo sapiens
tctgtgcttcgtgttc

SEQ ID NO: 23012 - DNA, 22 bp, Homo sapiens
tctctgcttttcttgctgtctc

SEQ ID NO: 23013 - DNA, 23 bp, Homo sapiens
tctctcttcttttcaatactttc

SEQ ID NO: 23014 - DNA, 23 bp, Homo sapiens
tctctgctctcttttcagttctc

SEQ ID NO: 23015 - DNA, 19 bp, Homo sapiens
tcagcttctttcccttttc

SEQ ID NO: 23016 - DNA, 25 bp, Homo sapiens
tctctcttcttaatgcagtgttctc

SEQ ID NO: 23017 - DNA, 16 bp, Homo sapiens
tctctactcctgtgtt

SEQ ID NO: 23018 - DNA, 21 bp, Homo sapiens
tctttccttcttttcagtgtt

SEQ ID NO: 23019 - DNA, 17 bp, Homo sapiens
tcttttcttttctttct

SEQ ID NO: 23020 - DNA, 21 bp, Homo sapiens
tctctgttcttttcctttctc

SEQ ID NO: 23021 - DNA, 21 bp, Homo sapiens
ctgcttcttttctaggcttct

SEQ ID NO: 23022 - DNA, 23 bp, Homo sapiens
tctgtgcttttttttctattttc

SEQ ID NO: 23023 - DNA, 20 bp, Homo sapiens
tctcttcttcttttccttct

SEQ ID NO: 23024 - DNA, 19 bp, Homo sapiens
tctctgtttgcttttttgt

SEQ ID NO: 23025 - DNA, 21 bp, Homo sapiens
tctctgatttctctgtgttct

SEQ ID NO: 23026 - DNA, 16 bp, Homo sapiens
tctgttttcatgttct

SEQ ID NO: 23027 - DNA, 19 bp, Homo sapiens
tctctgtattctttcttct

SEQ ID NO: 23028 - DNA, 20 bp, Homo sapiens
tctctttttttttctatatt

SEQ ID NO: 23029 - DNA, 22 bp, Homo sapiens
tctctgctgcttgtgtgttctc

SEQ ID NO: 23030 - DNA, 22 bp, Homo sapiens
tctctgctgcctgtgtgttctc

SEQ ID NO: 23031 - DNA, 22 bp, Homo sapiens
tctctgctgtctgtgtgttctc

SEQ ID NO: 23032 - DNA, 19 bp, Homo sapiens
ttcttttctttttatcccc

SEQ ID NO: 23033 - DNA, 18 bp, Homo sapiens
tctctgattctctgttct

SEQ ID NO: 23034 - DNA, 23 bp, Homo sapiens
tcttctgctttgttgtttgtgtt

SEQ ID NO: 23035 - DNA, 16 bp, Homo sapiens
ctgcttcttttgttct

SEQ ID NO: 23036 - DNA, 24 bp, Homo sapiens
tctttttttcttttctgaattctc

SEQ ID NO: 23037 - DNA, 23 bp, Homo sapiens
tctctgtctctcgaattgttctc

SEQ ID NO: 23038 - DNA, 24 bp, Homo sapiens
tcttttgtgtgttttctgtgttct

SEQ ID NO: 23039 - DNA, 20 bp, Homo sapiens
tctgattctttcggtttctc

SEQ ID NO: 23040 - DNA, 18 bp, Homo sapiens
tctctactttttttttat

SEQ ID NO: 23041 - DNA, 17 bp, Homo sapiens
tcttttcttttctggtc

SEQ ID NO: 23042 - DNA, 19 bp, Homo sapiens
tcttttcttttctctttct

SEQ ID NO: 23043 - DNA, 17 bp, Homo sapiens
tctctgctcttttctat

SEQ ID NO: 23044 - DNA, 18 bp, Homo sapiens
tctctgctccttttttgt

SEQ ID NO: 23045 - DNA, 19 bp, Homo sapiens
tctgttttctactggttct

SEQ ID NO: 23046 - DNA, 17 bp, Homo sapiens
tctttgcttttctggtt

SEQ ID NO: 23047 - DNA, 18 bp, Homo sapiens
tctctttgcttctgtgtt

SEQ ID NO: 23048 - DNA, 23 bp, Homo sapiens
tctcttctttttttctcattgtc

SEQ ID NO: 23049 - DNA, 20 bp, Homo sapiens
tctcagcttcttttcagctc

SEQ ID NO: 23050 - DNA, 18 bp, Homo sapiens
tctctgctctttgattct

SEQ ID NO: 23051 - DNA, 23 bp, Homo sapiens
tcttctgtttctttttggctttc

SEQ ID NO: 23052 - DNA, 17 bp, Homo sapiens
tctcttcttcttgtgtt

SEQ ID NO: 23053 - DNA, 21 bp, Homo sapiens
tctttgctctttcatattctc

SEQ ID NO: 23054 - DNA, 16 bp, Homo sapiens
gcttctttttgtttct

SEQ ID NO: 23055 - DNA, 23 bp, Homo sapiens
tctcttttttttttctgtcattc

SEQ ID NO: 23056 - DNA, 17 bp, Homo sapiens
tctctgctgcttgcgtt

SEQ ID NO: 23057 - DNA, 17 bp, Homo sapiens
tctcttcttttggttct

SEQ ID NO: 23058 - DNA, 18 bp, Homo sapiens
tctctgtatctttcttct

SEQ ID NO: 23059 - DNA, 16 bp, Homo sapiens
tctgtttcttttgttc

SEQ ID NO: 23060 - DNA, 18 bp, Homo sapiens
tctttcttctttttccgt

SEQ ID NO: 23061 - DNA, 22 bp, Homo sapiens
tctgtttctctttctccctgtc

SEQ ID NO: 23062 - DNA, 18 bp, Homo sapiens
cgtttcttttctgtagtc

SEQ ID NO: 23063 - DNA, 21 bp, Homo sapiens
tcttcttctttagtggttctc

SEQ ID NO: 23064 - DNA, 20 bp, Homo sapiens
tctctttttcttttctttct

SEQ ID NO: 23065 - DNA, 24 bp, Homo sapiens
tctctgtatttttaaagtgttctc

SEQ ID NO: 23066 - DNA, 17 bp, Homo sapiens
tctctttttttttctgt

SEQ ID NO: 23067 - DNA, 18 bp, Homo sapiens
tgcttctttttccttttc

SEQ ID NO: 23068 - DNA, 20 bp, Homo sapiens
ttcttttctgggctgttctc

SEQ ID NO: 23069 - DNA, 23 bp, Homo sapiens
tctgcttctttttaaattattct

SEQ ID NO: 23070 - DNA, 18 bp, Homo sapiens
tctcttcttctttcttct

SEQ ID NO: 23071 - DNA, 17 bp, Homo sapiens
tctttcttttctttctc

SEQ ID NO: 23072 - DNA, 18 bp, Homo sapiens
cctgcttctttttcagct

SEQ ID NO: 23073 - DNA, 21 bp, Homo sapiens
tcttttctttttttctatatt

SEQ ID NO: 23074 - DNA, 20 bp, Homo sapiens
ctgcttctttttgatgtctc

SEQ ID NO: 23075 - DNA, 17 bp, Homo sapiens
tcttttctttttgtgct

SEQ ID NO: 23076 - DNA, 21 bp, Homo sapiens
tctttcttctttctctttctc

SEQ ID NO: 23077 - DNA, 23 bp, Homo sapiens
tcttagtttcttttctatggctc

SEQ ID NO: 23078 - DNA, 16 bp, Homo sapiens
ctgctgcttgtgttct

SEQ ID NO: 23079 - DNA, 17 bp, Homo sapiens
tctgcttctttattccc

SEQ ID NO: 23080 - DNA, 19 bp, Homo sapiens
tctcgcttctttttatcct

SEQ ID NO: 23081 - DNA, 23 bp, Homo sapiens
tctatgcttctttttgtagcctc

SEQ ID NO: 23082 - DNA, 20 bp, Homo sapiens
tctctcttcttttctaggtt

SEQ ID NO: 23083 - DNA, 22 bp, Homo sapiens
tcctgctgcacttctgtgttct

SEQ ID NO: 23084 - DNA, 19 bp, Homo sapiens
tctgcttcttgaggttctc

SEQ ID NO: 23085 - DNA, 19 bp, Homo sapiens
tcctgtttcttctgttttc

SEQ ID NO: 23086 - DNA, 19 bp, Homo sapiens
tctgtctcttttctctact

SEQ ID NO: 23087 - DNA, 20 bp, Homo sapiens
tctgtttctcttcactttct

SEQ ID NO: 23088 - DNA, 21 bp, Homo sapiens
tcatacgtccttttttgtgtt

SEQ ID NO: 23089 - DNA, 19 bp, Homo sapiens
tctgcattcttcttgttct

SEQ ID NO: 23090 - DNA, 21 bp, Homo sapiens
tctctgctttttttccttctc

SEQ ID NO: 23091 - DNA, 16 bp, Homo sapiens
tctgcttatttgtgtt

SEQ ID NO: 23092 - DNA, 21 bp, Homo sapiens
tcctgtttctttcctctttct

SEQ ID NO: 23093 - DNA, 19 bp, Homo sapiens
tctctgtttctttgcccac

SEQ ID NO: 23094 - DNA, 65 bp, Rat cytomegalovirus
gggaggttcttatattccagggctctgacaggtatctcactgttatctcccctgggttttctcct

SEQ ID NO: 23095 - DNA, 18 bp, Rat cytomegalovirus
tcccctgggttttctcct

SEQ ID NO: 23096 - DNA, 17 bp, Homo sapiens
tcctcctggtctctcct

SEQ ID NO: 23097 - DNA, 17 bp, Homo sapiens
tcctcctgagccctcct

SEQ ID NO: 23098 - DNA, 18 bp, Homo sapiens
tctcctcgatcgtctcct

SEQ ID NO: 23099 - DNA, 18 bp, Homo sapiens
cctcctggggctgctcct

SEQ ID NO: 23100 - DNA, 18 bp, Homo sapiens
tccccagttcccgctcct

SEQ ID NO: 23101 - DNA, 15 bp, Homo sapiens
tcccctggctctcct

SEQ ID NO: 23102 - DNA, 18 bp, Homo sapiens
tcccctcgggagcctcct

SEQ ID NO: 23103 - DNA, 16 bp, Homo sapiens
tctccctccttctcct

SEQ ID NO: 23104 - DNA, 19 bp, Homo sapiens
tccctctggcctgcctcct

SEQ ID NO: 23105 - DNA, 16 bp, Homo sapiens
tcacctgaattctcct

SEQ ID NO: 23106 - DNA, 20 bp, Homo sapiens
tctcctgatgttttcttcta

SEQ ID NO: 23107 - DNA, 19 bp, Homo sapiens
tcccctaagccattcttct

SEQ ID NO: 23108 - DNA, 16 bp, Homo sapiens
tcccccattttctcct

SEQ ID NO: 23109 - DNA, 17 bp, Homo sapiens
tccacctggtctctcct

SEQ ID NO: 23110 - DNA, 16 bp, Homo sapiens
tcctcctgggcctcct

SEQ ID NO: 23111 - DNA, 18 bp, Homo sapiens
tccattcctttttctcct

SEQ ID NO: 23112 - DNA, 18 bp, Homo sapiens
tccccatgtcaccctcct

SEQ ID NO: 23113 - DNA, 20 bp, Homo sapiens
tctcctgcggcctcactcct

SEQ ID NO: 23114 - DNA, 19 bp, Homo sapiens
tcctctgtgtccggctcct

SEQ ID NO: 23115 - DNA, 21 bp, Homo sapiens
ccctgcacaagttttcttcta

SEQ ID NO: 23116 - DNA, 21 bp, Homo sapiens
tcctctgtgatatcctttcct

SEQ ID NO: 23117 - DNA, 16 bp, Homo sapiens
tcccctcccctctcct

SEQ ID NO: 23118 - DNA, 18 bp, Homo sapiens
tccctccctctttctcct

SEQ ID NO: 23119 - DNA, 19 bp, Homo sapiens
tcctgccttcccttctcct

SEQ ID NO: 23120 - DNA, 19 bp, Homo sapiens
ccctggacgattttttcct

SEQ ID NO: 23121 - DNA, 18 bp, Homo sapiens
tcctctgagctttcttct

SEQ ID NO: 23122 - DNA, 20 bp, Homo sapiens
tccctctctgattttcttct

SEQ ID NO: 23123 - DNA, 17 bp, Homo sapiens
tcctctgggctgtccct

SEQ ID NO: 23124 - DNA, 16 bp, Homo sapiens
tccccagggttctcct

SEQ ID NO: 23125 - DNA, 16 bp, Homo sapiens
tccctctgtctctcct

SEQ ID NO: 23126 - DNA, 16 bp, Homo sapiens
tcgcctgctttctcct

SEQ ID NO: 23127 - DNA, 19 bp, Homo sapiens
tcccctggcatggttctct

SEQ ID NO: 23128 - DNA, 16 bp, Homo sapiens
tcaccctccttctcct

SEQ ID NO: 23129 - DNA, 18 bp, Homo sapiens
ccccctgcagcttttcct

SEQ ID NO: 23130 - DNA, 16 bp, Homo sapiens
tcctcctccttctcct

SEQ ID NO: 23131 - DNA, 15 bp, Homo sapiens
tccccttcctctcct

SEQ ID NO: 23132 - DNA, 18 bp, Homo sapiens
ccccctgggcgtgcttct

SEQ ID NO: 23133 - DNA, 19 bp, Homo sapiens
tcctcctggcccgcctcct

SEQ ID NO: 23134 - DNA, 23 bp, Homo sapiens
tcctctgggaccaggttcttcta

SEQ ID NO: 23135 - DNA, 17 bp, Homo sapiens
tcacccttttctctcct

SEQ ID NO: 23136 - DNA, 19 bp, Homo sapiens
tctcctgggttcagttcct

SEQ ID NO: 23137 - DNA, 20 bp, Homo sapiens
tctgctgggtccaccctcct

SEQ ID NO: 23138 - DNA, 15 bp, Homo sapiens
tcccctccttctcct

SEQ ID NO: 23139 - DNA, 15 bp, Homo sapiens
tcccaatcttctcct

SEQ ID NO: 23140 - DNA, 20 bp, Homo sapiens
tcctctcggctcccgctcct

SEQ ID NO: 23141 - DNA, 16 bp, Homo sapiens
tcctcctggctctcct

SEQ ID NO: 23142 - DNA, 16 bp, Homo sapiens
tccccttgtctctcct

SEQ ID NO: 23143 - DNA, 18 bp, Homo sapiens
tcctcctgaaggccttcc

SEQ ID NO: 23144 - DNA, 20 bp, Homo sapiens
tccccttgcctcagttttct

SEQ ID NO: 23145 - DNA, 19 bp, Homo sapiens
tccccggggggccgctcct

SEQ ID NO: 23146 - DNA, 18 bp, Homo sapiens
tcctttggatcctctcct

SEQ ID NO: 23147 - DNA, 17 bp, Homo sapiens
tcccatatttttctcct

SEQ ID NO: 23148 - DNA, 17 bp, Homo sapiens
tcccatatctttctcct

SEQ ID NO: 23149 - DNA, 17 bp, Homo sapiens
tcctctggctgtcccct

SEQ ID NO: 23150 - DNA, 18 bp, Homo sapiens
tccctcgggttttcttct

SEQ ID NO: 23151 - DNA, 20 bp, Homo sapiens
tctcccggctccgatctcct

SEQ ID NO: 23152 - DNA, 20 bp, Homo sapiens
tcccactggcatcggttcct

SEQ ID NO: 23153 - DNA, 18 bp, Homo sapiens
cccctgggttcggatcct

SEQ ID NO: 23154 - DNA, 17 bp, Homo sapiens
tctcctgggcttttcct

SEQ ID NO: 23155 - DNA, 17 bp, Homo sapiens
tcctccagttttctcct

SEQ ID NO: 23156 - DNA, 21 bp, Homo sapiens
cctcctgggttcaattcttct

SEQ ID NO: 23157 - DNA, 18 bp, Homo sapiens
ccctctgggccccagctc

SEQ ID NO: 23158 - DNA, 19 bp, Homo sapiens
tccccagtatgaattttct

SEQ ID NO: 23159 - DNA, 18 bp, Homo sapiens
tctcctgtgtgctctcct

SEQ ID NO: 23160 - DNA, 19 bp, Homo sapiens
tctcctgtattactctcct

SEQ ID NO: 23161 - DNA, 18 bp, Homo sapiens
cctcctgggttttcttct

SEQ ID NO: 23162 - DNA, 19 bp, Homo sapiens
tcctctgggcctctctcct

SEQ ID NO: 23163 - DNA, 20 bp, Homo sapiens
cctcctgaagtatttttcct

SEQ ID NO: 23164 - DNA, 22 bp, Homo sapiens
tcctcccagactgttttcttct

SEQ ID NO: 23165 - DNA, 19 bp, Homo sapiens
ccctagtgtttgttcttct

SEQ ID NO: 23166 - DNA, 19 bp, Homo sapiens
tcccttcctgacttctcct

SEQ ID NO: 23167 - DNA, 16 bp, Homo sapiens
tcccgtggcttctcct

SEQ ID NO: 23168 - DNA, 18 bp, Homo sapiens
ccctgggtagtttttcct

SEQ ID NO: 23169 - DNA, 18 bp, Homo sapiens
tcccatgtagtatctcct

SEQ ID NO: 23170 - DNA, 18 bp, Homo sapiens
ccctaccagctttcttct

SEQ ID NO: 23171 - DNA, 20 bp, Homo sapiens
tcccctagcggccctttcct

SEQ ID NO: 23172 - DNA, 18 bp, Homo sapiens
cctgaagatttttctcct

SEQ ID NO: 23173 - DNA, 21 bp, Homo sapiens
tccgcgccttagttttcttct

SEQ ID NO: 23174 - DNA, 18 bp, Homo sapiens
tcacctgcctcttctcct

SEQ ID NO: 23175 - DNA, 18 bp, Homo sapiens
tcccttgaaacttttcct

SEQ ID NO: 23176 - DNA, 20 bp, Homo sapiens
ccctctaatgcttttctcct

SEQ ID NO: 23177 - DNA, 19 bp, Homo sapiens
tccccttttcccctctcct

SEQ ID NO: 23178 - DNA, 18 bp, Homo sapiens
tcacctggcctctctcct

SEQ ID NO: 23179 - DNA, 19 bp, Homo sapiens
tcctccccgaatttctcct

SEQ ID NO: 23180 - DNA, 20 bp, Homo sapiens
tcctcctgatcctttctcct

SEQ ID NO: 23181 - DNA, 19 bp, Homo sapiens
tcctcctgggagacctcct

SEQ ID NO: 23182 - DNA, 18 bp, Homo sapiens
cctccttggctttcttct

SEQ ID NO: 23183 - DNA, 21 bp, Homo sapiens
tcctctgaagatatttctcct

SEQ ID NO: 23184 - DNA, 15 bp, Homo sapiens
tccccatcttctcct

SEQ ID NO: 23185 - DNA, 19 bp, Homo sapiens
tcccccggggccccatcct

SEQ ID NO: 23186 - DNA, 18 bp, Homo sapiens
cctctcgatgtttctcct

SEQ ID NO: 23187 - DNA, 18 bp, Homo sapiens
ccaggtgagttttctcct

SEQ ID NO: 23188 - DNA, 16 bp, Homo sapiens
tccccgatcatctcct

SEQ ID NO: 23189 - DNA, 20 bp, Homo sapiens
cctcttggaaaacttctcct

SEQ ID NO: 23190 - DNA, 18 bp, Homo sapiens
ccctgagctttttttcct

SEQ ID NO: 23191 - DNA, 16 bp, Homo sapiens
tcctcccacctctcct

SEQ ID NO: 23192 - DNA, 19 bp, Homo sapiens
tcctcctgccacctctcct

SEQ ID NO: 23193 - DNA, 24 bp, Homo sapiens
tccctttattagcgttttcttcta

SEQ ID NO: 23194 - DNA, 17 bp, Homo sapiens
tcccctggtcccttcct

SEQ ID NO: 23195 - DNA, 21 bp, Homo sapiens
tccccgtggcccctgtctcct

SEQ ID NO: 23196 - DNA, 17 bp, Homo sapiens
tccgcctggcctctcct

SEQ ID NO: 23197 - DNA, 19 bp, Homo sapiens
cccccgatttctttctcct

SEQ ID NO: 23198 - DNA, 19 bp, Homo sapiens
tctcctgggggcccatcct

SEQ ID NO: 23199 - DNA, 20 bp, Homo sapiens
tctcctgtgccctctctcct

SEQ ID NO: 23200 - DNA, 18 bp, Homo sapiens
tcccccctcccttctcct

SEQ ID NO: 23201 - DNA, 19 bp, Homo sapiens
tcctcctcctccttctcct

SEQ ID NO: 23202 - DNA, 21 bp, Homo sapiens
tcccccagaggttttttccta

SEQ ID NO: 23203 - DNA, 20 bp, Homo sapiens
tccttctggagcagcctcct

SEQ ID NO: 23204 - DNA, 18 bp, Homo sapiens
cctcctaccggctctcct

SEQ ID NO: 23205 - DNA, 19 bp, Homo sapiens
ccccctgcctgcttctcct

SEQ ID NO: 23206 - DNA, 15 bp, Homo sapiens
tcccgattttctcct

SEQ ID NO: 23207 - DNA, 19 bp, Homo sapiens
tcctctgagtccaggccct

SEQ ID NO: 23208 - DNA, 18 bp, Homo sapiens
tccgtctgcttttctcct

SEQ ID NO: 23209 - DNA, 19 bp, Homo sapiens
ccctcggggctccgctcct

SEQ ID NO: 23210 - DNA, 18 bp, Homo sapiens
tctcccgggatctctcct

SEQ ID NO: 23211 - DNA, 18 bp, Homo sapiens
tcctcctcttcctctcct

SEQ ID NO: 23212 - DNA, 18 bp, Homo sapiens
tctcctgggctcagtcct

SEQ ID NO: 23213 - DNA, 17 bp, Homo sapiens
ccctccttagttctcct

SEQ ID NO: 23214 - DNA, 24 bp, Homo sapiens
tctcctggaccctattttcttcta

SEQ ID NO: 23215 - DNA, 18 bp, Homo sapiens
tcccctgggttgactcct

SEQ ID NO: 23216 - DNA, 16 bp, Homo sapiens
ccccctggatgctcct

SEQ ID NO: 23217 - DNA, 19 bp, Homo sapiens
tctcctgggcctgtttcct

SEQ ID NO: 23218 - DNA, 18 bp, Homo sapiens
tcccctaggtgaccccct

SEQ ID NO: 23219 - DNA, 19 bp, Homo sapiens
tcctcatcctaaatctcct

SEQ ID NO: 23220 - DNA, 16 bp, Homo sapiens
tcccctgccctctcct

SEQ ID NO: 23221 - DNA, 20 bp, Homo sapiens
tcccattgctcaggttttct

SEQ ID NO: 23222 - DNA, 25 bp, Homo sapiens
tctcctgggttcaagaattttccta

SEQ ID NO: 23223 - DNA, 15 bp, Homo sapiens
ccccctttttctcct

SEQ ID NO: 23224 - DNA, 18 bp, Homo sapiens
cctctgaatgcttctcct

SEQ ID NO: 23225 - DNA, 21 bp, Homo sapiens
tccccagggtgagcctttcct

SEQ ID NO: 23226 - DNA, 17 bp, Homo sapiens
tcccgctgggttctcct

SEQ ID NO: 23227 - DNA, 18 bp, Homo sapiens
tccccctctccttctcct

SEQ ID NO: 23228 - DNA, 15 bp, Homo sapiens
tcccctggctcccct

SEQ ID NO: 23229 - DNA, 19 bp, Homo sapiens
tccccttggccccctctct

SEQ ID NO: 23230 - DNA, 19 bp, Homo sapiens
ccccttgcgttgttctcct

SEQ ID NO: 23231 - DNA, 17 bp, Homo sapiens
tcccctggccttctcct

SEQ ID NO: 23232 - DNA, 17 bp, Homo sapiens
ccccctcagcttttcct

SEQ ID NO: 23233 - DNA, 16 bp, Homo sapiens
tcaccctgtttctcct

SEQ ID NO: 23234 - DNA, 17 bp, Homo sapiens
tcccctggccccgtcct

SEQ ID NO: 23235 - DNA, 20 bp, Homo sapiens
tcctcctgggtcggcctctc

SEQ ID NO: 23236 - DNA, 21 bp, Homo sapiens
tcctcctgggctgaacctcct

SEQ ID NO: 23237 - DNA, 20 bp, Homo sapiens
tccccctggaggggccttct

SEQ ID NO: 23238 - DNA, 20 bp, Homo sapiens
tctccctggggccactttct

SEQ ID NO: 23239 - DNA, 18 bp, Homo sapiens
tcccttgcagcttctcct

SEQ ID NO: 23240 - DNA, 16 bp, Homo sapiens
tcctcctctttctcct

SEQ ID NO: 23241 - DNA, 21 bp, Homo sapiens
ctgggcttcggttttctccta

SEQ ID NO: 23242 - DNA, 19 bp, Homo sapiens
tcctctgtctctctctcct

SEQ ID NO: 23243 - DNA, 21 bp, Homo sapiens
tccgctgtgacgttttctcct

SEQ ID NO: 23244 - DNA, 17 bp, Homo sapiens
tcctccgcttttctcct

SEQ ID NO: 23245 - DNA, 19 bp, Homo sapiens
tccccttgaggccatttct

SEQ ID NO: 23246 - DNA, 16 bp, Homo sapiens
tccactatcttctcct

SEQ ID NO: 23247 - DNA, 20 bp, Homo sapiens
tcctcctgaagccctttcct

SEQ ID NO: 23248 - DNA, 20 bp, Homo sapiens
tccccttggagtggccttct

SEQ ID NO: 23249 - DNA, 18 bp, Homo sapiens
tcctcctgtaggtttcct

SEQ ID NO: 23250 - DNA, 18 bp, Homo sapiens
ccccctggagcttttcct

SEQ ID NO: 23251 - DNA, 20 bp, Homo sapiens
tcctccgggatgcttttcct

SEQ ID NO: 23252 - DNA, 20 bp, Homo sapiens
tctccctggttccctctcct

SEQ ID NO: 23253 - DNA, 18 bp, Homo sapiens
tccaggcctggctctcct

SEQ ID NO: 23254 - DNA, 16 bp, Homo sapiens
tccctcgggctcccct

SEQ ID NO: 23255 - DNA, 17 bp, Homo sapiens
tccccctggctgctcct

SEQ ID NO: 23256 - DNA, 19 bp, Homo sapiens
ccccttggaggactctcct

SEQ ID NO: 23257 - DNA, 21 bp, Homo sapiens
cccctgggtaaaaagtctcct

SEQ ID NO: 23258 - DNA, 16 bp, Homo sapiens
ccctcctggttctcct

SEQ ID NO: 23259 - DNA, 16 bp, Homo sapiens
tcccaccccttctcct

SEQ ID NO: 23260 - DNA, 16 bp, Homo sapiens
tccccagctatctcct

SEQ ID NO: 23261 - DNA, 19 bp, Homo sapiens
tccactgcagggctctcct

SEQ ID NO: 23262 - DNA, 17 bp, Homo sapiens
cccccatagtttctcct

SEQ ID NO: 23263 - DNA, 20 bp, Homo sapiens
tctcctaggccctgcttcct

SEQ ID NO: 23264 - DNA, 16 bp, Homo sapiens
tccctctggctctcct

SEQ ID NO: 23265 - DNA, 22 bp, Homo sapiens
tccccatgcacatatttctcct

SEQ ID NO: 23266 - DNA, 15 bp, Homo sapiens
ccccctgggcctcct

SEQ ID NO: 23267 - DNA, 17 bp, Homo sapiens
tcccctcctcctctcct

SEQ ID NO: 23268 - DNA, 20 bp, Homo sapiens
ccctgggtctgttttcttct

SEQ ID NO: 23269 - DNA, 18 bp, Homo sapiens
cctcttaacttttctcct

SEQ ID NO: 23270 - DNA, 18 bp, Homo sapiens
ccctgggtcccttttcct

SEQ ID NO: 23271 - DNA, 24 bp, Homo sapiens
tcccctgggtccggtgttcttcta

SEQ ID NO: 23272 - DNA, 15 bp, Homo sapiens
tccccaggttctcct

SEQ ID NO: 23273 - DNA, 18 bp, Homo sapiens
cctcctgggccagctcct

SEQ ID NO: 23274 - DNA, 20 bp, Homo sapiens
tcctctccttcctttctcct

SEQ ID NO: 23275 - DNA, 18 bp, Homo sapiens
ccagtgcagttttctcct

SEQ ID NO: 23276 - DNA, 21 bp, Homo sapiens
tccctctgctataattctcct

SEQ ID NO: 23277 - DNA, 16 bp, Homo sapiens
tccactggcttctcct

SEQ ID NO: 23278 - DNA, 19 bp, Homo sapiens
tcctgctgggtcagcccct

SEQ ID NO: 23279 - DNA, 19 bp, Homo sapiens
tcctcctgccgcctctcct

SEQ ID NO: 23280 - DNA, 18 bp, Homo sapiens
tcccctgtggcttctcct

SEQ ID NO: 23281 - DNA, 18 bp, Homo sapiens
tcaccaagagtttctcct

SEQ ID NO: 23282 - DNA, 18 bp, Homo sapiens
tccctctaaatttttcct

SEQ ID NO: 23283 - DNA, 19 bp, Homo sapiens
tctcctgggctccaggcct

SEQ ID NO: 23284 - DNA, 16 bp, Homo sapiens
tccccgtctgtctcct

SEQ ID NO: 23285 - DNA, 18 bp, Homo sapiens
cctactgagttttcttct

SEQ ID NO: 23286 - DNA, 16 bp, Homo sapiens
tctccctacctctcct

SEQ ID NO: 23287 - DNA, 21 bp, Homo sapiens
tcccctggcgagccacctcct

SEQ ID NO: 23288 - DNA, 16 bp, Homo sapiens
tcacccttcctctcct

SEQ ID NO: 23289 - DNA, 19 bp, Homo sapiens
cccctgggctgtggctcct

SEQ ID NO: 23290 - DNA, 17 bp, Homo sapiens
tccccgaggcctctcct

SEQ ID NO: 23291 - DNA, 17 bp, Homo sapiens
tccccatggcctctcct

SEQ ID NO: 23292 - DNA, 16 bp, Homo sapiens
tcctcctgagcctcct

SEQ ID NO: 23293 - DNA, 17 bp, Homo sapiens
tcccccgggtgccgcct

SEQ ID NO: 23294 - DNA, 17 bp, Homo sapiens
ccccctgcctctctcct

SEQ ID NO: 23295 - DNA, 19 bp, Homo sapiens
tccactttgtccttctcct

SEQ ID NO: 23296 - DNA, 18 bp, Homo sapiens
tctcctaacttttcttct

SEQ ID NO: 23297 - DNA, 18 bp, Homo sapiens
tccccatgggggcttcct

SEQ ID NO: 23298 - DNA, 15 bp, Homo sapiens
ccccccacttctcct

SEQ ID NO: 23299 - DNA, 18 bp, Homo sapiens
tcccctggcccttctcct

SEQ ID NO: 23300 - DNA, 21 bp, Homo sapiens
tcccactgggggtcggttcct

SEQ ID NO: 23301 - DNA, 18 bp, Homo sapiens
tcccctaggccttttcct

SEQ ID NO: 23302 - DNA, 16 bp, Homo sapiens
tcctctgacttctcct

SEQ ID NO: 23303 - DNA, 15 bp, Homo sapiens
ccccctacctctcct

SEQ ID NO: 23304 - DNA, 16 bp, Homo sapiens
tccccagggctctcct

SEQ ID NO: 23305 - DNA, 19 bp, Homo sapiens
tctcctgtgtcagcctcct

SEQ ID NO: 23306 - DNA, 17 bp, Homo sapiens
tcctcctgccttctcct

SEQ ID NO: 23307 - DNA, 18 bp, Homo sapiens
ccttaagtagtttctcct

SEQ ID NO: 23308 - DNA, 19 bp, Homo sapiens
ccctcctgccctttttcct

SEQ ID NO: 23309 - DNA, 19 bp, Homo sapiens
tccacctttcccttctcct

SEQ ID NO: 23310 - DNA, 17 bp, Homo sapiens
tcctcctgcgctctcct

SEQ ID NO: 23311 - DNA, 19 bp, Homo sapiens
tctcctggatggttctcct

SEQ ID NO: 23312 - DNA, 131 bp, Equine herpesvirus 1
atatacccccaattagcccccaattggcacatggtaatataccgccatggcgccgtgcttggtattggtggtgatgttcacataaacagccagctgggggtgttttgtttaggtgggcttttgtggtatat

SEQ ID NO: 23313 - DNA, 24 bp, Equine herpesvirus 1
ttcacataaacagccagctggggg

SEQ ID NO: 23314 - DNA, 18 bp, Homo sapiens
tcacgggccagctggggg

SEQ ID NO: 23315 - DNA, 17 bp, Homo sapiens
ttcacataaacaccagc

SEQ ID NO: 23316 - DNA, 15 bp, Homo sapiens
cataaacagctgggg

SEQ ID NO: 23317 - DNA, 25 bp, Homo sapiens
ttcacataagcatgggggctggggg

SEQ ID NO: 23318 - DNA, 20 bp, Homo sapiens
ttcacaaggcagccaagagg

SEQ ID NO: 23319 - DNA, 22 bp, Homo sapiens
ttccatatagatacgctggggg

SEQ ID NO: 23320 - DNA, 18 bp, Homo sapiens
ttcatataaacagtcgcc

SEQ ID NO: 23321 - DNA, 22 bp, Homo sapiens
tcatgtaaacagcaggtggggg

SEQ ID NO: 23322 - DNA, 16 bp, Homo sapiens
tcacataagcggccgg

SEQ ID NO: 23323 - DNA, 19 bp, Homo sapiens
ttcgcatcaagtagctggg

SEQ ID NO: 23324 - DNA, 18 bp, Homo sapiens
ttcacataaatatctagg

SEQ ID NO: 23325 - DNA, 23 bp, Homo sapiens
ctcaccacatggccagctggggg

SEQ ID NO: 23326 - DNA, 22 bp, Homo sapiens
ttcacaaggcagccaaaccggg

SEQ ID NO: 23327 - DNA, 20 bp, Homo sapiens
ttcacatgagaagctgaagg

SEQ ID NO: 23328 - DNA, 25 bp, Homo sapiens
ttcacataaaaagtcagaattctgg

SEQ ID NO: 23329 - DNA, 19 bp, Homo sapiens
ttcacagggcagccaccgg

SEQ ID NO: 23330 - DNA, 19 bp, Homo sapiens
ttcacataaatatctgggg

SEQ ID NO: 23331 - DNA, 18 bp, Homo sapiens
acatgtgagcagctagaa

SEQ ID NO: 23332 - DNA, 19 bp, Homo sapiens
ttcatataaacaatcaggg

SEQ ID NO: 23333 - DNA, 21 bp, Homo sapiens
ttcaggtaggcaggccggggg

SEQ ID NO: 23334 - DNA, 21 bp, Homo sapiens
ttcagataggcagccagaggg

SEQ ID NO: 23335 - DNA, 19 bp, Homo sapiens
cattaaaaacagctggggg

SEQ ID NO: 23336 - DNA, 19 bp, Homo sapiens
acataaacagctggcactg

SEQ ID NO: 23337 - DNA, 18 bp, Homo sapiens
cataaacagctgtgaagg

SEQ ID NO: 23338 - DNA, 25 bp, Homo sapiens
ttcacataagtgccaggcttggggg

SEQ ID NO: 23339 - DNA, 20 bp, Homo sapiens
ttcatataaacagcatgaaa

SEQ ID NO: 23340 - DNA, 23 bp, Homo sapiens
ttcacaagacacggtgctggggg

SEQ ID NO: 23341 - DNA, 67 bp, Equine herpesvirus 1
cagctgcaatagcatcagtaaacagttttccattctaaaaatatctatgggattatgctatgcactg

SEQ ID NO: 23342 - DNA, 24 bp, Equine herpesvirus 1
agtaaacagttttccattctaaaa

SEQ ID NO: 23343 - DNA, 21 bp, Homo sapiens
agtaaacagttctttttccaa

SEQ ID NO: 23344 - DNA, 20 bp, Homo sapiens
agtaaacattttccatttct

SEQ ID NO: 23345 - DNA, 20 bp, Homo sapiens
agcaagcttccctattctaa

SEQ ID NO: 23346 - DNA, 20 bp, Homo sapiens
agcaaacaaaagaacattct

SEQ ID NO: 23347 - DNA, 19 bp, Homo sapiens
agagaacagttttccccct

SEQ ID NO: 23348 - DNA, 18 bp, Homo sapiens
gtaaacagccaagattct

SEQ ID NO: 23349 - DNA, 19 bp, Homo sapiens
agtaaacagttcttttcca

SEQ ID NO: 23350 - DNA, 17 bp, Homo sapiens
agtagttcctccattct

SEQ ID NO: 23351 - DNA, 15 bp, Homo sapiens
ataaatttccattct

SEQ ID NO: 23352 - DNA, 17 bp, Homo sapiens
gtaaacagtttttattc

SEQ ID NO: 23353 - DNA, 22 bp, Homo sapiens
agtgaacaattcattttctaaa

SEQ ID NO: 23354 - DNA, 15 bp, Homo sapiens
gtaaacagtttttct

SEQ ID NO: 23355 - DNA, 19 bp, Homo sapiens
aataaacagttctctttct

SEQ ID NO: 23356 - DNA, 19 bp, Homo sapiens
agtatacagcaattctaaa

SEQ ID NO: 23357 - DNA, 21 bp, Homo sapiens
agtagcagctttattctaaaa

SEQ ID NO: 23358 - DNA, 20 bp, Homo sapiens
gcaaacagttttgtctttct

SEQ ID NO: 23359 - DNA, 21 bp, Homo sapiens
gtaagatcttccattttaaaa

SEQ ID NO: 23360 - DNA, 17 bp, Homo sapiens
aataaacagttttcatc

SEQ ID NO: 23361 - DNA, 17 bp, Homo sapiens
agtagacattttccatc

SEQ ID NO: 23362 - DNA, 16 bp, Homo sapiens
ataaacagtttttcta

SEQ ID NO: 23363 - DNA, 19 bp, Homo sapiens
ataaacagtgatttccatt

SEQ ID NO: 23364 - DNA, 22 bp, Homo sapiens
gtaaatgctttcttttctaaaa

SEQ ID NO: 23365 - DNA, 19 bp, Homo sapiens
agaaacagtttcttcttct

SEQ ID NO: 23366 - DNA, 19 bp, Homo sapiens
agtaaacattttaaccatt

SEQ ID NO: 23367 - DNA, 19 bp, Homo sapiens
agtaagaagttttccagtc

SEQ ID NO: 23368 - DNA, 24 bp, Homo sapiens
agtaggcagtttctccttctaaaa

SEQ ID NO: 23369 - DNA, 18 bp, Homo sapiens
agttaacagtctattcta

SEQ ID NO: 23370 - DNA, 18 bp, Homo sapiens
agtgaacaggtttccatt

SEQ ID NO: 23371 - DNA, 23 bp, Homo sapiens
aatagacagttttctatttcaaa

SEQ ID NO: 23372 - DNA, 17 bp, Homo sapiens
agtaaacagtttttcta

SEQ ID NO: 23373 - DNA, 19 bp, Homo sapiens
agtaaacagctttactaaa

SEQ ID NO: 23374 - DNA, 68 bp, Equine herpesvirus 1
agatctcccccatgcaaatgttttagggtaggctgtacatggaataggtaaacgcttgggggtcttct

SEQ ID NO: 23375 - DNA, 24 bp, Equine herpesvirus 1
tggaataggtaaacgcttgggggt

SEQ ID NO: 23376 - DNA, 16 bp, Homo sapiens
ggataggacttggggg

SEQ ID NO: 23377 - DNA, 19 bp, Homo sapiens
tggagaggtgggccagggg

SEQ ID NO: 23378 - DNA, 19 bp, Homo sapiens
tggagaggtgggcaggggg

SEQ ID NO: 23379 - DNA, 18 bp, Homo sapiens
tggaacaggatttggggg

SEQ ID NO: 23380 - DNA, 18 bp, Homo sapiens
tggatagtggcttggggg

SEQ ID NO: 23381 - DNA, 22 bp, Homo sapiens
ggatgggtggacagctgggggt

SEQ ID NO: 23382 - DNA, 19 bp, Homo sapiens
tgggatagataaacgtctg

SEQ ID NO: 23383 - DNA, 22 bp, Homo sapiens
tggggtggggaaagaaccgggg

SEQ ID NO: 23384 - DNA, 22 bp, Homo sapiens
tggaataggcaggccgcagggt

SEQ ID NO: 23385 - DNA, 18 bp, Homo sapiens
tggggaggtatttggggg

SEQ ID NO: 23386 - DNA, 83 bp, Equine herpesvirus 1
gtttgggaaaaggagatttctgcaggtgcagtggttcccccgggccttatatcttgcagctttagaaatctgctttctcaaac

SEQ ID NO: 23387 - DNA, 24 bp, Equine herpesvirus 1
tatcttgcagctttagaaatctgc

SEQ ID NO: 23388 - DNA, 19 bp, Homo sapiens
ttgcagctttaaattctgc

SEQ ID NO: 23389 - DNA, 17 bp, Homo sapiens
tcttccagaaaaatctg

SEQ ID NO: 23390 - DNA, 18 bp, Homo sapiens
tattttgcacctttaaaa

SEQ ID NO: 23391 - DNA, 22 bp, Homo sapiens
tgctagtacttttggaaatctg

SEQ ID NO: 23392 - DNA, 24 bp, Homo sapiens
tcttcaagtcttttggaaatctgc

SEQ ID NO: 23393 - DNA, 17 bp, Homo sapiens
tatcttgcagctttgaa

SEQ ID NO: 23394 - DNA, 18 bp, Homo sapiens
ttccagctccatatctgc

SEQ ID NO: 23395 - DNA, 19 bp, Homo sapiens
tatcctgtagctttaaatg

SEQ ID NO: 23396 - DNA, 22 bp, Homo sapiens
tattttgttgcctggaaatctg

SEQ ID NO: 23397 - DNA, 19 bp, Homo sapiens
tctctaatttagaaatctg

SEQ ID NO: 23398 - DNA, 18 bp, Homo sapiens
aactctttggaaatctgc

SEQ ID NO: 23399 - DNA, 22 bp, Homo sapiens
tatctgcagctttgttcttctg

SEQ ID NO: 23400 - DNA, 63 bp, Ectromelia virus
gtccaacaacatatactcatagagcttatcaaacatcccctgtgcccatctaggttgccagac

SEQ ID NO: 23401 - DNA, 24 bp, Ectromelia virus
aacaacatatactcatagagctta

SEQ ID NO: 23402 - DNA, 15 bp, Homo sapiens
aacataatagagctt

SEQ ID NO: 23403 - DNA, 20 bp, Homo sapiens
aacaacacacactggggctt

SEQ ID NO: 23404 - DNA, 20 bp, Homo sapiens
aacaacatatgctgctgctc

SEQ ID NO: 23405 - DNA, 21 bp, Homo sapiens
aacatgtactacaaaagctta

SEQ ID NO: 23406 - DNA, 17 bp, Homo sapiens
atatatcataaagctta

SEQ ID NO: 23407 - DNA, 15 bp, Homo sapiens
aacatacacaggctt

SEQ ID NO: 23408 - DNA, 19 bp, Homo sapiens
aacatttttatagagctta

SEQ ID NO: 23409 - DNA, 15 bp, Homo sapiens
aacatatactcatgc

SEQ ID NO: 23410 - DNA, 19 bp, Homo sapiens
aacaaatactgaaagctta

SEQ ID NO: 23411 - DNA, 17 bp, Homo sapiens
caacatatttcatgctt

SEQ ID NO: 23412 - DNA, 18 bp, Homo sapiens
aacggatactcatgaact

SEQ ID NO: 23413 - DNA, 17 bp, Homo sapiens
aacaatatatactctag

SEQ ID NO: 23414 - DNA, 19 bp, Homo sapiens
aacaacatatacatatgaa

SEQ ID NO: 23415 - DNA, 31 bp, Homo sapiens
aacaacatgtgcctgccctcatggagcttat

SEQ ID NO: 23416 - DNA, 21 bp, Homo sapiens
acagcatatactgggaggctt

SEQ ID NO: 23417 - DNA, 112 bp, Ectromelia virus
ggtttaatattttcttagtacaaaagtcaatgttttaaaatatatggatgagagaatatttgtctgtataaaaactgtgtgaaattttgtaccaaagaaaaaaacgtgagcc

SEQ ID NO: 23418 - DNA, 24 bp, Ectromelia virus
tattttcttagtacaaaagtcaat

SEQ ID NO: 23419 - DNA, 19 bp, Homo sapiens
ttttcctagatgaaagtca

SEQ ID NO: 23420 - DNA, 20 bp, Homo sapiens
tattttcttagttgcaaagt

SEQ ID NO: 23421 - DNA, 16 bp, Homo sapiens
ttttcttacacaagtc

SEQ ID NO: 23422 - DNA, 22 bp, Homo sapiens
attttctgtaataaaagtcaat

SEQ ID NO: 23423 - DNA, 17 bp, Homo sapiens
tattttcttagtgtcaa

SEQ ID NO: 23424 - DNA, 23 bp, Homo sapiens
tattctcttaccagaaagggtca

SEQ ID NO: 23425 - DNA, 19 bp, Homo sapiens
tattttctaagtacaaagc

SEQ ID NO: 23426 - DNA, 131 bp, Ectromelia virus
ccatcagaaagagaataaaaatatttttgtaaaacttttttatgagaccatcgaagagagaaagagataaaacttttttacgactccatcagaaagagaataaaaatatttttgtaaaacttttttatgag

SEQ ID NO: 23427 - DNA, 24 bp, Ectromelia virus
tcagaaagagaataaaaatatttt

SEQ ID NO: 23428 - DNA, 23 bp, Homo sapiens
agaaaaggtaataaaaatatttt

SEQ ID NO: 23429 - DNA, 18 bp, Homo sapiens
agaaaataaaaatatttt

SEQ ID NO: 23430 - DNA, 21 bp, Homo sapiens
agaaaaagagtaaaacacttt

SEQ ID NO: 23431 - DNA, 21 bp, Homo sapiens
tcagagagagactaaaatatt

SEQ ID NO: 23432 - DNA, 21 bp, Homo sapiens
tcaggcagagtaaaatatttt

SEQ ID NO: 23433 - DNA, 21 bp, Homo sapiens
agaaagagaaatttctatttt

SEQ ID NO: 23434 - DNA, 19 bp, Homo sapiens
tcagaaagggaacagaaac

SEQ ID NO: 23435 - DNA, 20 bp, Homo sapiens
tcagagagacaaaatatttt

SEQ ID NO: 23436 - DNA, 25 bp, Homo sapiens
tcagagagcatgaaaaaaatatttt

SEQ ID NO: 23437 - DNA, 21 bp, Homo sapiens
tcagaaagaaatgggaaaaca

SEQ ID NO: 23438 - DNA, 20 bp, Homo sapiens
tcagaaagtggaatgcaaat

SEQ ID NO: 23439 - DNA, 21 bp, Homo sapiens
cagaaggagagtaaacatttt

SEQ ID NO: 23440 - DNA, 26 bp, Homo sapiens
tcagaaagggaaaggagatacatttt

SEQ ID NO: 23441 - DNA, 28 bp, Homo sapiens
gaaaaagaagaggagtaaaaatatttta

SEQ ID NO: 23442 - DNA, 19 bp, Homo sapiens
tcatggagagaataaaaac

SEQ ID NO: 23443 - DNA, 68 bp, Melanoplus sanguinipes entomopoxvirus
tattaaatgttgtatttttactaggttcaggtatattctcaaacccataaaaatttttaatttcaata

SEQ ID NO: 23444 - DNA, 24 bp, Melanoplus sanguinipes entomopoxvirus
ttaaatgttgtatttttactaggt

SEQ ID NO: 23445 - DNA, 21 bp, Homo sapiens
atgtcaatatttttattaggt

SEQ ID NO: 23446 - DNA, 20 bp, Homo sapiens
atgcagtgtttttactaggt

SEQ ID NO: 23447 - DNA, 19 bp, Homo sapiens
ttaaatttgtatttttact

SEQ ID NO: 23448 - DNA, 21 bp, Homo sapiens
ttaaatgttgtttccaaaggt

SEQ ID NO: 23449 - DNA, 21 bp, Homo sapiens
aatgatgtattctccataggt

SEQ ID NO: 23450 - DNA, 129 bp, Melanoplus sanguinipes entomopoxvirus
catcgttaaaatttttagcatatccatcattttttaaattttcaaatgattctctagatttccataaatatcctggatctaaattagaatcagaaactttaaatttatattctatagtttttaatgatg

SEQ ID NO: 23451 - DNA, 24 bp, Melanoplus sanguinipes entomopoxvirus
tagcatatccatcattttttaaat

SEQ ID NO: 23452 - DNA, 22 bp, Homo sapiens
agcatatctatcaaatctaaat

SEQ ID NO: 23453 - DNA, 19 bp, Homo sapiens
catcatcatcattttttaa

SEQ ID NO: 23454 - DNA, 21 bp, Homo sapiens
tagcaatgtccactcctttaa

SEQ ID NO: 23455 - DNA, 19 bp, Homo sapiens
tagcatatctacacaatct

SEQ ID NO: 23456 - DNA, 19 bp, Homo sapiens
tagcatatcaatctttaaa

SEQ ID NO: 23457 - DNA, 19 bp, Homo sapiens
catccatcattttttaaat

SEQ ID NO: 23458 - DNA, 22 bp, Homo sapiens
tagcatatcatatctcctaaat

SEQ ID NO: 23459 - DNA, 19 bp, Homo sapiens
tagcatattttatcatttt

SEQ ID NO: 23460 - DNA, 22 bp, Homo sapiens
gcctcaaaatcattttttaaat

SEQ ID NO: 23461 - DNA, 24 bp, Homo sapiens
agcataatccatcattttttaaat

SEQ ID NO: 23462 - DNA, 24 bp, Homo sapiens
tagcatacttcaactcttttaaat

SEQ ID NO: 23463 - DNA, 62 bp, Melanoplus sanguinipes entomopoxvirus
aaataatggataataattagtatttatataactaaatatggatctatcattattaattattt

SEQ ID NO: 23464 - DNA, 24 bp, Melanoplus sanguinipes entomopoxvirus
tggataataattagtatttatata

SEQ ID NO: 23465 - DNA, 19 bp, Homo sapiens
tgggcagtaattagtacct

SEQ ID NO: 23466 - DNA, 22 bp, Homo sapiens
tggatatacatatatttatata

SEQ ID NO: 23467 - DNA, 19 bp, Homo sapiens
tggaaataattagtatcca

SEQ ID NO: 23468 - DNA, 17 bp, Homo sapiens
ggataaagtatttatat

SEQ ID NO: 23469 - DNA, 69 bp, Melanoplus sanguinipes entomopoxvirus
tagatattggattattataaaataaaaaattaaaaaattttttgttaaattttaatttattaatatcta

SEQ ID NO: 23470 - DNA, 24 bp, Melanoplus sanguinipes entomopoxvirus
tattggattattataaaataaaaa

SEQ ID NO: 23471 - DNA, 24 bp, Homo sapiens
tattggatgtattatattacaaaa

SEQ ID NO: 23472 - DNA, 24 bp, Homo sapiens
tattgggctatattaaaataaaaa

SEQ ID NO: 23473 - DNA, 23 bp, Homo sapiens
tattggatcacaaaaaatgaaaa

SEQ ID NO: 23474 - DNA, 20 bp, Homo sapiens
tattggaaataataaaataa

SEQ ID NO: 23475 - DNA, 21 bp, Homo sapiens
agccttattataaaataaaaa

SEQ ID NO: 23476 - DNA, 17 bp, Homo sapiens
tattggattatttaaaa

SEQ ID NO: 23477 - DNA, 61 bp, Tupaia herpesvirus
gacggtggaggggcgggcgccacgggctcgggggaggatggcgcttggcctgcagaccgtc

SEQ ID NO: 23478 - DNA, 21 bp, Tupaia herpesvirus
gcgcttggcctgcagaccgtc

SEQ ID NO: 23479 - DNA, 21 bp, Homo sapiens
gcgctcggcccggcagccgtc

SEQ ID NO: 23480 - DNA, 20 bp, Homo sapiens
gctggcctgtagattgagtc

SEQ ID NO: 23481 - DNA, 19 bp, Homo sapiens
ggcaagacctgcagatcgt

SEQ ID NO: 23482 - DNA, 18 bp, Homo sapiens
gcttggcccagcctcgtc

SEQ ID NO: 23483 - DNA, 21 bp, Homo sapiens
gcgcctggcccgagagttgtc

SEQ ID NO: 23484 - DNA, 23 bp, Homo sapiens
gccttggcctgccccagcctgtc

SEQ ID NO: 23485 - DNA, 18 bp, Homo sapiens
gcgtctggcctggatcgc

SEQ ID NO: 23486 - DNA, 18 bp, Homo sapiens
cgcagcggtgcagaccgt

SEQ ID NO: 23487 - DNA, 21 bp, Homo sapiens
gcacttggcttgcccaaagtc

SEQ ID NO: 23488 - DNA, 19 bp, Homo sapiens
gccttggcctgtcacggtc

SEQ ID NO: 23489 - DNA, 17 bp, Homo sapiens
gcacttggcctccccgt

SEQ ID NO: 23490 - DNA, 21 bp, Homo sapiens
gcttggccaggtcaggactgt

SEQ ID NO: 23491 - DNA, 18 bp, Homo sapiens
gcctggcccccaaattgt

SEQ ID NO: 23492 - DNA, 19 bp, Homo sapiens
gcgcttagcctgcaccctc

SEQ ID NO: 23493 - DNA, 17 bp, Homo sapiens
gcactcgggcggatcgt

SEQ ID NO: 23494 - DNA, 15 bp, Homo sapiens
cttggcctcaccgtc

SEQ ID NO: 23495 - DNA, 20 bp, Homo sapiens
gcgcctgcccgcaggttgtc

SEQ ID NO: 23496 - DNA, 19 bp, Homo sapiens
gctgggcctgcacgccgtc

SEQ ID NO: 23497 - DNA, 20 bp, Homo sapiens
gccttggccttccagttgtc

SEQ ID NO: 23498 - DNA, 17 bp, Homo sapiens
gcacttggcctgatccg

SEQ ID NO: 23499 - DNA, 19 bp, Homo sapiens
acgcttggccgaagccgtc

SEQ ID NO: 23500 - DNA, 19 bp, Homo sapiens
gctttggccccaggccgtc

SEQ ID NO: 23501 - DNA, 23 bp, Homo sapiens
gcgctcggcttgcgggcgccgtc

SEQ ID NO: 23502 - DNA, 18 bp, Homo sapiens
gcacttgggacgactgtc

SEQ ID NO: 23503 - DNA, 19 bp, Homo sapiens
gcttggcctgggcagtgtc

SEQ ID NO: 23504 - DNA, 18 bp, Homo sapiens
gctgacctgcaggctgtc

SEQ ID NO: 23505 - DNA, 16 bp, Homo sapiens
acttcctcagaccgtc

SEQ ID NO: 23506 - DNA, 17 bp, Homo sapiens
gcttaacctagattgtc

SEQ ID NO: 23507 - DNA, 20 bp, Homo sapiens
gcgctcggcctgcattttgt

SEQ ID NO: 23508 - DNA, 16 bp, Homo sapiens
gccttggcctgcgcgt

SEQ ID NO: 23509 - DNA, 18 bp, Homo sapiens
gcgctggcccagactgtc

SEQ ID NO: 23510 - DNA, 20 bp, Homo sapiens
acgcttggctcagctctgtc

SEQ ID NO: 23511 - DNA, 20 bp, Homo sapiens
gccttggcctcccaaattgt

SEQ ID NO: 23512 - DNA, 19 bp, Homo sapiens
gcgcttagtacttcaccgt

SEQ ID NO: 23513 - DNA, 21 bp, Homo sapiens
gcacttggtttcctcactgtc

SEQ ID NO: 23514 - DNA, 19 bp, Homo sapiens
gcgctcggtactcgccgtc

SEQ ID NO: 23515 - DNA, 23 bp, Homo sapiens
gcgcttgagcagcaggggccgtc

SEQ ID NO: 23516 - DNA, 19 bp, Homo sapiens
gcccttggctaagaccgtc

SEQ ID NO: 23517 - DNA, 19 bp, Homo sapiens
acgtctcctgcggaccgtc

SEQ ID NO: 23518 - DNA, 21 bp, Homo sapiens
gcgcctggcacagcagccgtc

SEQ ID NO: 23519 - DNA, 16 bp, Homo sapiens
gccttggcctgaacgt

SEQ ID NO: 23520 - DNA, 17 bp, Homo sapiens
gcttccacgcagaccgt

SEQ ID NO: 23521 - DNA, 21 bp, Homo sapiens
gcccttggcctgaatgatgtc

SEQ ID NO: 23522 - DNA, 23 bp, Homo sapiens
gcgcatggcctgccctgagtgtc

SEQ ID NO: 23523 - DNA, 19 bp, Homo sapiens
gctcttggcctgaagggtc

SEQ ID NO: 23524 - DNA, 18 bp, Homo sapiens
ctcggcctgcgggccgtc

SEQ ID NO: 23525 - DNA, 16 bp, Homo sapiens
gccttggcctaactgt

SEQ ID NO: 23526 - DNA, 18 bp, Homo sapiens
gcgcttggccgctgccgc

SEQ ID NO: 23527 - DNA, 100 bp, Tupaia herpesvirus
gaaagggtaccagaccgggatcacggagccgttttgcgcggcggccggcagccactgcgcggagaagttgagcgggccgatggtgggtaggggccgtttc

SEQ ID NO: 23528 - DNA, 24 bp, Tupaia herpesvirus
aagggtaccagaccgggatcacgg

SEQ ID NO: 23529 - DNA, 18 bp, Homo sapiens
aagagtactaggccatgg

SEQ ID NO: 23530 - DNA, 22 bp, Homo sapiens
gggctgccctcggggatcacgg

SEQ ID NO: 23531 - DNA, 21 bp, Homo sapiens
agggtacccggccgggggcgg

SEQ ID NO: 23532 - DNA, 21 bp, Homo sapiens
gggtaccaggctggtcccagg

SEQ ID NO: 23533 - DNA, 18 bp, Homo sapiens
gggtaccaggcctgagat

SEQ ID NO: 23534 - DNA, 18 bp, Homo sapiens
aggataccagactgggat

SEQ ID NO: 23535 - DNA, 24 bp, Homo sapiens
aagggtaccggactgtatccatgg

SEQ ID NO: 23536 - DNA, 20 bp, Homo sapiens
ggtcggggccgggatcacgg

SEQ ID NO: 23537 - DNA, 24 bp, Homo sapiens
aagggtgcagcgagaggatcacgg

SEQ ID NO: 23538 - DNA, 22 bp, Homo sapiens
ggtaccaggcctcttcccatgg

SEQ ID NO: 23539 - DNA, 23 bp, Homo sapiens
aagggtaccaggaccattcatgg

SEQ ID NO: 23540 - DNA, 20 bp, Homo sapiens
agggggccagaccacagcgg

SEQ ID NO: 23541 - DNA, 92 bp, Tupaia herpesvirus
gttgccggcgcgggcccagacgctcggggcgaagctctggaggtccagcgggccgtagagcgtctcgacggaggtgggtcccggcgggtaat

SEQ ID NO: 23542 - DNA, 24 bp, Tupaia herpesvirus
gtagagcgtctcgacggaggtggg

SEQ ID NO: 23543 - DNA, 18 bp, Homo sapiens
aagggtgtcaggaggtgg

SEQ ID NO: 23544 - DNA, 23 bp, Homo sapiens
gtggagatggcgttgggggtggg

SEQ ID NO: 23545 - DNA, 18 bp, Homo sapiens
gagagcccgtggaggtgg

SEQ ID NO: 23546 - DNA, 21 bp, Homo sapiens
atagaggtgggtgggggtggg

SEQ ID NO: 23547 - DNA, 22 bp, Homo sapiens
gtctgcgtttgatggaggtggg

SEQ ID NO: 23548 - DNA, 19 bp, Homo sapiens
gtggaatgtcttgagatgg

SEQ ID NO: 23549 - DNA, 22 bp, Homo sapiens
gtagggctaggttggaggtggg

SEQ ID NO: 23550 - DNA, 21 bp, Homo sapiens
gaggtgggcgacggaggtggg

SEQ ID NO: 23551 - DNA, 23 bp, Homo sapiens
agagtgtgtgatgtgggggtggg

SEQ ID NO: 23552 - DNA, 18 bp, Homo sapiens
cgtctccatggaggtggg

SEQ ID NO: 23553 - DNA, 18 bp, Homo sapiens
gagacagatggaggtggg

SEQ ID NO: 23554 - DNA, 17 bp, Homo sapiens
gcatccggggaggtggg

SEQ ID NO: 23555 - DNA, 21 bp, Homo sapiens
gtggaggtcaggggaggtggg

SEQ ID NO: 23556 - DNA, 21 bp, Homo sapiens
agagcgtggcctggaggtggg

SEQ ID NO: 23557 - DNA, 21 bp, Homo sapiens
taggccggcggcggaggtggg

SEQ ID NO: 23558 - DNA, 16 bp, Homo sapiens
ggagaggcggaggtgg

SEQ ID NO: 23559 - DNA, 60 bp, Human papillomavirus type 40
tcttagtgtggtatttgcctgcggtggtccttcacacatttattatatatcacatacaga

SEQ ID NO: 23560 - DNA, 24 bp, Human papillomavirus type 40
agtgtggtatttgcctgcggtggt

SEQ ID NO: 23561 - DNA, 17 bp, Homo sapiens
tgtggtggctgcggtgg

SEQ ID NO: 23562 - DNA, 19 bp, Homo sapiens
agagtggtatttgccatgg

SEQ ID NO: 23563 - DNA, 18 bp, Homo sapiens
gtgtggtgtgttgtgtgg

SEQ ID NO: 23564 - DNA, 21 bp, Homo sapiens
agtgtggtgcttgcctcaggt

SEQ ID NO: 23565 - DNA, 20 bp, Homo sapiens
agtatggtatttgcttcagt

SEQ ID NO: 23566 - DNA, 21 bp, Homo sapiens
gtgtggtattgtcccctgggt

SEQ ID NO: 23567 - DNA, 21 bp, Homo sapiens
agtgtggtgtttggtttgcct

SEQ ID NO: 23568 - DNA, 23 bp, Homo sapiens
agttggtatttgtctggcttggt

SEQ ID NO: 23569 - DNA, 25 bp, Homo sapiens
agtgtggttctttccttgtggtggt

SEQ ID NO: 23570 - DNA, 21 bp, Homo sapiens
agttggtgatgatgcggtggt

SEQ ID NO: 23571 - DNA, 63 bp, Human papillomavirus type 40
gtatgggaaaacaaataggtggactgttattgtgggttcacacgttatatgttctcctagtac

SEQ ID NO: 23572 - DNA, 24 bp, Human papillomavirus type 40
ttcacacgttatatgttctcctag

SEQ ID NO: 23573 - DNA, 18 bp, Homo sapiens
acacaaatgttctcctag

SEQ ID NO: 23574 - DNA, 18 bp, Homo sapiens
ttcgcatttatatgttct

SEQ ID NO: 23575 - DNA, 18 bp, Homo sapiens
tccacactttgttctcct

SEQ ID NO: 23576 - DNA, 21 bp, Homo sapiens
ttcacagttatttactctcct

SEQ ID NO: 23577 - DNA, 22 bp, Homo sapiens
ttcacacatctgattttcctag

SEQ ID NO: 23578 - DNA, 15 bp, Homo sapiens
cacagttactcccct

SEQ ID NO: 23579 - DNA, 20 bp, Homo sapiens
gtgcatgtgtcttctcctag

SEQ ID NO: 23580 - DNA, 83 bp, Paramecium bursaria Chlorella virus 1
ccatgatgaaggtcctcaatgccatcaaggagtctggtaaggactacttcatccagctcgatgaggcagactctgtcatcagg

SEQ ID NO: 23581 - DNA, 24 bp, Paramecium bursaria Chlorella virus 1
atgaaggtcctcaatgccatcaag

SEQ ID NO: 23582 - DNA, 15 bp, Homo sapiens
tgaagtcctcaatca

SEQ ID NO: 23583 - DNA, 21 bp, Homo sapiens
tgaaagtccttgataatcaaa

SEQ ID NO: 23584 - DNA, 17 bp, Homo sapiens
atgaaggtccttggcca

SEQ ID NO: 23585 - DNA, 20 bp, Homo sapiens
atgaaggtcctcagcggcac

SEQ ID NO: 23586 - DNA, 21 bp, Homo sapiens
acgaaggtccctttcatcaag

SEQ ID NO: 23587 - DNA, 19 bp, Homo sapiens
agggcttaatgctatcaag

SEQ ID NO: 23588 - DNA, 18 bp, Homo sapiens
tgaggcgaatgccattaa

SEQ ID NO: 23589 - DNA, 18 bp, Homo sapiens
gaagggaaatgccatcaa

SEQ ID NO: 23590 - DNA, 17 bp, Homo sapiens
atggagtcctcacccac

SEQ ID NO: 23591 - DNA, 16 bp, Homo sapiens
atgactaatgccatca

SEQ ID NO: 23592 - DNA, 22 bp, Homo sapiens
atgaaggtcctaatgctacatc

SEQ ID NO: 23593 - DNA, 25 bp, Homo sapiens
atgaaggtgctgcttgactgtcaag

SEQ ID NO: 23594 - DNA, 18 bp, Homo sapiens
taaaggtccttctgtcaa

SEQ ID NO: 23595 - DNA, 22 bp, Homo sapiens
atgaaggtttgtcaattaccat

SEQ ID NO: 23596 - DNA, 22 bp, Homo sapiens
atgaaggctttggttactcaag

SEQ ID NO: 23597 - DNA, 25 bp, Homo sapiens
atgaggtctttctactgccatcaag

SEQ ID NO: 23598 - DNA, 20 bp, Homo sapiens
tgagtgcgcccaatgccatc

SEQ ID NO: 23599 - DNA, 18 bp, Homo sapiens
atgaggtcctcactctca

SEQ ID NO: 23600 - DNA, 22 bp, Homo sapiens
gaaggttctcaaccccatcaag

SEQ ID NO: 23601 - DNA, 63 bp, Myxoma virus
acgacgttctgtacttcgctggaggaaagctagacgcggttcccacgagacaggtcttgtcgt

SEQ ID NO: 23602 - DNA, 24 bp, Myxoma virus
tacttcgctggaggaaagctagac

SEQ ID NO: 23603 - DNA, 16 bp, Homo sapiens
cttgctggagggccag

SEQ ID NO: 23604 - DNA, 18 bp, Homo sapiens
ctttctggaggacagcag

SEQ ID NO: 23605 - DNA, 18 bp, Homo sapiens
ttcgctggatcgctggac

SEQ ID NO: 23606 - DNA, 19 bp, Homo sapiens
ttcctgggggggcccggac

SEQ ID NO: 23607 - DNA, 22 bp, Homo sapiens
tcctagaagaggggggctggac

SEQ ID NO: 23608 - DNA, 16 bp, Homo sapiens
ttcctgggaagctaga

SEQ ID NO: 23609 - DNA, 20 bp, Homo sapiens
cttttggaagaaggctggac

SEQ ID NO: 23610 - DNA, 18 bp, Homo sapiens
cttcgctggaggagcagc

SEQ ID NO: 23611 - DNA, 18 bp, Homo sapiens
ctttgctggaaaagttag

SEQ ID NO: 23612 - DNA, 18 bp, Homo sapiens
tccactaggaaagttaga

SEQ ID NO: 23613 - DNA, 18 bp, Homo sapiens
actggaggggggctagac

SEQ ID NO: 23614 - DNA, 21 bp, Homo sapiens
ctgggcagaggggagctagac

SEQ ID NO: 23615 - DNA, 20 bp, Homo sapiens
ctttgctggaggaacttgac

SEQ ID NO: 23616 - DNA, 21 bp, Homo sapiens
cactggtagaggagagctgga

SEQ ID NO: 23617 - DNA, 72 bp, Paramecium bursaria Chlorella virus 1
ggcggtcttgagagtacgcgcaaggaattcatgaagtttatctcggaaaattaccgcgttacgaatgccgct

SEQ ID NO: 23618 - DNA, 24 bp, Paramecium bursaria Chlorella virus 1
tgagagtacgcgcaaggaattcat

SEQ ID NO: 23619 - DNA, 17 bp, Homo sapiens
gagagtacgggagttca

SEQ ID NO: 23620 - DNA, 81 bp, Myxoma virus
cgaactgtccgtccccaaggcgagcgttacggcgatcgtctataaagagaggttgtactgcgtaggggggctggtggatcg

SEQ ID NO: 23621 - DNA, 24 bp, Myxoma virus
gagcgttacggcgatcgtctataa

SEQ ID NO: 23622 - DNA, 21 bp, Homo sapiens
gcgtggtggcgcgcgcctata

SEQ ID NO: 23623 - DNA, 22 bp, Homo sapiens
gcgtggtggtgcacgcctataa

SEQ ID NO: 23624 - DNA, 20 bp, Homo sapiens
gagtgctatggcttcctata

SEQ ID NO: 23625 - DNA, 21 bp, Homo sapiens
gcgtcgtggtgggcgcctata

SEQ ID NO: 23626 - DNA, 22 bp, Homo sapiens
gcgtggtggcacgtgtctataa

SEQ ID NO: 23627 - DNA, 65 bp, Myxoma virus
gtagacgtaatcgacttagaagcggattataaaaccgtatttgacgtgatttattacatgtatac

SEQ ID NO: 23628 - DNA, 24 bp, Myxoma virus
tgacgtgatttattacatgtatac

SEQ ID NO: 23629 - DNA, 18 bp, Homo sapiens
taatgaagttacatgtat

SEQ ID NO: 23630 - DNA, 19 bp, Homo sapiens
ataaaatgttacatgtata

SEQ ID NO: 23631 - DNA, 19 bp, Homo sapiens
tgacttggtttattaccgt

SEQ ID NO: 23632 - DNA, 22 bp, Homo sapiens
tgacgtgaattagtctacgtgt

SEQ ID NO: 23633 - DNA, 25 bp, Homo sapiens
tgatttgatcattacacatgtatac

SEQ ID NO: 23634 - DNA, 20 bp, Homo sapiens
tgacgtgattttttaaaagt

SEQ ID NO: 23635 - DNA, 21 bp, Homo sapiens
tgatggattgcatacatgtat

SEQ ID NO: 23636 - DNA, 19 bp, Homo sapiens
tgacgtgattattacatat

SEQ ID NO: 23637 - DNA, 113 bp, Marburg virus
aactacctcttaagcttttgtggatggtttcaatatgtgcgtagaggttaatttaaagagatttcttgttgcacagttttttgtattacttacttgggcttgaagacatagtt

SEQ ID NO: 23638 - DNA, 24 bp, Marburg virus
ttgcacagttttttgtattactta

SEQ ID NO: 23639 - DNA, 19 bp, Homo sapiens
ttgcacagttttcaaaatt

SEQ ID NO: 23640 - DNA, 18 bp, Homo sapiens
ttgcaagttttttgactt

SEQ ID NO: 23641 - DNA, 19 bp, Homo sapiens
gcacagtttttaatgcatt

SEQ ID NO: 23642 - DNA, 18 bp, Homo sapiens
gcacaggctgtattactt

SEQ ID NO: 23643 - DNA, 18 bp, Homo sapiens
ttgcaacagtttgtttgt

SEQ ID NO: 23644 - DNA, 18 bp, Homo sapiens
ttgccagttttccctatt

SEQ ID NO: 23645 - DNA, 17 bp, Homo sapiens
ttgcatgttttttgtat

SEQ ID NO: 23646 - DNA, 25 bp, Homo sapiens
ttgcacagatttacacagttactta

SEQ ID NO: 23647 - DNA, 17 bp, Homo sapiens
gcatgtctgtattactt

SEQ ID NO: 23648 - DNA, 19 bp, Homo sapiens
cagttttttaatccactta

SEQ ID NO: 23649 - DNA, 23 bp, Homo sapiens
ttgcacagtctttttgcaatctt

SEQ ID NO: 23650 - DNA, 21 bp, Homo sapiens
ctgcatagttggcattactta

SEQ ID NO: 23651 - DNA, 19 bp, Homo sapiens
ttgcgcagtctacatttgc

SEQ ID NO: 23652 - DNA, 23 bp, Homo sapiens
ttgtgcagttttctgtttactta

SEQ ID NO: 23653 - DNA, 61 bp, Lymphocystis disease virus 1
gaatgacgttatgtactaaatctttactcggttcaacggtataccctttataaacaagttc

SEQ ID NO: 23654 - DNA, 24 bp, Lymphocystis disease virus 1
cgttatgtactaaatctttactcg

SEQ ID NO: 23655 - DNA, 19 bp, Homo sapiens
gttaggtactaaattttca

SEQ ID NO: 23656 - DNA, 18 bp, Homo sapiens
ttatgtactgaaaatctt

SEQ ID NO: 23657 - DNA, 73 bp, Lymphocystis disease virus 1
cgtaattgtatcagcgaatgtacatgaatcatttatcctaactgcaatctgtgcacacgctgtagtgattgcg

SEQ ID NO: 23658 - DNA, 24 bp, Lymphocystis disease virus 1
tgtatcagcgaatgtacatgaatc

SEQ ID NO: 23659 - DNA, 20 bp, Homo sapiens
tgtgtcagcaaatgagtaga

SEQ ID NO: 23660 - DNA, 22 bp, Homo sapiens
tgtatcaagtacctgtatgaat

SEQ ID NO: 23661 - DNA, 22 bp, Homo sapiens
tgttaataccatgtacatgaat

SEQ ID NO: 23662 - DNA, 21 bp, Homo sapiens
tatgtcagctcatgtatgaat

SEQ ID NO: 23663 - DNA, 18 bp, Homo sapiens
aactgagtgtacatgaat

SEQ ID NO: 23664 - DNA, 23 bp, Homo sapiens
tgtatttgtggatgtacatgaac

SEQ ID NO: 23665 - DNA, 20 bp, Homo sapiens
tgtatgagcgaatgagcatg

SEQ ID NO: 23666 - DNA, 60 bp, Lymphocystis disease virus 1
gtaacggtaaaataatataaacttagtttaactcctaaagtagatctgattaattgttac

SEQ ID NO: 23667 - DNA, 23 bp, Lymphocystis disease virus 1
aagtagatctgattaattgttac

SEQ ID NO: 23668 - DNA, 24 bp, Homo sapiens
ggatagattattgaataattgtta

SEQ ID NO: 23669 - DNA, 22 bp, Homo sapiens
aagtagattatcatcttgttac

SEQ ID NO: 23670 - DNA, 22 bp, Homo sapiens
gatctgattgttctcctgttac

SEQ ID NO: 23671 - DNA, 20 bp, Homo sapiens
aagtaatctgaccaggttac

SEQ ID NO: 23672 - DNA, 19 bp, Homo sapiens
gtagagaggtaattgttac

SEQ ID NO: 23673 - DNA, 18 bp, Homo sapiens
aagtacacctaattgtta

SEQ ID NO: 23674 - DNA, 20 bp, Homo sapiens
aagtgaatctgaattgttac

SEQ ID NO: 23675 - DNA, 20 bp, Homo sapiens
aagtagattcaacttgttac

SEQ ID NO: 23676 - DNA, 63 bp, Human papillomavirus type 3
gcgacaaacttgaggaccaaataatgcattggcaattgatgcggttagagcaagctttgttgt

SEQ ID NO: 23677 - DNA, 18 bp, Human papillomavirus type 3
tagagcaagctttgttgt

SEQ ID NO: 23678 - DNA, 16 bp, Homo sapiens
cagagcagcctgttgt

SEQ ID NO: 23679 - DNA, 71 bp, Fowl adenovirus D
ggatactcctattacgtcgaagtcagaggtatagaactttcccctcctttttctacatgatatcccgttcc

SEQ ID NO: 23680 - DNA, 24 bp, Fowl adenovirus D
tattacgtcgaagtcagaggtata

SEQ ID NO: 23681 - DNA, 19 bp, Homo sapiens
gcacgaagtcagaggtata

SEQ ID NO: 23682 - DNA, 78 bp, Fowl adenovirus D
accactataatccccgcttcctataatctctacttcctatgattaaatgggtaattaaatgatgggtaattaagtggt

SEQ ID NO: 23683 - DNA, 24 bp, Fowl adenovirus D
tataatccccgcttcctataatct

SEQ ID NO: 23684 - DNA, 27 bp, Homo sapiens
tataatccttacttctaaccaaaatct

SEQ ID NO: 23685 - DNA, 18 bp, Homo sapiens
tctcctcctctataatct

SEQ ID NO: 23686 - DNA, 23 bp, Homo sapiens
tataatctctcttcatatagtct

SEQ ID NO: 23687 - DNA, 21 bp, Homo sapiens
tataattacagcctataatct

SEQ ID NO: 23688 - DNA, 17 bp, Homo sapiens
cctcacgcctataatct

SEQ ID NO: 23689 - DNA, 16 bp, Homo sapiens
taatccccaatataat

SEQ ID NO: 23690 - DNA, 83 bp, Myxoma virus
gaggatgtcatcgtgcgtagtcttcccagttgtcccgcgcttatgggaatggggtctttgaagactatccacgtcacgttttt

SEQ ID NO: 23691 - DNA, 24 bp, Myxoma virus
catcgtgcgtagtcttcccagttg

SEQ ID NO: 23692 - DNA, 20 bp, Homo sapiens
tacagcagtctttccagttg

SEQ ID NO: 23693 - DNA, 20 bp, Homo sapiens
tcgtggtatattcccagttg

SEQ ID NO: 23694 - DNA, 22 bp, Homo sapiens
catctgttcaacttcccagttg

SEQ ID NO: 23695 - DNA, 20 bp, Homo sapiens
gtggccccccttcccagttg

SEQ ID NO: 23696 - DNA, 60 bp, Fowlpox virus
ttcatcaattaatgcctattatgatgtagtctctgcgcataggtatgatttgaagttgag

SEQ ID NO: 23697 - DNA, 24 bp, Fowlpox virus
ttaatgcctattatgatgtagtct

SEQ ID NO: 23698 - DNA, 21 bp, Homo sapiens
tgcctattcactgggtggtct

SEQ ID NO: 23699 - DNA, 18 bp, Homo sapiens
ttaatgcctattcagagt

SEQ ID NO: 23700 - DNA, 18 bp, Homo sapiens
ttaatgcctggttgtgat

SEQ ID NO: 23701 - DNA, 19 bp, Homo sapiens
atgtctattcatatagtct

SEQ ID NO: 23702 - DNA, 18 bp, Homo sapiens
ttaatgccaattgtgatg

SEQ ID NO: 23703 - DNA, 21 bp, Homo sapiens
ttaatgctgtgataatgtagt

SEQ ID NO: 23704 - DNA, 19 bp, Homo sapiens
ttaatgcctgttgtaagtc

SEQ ID NO: 23705 - DNA, 78 bp, Fowlpox virus
ctcgccggggctctagaatacaaaatgcgcacggacgctcgtataaactcgcgcatttttatttgaagttaaatcgag

SEQ ID NO: 23706 - DNA, 24 bp, Fowlpox virus
tagaatacaaaatgcgcacggacg

SEQ ID NO: 23707 - DNA, 21 bp, Homo sapiens
taaaatgcaaagtacactgga

SEQ ID NO: 23708 - DNA, 19 bp, Homo sapiens
gaatacaaaccacggcgga

SEQ ID NO: 23709 - DNA, 20 bp, Homo sapiens
tagaacacaagcattgtgga

SEQ ID NO: 23710 - DNA, 23 bp, Homo sapiens
taaaatacagagttacatggacg

SEQ ID NO: 23711 - DNA, 23 bp, Homo sapiens
agaatgcaaaatgcaggtatgga

SEQ ID NO: 23712 - DNA, 23 bp, Homo sapiens
taaaatacaaaatggcacagacg

SEQ ID NO: 23713 - DNA, 76 bp, Cercopithecine herpesvirus 7
aatcgcgccgtagagacacgtacgcgttgtattaacacatactggaaagaacatcgcgcacagctacggcgggatt

SEQ ID NO: 23714 - DNA, 18 bp, Cercopithecine herpesvirus 7
cacagctacggcgggatt

SEQ ID NO: 23715 - DNA, 20 bp, Homo sapiens
cacagttcccacacaggatt

SEQ ID NO: 23716 - DNA, 17 bp, Homo sapiens
cacactaggacaggatt

SEQ ID NO: 23717 - DNA, 17 bp, Homo sapiens
cacagcaaactaggatt

SEQ ID NO: 23718 - DNA, 18 bp, Homo sapiens
cacagccacacctagatt

SEQ ID NO: 23719 - DNA, 17 bp, Homo sapiens
cacagccaaacgcgatt

SEQ ID NO: 23720 - DNA, 18 bp, Homo sapiens
cacagcagcacatggatt

SEQ ID NO: 23721 - DNA, 18 bp, Homo sapiens
cacaactactaagagatt

SEQ ID NO: 23722 - DNA, 16 bp, Homo sapiens
cacagccaccagaatt

SEQ ID NO: 23723 - DNA, 19 bp, Homo sapiens
cacagcaccacactggatt

SEQ ID NO: 23724 - DNA, 17 bp, Homo sapiens
cacagcaagctgagatt

SEQ ID NO: 23725 - DNA, 18 bp, Homo sapiens
acagctgtgagcaagatt

SEQ ID NO: 23726 - DNA, 21 bp, Homo sapiens
cacagctatcatactgggatt

SEQ ID NO: 23727 - DNA, 17 bp, Homo sapiens
cacaacacgtagggatt

SEQ ID NO: 23728 - DNA, 18 bp, Homo sapiens
cagagctgagacaggatt

SEQ ID NO: 23729 - DNA, 16 bp, Homo sapiens
cacggcacacaggatt

SEQ ID NO: 23730 - DNA, 19 bp, Homo sapiens
cacagctcgacatgggatt

SEQ ID NO: 23731 - DNA, 18 bp, Homo sapiens
acaggccggggcgggatt

SEQ ID NO: 23732 - DNA, 17 bp, Homo sapiens
cacagctaaagaggatt

SEQ ID NO: 23733 - DNA, 17 bp, Homo sapiens
cacagccattcaaaatt

SEQ ID NO: 23734 - DNA, 16 bp, Homo sapiens
cacagcctgcgggact

SEQ ID NO: 23735 - DNA, 16 bp, Homo sapiens
cacagcagcggagact

SEQ ID NO: 23736 - DNA, 18 bp, Homo sapiens
cacagctacaaactgatt

SEQ ID NO: 23737 - DNA, 18 bp, Homo sapiens
cacagctagggcaagact

SEQ ID NO: 23738 - DNA, 18 bp, Homo sapiens
cacagttagaacaagatt

SEQ ID NO: 23739 - DNA, 20 bp, Homo sapiens
cacagctacttcactggatt

SEQ ID NO: 23740 - DNA, 20 bp, Homo sapiens
acagctacgagctctggatt

SEQ ID NO: 23741 - DNA, 20 bp, Homo sapiens
cacagcaacaccacaggatt

SEQ ID NO: 23742 - DNA, 16 bp, Homo sapiens
cacagtaaacaggatt

SEQ ID NO: 23743 - DNA, 16 bp, Homo sapiens
cacactaggcaggatt

SEQ ID NO: 23744 - DNA, 17 bp, Homo sapiens
cacagataagcaggatt

SEQ ID NO: 23745 - DNA, 18 bp, Homo sapiens
cagagctacaggtggatt

SEQ ID NO: 23746 - DNA, 94 bp, Cercopithecine herpesvirus 7
aggccctgttttattaacaacattaaagcattctcagaggaaaggtttaaccacagctgagtgccttttatgttgtttgcttaatataggccct

SEQ ID NO: 23747 - DNA, 24 bp, Cercopithecine herpesvirus 7
gccctgttttattaacaacattaa

SEQ ID NO: 23748 - DNA, 20 bp, Homo sapiens
gctctgctttattgacctca

SEQ ID NO: 23749 - DNA, 22 bp, Homo sapiens
gccttgttttataaatacacat

SEQ ID NO: 23750 - DNA, 20 bp, Homo sapiens
gccctgtctttttcggcatt

SEQ ID NO: 23751 - DNA, 24 bp, Homo sapiens
gcctttcaccagtaacaacattaa

SEQ ID NO: 23752 - DNA, 18 bp, Homo sapiens
accttgttttacacatta

SEQ ID NO: 23753 - DNA, 17 bp, Homo sapiens
gccctgtttattgacaa

SEQ ID NO: 23754 - DNA, 17 bp, Homo sapiens
gctctgttttattacaa

SEQ ID NO: 23755 - DNA, 19 bp, Homo sapiens
gctttgttttattaacgac

SEQ ID NO: 23756 - DNA, 75 bp, Cercopithecine herpesvirus 7
tcctttttgtgctatgtcggagttacaaacaaatccacaaattttatttgcccatcctacatttacaaacaagga

SEQ ID NO: 23757 - DNA, 24 bp, Cercopithecine herpesvirus 7
tttgtgctatgtcggagttacaaa

SEQ ID NO: 23758 - DNA, 16 bp, Homo sapiens
tttatacctcggggtt

SEQ ID NO: 23759 - DNA, 20 bp, Homo sapiens
tttgtgctacgttttgtgag

SEQ ID NO: 23760 - DNA, 20 bp, Homo sapiens
tttgtgctgtgcaccaacaa

SEQ ID NO: 23761 - DNA, 18 bp, Homo sapiens
tttgttagttgagttaca

SEQ ID NO: 23762 - DNA, 18 bp, Homo sapiens
tgctgtggcagttacaaa

SEQ ID NO: 23763 - DNA, 15 bp, Homo sapiens
ttgtgctatggggtt

SEQ ID NO: 23764 - DNA, 20 bp, Homo sapiens
tttgtgctgtgcactaacaa

SEQ ID NO: 23765 - DNA, 19 bp, Homo sapiens
gtgctaaaagagagttaca

SEQ ID NO: 23766 - DNA, 17 bp, Homo sapiens
tttgtgctatgtttagc

SEQ ID NO: 23767 - DNA, 18 bp, Homo sapiens
tttgtgctatgtgataag

SEQ ID NO: 23768 - DNA, 18 bp, Homo sapiens
ctattttggagttacaaa

SEQ ID NO: 23769 - DNA, 18 bp, Homo sapiens
tttgtgtattccaagtta

SEQ ID NO: 23770 - DNA, 23 bp, Homo sapiens
tctgtgctagtataagttgcaaa

SEQ ID NO: 23771 - DNA, 21 bp, Homo sapiens
tttggcagcgggagttacaaa

SEQ ID NO: 23772 - DNA, 20 bp, Homo sapiens
tttgtgcctgtctcaaagtt

SEQ ID NO: 23773 - DNA, 88 bp, Camelpox virus
gccggttagtatgacttacttgtataataagtatagttttaaactgattttagcagaatatataagacacagaaatactgtatccggc

SEQ ID NO: 23774 - DNA, 24 bp, Camelpox virus
taagacacagaaatactgtatccg

SEQ ID NO: 23775 - DNA, 19 bp, Homo sapiens
gacacagagaaacagtatc

SEQ ID NO: 23776 - DNA, 22 bp, Homo sapiens
aggcacagaaacttggtgtgtc

SEQ ID NO: 23777 - DNA, 19 bp, Homo sapiens
taagacacaaaatgaatcc

SEQ ID NO: 23778 - DNA, 23 bp, Homo sapiens
gacacagaaaagctcctatctcg

SEQ ID NO: 23779 - DNA, 18 bp, Homo sapiens
taagacacaggcatagcc

SEQ ID NO: 23780 - DNA, 18 bp, Homo sapiens
caagatacagaaatgctg

SEQ ID NO: 23781 - DNA, 19 bp, Homo sapiens
taaaacacagaatgtgtat

SEQ ID NO: 23782 - DNA, 22 bp, Homo sapiens
taagacacaggaatcccaatac

SEQ ID NO: 23783 - DNA, 16 bp, Homo sapiens
gacacagaactgacat

SEQ ID NO: 23784 - DNA, 16 bp, Homo sapiens
taagacacaggactgt

SEQ ID NO: 23785 - DNA, 20 bp, Homo sapiens
aagatacagaaatatttcac

SEQ ID NO: 23786 - DNA, 19 bp, Homo sapiens
tgaacacagaaaatgtatc

SEQ ID NO: 23787 - DNA, 18 bp, Homo sapiens
agtgcacaggaataccat

SEQ ID NO: 23788 - DNA, 19 bp, Homo sapiens
taagacaccttaattgtat

SEQ ID NO: 23789 - DNA, 17 bp, Homo sapiens
agacacaatattgtatc

SEQ ID NO: 23790 - DNA, 22 bp, Homo sapiens
taagccacagaaatagccacat

SEQ ID NO: 23791 - DNA, 17 bp, Homo sapiens
taagacacaggcagcca

SEQ ID NO: 23792 - DNA, 15 bp, Homo sapiens
agacacaaaaatgca

SEQ ID NO: 23793 - DNA, 23 bp, Homo sapiens
taagacacagagacaacagactg

SEQ ID NO: 23794 - DNA, 20 bp, Homo sapiens
taaggcacagaaacagtatc

SEQ ID NO: 23795 - DNA, 20 bp, Homo sapiens
aaggcacagaaatgaaactg

SEQ ID NO: 23796 - DNA, 20 bp, Homo sapiens
aagacacagggcctcgtatc

SEQ ID NO: 23797 - DNA, 19 bp, Homo sapiens
taagcacagaaaacatatc

SEQ ID NO: 23798 - DNA, 20 bp, Homo sapiens
taaaacacagaaaagatctg

SEQ ID NO: 23799 - DNA, 19 bp, Homo sapiens
taagaggcagaaacatctg

SEQ ID NO: 23800 - DNA, 92 bp, Camelpox virus
tttgtcaactttgtaaaggatattatatgttgtgattctagaatagtagtagctctatctagtctagtatctaaacattgggaattgacaaa

SEQ ID NO: 23801 - DNA, 92 bp, Camelpox virus; identical to SEQ ID NO: 23800

SEQ ID NO: 23802 - DNA, 19 bp, Homo sapiens
tatgttataggggaatagt

SEQ ID NO: 23803 - DNA, 116 bp, Turkey astrovirus
gtcctgggctatattccagtagatagattggttgagaggagaaatgtgataacagacccactccttaagttggtagaaccctggagacaagaaacttatggcccagcagtatggac

SEQ ID NO: 23804 - DNA, 24 bp, Turkey astrovirus
gctatattccagtagatagattgg

SEQ ID NO: 23805 - DNA, 18 bp, Homo sapiens
tattccaggagtgattgg

SEQ ID NO: 23806 - DNA, 18 bp, Homo sapiens
gctatactccagtagctg

SEQ ID NO: 23807 - DNA, 21 bp, Homo sapiens
gctatatatactgtagattgg

SEQ ID NO: 23808 - DNA, 21 bp, Homo sapiens
tattccagtgggattctatgg

SEQ ID NO: 23809 - DNA, 23 bp, Homo sapiens
gctatatctggtagatgttgtgg

SEQ ID NO: 23810 - DNA, 100 bp, Fowlpox virus
atcgttagcacaccttaaagattagaagaaatacaggttagtgtaataataacgtattattatctagcacaaaaatgtttcaaagggcgtgttattagat

SEQ ID NO: 23811 - DNA, 24 bp, Fowlpox virus
tagcacaccttaaagattagaaga

SEQ ID NO: 23812 - DNA, 18 bp, Homo sapiens
tagtgacctcattagaag

SEQ ID NO: 23813 - DNA, 18 bp, Homo sapiens
gcataccccggttagaag

SEQ ID NO: 23814 - DNA, 23 bp, Homo sapiens
tagctcatcttaaattaaaaaga

SEQ ID NO: 23815 - DNA, 21 bp, Homo sapiens
tagcatgcattaaagaccaga

SEQ ID NO: 23816 - DNA, 18 bp, Homo sapiens
acattaaaagattagaag

SEQ ID NO: 23817 - DNA, 22 bp, Homo sapiens
cagcacactttgagatggctag

SEQ ID NO: 23818 - DNA, 18 bp, Homo sapiens
cagcacatggattagaag

SEQ ID NO: 23819 - DNA, 16 bp, Homo sapiens
tagcaacctcttagaa

SEQ ID NO: 23820 - DNA, 22 bp, Homo sapiens
tagcacacattagataaagaag

SEQ ID NO: 23821 - DNA, 19 bp, Homo sapiens
caccttaaaggttggaaga

SEQ ID NO: 23822 - DNA, 21 bp, Homo sapiens
tagcacacctttgggtctaga

SEQ ID NO: 23823 - DNA, 18 bp, Homo sapiens
gcatctttgattagaaga

SEQ ID NO: 23824 - DNA, 18 bp, Homo sapiens
taggcacctaattagaag

SEQ ID NO: 23825 - DNA, 21 bp, Homo sapiens
gctatgccttaaactagaaga

SEQ ID NO: 23826 - DNA, 22 bp, Homo sapiens
gcacaccttggagatattgcag

SEQ ID NO: 23827 - DNA, 20 bp, Homo sapiens
gcacacctgggagagccaga

SEQ ID NO: 23828 - DNA, 21 bp, Homo sapiens
tagcccaaggaggttagaaga

SEQ ID NO: 23829 - DNA, 86 bp, Turkey astrovirus
atttgttatggtgatgaccggcttttagcagttgacaagaggtttataaattcctatgatactgctgcagttattgccatgtacaa

SEQ ID NO: 23830 - DNA, 24 bp, Turkey astrovirus
tgatactgctgcagttattgccat

SEQ ID NO: 23831 - DNA, 18 bp, Homo sapiens
tgatgttggtgcagtcat

SEQ ID NO: 23832 - DNA, 17 bp, Homo sapiens
tgaactgctgcagttac

SEQ ID NO: 23833 - DNA, 20 bp, Homo sapiens
tgatactgctgcatataagc

SEQ ID NO: 23834 - DNA, 17 bp, Homo sapiens
tgctactgctgctactg

SEQ ID NO: 23835 - DNA, 19 bp, Homo sapiens
tgaggctgctgcagaccca

SEQ ID NO: 23836 - DNA, 18 bp, Homo sapiens
tgatcactgctgtattgc

SEQ ID NO: 23837 - DNA, 18 bp, Homo sapiens
atactgctgttcttgcca

SEQ ID NO: 23838 - DNA, 19 bp, Homo sapiens
tggtactgctgcagagctg

SEQ ID NO: 23839 - DNA, 20 bp, Homo sapiens
tgatactgttgtgttaaggc

SEQ ID NO: 23840 - DNA, 22 bp, Homo sapiens
tgatactgactgcagaaaactg

SEQ ID NO: 23841 - DNA, 19 bp, Homo sapiens
tgacactgttccaaattgc

SEQ ID NO: 23842 - DNA, 22 bp, Homo sapiens
taatatgtactgtggttattgc

SEQ ID NO: 23843 - DNA, 21 bp, Homo sapiens
gatattgctgtgccatgccat

SEQ ID NO: 23844 - DNA, 16 bp, Homo sapiens
tgatactgatcattgc

SEQ ID NO: 23845 - DNA, 68 bp, Fowlpox virus
gttaaattacgtgattatattataagttatctgcttactttaacattatatagtaattatatactaac

SEQ ID NO: 23846 - DNA, 24 bp, Fowlpox virus
cgtgattatattataagttatctg

SEQ ID NO: 23847 - DNA, 24 bp, Homo sapiens
gtgattatgctgtaataaaatctg

SEQ ID NO: 23848 - DNA, 24 bp, Homo sapiens
gtgattataaataacagttatctg

SEQ ID NO: 23849 - DNA, 22 bp, Homo sapiens
gtggatgcatataagttgtctg

SEQ ID NO: 23850 - DNA, 62 bp, Fowlpox virus
ctgtatttcttctaatctttaaggtgtgctaacgatatatcacgggattaaaaggttattag

SEQ ID NO: 23851 - DNA, 24 bp, Fowlpox virus
tatcacgggattaaaaggttatta

SEQ ID NO: 23852 - DNA, 17 bp, Homo sapiens
tcacaatgtaaaaggtt

SEQ ID NO: 23853 - DNA, 25 bp, Homo sapiens
tatcacaggattaaaactccagtta

SEQ ID NO: 23854 - DNA, 18 bp, Homo sapiens
tcatgggattaaaaaatt

SEQ ID NO: 23855 - DNA, 19 bp, Homo sapiens
tattgcgggattatgatta

SEQ ID NO: 23856 - DNA, 19 bp, Homo sapiens
atcatgggattagaaggtt

SEQ ID NO: 23857 - DNA, 19 bp, Homo sapiens
tatcatggattaaagccat

SEQ ID NO: 23858 - DNA, 17 bp, Homo sapiens
tatcatgggatgaaggt

SEQ ID NO: 23859 - DNA, 20 bp, Homo sapiens
atcacttgaaaaggttatta

SEQ ID NO: 23860 - DNA, 22 bp, Homo sapiens
tcattaggttgaaaggttatta

SEQ ID NO: 23861 - DNA, 131 bp, Human herpesvirus 4
tgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtca

SEQ ID NO: 23862 - DNA, 24 bp, Human herpesvirus 4
ggccattgtcatcagtgttgtcag

SEQ ID NO: 23863 - DNA, 22 bp, Homo sapiens
ggccattgtttctggatgtcag

SEQ ID NO: 23864 - DNA, 17 bp, Homo sapiens
ggtcatttcatcagcat

SEQ ID NO: 23865 - DNA, 26 bp, Homo sapiens
ggccattgtcactggtacttgctcag

SEQ ID NO: 23866 - DNA, 21 bp, Homo sapiens
ggccgtgggtggtgttgtcag

SEQ ID NO: 23867 - DNA, 17 bp, Homo sapiens
ccatctcatagtgttgt

SEQ ID NO: 23868 - DNA, 24 bp, Homo sapiens
ggccattgattgattgattgtcag

SEQ ID NO: 23869 - DNA, 19 bp, Homo sapiens
ggccattgctatcatctca

SEQ ID NO: 23870 - DNA, 23 bp, Homo sapiens
ggctgttgtcattattcgtgcag

SEQ ID NO: 23871 - DNA, 20 bp, Homo sapiens
ggccattgtttataatgttg

SEQ ID NO: 23872 - DNA, 20 bp, Homo sapiens
gcttgttgtcatcactgttg

SEQ ID NO: 23873 - DNA, 21 bp, Homo sapiens
gcttgtgctcctcagtgttgt

SEQ ID NO: 23874 - DNA, 21 bp, Homo sapiens
ggccatgttgtctgtagtcag

SEQ ID NO: 23875 - DNA, 21 bp, Homo sapiens
gatcattgtcattaacatcag

SEQ ID NO: 23876 - DNA, 21 bp, Homo sapiens
ggtccttgtcatcaggtgcag

SEQ ID NO: 23877 - DNA, 21 bp, Homo sapiens
agcttcctacatcagtgttgt

SEQ ID NO: 23878 - DNA, 22 bp, Homo sapiens
ggccattgttatcagtaaccag

SEQ ID NO: 23879 - DNA, 23 bp, Homo sapiens
ggctgttgtcatgagaatgtcag

SEQ ID NO: 23880 - DNA, 20 bp, Homo sapiens
ggctgttgtcagcagatgtc

SEQ ID NO: 23881 - DNA, 23 bp, Homo sapiens
ggctgtgttgctcatgttgtcag

SEQ ID NO: 23882 - DNA, 79 bp, Human herpesvirus 4
gcggagtctggcaacgcccgggtccttgctacctgtgtggtgtgttaagggctgggtaaaggtgtctgccaattctcgc

SEQ ID NO: 23883 - DNA, 24 bp, Human herpesvirus 4
tgtgttaagggctgggtaaaggtg

SEQ ID NO: 23884 - DNA, 21 bp, Homo sapiens
gccaggggctgggtggaggtg

SEQ ID NO: 23885 - DNA, 21 bp, Homo sapiens
tgttttatgggggtggaggtg

SEQ ID NO: 23886 - DNA, 21 bp, Homo sapiens
tgtttaggggctggggacagg

SEQ ID NO: 23887 - DNA, 18 bp, Homo sapiens
tatgttaatggtgaaggt

SEQ ID NO: 23888 - DNA, 76 bp, Human herpesvirus 4
gcatctccaataagtagatccagatacctaagactgcgttgaaaaaagagtgttagggttggaaaagtgggggtgt

SEQ ID NO: 23889 - DNA, 24 bp, Human herpesvirus 4
tctccaataagtagatccagatac

SEQ ID NO: 23890 - DNA, 18 bp, Homo sapiens
tctccagataagccagat

SEQ ID NO: 23891 - DNA, 15 bp, Homo sapiens
tctccaatgtaccag

SEQ ID NO: 23892 - DNA, 19 bp, Homo sapiens
ctccaataaactcctggat

SEQ ID NO: 23893 - DNA, 21 bp, Homo sapiens
tctctggtagtacatccagat

SEQ ID NO: 23894 - DNA, 22 bp, Homo sapiens
tccaataattaccatgggatac

SEQ ID NO: 23895 - DNA, 19 bp, Homo sapiens
cctccaatggagacaccag

SEQ ID NO: 23896 - DNA, 19 bp, Homo sapiens
tctccaatgcagtcaggta

SEQ ID NO: 23897 - DNA, 21 bp, Homo sapiens
tctctagtaccttcccagata

SEQ ID NO: 23898 - DNA, 17 bp, Homo sapiens
tccagtaagtccagata

SEQ ID NO: 23899 - DNA, 16 bp, Homo sapiens
tccaacaagcttccag

SEQ ID NO: 23900 - DNA, 16 bp, Homo sapiens
tctcagaggtccagat

SEQ ID NO: 23901 - DNA, 19 bp, Homo sapiens
tctccagatattccagata

SEQ ID NO: 23902 - DNA, 20 bp, Homo sapiens
tctccaataccaactggata

SEQ ID NO: 23903 - DNA, 19 bp, Homo sapiens
tccaataaatggaatgata

SEQ ID NO: 23904 - DNA, 18 bp, Homo sapiens
tctctgtaatcccagata

SEQ ID NO: 23905 - DNA, 90 bp, Human herpesvirus 6B
tttgactatttcgaaagagttattaacagttaccgtcaatgcgttggagcaagcgacggtgtatcctatattcggaagtgagatgtcaga

SEQ ID NO: 23906 - DNA, 24 bp, Human herpesvirus 6B
tatttcgaaagagttattaacagt

SEQ ID NO: 23907 - DNA, 15 bp, Homo sapiens
tttcgaagattaaca

SEQ ID NO: 23908 - DNA, 22 bp, Homo sapiens
tatttcgcaagctattaatagt

SEQ ID NO: 23909 - DNA, 24 bp, Homo sapiens
tattttaaagagttccaacacagt

SEQ ID NO: 23910 - DNA, 21 bp, Homo sapiens
tttcgaaagagaaggcgcagt

SEQ ID NO: 23911 - DNA, 19 bp, Homo sapiens
tatttcaaagaggtcacag

SEQ ID NO: 23912 - DNA, 24 bp, Homo sapiens
tatttttaaagagtcaaaaacagt

SEQ ID NO: 23913 - DNA, 92 bp, Human herpesvirus 6B
gacccctttataagatttacagacgattttagaggagaaatgatcaatacttttttcaataatgctcagatgtggaattttacgttcgggtc

SEQ ID NO: 23914 - DNA, 24 bp, Human herpesvirus 6B
tataagatttacagacgattttag

SEQ ID NO: 23915 - DNA, 21 bp, Homo sapiens
taagattttaacagtgatttt

SEQ ID NO: 23916 - DNA, 19 bp, Homo sapiens
taagatttacaaacatttt

SEQ ID NO: 23917 - DNA, 125 bp, Human herpesvirus 1
ggcctctgtgttccgggcacggtttccctgcttttacgccacggcgagctcttatgccggggtgaactccacggccgaggtgcgcgggggtgtagccgtgcccctcaggttggacacgcagagcc

SEQ ID NO: 23918 - DNA, 24 bp, Human herpesvirus 1
tccctgcttttacgccacggcgag

SEQ ID NO: 23919 - DNA, 25 bp, Homo sapiens
tctctgtgtttcgcttcatggtgag

SEQ ID NO: 23920 - DNA, 20 bp, Homo sapiens
cctgcttttgctcacctcag

SEQ ID NO: 23921 - DNA, 18 bp, Homo sapiens
tctctgctttgctggtga

SEQ ID NO: 23922 - DNA, 19 bp, Homo sapiens
tctctgcttttagctccag

SEQ ID NO: 23923 - DNA, 21 bp, Homo sapiens
ccgcttccaggctgcggtgag

SEQ ID NO: 23924 - DNA, 21 bp, Homo sapiens
cccctgctggtggtcgcggcg

SEQ ID NO: 23925 - DNA, 21 bp, Homo sapiens
tccctgctagcacgcggcgag

SEQ ID NO: 23926 - DNA, 79 bp, Tupaia herpesvirus
ggtccaagtcccgggtcttgggagggatgtatttgggtggagccaagagtctctctggagtggtgactttctgtggact

SEQ ID NO: 23927 - DNA, 24 bp, Tupaia herpesvirus
tctctggagtggtgactttctgtg

SEQ ID NO: 23928 - DNA, 23 bp, Homo sapiens
tcactgaagcatgactttctgtg

SEQ ID NO: 23929 - DNA, 21 bp, Homo sapiens
tctagataatgactttctgtg

SEQ ID NO: 23930 - DNA, 19 bp, Homo sapiens
tctttgataggctttctgt

SEQ ID NO: 23931 - DNA, 19 bp, Homo sapiens
tggggtggtgacacctgtg

SEQ ID NO: 23932 - DNA, 16 bp, Homo sapiens
tctgggatgtttctgt

SEQ ID NO: 23933 - DNA, 19 bp, Homo sapiens
tctggaagttatttctgtg

SEQ ID NO: 23934 - DNA, 22 bp, Homo sapiens
tctcagtgactggctttctgtg

SEQ ID NO: 23935 - DNA, 21 bp, Homo sapiens
cctggagttcaagtttctgtg

SEQ ID NO: 23936 - DNA, 22 bp, Homo sapiens
tctctgtagagttttttctgtg

SEQ ID NO: 23937 - DNA, 18 bp, Homo sapiens
cctgtcctggttttctgt

SEQ ID NO: 23938 - DNA, 21 bp, Homo sapiens
tctggagacagtctttctgtg

SEQ ID NO: 23939 - DNA, 19 bp, Homo sapiens
tgcatgtatgctttctgtg

SEQ ID NO: 23940 - DNA, 23 bp, Homo sapiens
tctctgggggtggtgcccctgtg

SEQ ID NO: 23941 - DNA, 22 bp, Homo sapiens
tctctgcagtggacagtctgtg

SEQ ID NO: 23942 - DNA, 21 bp, Homo sapiens
tcttctggagtggtccctgtg

SEQ ID NO: 23943 - DNA, 18 bp, Homo sapiens
cctctggacactttttgt

SEQ ID NO: 23944 - DNA, 21 bp, Homo sapiens
tctctgaaaatactttttgtg

SEQ ID NO: 23945 - DNA, 22 bp, Homo sapiens
tctgagtttctaattttctgtg

SEQ ID NO: 23946 - DNA, 63 bp, Human herpesvirus 1
cggctcgcgccgtgctgacaaacgccttgctgttgggcgtcttcctgtgcacggccgacgccg

SEQ ID NO: 23947 - DNA, 24 bp, Human herpesvirus 1
gcgccgtgctgacaaacgccttgc

SEQ ID NO: 23948 - DNA, 22 bp, Homo sapiens
gcgctgagccgcggcgccttgc

SEQ ID NO: 23949 - DNA, 20 bp, Homo sapiens
gtgtggcatgggcgccttgc

SEQ ID NO: 23950 - DNA, 21 bp, Homo sapiens
ccggtaccccgagcgccttgc

SEQ ID NO: 23951 - DNA, 17 bp, Homo sapiens
gctgtgctgactgcttg

SEQ ID NO: 23952 - DNA, 23 bp, Homo sapiens
gcctgtgctgaccgtggccttgc

SEQ ID NO: 23953 - DNA, 22 bp, Homo sapiens
gcgccgtgctgacgctgactgc

SEQ ID NO: 23954 - DNA, 24 bp, Homo sapiens
gcgccgcgccccggaatgctttgc

SEQ ID NO: 23955 - DNA, 23 bp, Homo sapiens
gcttccaatgacggacgccttgc

SEQ ID NO: 23956 - DNA, 21 bp, Homo sapiens
gcactgtgctgactttcttgc

SEQ ID NO: 23957 - DNA, 18 bp, Homo sapiens
acgccgtgctgacagacg

SEQ ID NO: 23958 - DNA, 89 bp, Lymphocystis disease virus 1
gtgtataggttgtaagcgcagtggtcgttgttgttgccgcggcaacagtggttggtggtgaacactgtgtatttgcactactagaacac

SEQ ID NO: 23959 - DNA, 24 bp, Lymphocystis disease virus 1
taggttgtaagcgcagtggtcgtt

SEQ ID NO: 23960 - DNA, 19 bp, Homo sapiens
taggttggagtgcagtggt

SEQ ID NO: 23961 - DNA, 22 bp, Homo sapiens
taggttgtaggctgggggagtt

SEQ ID NO: 23962 - DNA, 17 bp, Homo sapiens
ggttgcaagtggttcgt

SEQ ID NO: 23963 - DNA, 15 bp, Homo sapiens
taggttgtaagagta

SEQ ID NO: 23964 - DNA, 118 bp, Gallid herpesvirus 2
gcgatggtaggtcagtggtaatatgaccagccgtgttgattgttccattgggctccactttaccgatgatgctgtcagcaaacatttgtctaaatatgtgccacaattcactgttcgc

SEQ ID NO: 23965 - DNA, 24 bp, Gallid herpesvirus 2
agtggtaatatgaccagccgtgtt

SEQ ID NO: 23966 - DNA, 18 bp, Homo sapiens
aggggtaatatggccatt

SEQ ID NO: 23967 - DNA, 23 bp, Homo sapiens
atggtaacactaccagttgtgtt

SEQ ID NO: 23968 - DNA, 24 bp, Homo sapiens
agtggtaatggtgtggactgtgtt

SEQ ID NO: 23969 - DNA, 75 bp, Rana tigrina ranavirus
aagcgcaagagtcccaacattcctcatacagagactgtagactttgtatgggggtttaatgttgagactcgcctt

SEQ ID NO: 23970 - DNA, 24 bp, Rana tigrina ranavirus
tatgggggtttaatgttgagactc

SEQ ID NO: 23971 - DNA, 16 bp, Homo sapiens
tgggggttttgcggag

SEQ ID NO: 23972 - DNA, 16 bp, Homo sapiens
tgggggtttcattcag

SEQ ID NO: 23973 - DNA, 15 bp, Homo sapiens
gggagaatgttgaga

SEQ ID NO: 23974 - DNA, 130 bp, Rana tigrina ranavirus
ctcaatgtccttaacggtgtacgggacctctatgagctttatgcccagcttctgacaggccgccctcttgtagcagtctcgctcgtgctgcttccttaggtcatgcctgcctcccttgtggaacacagag

SEQ ID NO: 23975 - DNA, 24 bp, Rana tigrina ranavirus
tatgagctttatgcccagcttctg

SEQ ID NO: 23976 - DNA, 22 bp, Homo sapiens
tgagccttgggacaagtttctg

SEQ ID NO: 23977 - DNA, 24 bp, Homo sapiens
catgagcaaatcacttagcttctg

SEQ ID NO: 23978 - DNA, 20 bp, Homo sapiens
tggcttctaaacagcttctg

SEQ ID NO: 23979 - DNA, 16 bp, Homo sapiens
tatgagctttgtggct

SEQ ID NO: 23980 - DNA, 18 bp, Homo sapiens
atgagctcttcggcttct

SEQ ID NO: 23981 - DNA, 20 bp, Homo sapiens
tgaactttattatgcttctg

SEQ ID NO: 23982 - DNA, 19 bp, Homo sapiens
tgagccttatttctttctg

SEQ ID NO: 23983 - DNA, 17 bp, Homo sapiens
atgagtttacagcttct

SEQ ID NO: 23984 - DNA, 20 bp, Homo sapiens
aagctggccttcagcttctg

SEQ ID NO: 23985 - DNA, 18 bp, Homo sapiens
agcttcaatcagcttctg

SEQ ID NO: 23986 - DNA, 19 bp, Homo sapiens
tgggctcacctggcttctg

SEQ ID NO: 23987 - DNA, 67 bp, Rana tigrina ranavirus
tatcttaggatattttacatccagtaccactctcctaaacgttgtgatactaaaatatcttaagata

SEQ ID NO: 23988 - DNA, 24 bp, Rana tigrina ranavirus
tattttacatccagtaccactctc

SEQ ID NO: 23989 - DNA, 24 bp, Homo sapiens
attttgcatctatcatccactctc

SEQ ID NO: 23990 - DNA, 21 bp, Homo sapiens
tattttacaccagcaactctc

SEQ ID NO: 23991 - DNA, 23 bp, Homo sapiens
tatcttgcattcacttcactctc

SEQ ID NO: 23992 - DNA, 21 bp, Homo sapiens
tatttttccagtaccattctc

SEQ ID NO: 23993 - DNA, 22 bp, Homo sapiens
ttttacattcattcaccgttct

SEQ ID NO: 23994 - DNA, 20 bp, Homo sapiens
tactttacattatacacact

SEQ ID NO: 23995 - DNA, 22 bp, Homo sapiens
tattttacaaccaggcgttctc

SEQ ID NO: 23996 - DNA, 19 bp, Homo sapiens
tattttacattcacctctc

SEQ ID NO: 23997 - DNA, 21 bp, Homo sapiens
tttacatccaactcaagctct

SEQ ID NO: 23998 - DNA, 19 bp, Homo sapiens
tatttcacaaaagctacca

SEQ ID NO: 23999 - DNA, 21 bp, Homo sapiens
tattttacagcgtttcactct

SEQ ID NO: 24000 - DNA, 62 bp, Chimpanzee cytomegalovirus
gcgacggaagtgtccgcgagcacgcattcaaaaacgtagcgttatccgagctggtccgtcgc

SEQ ID NO: 24001 - DNA, 24 bp, Chimpanzee cytomegalovirus
acggaagtgtccgcgagcacgcat

SEQ ID NO: 24002 - DNA, 20 bp, Homo sapiens
gaaggtgtcacaacacgcat

SEQ ID NO: 24003 - DNA, 20 bp, Homo sapiens
ggaagtgttccttgcagcat

SEQ ID NO: 24004 - DNA, 101 bp, Chimpanzee cytomegalovirus
ccagtgtgctctgggcgccggacgtggagatcagcacggtccgccggcacagcgcggcggtccgcgctttcgcgtcggctctcaggaactacatgttttgg

SEQ ID NO: 24005 - DNA, 24 bp, Chimpanzee cytomegalovirus
cggtccgcgctttcgcgtcggctc

SEQ ID NO: 24006 - DNA, 20 bp, Homo sapiens
cggcctgcgctttcgagacc

SEQ ID NO: 24007 - DNA, 23 bp, Homo sapiens
cggactgcccccagtgtcggctc

SEQ ID NO: 24008 - DNA, 104 bp, Chimpanzee cytomegalovirus
gtcttctctatctactggcagggccactccgagttggtctacatccttacgggtctcacacactgcacgaaactagtggtcgaatgtgggcagatgaaggggac

SEQ ID NO: 24009 - DNA, 24 bp, Chimpanzee cytomegalovirus
tgcacgaaactagtggtcgaatgt

SEQ ID NO: 24010 - DNA, 16 bp, Homo sapiens
catgaaactagaaatg

SEQ ID NO: 24011 - DNA, 17 bp, Homo sapiens
gaaactaaagtgaatgt

SEQ ID NO: 24012 - DNA, 61 bp, Chimpanzee cytomegalovirus
cggaatctatatgattcgggtctcggacgggaatatgggtccgaggaacgtggtatggccg

SEQ ID NO: 24013 - DNA, 24 bp, Chimpanzee cytomegalovirus
tgattcgggtctcggacgggaata

SEQ ID NO: 24014 - DNA, 18 bp, Homo sapiens
tggatcgggtctggggga

SEQ ID NO: 24015 - DNA, 65 bp, Chimpanzee cytomegalovirus
tgcctgcacaagtaccaggaggggctgtcgactatcgagcagctgcaatcggtgctacagcagca

SEQ ID NO: 24016 - DNA, 24 bp, Chimpanzee cytomegalovirus
caagtaccaggaggggctgtcgac

SEQ ID NO: 24017 - DNA, 20 bp, Homo sapiens
caagtgcaggagggggcggc

SEQ ID NO: 24018 - DNA, 20 bp, Homo sapiens
caagagccaggagggtacca

SEQ ID NO: 24019 - DNA, 20 bp, Homo sapiens
tgagtattggagagctgtcg

SEQ ID NO: 24020 - DNA, 19 bp, Homo sapiens
tgagtccaggaggccacga

SEQ ID NO: 24021 - DNA, 22 bp, Homo sapiens
caagtaccgggacggtgagggc

SEQ ID NO: 24022 - DNA, 19 bp, Homo sapiens
aagagccgggagggggccg

SEQ ID NO: 24023 - DNA, 17 bp, Homo sapiens
gtactggaaagctgtcg

SEQ ID NO: 24024 - DNA, 17 bp, Homo sapiens
caagcaccaggaggctg

SEQ ID NO: 24025 - DNA, 18 bp, Homo sapiens
caagtaccaaggggcggc

SEQ ID NO: 24026 - DNA, 17 bp, Homo sapiens
gcactgggagggctgcc

SEQ ID NO: 24027 - DNA, 19 bp, Homo sapiens
caagtaccagagaggggtg

SEQ ID NO: 24028 - DNA, 17 bp, Homo sapiens
tgagtaccagggggccc

SEQ ID NO: 24029 - DNA, 25 bp, Homo sapiens
aaggccaggaaaatgtggctgttga

SEQ ID NO: 24030 - DNA, 19 bp, Homo sapiens
tgagttccaggaggcgtga

SEQ ID NO: 24031 - DNA, 19 bp, Homo sapiens
caagtctgggagggccacg

SEQ ID NO: 24032 - DNA, 22 bp, Homo sapiens
caagtggctctggggctgttga

SEQ ID NO: 24033 - DNA, 17 bp, Homo sapiens
caaggtcaggagggcga

SEQ ID NO: 24034 - DNA, 20 bp, Homo sapiens
caagtacaaggaaccagtcg

SEQ ID NO: 24035 - DNA, 19 bp, Homo sapiens
caggtactcaggaggctgt

SEQ ID NO: 24036 - DNA, 20 bp, Homo sapiens
caagtaccaagggggggcca

SEQ ID NO: 24037 - DNA, 17 bp, Homo sapiens
caaggccagggggggtc

SEQ ID NO: 24038 - DNA, 19 bp, Homo sapiens
caggcgccgggaggggccg

SEQ ID NO: 24039 - DNA, 19 bp, Homo sapiens
aggaccaggaggccagcga

SEQ ID NO: 24040 - DNA, 18 bp, Homo sapiens
tgagtttcaggaggctgt

SEQ ID NO: 24041 - DNA, 20 bp, Homo sapiens
tgagtgccaggagaggctgt

SEQ ID NO: 24042 - DNA, 19 bp, Homo sapiens
aagtccaggagggcgccga

SEQ ID NO: 24043 - DNA, 19 bp, Homo sapiens
tgagtgccaggagaggtgc

SEQ ID NO: 24044 - DNA, 19 bp, Homo sapiens
cgataccaggaggctatga

SEQ ID NO: 24045 - DNA, 68 bp, Feline foamy virus
gactaaacttcctggggactagaggtgtggaaactttgctgcctctgcttcacgggaagtttttggtt

SEQ ID NO: 24046 - DNA, 24 bp, Feline foamy virus
taaacttcctggggactagaggtg

SEQ ID NO: 24047 - DNA, 21 bp, Homo sapiens
actgggctggggctgggggtg

SEQ ID NO: 24048 - DNA, 18 bp, Homo sapiens
cttcctgggaggaaggtg

SEQ ID NO: 24049 - DNA, 20 bp, Homo sapiens
aactactagggttaggggtg

SEQ ID NO: 24050 - DNA, 18 bp, Homo sapiens
ctccccgggctggaggtg

SEQ ID NO: 24051 - DNA, 19 bp, Homo sapiens
cttcctggaggcggaggtg

SEQ ID NO: 24052 - DNA, 20 bp, Homo sapiens
cctcctgaatagtagaggtg

SEQ ID NO: 24053 - DNA, 18 bp, Homo sapiens
ttcccagggctggaggtg

SEQ ID NO: 24054 - DNA, 19 bp, Homo sapiens
ttcctgggtgatctttgtg

SEQ ID NO: 24055 - DNA, 18 bp, Homo sapiens
ctccctggggagggggtg

SEQ ID NO: 24056 - DNA, 19 bp, Homo sapiens
cttcctggatccaggggtg

SEQ ID NO: 24057 - DNA, 23 bp, Homo sapiens
cttcctgggctggtgtagaggtg

SEQ ID NO: 24058 - DNA, 18 bp, Homo sapiens
taaacttcgtgggagagg

SEQ ID NO: 24059 - DNA, 16 bp, Homo sapiens
acttccaggcagaggt

SEQ ID NO: 24060 - DNA, 18 bp, Homo sapiens
actttctggacaggggtg

SEQ ID NO: 24061 - DNA, 21 bp, Homo sapiens
taaactgcctggacagaggtg

SEQ ID NO: 24062 - DNA, 15 bp, Homo sapiens
cttcctggaggaggt

SEQ ID NO: 24063 - DNA, 16 bp, Homo sapiens
acttcctggaggaggt

SEQ ID NO: 24064 - DNA, 19 bp, Homo sapiens
cttcctgggggaagaggtg

SEQ ID NO: 24065 - DNA, 18 bp, Homo sapiens
ccctggggactgggggtg

SEQ ID NO: 24066 - DNA, 60 bp, Human adenovirus E
cctggagatgatgctgacagtatgattttttacaaagtaactgttgttgatcccatactc

SEQ ID NO: 24067 - DNA, 24 bp, Human adenovirus E
tgatgctgacagtatgatttttta

SEQ ID NO: 24068 - DNA, 20 bp, Homo sapiens
tgatgctgtagtactccttt

SEQ ID NO: 24069 - DNA, 22 bp, Homo sapiens
tgatactgaagtagatttttta

SEQ ID NO: 24070 - DNA, 22 bp, Homo sapiens
tgatgctgatggatgattaatt

SEQ ID NO: 24071 - DNA, 24 bp, Homo sapiens
tgatgctgataatagcagttttta

SEQ ID NO: 24072 - DNA, 18 bp, Homo sapiens
tgatgctggcagcatgac

SEQ ID NO: 24073 - DNA, 19 bp, Homo sapiens
gatgctgacagttattttt

SEQ ID NO: 24074 - DNA, 21 bp, Homo sapiens
tgatgccgacggtgtggttct

SEQ ID NO: 24075 - DNA, 83 bp, Human adenovirus E
cattgtcggtgtgctttcgggattagcagtcataatcatctgcatgttcatttttgcttgctgctatagaaggctttaccgac

SEQ ID NO: 24076 - DNA, 22 bp, Human adenovirus E
tgctatagaaggctttaccgac

SEQ ID NO: 24077 - DNA, 15 bp, Homo sapiens
tgctatagcttaccg

SEQ ID NO: 24078 - DNA, 17 bp, Homo sapiens
tgcatagaaggcttacc

SEQ ID NO: 24079 - DNA, 19 bp, Homo sapiens
tgctaggggctccactgac

SEQ ID NO: 24080 - DNA, 17 bp, Homo sapiens
tgcgtagaaggctcccg

SEQ ID NO: 24081 - DNA, 18 bp, Homo sapiens
tgctgtagcgggctctac

SEQ ID NO: 24082 - DNA, 18 bp, Homo sapiens
tgttataaaaggtttcac

SEQ ID NO: 24083 - DNA, 22 bp, Homo sapiens
tgctacagagcagaccattgac

SEQ ID NO: 24084 - DNA, 20 bp, Homo sapiens
tgctacaggaataagcgccg

SEQ ID NO: 24085 - DNA, 23 bp, Homo sapiens
tgctataggagctaactcttgac

SEQ ID NO: 24086 - DNA, 17 bp, Homo sapiens
tatagaagagctctgac

SEQ ID NO: 24087 - DNA, 16 bp, Homo sapiens
tgctataaggctttga

SEQ ID NO: 24088 - DNA, 18 bp, Homo sapiens
tgctgcaggaggctccac

SEQ ID NO: 24089 - DNA, 21 bp, Homo sapiens
tgctatggaatgggccctgac

SEQ ID NO: 24090 - DNA, 23 bp, Homo sapiens
tgttctagaaggcttggggagac

SEQ ID NO: 24091 - DNA, 20 bp, Homo sapiens
tgctacaggaggccacagac

SEQ ID NO: 24092 - DNA, 66 bp, Murine adenovirus A
tgagtatagacccaatccttaaactgatttaaaaccccatcaagagggttctcttctaattcctca

SEQ ID NO: 24093 - DNA, 24 bp, Murine adenovirus A
tatagacccaatccttaaactgat

SEQ ID NO: 24094 - DNA, 18 bp, Homo sapiens
catagacccaatttttaa

SEQ ID NO: 24095 - DNA, 22 bp, Homo sapiens
tatagacccatgacagactgat

SEQ ID NO: 24096 - DNA, 19 bp, Homo sapiens
tagacccagttcttagact

SEQ ID NO: 24097 - DNA, 131 bp, Turkey adenovirus 3
ttagtagagttgggtaatgttatagctagtcttggaccgagttatgatcaattaaagttgcagcaaggattgaattatttggtaactaaccaaagacaagaatataaaccatcagtacctgacttgactaa

SEQ ID NO: 24098 - DNA, 24 bp, Turkey adenovirus 3
tgggtaatgttatagctagtcttg

SEQ ID NO: 24099 - DNA, 20 bp, Homo sapiens
tggataatgttgtgaaagct

SEQ ID NO: 24100 - DNA, 65 bp, Murine adenovirus A
gcgaccgcacagcagggaattgtagcacaaaataatactgcgccaccaacctactgcgcatgcgc

SEQ ID NO: 24101 - DNA, 24 bp, Murine adenovirus A
ccgcacagcagggaattgtagcac

SEQ ID NO: 24102 - DNA, 18 bp, Homo sapiens
gcacagcagggaggccac

SEQ ID NO: 24103 - DNA, 18 bp, Homo sapiens
gcacagcaattgtagcac

SEQ ID NO: 24104 - DNA, 19 bp, Homo sapiens
cctgcagcagggggatcgc

SEQ ID NO: 24105 - DNA, 21 bp, Homo sapiens
ccggcagcagggggaaggcac

SEQ ID NO: 24106 - DNA, 18 bp, Homo sapiens
cacacagcggggagtggc

SEQ ID NO: 24107 - DNA, 20 bp, Homo sapiens
gcacagcagtgtgagggcac

SEQ ID NO: 24108 - DNA, 19 bp, Homo sapiens
acagcagggctgacagcac

SEQ ID NO: 24109 - DNA, 18 bp, Homo sapiens
gcatagcaggaaagtcgc

SEQ ID NO: 24110 - DNA, 18 bp, Homo sapiens
agcagggattacaggcac

SEQ ID NO: 24111 - DNA, 23 bp, Homo sapiens
ccgtgcagcagggtggggtccac

SEQ ID NO: 24112 - DNA, 22 bp, Homo sapiens
ccacggcaggttctcgtagcac

SEQ ID NO: 24113 - DNA, 21 bp, Homo sapiens
ccgcagcagcagggaggctgc

SEQ ID NO: 24114 - DNA, 19 bp, Homo sapiens
gccagcagggaaggactgt

SEQ ID NO: 24115 - DNA, 20 bp, Homo sapiens
ccgcagagcagggaatgggc

SEQ ID NO: 24116 - DNA, 22 bp, Homo sapiens
gcaagtaggcttcctgtagcac

SEQ ID NO: 24117 - DNA, 20 bp, Homo sapiens
cctgcagcagggggtcccac

SEQ ID NO: 24118 - DNA, 19 bp, Homo sapiens
cgcacagcgggggctcgca

SEQ ID NO: 24119 - DNA, 19 bp, Homo sapiens
ccgcacagcacggagtagc

SEQ ID NO: 24120 - DNA, 22 bp, Homo sapiens
ccgagtagcagggattacaggc

SEQ ID NO: 24121 - DNA, 22 bp, Homo sapiens
ccgcgcagcagggcggtcgcgc

SEQ ID NO: 24122 - DNA, 21 bp, Homo sapiens
ccgcatgctgggggatggcac

SEQ ID NO: 24123 - DNA, 21 bp, Homo sapiens
cgccagcagggggcgatgtgc

SEQ ID NO: 24124 - DNA, 19 bp, Homo sapiens
gcagcagcagggaaaccgt

SEQ ID NO: 24125 - DNA, 19 bp, Homo sapiens
acacagcaggtcttggcgc

SEQ ID NO: 24126 - DNA, 18 bp, Homo sapiens
gctacagcagggaagcgc

SEQ ID NO: 24127 - DNA, 18 bp, Homo sapiens
ccgcaacagcaggggatt

SEQ ID NO: 24128 - DNA, 20 bp, Homo sapiens
ccgcacagcaggaggtgagc

SEQ ID NO: 24129 - DNA, 18 bp, Homo sapiens
ccgccagcagggtcagca

SEQ ID NO: 24130 - DNA, 19 bp, Homo sapiens
gcagcagcaggggcagcac

SEQ ID NO: 24131 - DNA, 22 bp, Homo sapiens
ccgcgcagcagggcatcctcac

SEQ ID NO: 24132 - DNA, 19 bp, Homo sapiens
gccagcaggggcagcagca

SEQ ID NO: 24133 - DNA, 20 bp, Homo sapiens
ccgcacagcacggggctcgc

SEQ ID NO: 24134 - DNA, 22 bp, Homo sapiens
ccccatccaaggaattgtggca

SEQ ID NO: 24135 - DNA, 19 bp, Homo sapiens
cctgcagcaggggcgtcgc

SEQ ID NO: 24136 - DNA, 18 bp, Homo sapiens
gcgcagcaaggaggctgc

SEQ ID NO: 24137 - DNA, 24 bp, Homo sapiens
ccgtccagcaggacagggtagcac

SEQ ID NO: 24138 - DNA, 23 bp, Homo sapiens
ccgcactggtaggaaggtggcac

SEQ ID NO: 24139 - DNA, 18 bp, Homo sapiens
cagcaatggattgtagca

SEQ ID NO: 24140 - DNA, 21 bp, Homo sapiens
ccgcacagcaggcagcaacac

SEQ ID NO: 24141 - DNA, 19 bp, Homo sapiens
ccgcgcagcaggggtgcgc

SEQ ID NO: 24142 - DNA, 17 bp, Homo sapiens
catacagcagagtagca

SEQ ID NO: 24143 - DNA, 17 bp, Homo sapiens
cgtcagtagggaactgc

SEQ ID NO: 24144 - DNA, 22 bp, Homo sapiens
gcacggcgggggactcgggcac

SEQ ID NO: 24145 - DNA, 17 bp, Homo sapiens
ccgacagcagggggcgc

SEQ ID NO: 24146 - DNA, 21 bp, Homo sapiens
gccacagcagggaggaaggca

SEQ ID NO: 24147 - DNA, 18 bp, Homo sapiens
cgcacagcaggcggctgc

SEQ ID NO: 24148 - DNA, 21 bp, Homo sapiens
gcagtggtcaacttgtagcac

SEQ ID NO: 24149 - DNA, 23 bp, Homo sapiens
gcagcagcagcttcaggtagcac

SEQ ID NO: 24150 - DNA, 20 bp, Homo sapiens
cctgcagcaggggtccgtgc

SEQ ID NO: 24151 - DNA, 17 bp, Homo sapiens
ccggcagcagggaaagc

SEQ ID NO: 24152 - DNA, 19 bp, Homo sapiens
cacagcaggaaattagtgc

SEQ ID NO: 24153 - DNA, 19 bp, Homo sapiens
cctgcagcagggtggggca

SEQ ID NO: 24154 - DNA, 108 bp, Odontoglossum ringspot virus
tctctgaatttattaatttatcagcctttgaaaaactactaccgtcagctttaacggctgtcaagtcggtacgtattccaaaggttgataaaattataagttacgaga

SEQ ID NO: 24155 - DNA, 24 bp, Odontoglossum ringspot virus
tgtcaagtcggtacgtattccaaa

SEQ ID NO: 24156 - DNA, 17 bp, Homo sapiens
tgtcaagctctattcca

SEQ ID NO: 24157 - DNA, 19 bp, Homo sapiens
tgtcaattcggaattccaa

SEQ ID NO: 24158 - DNA, 18 bp, Homo sapiens
agtcagtatgtgttccaa

SEQ ID NO: 24159 - DNA, 21 bp, Homo sapiens
tgtcaagttggttatgctctc

SEQ ID NO: 24160 - DNA, 23 bp, Homo sapiens
tgtcaggtcgaagcaattccaaa

SEQ ID NO: 24161 - DNA, 17 bp, Homo sapiens
tgtcaagtggtggccca

SEQ ID NO: 24162 - DNA, 19 bp, Homo sapiens
gtcaaggtcagtgtgtttc

SEQ ID NO: 24163 - DNA, 88 bp, Human herpesvirus 1
ggagtcgggcacggcgccagtgctcgcacttcgccctaataatatatatatattgggacgaagtgcgaacgcttcgcgttctcacttc

SEQ ID NO: 24164 - DNA, 24 bp, Human herpesvirus 1
ttgggacgaagtgcgaacgcttcg

SEQ ID NO: 24165 - DNA, 16 bp, Homo sapiens
ttgggagtgaacgctt

SEQ ID NO: 24166 - DNA, 20 bp, Homo sapiens
ttgggacggagtctgactct

SEQ ID NO: 24167 - DNA, 19 bp, Homo sapiens
ttgagacggagtctcgctt

SEQ ID NO: 24168 - DNA, 92 bp, Odontoglossum ringspot virus
gtgagtatctgtcttgtagacaaacgcatgaaaagagctaatgaagcaacacttggctcttatcatacatctgcttgcaagaagagattcac

SEQ ID NO: 24169 - DNA, 24 bp, Odontoglossum ringspot virus
tgtcttgtagacaaacgcatgaaa

SEQ ID NO: 24170 - DNA, 21 bp, Homo sapiens
tgtcttgtggacaacgcagtg

SEQ ID NO: 24171 - DNA, 19 bp, Homo sapiens
tcttgagaaaacgtatgaa

SEQ ID NO: 24172 - DNA, 20 bp, Homo sapiens
tgtcttgtagatggggcaca

SEQ ID NO: 24173 - DNA, 23 bp, Homo sapiens
tgttttgagacagaaacatgaaa

SEQ ID NO: 24174 - DNA, 22 bp, Homo sapiens
tgttttgtggcaaacacacaaa

SEQ ID NO: 24175 - DNA, 20 bp, Homo sapiens
tgtttgtagacagccacctg

SEQ ID NO: 24176 - DNA, 19 bp, Homo sapiens
gttttgtagacagagatga

SEQ ID NO: 24177 - DNA, 21 bp, Homo sapiens
tgtttgtagacatatctgaaa

SEQ ID NO: 24178 - DNA, 18 bp, Homo sapiens
tgtcctgtagacaactga

SEQ ID NO: 24179 - DNA, 16 bp, Homo sapiens
tgttttgtagacagca

SEQ ID NO: 24180 - DNA, 22 bp, Homo sapiens
tgtctgtaactcctgcatgaaa

SEQ ID NO: 24181 - DNA, 20 bp, Homo sapiens
tgtcttgtgcacaaatacat

SEQ ID NO: 24182 - DNA, 24 bp, Homo sapiens
tgtcttattttaaaagcgtatgaa

SEQ ID NO: 24183 - DNA, 18 bp, Homo sapiens
tgtcttgtgatgcttgaa

SEQ ID NO: 24184 - DNA, 18 bp, Homo sapiens
tgtttagtagacaaatga

SEQ ID NO: 24185 - DNA, 17 bp, Homo sapiens
tgtcttgtaggcacaaa

SEQ ID NO: 24186 - DNA, 75 bp, Molluscum contagiosum virus
gtcgacgacgaagatgcagtggttgtgcgcggttaacggagttccgcctacttttacttcaatctttgcgtcggc

SEQ ID NO: 24187 - DNA, 24 bp, Molluscum contagiosum virus
acgaagatgcagtggttgtgcgcg

SEQ ID NO: 24188 - DNA, 19 bp, Homo sapiens
gaggatgcagtgagccgtg

SEQ ID NO: 24189 - DNA, 20 bp, Homo sapiens
cgaggatgcagtggggcgcg

SEQ ID NO: 24190 - DNA, 20 bp, Homo sapiens
cgcgggtgcgagtgtgtgcg

SEQ ID NO: 24191 - DNA, 23 bp, Homo sapiens
cggagagcggggtcgcgtgcgcg

SEQ ID NO: 24192 - DNA, 21 bp, Homo sapiens
cgggatgcggctctgtgcgcg

SEQ ID NO: 24193 - DNA, 17 bp, Homo sapiens
cggggacgtgggtgcgc

SEQ ID NO: 24194 - DNA, 17 bp, Homo sapiens
gaggagcagtggcagtg

SEQ ID NO: 24195 - DNA, 19 bp, Homo sapiens
gaagatgtggctgtgtgcg

SEQ ID NO: 24196 - DNA, 16 bp, Homo sapiens
gaagtgcagttgtgcg

SEQ ID NO: 24197 - DNA, 16 bp, Homo sapiens
gaagtgcagtggtgtg

SEQ ID NO: 24198 - DNA, 17 bp, Homo sapiens
atgagggtgtgtgcaca

SEQ ID NO: 24199 - DNA, 20 bp, Homo sapiens
cgaagatgtcgtgggccgtg

SEQ ID NO: 24200 - DNA, 21 bp, Homo sapiens
cgaggtgcagtggcgaggacg

SEQ ID NO: 24201 - DNA, 18 bp, Homo sapiens
cgggaatgcagtggtgtg

SEQ ID NO: 24202 - DNA, 17 bp, Homo sapiens
gaaggtgagtggttgcg

SEQ ID NO: 24203 - DNA, 18 bp, Homo sapiens
acggagatgaggtgggtg

SEQ ID NO: 24204 - DNA, 16 bp, Homo sapiens
cgggatgcagctgcgc

SEQ ID NO: 24205 - DNA, 19 bp, Homo sapiens
gaagatggcggcggctgcg

SEQ ID NO: 24206 - DNA, 16 bp, Homo sapiens
gaagtgcagtggcgcg

SEQ ID NO: 24207 - DNA, 19 bp, Homo sapiens
agaagcggtggctgctgcg

SEQ ID NO: 24208 - DNA, 19 bp, Homo sapiens
gaagatgcaagggtgtgtg

SEQ ID NO: 24209 - DNA, 18 bp, Homo sapiens
gaaggatgcagtcgtgtg

SEQ ID NO: 24210 - DNA, 18 bp, Homo sapiens
agatgcagtccccgtgcg

SEQ ID NO: 24211 - DNA, 63 bp, Molluscum contagiosum virus
gcgcagcagctgctcgcgcagagacagtgtttgcggcgcgggcgcgggcggcagagcgcgcgc

SEQ ID NO: 24212 - DNA, 24 bp, Molluscum contagiosum virus
cagcagctgctcgcgcagagacag

SEQ ID NO: 24213 - DNA, 25 bp, Homo sapiens
cagcagctcgtggtatcggggacag

SEQ ID NO: 24214 - DNA, 21 bp, Homo sapiens
acagttgtgtgctagagacag

SEQ ID NO: 24215 - DNA, 16 bp, Homo sapiens
cagtgctgccagagac

SEQ ID NO: 24216 - DNA, 22 bp, Homo sapiens
cagcagctgccaaataagacag

SEQ ID NO: 24217 - DNA, 23 bp, Homo sapiens
cagcagctgctttctggggacag

SEQ ID NO: 24218 - DNA, 18 bp, Homo sapiens
caggggctgctcagacag

SEQ ID NO: 24219 - DNA, 24 bp, Homo sapiens
cagcagctatttaaaataagacag

SEQ ID NO: 24220 - DNA, 19 bp, Homo sapiens
cagcagctccgggtggaga

SEQ ID NO: 24221 - DNA, 19 bp, Homo sapiens
gcagctgctcacgacacag

SEQ ID NO: 24222 - DNA, 19 bp, Homo sapiens
acagctggggtccgcagag

SEQ ID NO: 24223 - DNA, 18 bp, Homo sapiens
cagcagccgctcgcgcag

SEQ ID NO: 24224 - DNA, 21 bp, Homo sapiens
cagcagctccttgctttacag

SEQ ID NO: 24225 - DNA, 19 bp, Homo sapiens
cagcagctggcaaggggag

SEQ ID NO: 24226 - DNA, 19 bp, Homo sapiens
gcgctggcgttagagacag

SEQ ID NO: 24227 - DNA, 18 bp, Homo sapiens
caggagctgctcagacag

SEQ ID NO: 24228 - DNA, 17 bp, Homo sapiens
cagtggctgctcgccag

SEQ ID NO: 24229 - DNA, 18 bp, Homo sapiens
agtggccgcgcagagaca

SEQ ID NO: 24230 - DNA, 19 bp, Homo sapiens
gccgctgcagcagagacag

SEQ ID NO: 24231 - DNA, 22 bp, Homo sapiens
cagcagctcttgtgatcgagag

SEQ ID NO: 24232 - DNA, 20 bp, Homo sapiens
agcagctgcttcactagcag

SEQ ID NO: 24233 - DNA, 23 bp, Homo sapiens
agcagctgtggtggcaggggcag

SEQ ID NO: 24234 - DNA, 18 bp, Homo sapiens
cagcagctgcttctacag

SEQ ID NO: 24235 - DNA, 21 bp, Homo sapiens
cagccggcagcagcgcagaga

SEQ ID NO: 24236 - DNA, 18 bp, Homo sapiens
cagggctgctcgcgccag

SEQ ID NO: 24237 - DNA, 18 bp, Homo sapiens
cagcagctggaacagaga

SEQ ID NO: 24238 - DNA, 17 bp, Homo sapiens
gcagctgctctaagaca

SEQ ID NO: 24239 - DNA, 18 bp, Homo sapiens
acagctgccacagaggca

SEQ ID NO: 24240 - DNA, 18 bp, Homo sapiens
cagcagctggcgaggaga

SEQ ID NO: 24241 - DNA, 17 bp, Homo sapiens
gcagctgctcccagaga

SEQ ID NO: 24242 - DNA, 22 bp, Homo sapiens
gccggctgctcgctgcacagac

SEQ ID NO: 24243 - DNA, 22 bp, Homo sapiens
ggacagacaggtgcagagacag

SEQ ID NO: 24244 - DNA, 21 bp, Homo sapiens
caggggctgtgggagagacag

SEQ ID NO: 24245 - DNA, 21 bp, Homo sapiens
cagcagctatttcagaggcag

SEQ ID NO: 24246 - DNA, 20 bp, Homo sapiens
acagctgcaccgggagacag

SEQ ID NO: 24247 - DNA, 23 bp, Homo sapiens
cagtggactgcatcaagagacag

SEQ ID NO: 24248 - DNA, 22 bp, Homo sapiens
cagcagctgaccccagagacag

SEQ ID NO: 24249 - DNA, 19 bp, Homo sapiens
gcatacaatgcagagacag

SEQ ID NO: 24250 - DNA, 18 bp, Homo sapiens
cagcagctgccccacaga

SEQ ID NO: 24251 - DNA, 15 bp, Homo sapiens
gcagccggcgcagag

SEQ ID NO: 24252 - DNA, 20 bp, Homo sapiens
gcagccgcgcctggggacag

SEQ ID NO: 24253 - DNA, 26 bp, Homo sapiens
cagcggctgctcacctccagggacag

SEQ ID NO: 24254 - DNA, 17 bp, Homo sapiens
gccgctgctcggagaga

SEQ ID NO: 24255 - DNA, 17 bp, Homo sapiens
agcagctgctgcagtag

SEQ ID NO: 24256 - DNA, 21 bp, Homo sapiens
caacagctggggcctggagac

SEQ ID NO: 24257 - DNA, 25 bp, Homo sapiens
cagcagctctttgcagcaatgacag

SEQ ID NO: 24258 - DNA, 18 bp, Homo sapiens
caggagctgctccaggag

SEQ ID NO: 24259 - DNA, 19 bp, Homo sapiens
aggggctgctcggcggcag

SEQ ID NO: 24260 - DNA, 16 bp, Homo sapiens
gcagctgccagggaca

SEQ ID NO: 24261 - DNA, 19 bp, Homo sapiens
gcagcatggacagagacag

SEQ ID NO: 24262 - DNA, 25 bp, Homo sapiens
cagcagctcctcgccagccagacag

SEQ ID NO: 24263 - DNA, 17 bp, Homo sapiens
gctgtgcgcagagacag

SEQ ID NO: 24264 - DNA, 16 bp, Homo sapiens
cagagctgccagagac

SEQ ID NO: 24265 - DNA, 19 bp, Homo sapiens
gcagctgctcttggcccag

SEQ ID NO: 24266 - DNA, 19 bp, Homo sapiens
cagcagctgttctgtagac

SEQ ID NO: 24267 - DNA, 22 bp, Homo sapiens
acagctgcttaaggggaggcag

SEQ ID NO: 24268 - DNA, 20 bp, Homo sapiens
cagcagctcctcttgggcag

SEQ ID NO: 24269 - DNA, 18 bp, Homo sapiens
cagcacctgcaagagaca

SEQ ID NO: 24270 - DNA, 18 bp, Homo sapiens
cagcagctgctctgtcag

SEQ ID NO: 24271 - DNA, 20 bp, Homo sapiens
cagcagctgtccctagacag

SEQ ID NO: 24272 - DNA, 18 bp, Homo sapiens
gctgggggccagagacag

SEQ ID NO: 24273 - DNA, 19 bp, Homo sapiens
caatggctgctcgcgcgag

SEQ ID NO: 24274 - DNA, 21 bp, Homo sapiens
cagcggtggctgcagagacag

SEQ ID NO: 24275 - DNA, 20 bp, Homo sapiens
cagaggctgctcaggggcag

SEQ ID NO: 24276 - DNA, 21 bp, Homo sapiens
gcatgctgcaggcagagacag

SEQ ID NO: 24277 - DNA, 23 bp, Homo sapiens
gcagctgctttgcccgtgagcag

SEQ ID NO: 24278 - DNA, 24 bp, Homo sapiens
cagcagctgtgtgaccttgggcag

SEQ ID NO: 24279 - DNA, 23 bp, Homo sapiens
cagcagcctccctgtggggacag

SEQ ID NO: 24280 - DNA, 22 bp, Homo sapiens
acagctgcagccctggggacag

SEQ ID NO: 24281 - DNA, 22 bp, Homo sapiens
cagggctgcagccgagagacag

SEQ ID NO: 24282 - DNA, 20 bp, Homo sapiens
cagctgagacccagagacag

SEQ ID NO: 24283 - DNA, 15 bp, Homo sapiens
acagctgcacagaga

SEQ ID NO: 24284 - DNA, 20 bp, Homo sapiens
cagtaactgctcccaggcag

SEQ ID NO: 24285 - DNA, 20 bp, Homo sapiens
gcagctgctcagcagggcag

SEQ ID NO: 24286 - DNA, 19 bp, Homo sapiens
cagtagctgctccccacag

SEQ ID NO: 24287 - DNA, 19 bp, Homo sapiens
cagagctgctctgaagaga

SEQ ID NO: 24288 - DNA, 23 bp, Homo sapiens
cagcaactgctgcatggagacag

SEQ ID NO: 24289 - DNA, 17 bp, Homo sapiens
gctgtcaagagagacag

SEQ ID NO: 24290 - DNA, 15 bp, Homo sapiens
cagtactgcagagac

SEQ ID NO: 24291 - DNA, 21 bp, Homo sapiens
cagcagctgcctgggaggcag

SEQ ID NO: 24292 - DNA, 20 bp, Homo sapiens
cagagctgctcgcgcatcac

SEQ ID NO: 24293 - DNA, 20 bp, Homo sapiens
cagcagctgctttgccacag

SEQ ID NO: 24294 - DNA, 19 bp, Homo sapiens
gccacccgtgcagagacag

SEQ ID NO: 24295 - DNA, 18 bp, Homo sapiens
cagggccctgcagagaca

SEQ ID NO: 24296 - DNA, 70 bp, Tupaia herpesvirus
cagcggcacggcgttgttgatggtcttgggctggaacgagcggtccgtgatgtacagacacgtgctgttg

SEQ ID NO: 24297 - DNA, 20 bp, Tupaia herpesvirus
tgtacagacacgtgctgttg

SEQ ID NO: 24298 - DNA, 20 bp, Homo sapiens
gtgcaggcattttgctgttg

SEQ ID NO: 24299 - DNA, 15 bp, Homo sapiens
tgtacaaatgctatt

SEQ ID NO: 24300 - DNA, 18 bp, Homo sapiens
tgcacagacatgctcctg

SEQ ID NO: 24301 - DNA, 16 bp, Homo sapiens
cacaaatgtgctgttg

SEQ ID NO: 24302 - DNA, 18 bp, Homo sapiens
tgtacagacacaaaattg

SEQ ID NO: 24303 - DNA, 21 bp, Homo sapiens
tgtacatgctggtatctgttg

SEQ ID NO: 24304 - DNA, 17 bp, Homo sapiens
tacagacacgcccactg

SEQ ID NO: 24305 - DNA, 19 bp, Homo sapiens
tgcactgagtgtgctgttg

SEQ ID NO: 24306 - DNA, 17 bp, Homo sapiens
tgacagactcactgttg

SEQ ID NO: 24307 - DNA, 20 bp, Homo sapiens
tgtaaagaactttgctgttg

SEQ ID NO: 24308 - DNA, 22 bp, Homo sapiens
tgtacaaaaatacctgctgttg

SEQ ID NO: 24309 - DNA, 18 bp, Homo sapiens
tgtcagacacgttatatt

SEQ ID NO: 24310 - DNA, 19 bp, Homo sapiens
tgtacaattggtgctgttg

SEQ ID NO: 24311 - DNA, 21 bp, Homo sapiens
tgtacagaccattaaatgttg

SEQ ID NO: 24312 - DNA, 19 bp, Homo sapiens
tgtacagacagtgacgatg

SEQ ID NO: 24313 - DNA, 15 bp, Homo sapiens
tgtacagatgctatt

SEQ ID NO: 24314 - DNA, 18 bp, Homo sapiens
gtgcagatgatgctgttg

SEQ ID NO: 24315 - DNA, 21 bp, Homo sapiens
tatacagacatcattgtgttg

SEQ ID NO: 24316 - DNA, 19 bp, Homo sapiens
tgtagagacacgccaactg

SEQ ID NO: 24317 - DNA, 18 bp, Homo sapiens
tgtagggacacgtgttgt

SEQ ID NO: 24318 - DNA, 17 bp, Homo sapiens
tgtcagagttactgttg

SEQ ID NO: 24319 - DNA, 16 bp, Homo sapiens
tgtgcagatgctgtta

SEQ ID NO: 24320 - DNA, 15 bp, Homo sapiens
tgtacagatgccatt

SEQ ID NO: 24321 - DNA, 20 bp, Homo sapiens
tgtataaacactgccagttg

SEQ ID NO: 24322 - DNA, 18 bp, Homo sapiens
tgcacagacacgcctctg

SEQ ID NO: 24323 - DNA, 21 bp, Homo sapiens
tgtcacagagcgtagctgttg

SEQ ID NO: 24324 - DNA, 17 bp, Homo sapiens
tgtacagatgtggccat

SEQ ID NO: 24325 - DNA, 17 bp, Homo sapiens
tatacaaaatgctgttg

SEQ ID NO: 24326 - DNA, 18 bp, Homo sapiens
tgtacagaatgtctcttg

SEQ ID NO: 24327 - DNA, 19 bp, Homo sapiens
tgtctagaccttgctgttg

SEQ ID NO: 24328 - DNA, 18 bp, Homo sapiens
tgtacagaacagcctttg

SEQ ID NO: 24329 - DNA, 16 bp, Homo sapiens
tgtacagcatgctgct

SEQ ID NO: 24330 - DNA, 18 bp, Homo sapiens
tgtacagacaggtctctg

SEQ ID NO: 24331 - DNA, 17 bp, Homo sapiens
tgcatggactgctgttg

SEQ ID NO: 24332 - DNA, 20 bp, Homo sapiens
tgtcagaccacatgctgttg

SEQ ID NO: 24333 - DNA, 20 bp, Homo sapiens
tgtacagaacgtacaggttg

SEQ ID NO: 24334 - DNA, 23 bp, Homo sapiens
tgtacagattagtgtttctgttg

SEQ ID NO: 24335 - DNA, 22 bp, Homo sapiens
tgtgggacacacaggcttgttg

SEQ ID NO: 24336 - DNA, 19 bp, Homo sapiens
atacagatgtgtgctgttg

SEQ ID NO: 24337 - DNA, 19 bp, Homo sapiens
tgtgagacaagtactgttg

SEQ ID NO: 24338 - DNA, 17 bp, Homo sapiens
tgtagactttgctgttg

SEQ ID NO: 24339 - DNA, 23 bp, Homo sapiens
tgcacagatgtttcgtggtgttg

SEQ ID NO: 24340 - DNA, 19 bp, Homo sapiens
tgtgtaaacggtaccgttg

SEQ ID NO: 24341 - DNA, 20 bp, Homo sapiens
tgtcaggcaggacgctgttg

SEQ ID NO: 24342 - DNA, 19 bp, Homo sapiens
tgtgacagctttgctgttg

SEQ ID NO: 24343 - DNA, 16 bp, Homo sapiens
tgtgcaggtgctgtta

SEQ ID NO: 24344 - DNA, 17 bp, Homo sapiens
tgcaacatctgctgttg

SEQ ID NO: 24345 - DNA, 17 bp, Homo sapiens
tgtacagatgtggtatt

SEQ ID NO: 24346 - DNA, 20 bp, Homo sapiens
tgtacaggtgcttactgttg

SEQ ID NO: 24347 - DNA, 18 bp, Homo sapiens
tgtacaaatgtgccacca

SEQ ID NO: 24348 - DNA, 18 bp, Homo sapiens
tgtttggaacggctgttg

SEQ ID NO: 24349 - DNA, 17 bp, Homo sapiens
tgaacagacacggccgt

SEQ ID NO: 24350 - DNA, 21 bp, Homo sapiens
tgtcacagagcgtggctgttg

SEQ ID NO: 24351 - DNA, 18 bp, Homo sapiens
gtacagacatatgggttg

SEQ ID NO: 24352 - DNA, 18 bp, Homo sapiens
tgtacagaaatacaattg

SEQ ID NO: 24353 - DNA, 17 bp, Homo sapiens
tgtactgatgtactatt

SEQ ID NO: 24354 - DNA, 19 bp, Homo sapiens
tgcacagagaagactgttg

SEQ ID NO: 24355 - DNA, 18 bp, Homo sapiens
tgcatagacacgttgttg

SEQ ID NO: 24356 - DNA, 63 bp, Equine foamy virus
tctgagggatggctcgtacaacaaaacacacatcgaggaatgtaatacctgtcctctctcaga

SEQ ID NO: 24357 - DNA, 21 bp, Equine foamy virus
taatacctgtcctctctcaga

SEQ ID NO: 24358 - DNA, 15 bp, Homo sapiens
taatacctgcctcag

SEQ ID NO: 24359 - DNA, 19 bp, Homo sapiens
acacctgtttcactctaga

SEQ ID NO: 24360 - DNA, 20 bp, Homo sapiens
taatcatagtatctctcaga

SEQ ID NO: 24361 - DNA, 18 bp, Homo sapiens
taatacctatttaccaga

SEQ ID NO: 24362 - DNA, 15 bp, Homo sapiens
taataccttctccag

SEQ ID NO: 24363 - DNA, 16 bp, Homo sapiens
atacctatttctcaga

SEQ ID NO: 24364 - DNA, 19 bp, Homo sapiens
taatactgtcctcacatag

SEQ ID NO: 24365 - DNA, 16 bp, Homo sapiens
taaaacctcctctcag

SEQ ID NO: 24366 - DNA, 18 bp, Homo sapiens
taacaccttgttctcaga

SEQ ID NO: 24367 - DNA, 19 bp, Homo sapiens
cacctgtcaccagctcaga

SEQ ID NO: 24368 - DNA, 19 bp, Homo sapiens
taatgcctgccccattcag

SEQ ID NO: 24369 - DNA, 16 bp, Homo sapiens
tacctaccctctcaga

SEQ ID NO: 24370 - DNA, 18 bp, Homo sapiens
acaggtgttctctctcag

SEQ ID NO: 24371 - DNA, 20 bp, Homo sapiens
taacttctgtctctctcaga

SEQ ID NO: 24372 - DNA, 18 bp, Homo sapiens
cctgtccctgtcctcaga

SEQ ID NO: 24373 - DNA, 24 bp, Homo sapiens
aatacctggaagcactctcttgga

SEQ ID NO: 24374 - DNA, 18 bp, Homo sapiens
aatacctgttcatctcag

SEQ ID NO: 24375 - DNA, 18 bp, Homo sapiens
cctctccccctactcaga

SEQ ID NO: 24376 - DNA, 15 bp, Homo sapiens
taataccttctctag

SEQ ID NO: 24377 - DNA, 21 bp, Homo sapiens
taatacctgctggtcatcaga

SEQ ID NO: 24378 - DNA, 16 bp, Homo sapiens
atacctacctctcaga

SEQ ID NO: 24379 - DNA, 21 bp, Homo sapiens
atatttgtcctccttttcaga

SEQ ID NO: 24380 - DNA, 18 bp, Homo sapiens
cctggagcccctctcaga

SEQ ID NO: 24381 - DNA, 18 bp, Homo sapiens
atactgctgctctctcag

SEQ ID NO: 24382 - DNA, 94 bp, Equine foamy virus
atctccttaaaggaaataaatacctgggctacttaagagagttttatactcatacttaatataggccttagagtattccctattttaaggagat

SEQ ID NO: 24383 - DNA, 24 bp, Equine foamy virus
tcatacttaatataggccttagag

SEQ ID NO: 24384 - DNA, 19 bp, Homo sapiens
tcatacttaataaaggcct

SEQ ID NO: 24385 - DNA, 20 bp, Homo sapiens
tacttaacattgacctttag

SEQ ID NO: 24386 - DNA, 61 bp, African swine fever virus
aatgaagtagatcaacactatttggaatatattctataattagtatatgatacatagcatt

SEQ ID NO: 24387 - DNA, 24 bp, African swine fever virus
aagtagatcaacactatttggaat

SEQ ID NO: 24388 - DNA, 21 bp, Homo sapiens
agaagatcagcattttagaat

SEQ ID NO: 24389 - DNA, 20 bp, Homo sapiens
aagtagattaacattaagga

SEQ ID NO: 24390 - DNA, 17 bp, Homo sapiens
aagtgatcaacacaggg

SEQ ID NO: 24391 - DNA, 21 bp, Homo sapiens
aagtagattagcctgattgga

SEQ ID NO: 24392 - DNA, 19 bp, Homo sapiens
aagagatcaacatttccag

SEQ ID NO: 24393 - DNA, 16 bp, Homo sapiens
tagatcagtacctaga

SEQ ID NO: 24394 - DNA, 17 bp, Homo sapiens
gtagtatctatttggaa

SEQ ID NO: 24395 - DNA, 20 bp, Homo sapiens
gtagatccacgcgacccgga

SEQ ID NO: 24396 - DNA, 21 bp, Homo sapiens
tagaagtacattatttggaat

SEQ ID NO: 24397 - DNA, 19 bp, Homo sapiens
aagtagatcaataattaga

SEQ ID NO: 24398 - DNA, 23 bp, Homo sapiens
aagtagataaatactataggaat

SEQ ID NO: 24399 - DNA, 16 bp, Homo sapiens
aagagatcaacgtcgg

SEQ ID NO: 24400 - DNA, 81 bp, Human herpesvirus 6
ggacaagggtttttgaacttggtcttgcatggtatatacaattgttctattgtccgtgagaggtcgacaaaacttctggcc

SEQ ID NO: 24401 - DNA, 24 bp, Human herpesvirus 6
agggtttttgaacttggtcttgca

SEQ ID NO: 24402 - DNA, 19 bp, Homo sapiens
agggtttttaaagctttgt

SEQ ID NO: 24403 - DNA, 18 bp, Homo sapiens
agggtttgtgaatttggc

SEQ ID NO: 24404 - DNA, 20 bp, Homo sapiens
agagcactggcttggtcttg

SEQ ID NO: 24405 - DNA, 20 bp, Homo sapiens
gggtctttggggtctttgca

SEQ ID NO: 24406 - DNA, 22 bp, Homo sapiens
agggcttttgggcttggccctg

SEQ ID NO: 24407 - DNA, 22 bp, Homo sapiens
gggttttctgggcttggtcttg

SEQ ID NO: 24408 - DNA, 17 bp, Homo sapiens
agggtttttggctttgt

SEQ ID NO: 24409 - DNA, 64 bp, Human herpesvirus 6
gtatagtaatcattcaggtttacccgaggtgacgttttccccgagtaaatcgaacgatacttac

SEQ ID NO: 24410 - DNA, 23 bp, Human herpesvirus 6
cgagtaaatcgaacgatacttac

SEQ ID NO: 24411 - DNA, 20 bp, Homo sapiens
gagtaaattgaacaagttac

SEQ ID NO: 24412 - DNA, 17 bp, Homo sapiens
gagtaaatgaatgatac

SEQ ID NO: 24413 - DNA, 18 bp, Homo sapiens
gagtaaactgaacgctct

SEQ ID NO: 24414 - DNA, 67 bp, Human herpesvirus 6
gtgtacaaatgtatatgtaaacacaacaggaaaatatacatgtcccaaggcgtatacattctaacac

SEQ ID NO: 24415 - DNA, 24 bp, Human herpesvirus 6
tcccaaggcgtatacattctaaca

SEQ ID NO: 24416 - DNA, 18 bp, Homo sapiens
caaggcataggactaaca

SEQ ID NO: 24417 - DNA, 16 bp, Homo sapiens
ccccaaaagctacatt

SEQ ID NO: 24418 - DNA, 24 bp, Homo sapiens
caaggcatatacaaaagtctgaca

SEQ ID NO: 24419 - DNA, 20 bp, Homo sapiens
tcccaagatgtgtacagctc

SEQ ID NO: 24420 - DNA, 21 bp, Homo sapiens
tcctgaggctgctttctaaca

SEQ ID NO: 24421 - DNA, 19 bp, Homo sapiens
tcccaaggtcatatgcatt

SEQ ID NO: 24422 - DNA, 21 bp, Homo sapiens
tccctgagctacattctaaca

SEQ ID NO: 24423 - DNA, 18 bp, Homo sapiens
catggagtttacattcta

SEQ ID NO: 24424 - DNA, 16 bp, Homo sapiens
ccacaggacattctaa

SEQ ID NO: 24425 - DNA, 19 bp, Homo sapiens
tcctaaggcgtaactgcta

SEQ ID NO: 24426 - DNA, 19 bp, Homo sapiens
caaggcacacattctgaca

SEQ ID NO: 24427 - DNA, 15 bp, Homo sapiens
tcccagacattctaa

SEQ ID NO: 24428 - DNA, 18 bp, Homo sapiens
aggccatctattctaaca

SEQ ID NO: 24429 - DNA, 21 bp, Homo sapiens
tcccaaggcagaattctgaca

SEQ ID NO: 24430 - DNA, 19 bp, Homo sapiens
tccagtacacacattctaa

SEQ ID NO: 24431 - DNA, 16 bp, Homo sapiens
aagagcaccattctaa

SEQ ID NO: 24432 - DNA, 23 bp, Homo sapiens
tctccataccttacattctgaca

SEQ ID NO: 24433 - DNA, 17 bp, Homo sapiens
cctaggcgtatgcccaa

SEQ ID NO: 24434 - DNA, 18 bp, Homo sapiens
tcctgaggcccattctaa

SEQ ID NO: 24435 - DNA, 62 bp, Human papillomavirus type 25
cctcctctgccacctcccaacggtcacaacgatcgcgatccagggcagggagcagcaggggg

SEQ ID NO: 24436 - DNA, 22 bp, Human papillomavirus type 25
cagggcagggagcagcaggggg

SEQ ID NO: 24437 - DNA, 17 bp, Homo sapiens
ggcgcagggagccgggg

SEQ ID NO: 24438 - DNA, 20 bp, Homo sapiens
gggctggggagcagcaacag

SEQ ID NO: 24439 - DNA, 17 bp, Homo sapiens
agggcagagaggagggg

SEQ ID NO: 24440 - DNA, 17 bp, Homo sapiens
cagtgcagggagcgcgg

SEQ ID NO: 24441 - DNA, 18 bp, Homo sapiens
agggagggggccgcaggg

SEQ ID NO: 24442 - DNA, 17 bp, Homo sapiens
gggcagggagcagaaag

SEQ ID NO: 24443 - DNA, 18 bp, Homo sapiens
ggaggtggggagcagggg

SEQ ID NO: 24444 - DNA, 23 bp, Homo sapiens
aggcagggagcccctgaaggggg

SEQ ID NO: 24445 - DNA, 18 bp, Homo sapiens
cagggcagcggagtgggg

SEQ ID NO: 24446 - DNA, 21 bp, Homo sapiens
cagggcagcggggctcatggg

SEQ ID NO: 24447 - DNA, 20 bp, Homo sapiens
cagggtggggggaggcgggg

SEQ ID NO: 24448 - DNA, 20 bp, Homo sapiens
caaggcacaactggtggggg

SEQ ID NO: 24449 - DNA, 17 bp, Homo sapiens
gggctcggggcaggggg

SEQ ID NO: 24450 - DNA, 22 bp, Homo sapiens
cagggtgggggcccgaggtggg

SEQ ID NO: 24451 - DNA, 21 bp, Homo sapiens
gggtggggctggtgcaggggg

SEQ ID NO: 24452 - DNA, 21 bp, Homo sapiens
cagggcagggtggccctgggg

SEQ ID NO: 24453 - DNA, 18 bp, Homo sapiens
gggcaggggacagccagg

SEQ ID NO: 24454 - DNA, 19 bp, Homo sapiens
cagggacagggagccaggg

SEQ ID NO: 24455 - DNA, 17 bp, Homo sapiens
gggtagggggcaagagg

SEQ ID NO: 24456 - DNA, 18 bp, Homo sapiens
agggtcaccagcgggggg

SEQ ID NO: 24457 - DNA, 19 bp, Homo sapiens
ggaggcagggggcccgggg

SEQ ID NO: 24458 - DNA, 19 bp, Homo sapiens
cagggtgcggagggcgggg

SEQ ID NO: 24459 - DNA, 22 bp, Homo sapiens
cagggtgggagacaagaggggg

SEQ ID NO: 24460 - DNA, 22 bp, Homo sapiens
gggcaggggtgggtgcaggggg

SEQ ID NO: 24461 - DNA, 17 bp, Homo sapiens
cagggcgggagtgcggg

SEQ ID NO: 24462 - DNA, 15 bp, Homo sapiens
gggcagggaaagggg

SEQ ID NO: 24463 - DNA, 15 bp, Homo sapiens
aggcggggccagggg

SEQ ID NO: 24464 - DNA, 21 bp, Homo sapiens
gggcagggaaggtgctggggg

SEQ ID NO: 24465 - DNA, 19 bp, Homo sapiens
gggcagggggcggccaggg

SEQ ID NO: 24466 - DNA, 16 bp, Homo sapiens
gggcagggaggcgagg

SEQ ID NO: 24467 - DNA, 20 bp, Homo sapiens
aggcagggggccagaagggg

SEQ ID NO: 24468 - DNA, 18 bp, Homo sapiens
ggggagggggccacaggg

SEQ ID NO: 24469 - DNA, 20 bp, Homo sapiens
cagggtggggaagaaagggg

SEQ ID NO: 24470 - DNA, 20 bp, Homo sapiens
ggaggcaggggatgcggggg

SEQ ID NO: 24471 - DNA, 22 bp, Homo sapiens
cagggcagggcagccctcgggg

SEQ ID NO: 24472 - DNA, 18 bp, Homo sapiens
agaggtaggcacaggggg

SEQ ID NO: 24473 - DNA, 17 bp, Homo sapiens
ggagtgggagcaggggg

SEQ ID NO: 24474 - DNA, 18 bp, Homo sapiens
cagggcagaggggagggg

SEQ ID NO: 24475 - DNA, 21 bp, Homo sapiens
ggggaggtgaggggcaggggg

SEQ ID NO: 24476 - DNA, 20 bp, Homo sapiens
cagggcaggagagcccgggg

SEQ ID NO: 24477 - DNA, 16 bp, Homo sapiens
cagggcagggagggag

SEQ ID NO: 24478 - DNA, 17 bp, Homo sapiens
cagggcggtgagcatgg

SEQ ID NO: 24479 - DNA, 15 bp, Homo sapiens
aggcagaggcagggg

SEQ ID NO: 24480 - DNA, 21 bp, Homo sapiens
caggggtgggaatacaggggg

SEQ ID NO: 24481 - DNA, 22 bp, Homo sapiens
cagaggtagggggtgccacagg

SEQ ID NO: 24482 - DNA, 21 bp, Homo sapiens
aggcagaacagaggtaggggg

SEQ ID NO: 24483 - DNA, 18 bp, Homo sapiens
ggaggcagggagaagggg

SEQ ID NO: 24484 - DNA, 17 bp, Homo sapiens
gggcaggggcgcgacgg

SEQ ID NO: 24485 - DNA, 17 bp, Homo sapiens
caggacagggggccggg

SEQ ID NO: 24486 - DNA, 17 bp, Homo sapiens
caggatagggagcaggg

SEQ ID NO: 24487 - DNA, 22 bp, Homo sapiens
cagggcgtggggtgcgcggggg

SEQ ID NO: 24488 - DNA, 21 bp, Homo sapiens
cagggcaggaggcatgttggg

SEQ ID NO: 24489 - DNA, 17 bp, Homo sapiens
gggcaggaagcaagggg

SEQ ID NO: 24490 - DNA, 20 bp, Homo sapiens
ggtgcagggagcactaaagg

SEQ ID NO: 24491 - DNA, 20 bp, Homo sapiens
cagtgcagggtggcaggggg

SEQ ID NO: 24492 - DNA, 19 bp, Homo sapiens
gggcaggcaggcagagggg

SEQ ID NO: 24493 - DNA, 19 bp, Homo sapiens
tgaggcagcaggcaggggg

SEQ ID NO: 24494 - DNA, 21 bp, Homo sapiens
cagggacagggggctccaggg

SEQ ID NO: 24495 - DNA, 20 bp, Homo sapiens
aagtgaggggcagcaggggg

SEQ ID NO: 24496 - DNA, 19 bp, Homo sapiens
caaggcagggggaaggggg

SEQ ID NO: 24497 - DNA, 18 bp, Homo sapiens
gggcagggaaaaaggggg

SEQ ID NO: 24498 - DNA, 22 bp, Homo sapiens
cagtcccgggagcagcgggggg

SEQ ID NO: 24499 - DNA, 21 bp, Homo sapiens
agggcagggggcaaactcagg

SEQ ID NO: 24500 - DNA, 19 bp, Homo sapiens
caggacagggagctttggg

SEQ ID NO: 24501 - DNA, 19 bp, Homo sapiens
gggcagcagcagcaggggg

SEQ ID NO: 24502 - DNA, 17 bp, Homo sapiens
cagggcaggcagcgggg

SEQ ID NO: 24503 - DNA, 16 bp, Homo sapiens
gggccggagcaggggg

SEQ ID NO: 24504 - DNA, 21 bp, Homo sapiens
ggacaggggacatccaggggg

SEQ ID NO: 24505 - DNA, 18 bp, Homo sapiens
cagagtggggaggcgggg

SEQ ID NO: 24506 - DNA, 17 bp, Homo sapiens
aaggccggcagcagggg

SEQ ID NO: 24507 - DNA, 17 bp, Homo sapiens
gggcagaggcttggggg

SEQ ID NO: 24508 - DNA, 19 bp, Homo sapiens
gggcagggggcatcccagg

SEQ ID NO: 24509 - DNA, 22 bp, Homo sapiens
cagggttgggggcggctggggg

SEQ ID NO: 24510 - DNA, 18 bp, Homo sapiens
ggtgcagggagctggggg

SEQ ID NO: 24511 - DNA, 20 bp, Homo sapiens
gagcccagggcagcaggggg

SEQ ID NO: 24512 - DNA, 24 bp, Homo sapiens
cagggcagcttcagcagcaggggg

SEQ ID NO: 24513 - DNA, 22 bp, Homo sapiens
cagaggcggcagcggcgggggg

SEQ ID NO: 24514 - DNA, 15 bp, Homo sapiens
ggacagggagcaggg

SEQ ID NO: 24515 - DNA, 18 bp, Homo sapiens
gggcaggggcgatggggg

SEQ ID NO: 24516 - DNA, 19 bp, Homo sapiens
gggtggggagcagcaacag

SEQ ID NO: 24517 - DNA, 20 bp, Homo sapiens
aaggtggggagcagacctgg

SEQ ID NO: 24518 - DNA, 16 bp, Homo sapiens
aggcaatgggcagggg

SEQ ID NO: 24519 - DNA, 16 bp, Homo sapiens
ggggggagcaggaggg

SEQ ID NO: 24520 - DNA, 18 bp, Homo sapiens
cagggcagtggagtaggg

SEQ ID NO: 24521 - DNA, 18 bp, Homo sapiens
gggcagggatgcagtcag

SEQ ID NO: 24522 - DNA, 19 bp, Homo sapiens
cagggggggcggttggggg

SEQ ID NO: 24523 - DNA, 16 bp, Homo sapiens
cagggagggagcaagg

SEQ ID NO: 24524 - DNA, 18 bp, Homo sapiens
ggagatggcagcaggggg

SEQ ID NO: 24525 - DNA, 20 bp, Homo sapiens
agggcagagggaagctgggg

SEQ ID NO: 24526 - DNA, 17 bp, Homo sapiens
agggcaagggagtaggg

SEQ ID NO: 24527 - DNA, 17 bp, Homo sapiens
cagggcgaggggcaggg

SEQ ID NO: 24528 - DNA, 17 bp, Homo sapiens
gggcagggagccggggg

SEQ ID NO: 24529 - DNA, 17 bp, Homo sapiens
cagggcagggggcaggg

SEQ ID NO: 24530 - DNA, 22 bp, Homo sapiens
cagggcagggaggtggtctggg

SEQ ID NO: 24531 - DNA, 15 bp, Homo sapiens
cagggcaggggcggg

SEQ ID NO: 24532 - DNA, 16 bp, Homo sapiens
agggcgggcgcggggg

SEQ ID NO: 24533 - DNA, 17 bp, Homo sapiens
cagggcgaggagagggg

SEQ ID NO: 24534 - DNA, 16 bp, Homo sapiens
agggcagggggcgggg

SEQ ID NO: 24535 - DNA, 17 bp, Homo sapiens
gggcggggcgtcaaggg

SEQ ID NO: 24536 - DNA, 20 bp, Homo sapiens
cagggttacagagcaggggg

SEQ ID NO: 24537 - DNA, 23 bp, Homo sapiens
cagggcaggagggcagacactag

SEQ ID NO: 24538 - DNA, 24 bp, Homo sapiens
caggggaggccccagggtaggggg

SEQ ID NO: 24539 - DNA, 21 bp, Homo sapiens
cagggcggggaggggcagggg

SEQ ID NO: 24540 - DNA, 18 bp, Homo sapiens
aggcagggggtcaggggg

SEQ ID NO: 24541 - DNA, 24 bp, Homo sapiens
gggcaggggaggccaggcaggggg

SEQ ID NO: 24542 - DNA, 19 bp, Homo sapiens
cagggctagggagcccggg

SEQ ID NO: 24543 - DNA, 22 bp, Homo sapiens
gggaagggactgaagcaggggg

SEQ ID NO: 24544 - DNA, 16 bp, Homo sapiens
agcgcagggagcgggg

SEQ ID NO: 24545 - DNA, 23 bp, Homo sapiens
cagggcagggggaaggcgggggg

SEQ ID NO: 24546 - DNA, 17 bp, Homo sapiens
gggcgcagggcaggggg

SEQ ID NO: 24547 - DNA, 17 bp, Homo sapiens
cagggtaggaagagggg

SEQ ID NO: 24548 - DNA, 17 bp, Homo sapiens
tgaggcagggccagggg

SEQ ID NO: 24549 - DNA, 18 bp, Homo sapiens
cagggcaggtggcagcag

SEQ ID NO: 24550 - DNA, 18 bp, Homo sapiens
gggcgggcgagcgcgggg

SEQ ID NO: 24551 - DNA, 18 bp, Homo sapiens
agggcaggcagagtgggg

SEQ ID NO: 24552 - DNA, 19 bp, Homo sapiens
gggcagggagccttggggg

SEQ ID NO: 24553 - DNA, 18 bp, Homo sapiens
gggtggggagggcggggg

SEQ ID NO: 24554 - DNA, 20 bp, Homo sapiens
cagggcagggggctacaggg

SEQ ID NO: 24555 - DNA, 22 bp, Homo sapiens
gggcaggtggaggtgcaggggg

SEQ ID NO: 24556 - DNA, 19 bp, Homo sapiens
gggcgggcggcgcaggggg

SEQ ID NO: 24557 - DNA, 19 bp, Homo sapiens
agggcaggtgagctggggg

SEQ ID NO: 24558 - DNA, 19 bp, Homo sapiens
ggggtggggcaggaagggg

SEQ ID NO: 24559 - DNA, 19 bp, Homo sapiens
agggctggatctcaggggg

SEQ ID NO: 24560 - DNA, 20 bp, Homo sapiens
gggcagggcagcaagaaggg

SEQ ID NO: 24561 - DNA, 19 bp, Homo sapiens
cagggagggaggcacgggg

SEQ ID NO: 24562 - DNA, 15 bp, Homo sapiens
cagggcaggcagggg

SEQ ID NO: 24563 - DNA, 19 bp, Homo sapiens
ggggaggggtggcaggggg

SEQ ID NO: 24564 - DNA, 22 bp, Homo sapiens
cagggcgggggagcaaagaggg

SEQ ID NO: 24565 - DNA, 17 bp, Homo sapiens
cagggcaggggtagggg

SEQ ID NO: 24566 - DNA, 18 bp, Homo sapiens
caggggagggggcggcgg

SEQ ID NO: 24567 - DNA, 17 bp, Homo sapiens
cagggccgggagagggg

SEQ ID NO: 24568 - DNA, 16 bp, Homo sapiens
cagggcaggggccggg

SEQ ID NO: 24569 - DNA, 20 bp, Homo sapiens
cagggcaggaaccacggggg

SEQ ID NO: 24570 - DNA, 20 bp, Homo sapiens
aggcagggggcgaaaagggg

SEQ ID NO: 24571 - DNA, 19 bp, Homo sapiens
gggtggggggcaagagggg

SEQ ID NO: 24572 - DNA, 23 bp, Homo sapiens
cagggttggggaggcagcagggg

SEQ ID NO: 24573 - DNA, 21 bp, Homo sapiens
cagggcaggcagcatccaggg

SEQ ID NO: 24574 - DNA, 16 bp, Homo sapiens
ggcggggagcaggggg

SEQ ID NO: 24575 - DNA, 18 bp, Homo sapiens
caggagcagggggcatgg

SEQ ID NO: 24576 - DNA, 19 bp, Homo sapiens
cagggcagcggggccgggg

SEQ ID NO: 24577 - DNA, 23 bp, Homo sapiens
cagggcggggaggaaaaccgggg

SEQ ID NO: 24578 - DNA, 19 bp, Homo sapiens
gggcagagggtcagccggg

SEQ ID NO: 24579 - DNA, 15 bp, Homo sapiens
gggcagggcaggggg

SEQ ID NO: 24580 - DNA, 18 bp, Homo sapiens
cagggcagggggcctggg

SEQ ID NO: 24581 - DNA, 18 bp, Homo sapiens
agggcaaaaggtaggggg

SEQ ID NO: 24582 - DNA, 19 bp, Homo sapiens
cagggcagaggccgggggg

SEQ ID NO: 24583 - DNA, 17 bp, Homo sapiens
ggggtgggagcagaagg

SEQ ID NO: 24584 - DNA, 16 bp, Homo sapiens
agagcagggagtgggg

SEQ ID NO: 24585 - DNA, 18 bp, Homo sapiens
cagggcagagggtcaggg

SEQ ID NO: 24586 - DNA, 19 bp, Homo sapiens
cagtggcagggagtggggg

SEQ ID NO: 24587 - DNA, 15 bp, Homo sapiens
cagggcagagagggg

SEQ ID NO: 24588 - DNA, 18 bp, Homo sapiens
gcactgggcagcaggggg

SEQ ID NO: 24589 - DNA, 19 bp, Homo sapiens
cagggagggggttcaaggg

SEQ ID NO: 24590 - DNA, 20 bp, Homo sapiens
gggcagggaacagacccagg

SEQ ID NO: 24591 - DNA, 20 bp, Homo sapiens
gagcagggagcaagctttgg

SEQ ID NO: 24592 - DNA, 16 bp, Homo sapiens
cagggaagggaagggg

SEQ ID NO: 24593 - DNA, 22 bp, Homo sapiens
aggcagggagcggcaccccggg

SEQ ID NO: 24594 - DNA, 20 bp, Homo sapiens
cagggggggggggcgggggg

SEQ ID NO: 24595 - DNA, 15 bp, Homo sapiens
cagggcagggagagg

SEQ ID NO: 24596 - DNA, 17 bp, Homo sapiens
gggcagagaggaagggg

SEQ ID NO: 24597 - DNA, 15 bp, Homo sapiens
gggcaggcagagggg

SEQ ID NO: 24598 - DNA, 18 bp, Homo sapiens
agggcaggggcctcaggg

SEQ ID NO: 24599 - DNA, 18 bp, Homo sapiens
gggctgagaagcaggggg

SEQ ID NO: 24600 - DNA, 19 bp, Homo sapiens
caggacagagggcaggggg

SEQ ID NO: 24601 - DNA, 18 bp, Homo sapiens
agggcagggggcaggggg

SEQ ID NO: 24602 - DNA, 21 bp, Homo sapiens
gggtggggaggcaagaaaggg

SEQ ID NO: 24603 - DNA, 21 bp, Homo sapiens
tgaggcagggggaggcggggg

SEQ ID NO: 24604 - DNA, 19 bp, Homo sapiens
agggtggggaggcaggggg

SEQ ID NO: 24605 - DNA, 20 bp, Homo sapiens
cagggtgaggaaggaggggg

SEQ ID NO: 24606 - DNA, 17 bp, Homo sapiens
caggggtggggcagggg

SEQ ID NO: 24607 - DNA, 16 bp, Homo sapiens
agggcagggagcaggg

SEQ ID NO: 24608 - DNA, 20 bp, Homo sapiens
cagggcggggcggtggcggg

SEQ ID NO: 24609 - DNA, 19 bp, Homo sapiens
aggctagggccgcaggggg

SEQ ID NO: 24610 - DNA, 18 bp, Homo sapiens
agggcaaggggcacatgg

SEQ ID NO: 24611 - DNA, 21 bp, Homo sapiens
aggcagagataaggcaggggg

SEQ ID NO: 24612 - DNA, 17 bp, Homo sapiens
cagggaggggggcgcgg

SEQ ID NO: 24613 - DNA, 24 bp, Homo sapiens
cagggcagggggaatcctaggggg

SEQ ID NO: 24614 - DNA, 18 bp, Homo sapiens
cagggcagggagaagagg

SEQ ID NO: 24615 - DNA, 22 bp, Homo sapiens
cagggcaagctggagcaggggg

SEQ ID NO: 24616 - DNA, 19 bp, Homo sapiens
agggcaggcagcaacaggg

SEQ ID NO: 24617 - DNA, 15 bp, Homo sapiens
gagcagggagcaggg

SEQ ID NO: 24618 - DNA, 18 bp, Homo sapiens
cagggatggggagagggg

SEQ ID NO: 24619 - DNA, 17 bp, Homo sapiens
caggggagggggcggag

SEQ ID NO: 24620 - DNA, 16 bp, Homo sapiens
gggcaggggcgcgggg

SEQ ID NO: 24621 - DNA, 23 bp, Homo sapiens
ggggtgggaggggtggcaggggg

SEQ ID NO: 24622 - DNA, 18 bp, Homo sapiens
gggcagaggggcaggggg

SEQ ID NO: 24623 - DNA, 17 bp, Homo sapiens
ggacagggaggaagggg

SEQ ID NO: 24624 - DNA, 21 bp, Homo sapiens
gggcaggggctgggcgggggg

SEQ ID NO: 24625 - DNA, 19 bp, Homo sapiens
agggcagggtttgaggggg

SEQ ID NO: 24626 - DNA, 18 bp, Homo sapiens
cagagcagggggtcaggg

SEQ ID NO: 24627 - DNA, 18 bp, Homo sapiens
ggtggcagcagcaggggg

SEQ ID NO: 24628 - DNA, 19 bp, Homo sapiens
gggcaaggcctagaggggg

SEQ ID NO: 24629 - DNA, 16 bp, Homo sapiens
aggcagggaggcgggg

SEQ ID NO: 24630 - DNA, 17 bp, Homo sapiens
cagagtggggagcgagg

SEQ ID NO: 24631 - DNA, 20 bp, Homo sapiens
agggcaggggccttgtgggg

SEQ ID NO: 24632 - DNA, 21 bp, Homo sapiens
cagggcagtgagtaaacccgg

SEQ ID NO: 24633 - DNA, 22 bp, Homo sapiens
cagggcgaggggtgaacaatgg

SEQ ID NO: 24634 - DNA, 19 bp, Homo sapiens
cagaggtgggggctggggg

SEQ ID NO: 24635 - DNA, 17 bp, Homo sapiens
gggcaggggtgccaggg

SEQ ID NO: 24636 - DNA, 22 bp, Homo sapiens
gggcagggggctgtctgagggg

SEQ ID NO: 24637 - DNA, 17 bp, Homo sapiens
gggccgggggcaagggg

SEQ ID NO: 24638 - DNA, 19 bp, Homo sapiens
cagggcaggggatgaacgg

SEQ ID NO: 24639 - DNA, 22 bp, Homo sapiens
caggagagtgggcagcaggggg

SEQ ID NO: 24640 - DNA, 21 bp, Homo sapiens
caggggagggagagatggggg

SEQ ID NO: 24641 - DNA, 20 bp, Homo sapiens
gggcagggaaggtgtggggg

SEQ ID NO: 24642 - DNA, 15 bp, Homo sapiens
aggacagggaagggg

SEQ ID NO: 24643 - DNA, 18 bp, Homo sapiens
ggcaggggcagcaggggg

SEQ ID NO: 24644 - DNA, 19 bp, Homo sapiens
gggcgcggggaggaggggg

SEQ ID NO: 24645 - DNA, 19 bp, Homo sapiens
gggcagggaggggaagggg

SEQ ID NO: 24646 - DNA, 15 bp, Homo sapiens
cagggcaggaagggg

SEQ ID NO: 24647 - DNA, 16 bp, Homo sapiens
gggcggggagcagggg

SEQ ID NO: 24648 - DNA, 18 bp, Homo sapiens
aggcagggagaaaagggg

SEQ ID NO: 24649 - DNA, 17 bp, Homo sapiens
agggcagggaggagggg

SEQ ID NO: 24650 - DNA, 19 bp, Homo sapiens
tgaggcagagtgcaggggg

SEQ ID NO: 24651 - DNA, 24 bp, Homo sapiens
cagggagggggtgttggcgggggg

SEQ ID NO: 24652 - DNA, 19 bp, Homo sapiens
ggggtggaggcagaggggg

SEQ ID NO: 24653 - DNA, 16 bp, Homo sapiens
ggacagggagctgggg

SEQ ID NO: 24654 - DNA, 18 bp, Homo sapiens
ggggggggggcaaggggg

SEQ ID NO: 24655 - DNA, 18 bp, Homo sapiens
aaggtgggtggcaggggg

SEQ ID NO: 24656 - DNA, 19 bp, Homo sapiens
cagggcagtgagcaagagg

SEQ ID NO: 24657 - DNA, 18 bp, Homo sapiens
cagaggcagggagctggg

SEQ ID NO: 24658 - DNA, 21 bp, Homo sapiens
ggctcggagggtagcgggggg

SEQ ID NO: 24659 - DNA, 17 bp, Homo sapiens
gggcacggggcaggggg

SEQ ID NO: 24660 - DNA, 20 bp, Homo sapiens
caggacaccagggcaggggg

SEQ ID NO: 24661 - DNA, 19 bp, Homo sapiens
caggggagggagcatcagg

SEQ ID NO: 24662 - DNA, 19 bp, Homo sapiens
cagggcagagagctgtggg

SEQ ID NO: 24663 - DNA, 20 bp, Homo sapiens
cagggcagtggtcatggggg

SEQ ID NO: 24664 - DNA, 17 bp, Homo sapiens
cagggagggagcagcag

SEQ ID NO: 24665 - DNA, 16 bp, Homo sapiens
cagggcagggacaggg

SEQ ID NO: 24666 - DNA, 21 bp, Homo sapiens
cagggcgggggagtgaaaggg

SEQ ID NO: 24667 - DNA, 16 bp, Homo sapiens
gggcgggagcaggggg

SEQ ID NO: 24668 - DNA, 17 bp, Homo sapiens
cagggtgaggggcgggg

SEQ ID NO: 24669 - DNA, 22 bp, Homo sapiens
cagggcagggggcagacagggg

SEQ ID NO: 24670 - DNA, 21 bp, Homo sapiens
cagggcaggagtggtccaggg

SEQ ID NO: 24671 - DNA, 16 bp, Homo sapiens
caggggaggggcgggg

SEQ ID NO: 24672 - DNA, 20 bp, Homo sapiens
cagagtggggagcgcccagg

SEQ ID NO: 24673 - DNA, 22 bp, Homo sapiens
cagggcagagggaatatggggg

SEQ ID NO: 24674 - DNA, 17 bp, Homo sapiens
gggcaaggagcagatgg

SEQ ID NO: 24675 - DNA, 20 bp, Homo sapiens
cagggcagggtagggagggg

SEQ ID NO: 24676 - DNA, 17 bp, Homo sapiens
gggcagggcataggggg

SEQ ID NO: 24677 - DNA, 20 bp, Homo sapiens
cagggcggggcggggtgggg

SEQ ID NO: 24678 - DNA, 21 bp, Homo sapiens
cagggcaggtgggcagccagg

SEQ ID NO: 24679 - DNA, 19 bp, Homo sapiens
gggcagggagtcagcgggg

SEQ ID NO: 24680 - DNA, 15 bp, Homo sapiens
gggcaagggcagggg

SEQ ID NO: 24681 - DNA, 21 bp, Homo sapiens
cagggaggggaggcgaggggg

SEQ ID NO: 24682 - DNA, 17 bp, Homo sapiens
gggcgggagcggcaggg

SEQ ID NO: 24683 - DNA, 16 bp, Homo sapiens
cagggagggagcaggg

SEQ ID NO: 24684 - DNA, 23 bp, Homo sapiens
cagggcaggggggaggctggggg

SEQ ID NO: 24685 - DNA, 17 bp, Homo sapiens
ggggagggagcagaggg

SEQ ID NO: 24686 - DNA, 18 bp, Homo sapiens
cagggcaaggggcagggg

SEQ ID NO: 24687 - DNA, 17 bp, Homo sapiens
gggtgggcgacaggggg

SEQ ID NO: 24688 - DNA, 17 bp, Homo sapiens
gggcagggaaaaggggg

SEQ ID NO: 24689 - DNA, 20 bp, Homo sapiens
cagggtgggaggcagagggg

SEQ ID NO: 24690 - DNA, 19 bp, Homo sapiens
gggcagaggaaggaggggg

SEQ ID NO: 24691 - DNA, 19 bp, Homo sapiens
gggcaggggtttcaggggg

SEQ ID NO: 24692 - DNA, 19 bp, Homo sapiens
aggcagggagtgcacctgg

SEQ ID NO: 24693 - DNA, 20 bp, Homo sapiens
caggggagggggcctggggg

SEQ ID NO: 24694 - DNA, 17 bp, Homo sapiens
cagggcagaggggcggg

SEQ ID NO: 24695 - DNA, 17 bp, Homo sapiens
cagggagggagtagaag

SEQ ID NO: 24696 - DNA, 20 bp, Homo sapiens
cagggcagggagaggcgggg

SEQ ID NO: 24697 - DNA, 22 bp, Homo sapiens
cagggcgggcgagggcaggggg

SEQ ID NO: 24698 - DNA, 18 bp, Homo sapiens
cagggtgggagaccgggg

SEQ ID NO: 24699 - DNA, 17 bp, Homo sapiens
cagggcaggggtcaggg

SEQ ID NO: 24700 - DNA, 19 bp, Homo sapiens
gggctggggagcacagggg

SEQ ID NO: 24701 - DNA, 17 bp, Homo sapiens
cagggaagggagcaggg

SEQ ID NO: 24702 - DNA, 20 bp, Homo sapiens
cagggaggagaggcaggggg

SEQ ID NO: 24703 - DNA, 18 bp, Homo sapiens
aggcaggggtgctggggg

SEQ ID NO: 24704 - DNA, 19 bp, Homo sapiens
cagggcgggagcagacggg

SEQ ID NO: 24705 - DNA, 20 bp, Homo sapiens
cagggcaggcagggctgggg

SEQ ID NO: 24706 - DNA, 21 bp, Homo sapiens
gggcagggggccagatcgggg

SEQ ID NO: 24707 - DNA, 16 bp, Homo sapiens
gggcagggagccgggg

SEQ ID NO: 24708 - DNA, 15 bp, Homo sapiens
gggcagcagcagggg

SEQ ID NO: 24709 - DNA, 23 bp, Homo sapiens
cagggcggtggggggtaaggggg

SEQ ID NO: 24710 - DNA, 17 bp, Homo sapiens
agggcagggggcatggg

SEQ ID NO: 24711 - DNA, 16 bp, Homo sapiens
gggcagaggagcaggg

SEQ ID NO: 24712 - DNA, 17 bp, Homo sapiens
gggtggggaagcagagg

SEQ ID NO: 24713 - DNA, 18 bp, Homo sapiens
cagggcagggagaagggg

SEQ ID NO: 24714 - DNA, 20 bp, Homo sapiens
ggggagggggtggcaaaagg

SEQ ID NO: 24715 - DNA, 18 bp, Homo sapiens
gggcagggaaggtggggg

SEQ ID NO: 24716 - DNA, 18 bp, Homo sapiens
gggcaggaagcccggggg

SEQ ID NO: 24717 - DNA, 20 bp, Homo sapiens
caggccagggagtggcaggg

SEQ ID NO: 24718 - DNA, 18 bp, Homo sapiens
ggggtgggagagtggagg

SEQ ID NO: 24719 - DNA, 21 bp, Homo sapiens
ggggatggagctggcgggggg

SEQ ID NO: 24720 - DNA, 19 bp, Homo sapiens
caggacagggagagagggg

SEQ ID NO: 24721 - DNA, 16 bp, Homo sapiens
cagggcagggataggg

SEQ ID NO: 24722 - DNA, 19 bp, Homo sapiens
gggcagggcggcaaacagg

SEQ ID NO: 24723 - DNA, 21 bp, Homo sapiens
cagggcagggggagcacaggg

SEQ ID NO: 24724 - DNA, 15 bp, Homo sapiens
aggcagggcaggggg

SEQ ID NO: 24725 - DNA, 24 bp, Homo sapiens
cagggcaggaggcagcctccaggg

SEQ ID NO: 24726 - DNA, 21 bp, Homo sapiens
cagggcagagggtgcctgggg

SEQ ID NO: 24727 - DNA, 22 bp, Homo sapiens
caaggcaggcacaggcaggggg

SEQ ID NO: 24728 - DNA, 19 bp, Homo sapiens
agggcggggagctgcaggg

SEQ ID NO: 24729 - DNA, 23 bp, Homo sapiens
gggcgggaagcagcccccggggg

SEQ ID NO: 24730 - DNA, 21 bp, Homo sapiens
ggggtggagctaggcaggggg

SEQ ID NO: 24731 - DNA, 17 bp, Homo sapiens
gggcagggcagaggggg

SEQ ID NO: 24732 - DNA, 21 bp, Homo sapiens
ggtggatgcagcagcaggggg

SEQ ID NO: 24733 - DNA, 22 bp, Homo sapiens
cagagtggggagctgctcgggg

SEQ ID NO: 24734 - DNA, 18 bp, Homo sapiens
gggcagggggcgacacag

SEQ ID NO: 24735 - DNA, 22 bp, Homo sapiens
cagggcagtggggctccagggg

SEQ ID NO: 24736 - DNA, 20 bp, Homo sapiens
cagggcagggaagtggaggg

SEQ ID NO: 24737 - DNA, 22 bp, Homo sapiens
agggcacacacctggcaggggg

SEQ ID NO: 24738 - DNA, 19 bp, Homo sapiens
cagggcagtggaggcgggg

SEQ ID NO: 24739 - DNA, 18 bp, Homo sapiens
cagggtagggggcagggg

SEQ ID NO: 24740 - DNA, 22 bp, Homo sapiens
gggcaggatgggcagtgggggg

SEQ ID NO: 24741 - DNA, 16 bp, Homo sapiens
caaggcagggggcagg

SEQ ID NO: 24742 - DNA, 20 bp, Homo sapiens
cagtgcagaaaggcaggggg

SEQ ID NO: 24743 - DNA, 17 bp, Homo sapiens
ggggagggagcagaagg

SEQ ID NO: 24744 - DNA, 17 bp, Homo sapiens
caggacagggggcagag

SEQ ID NO: 24745 - DNA, 23 bp, Homo sapiens
cagggcaggagaagtgttggggg

SEQ ID NO: 24746 - DNA, 18 bp, Homo sapiens
gggcagggccccaggggg

SEQ ID NO: 24747 - DNA, 18 bp, Homo sapiens
gggcaaggaaggtggggg

SEQ ID NO: 24748 - DNA, 18 bp, Homo sapiens
cagggccggggcaggggg

SEQ ID NO: 24749 - DNA, 20 bp, Homo sapiens
cagggcagggacatccatgg

SEQ ID NO: 24750 - DNA, 19 bp, Homo sapiens
aggcagggagttttaaggg

SEQ ID NO: 24751 - DNA, 18 bp, Homo sapiens
cagggccgggggcagtca

SEQ ID NO: 24752 - DNA, 20 bp, Homo sapiens
cagggcaggagcttgatggg

SEQ ID NO: 24753 - DNA, 21 bp, Homo sapiens
aagtgccagggtggcaggggg

SEQ ID NO: 24754 - DNA, 18 bp, Homo sapiens
ggacggggagcggcgggg

SEQ ID NO: 24755 - DNA, 19 bp, Homo sapiens
caggggggacagcgggggg

SEQ ID NO: 24756 - DNA, 18 bp, Homo sapiens
gggcagagcagcaggggg

SEQ ID NO: 24757 - DNA, 20 bp, Homo sapiens
gggcagggagcatcataggg

SEQ ID NO: 24758 - DNA, 17 bp, Homo sapiens
gggcggggggcaggggg

SEQ ID NO: 24759 - DNA, 21 bp, Homo sapiens
agggtgggcaccagcaggggg

SEQ ID NO: 24760 - DNA, 18 bp, Homo sapiens
gggtagggggcagcaggg

SEQ ID NO: 24761 - DNA, 23 bp, Homo sapiens
gggctgggggggctgggaggggg

SEQ ID NO: 24762 - DNA, 16 bp, Homo sapiens
gggcagggagcggtgg

SEQ ID NO: 24763 - DNA, 21 bp, Homo sapiens
caggggaggggctagaggggg

SEQ ID NO: 24764 - DNA, 23 bp, Homo sapiens
caggggagggaggcctgcggggg

SEQ ID NO: 24765 - DNA, 17 bp, Homo sapiens
caggtcagggagtgggg

SEQ ID NO: 24766 - DNA, 19 bp, Homo sapiens
agggcaaggaggccagggg

SEQ ID NO: 24767 - DNA, 19 bp, Homo sapiens
cagggagggtggcaggggg

SEQ ID NO: 24768 - DNA, 24 bp, Homo sapiens
caaggcagagcccgcagcaggggg

SEQ ID NO: 24769 - DNA, 24 bp, Homo sapiens
cagggagggaaaccgggtaggggg

SEQ ID NO: 24770 - DNA, 17 bp, Homo sapiens
gggcaagggagtggggg

SEQ ID NO: 24771 - DNA, 21 bp, Homo sapiens
agggcaggggctaagaggggg

SEQ ID NO: 24772 - DNA, 18 bp, Homo sapiens
gggcaggaggggctgggg

SEQ ID NO: 24773 - DNA, 16 bp, Homo sapiens
agggtgggcacagggg

SEQ ID NO: 24774 - DNA, 16 bp, Homo sapiens
aaggcagggagcaagg

SEQ ID NO: 24775 - DNA, 25 bp, Homo sapiens
cagggagggaggggcgggtaggggg

SEQ ID NO: 24776 - DNA, 23 bp, Homo sapiens
cagggtgtggaagaggtaggggg

SEQ ID NO: 24777 - DNA, 21 bp, Homo sapiens
gggcaggggacagaacaaagg

SEQ ID NO: 24778 - DNA, 20 bp, Homo sapiens
cagggggtaggagcaggggg

SEQ ID NO: 24779 - DNA, 16 bp, Homo sapiens
caaggcagggagtggg

SEQ ID NO: 24780 - DNA, 19 bp, Homo sapiens
gggcgggcggtgcaggggg

SEQ ID NO: 24781 - DNA, 16 bp, Homo sapiens
gggcggggagcaagag

SEQ ID NO: 24782 - DNA, 17 bp, Homo sapiens
cagggcagggataaagg

SEQ ID NO: 24783 - DNA, 20 bp, Homo sapiens
gggcagagcctagcaggggg

SEQ ID NO: 24784 - DNA, 18 bp, Homo sapiens
ggacagggggagcagggg

SEQ ID NO: 24785 - DNA, 18 bp, Homo sapiens
cagggcgggggctggggg

SEQ ID NO: 24786 - DNA, 19 bp, Homo sapiens
aggcagggggccgcagggg

SEQ ID NO: 24787 - DNA, 22 bp, Homo sapiens
ggggagggagcagacgcggggg

SEQ ID NO: 24788 - DNA, 17 bp, Homo sapiens
cagggagggagctgggg

SEQ ID NO: 24789 - DNA, 20 bp, Homo sapiens
cagggcaggggtggcacagg

SEQ ID NO: 24790 - DNA, 17 bp, Homo sapiens
cagggcagggagtgggg

SEQ ID NO: 24791 - DNA, 18 bp, Homo sapiens
gggcagggggcggcaagg

SEQ ID NO: 24792 - DNA, 19 bp, Homo sapiens
cagggcaggggcccagggg

SEQ ID NO: 24793 - DNA, 18 bp, Homo sapiens
gggcagggaggctgtggg

SEQ ID NO: 24794 - DNA, 20 bp, Homo sapiens
gggcgggggcgagaacgggg

SEQ ID NO: 24795 - DNA, 20 bp, Homo sapiens
caggacagtaaggcaggggg

SEQ ID NO: 24796 - DNA, 19 bp, Homo sapiens
agggtagggggacagaggg

SEQ ID NO: 24797 - DNA, 22 bp, Homo sapiens
caggggagggggcccagtgggg

SEQ ID NO: 24798 - DNA, 17 bp, Homo sapiens
cagggacggggaagggg

SEQ ID NO: 24799 - DNA, 17 bp, Homo sapiens
agggcagggagatgggg

SEQ ID NO: 24800 - DNA, 18 bp, Homo sapiens
gggggagagggcaggggg

SEQ ID NO: 24801 - DNA, 17 bp, Homo sapiens
gggcagggcatgggggg

SEQ ID NO: 24802 - DNA, 20 bp, Homo sapiens
caaggcagggggtggccagg

SEQ ID NO: 24803 - DNA, 19 bp, Homo sapiens
gggcagaggagcagccggg

SEQ ID NO: 24804 - DNA, 22 bp, Homo sapiens
cagggtccacttcagcaggggg

SEQ ID NO: 24805 - DNA, 18 bp, Homo sapiens
caggagcagggggcacgg

SEQ ID NO: 24806 - DNA, 17 bp, Homo sapiens
cagggtgaggggcggaa

SEQ ID NO: 24807 - DNA, 15 bp, Homo sapiens
gggcagggagcaggg

SEQ ID NO: 24808 - DNA, 16 bp, Homo sapiens
gggcagggagcagggg

SEQ ID NO: 24809 - DNA, 19 bp, Homo sapiens
cagggcaggaggcatgggg

SEQ ID NO: 24810 - DNA, 17 bp, Homo sapiens
gggcaggagctgcgggg

SEQ ID NO: 24811 - DNA, 19 bp, Homo sapiens
caggaggggcagcaggggg

SEQ ID NO: 24812 - DNA, 23 bp, Homo sapiens
cagggtgggtgagcagaaaaggg

SEQ ID NO: 24813 - DNA, 16 bp, Homo sapiens
agggcagggggcaggg

SEQ ID NO: 24814 - DNA, 19 bp, Homo sapiens
caggggagagggcaggggg

SEQ ID NO: 24815 - DNA, 18 bp, Homo sapiens
cagggtggggtgcacagg

SEQ ID NO: 24816 - DNA, 18 bp, Homo sapiens
ggggtaggaggcaagggg

SEQ ID NO: 24817 - DNA, 17 bp, Homo sapiens
gggcaggggcagcttgg

SEQ ID NO: 24818 - DNA, 19 bp, Homo sapiens
agggtagggagcactgggg

SEQ ID NO: 24819 - DNA, 19 bp, Homo sapiens
cagggcagagggcagaagg

SEQ ID NO: 24820 - DNA, 17 bp, Homo sapiens
cagggcaggggccaggg

SEQ ID NO: 24821 - DNA, 17 bp, Homo sapiens
gggcaggggcctggggg

SEQ ID NO: 24822 - DNA, 17 bp, Homo sapiens
tgaggcaaaggcagggg

SEQ ID NO: 24823 - DNA, 18 bp, Homo sapiens
aggccaggaagcaggggg

SEQ ID NO: 24824 - DNA, 25 bp, Homo sapiens
caggggaggggggccgctcaggggg

SEQ ID NO: 24825 - DNA, 23 bp, Homo sapiens
gggcaggggcggccgggtggggg

SEQ ID NO: 24826 - DNA, 17 bp, Homo sapiens
gggtgggaggcaggggg

SEQ ID NO: 24827 - DNA, 15 bp, Homo sapiens
aggcaggagcagggg

SEQ ID NO: 24828 - DNA, 26 bp, Homo sapiens
cagggtacggggtgtgctggtggggg

SEQ ID NO: 24829 - DNA, 20 bp, Homo sapiens
gggcagaggtcaggaggggg

SEQ ID NO: 24830 - DNA, 20 bp, Homo sapiens
aggcagggagtcaggagggg

SEQ ID NO: 24831 - DNA, 20 bp, Homo sapiens
caaggcggggggcacgaagg

SEQ ID NO: 24832 - DNA, 22 bp, Homo sapiens
gggcaggggccaaggcgggggg

SEQ ID NO: 24833 - DNA, 17 bp, Homo sapiens
gggcagggaggcggggg

SEQ ID NO: 24834 - DNA, 19 bp, Homo sapiens
agcccagggcggcaggggg

SEQ ID NO: 24835 - DNA, 19 bp, Homo sapiens
gcatgggagcagcgggggg

SEQ ID NO: 24836 - DNA, 17 bp, Homo sapiens
cagggccgggggcaggg

SEQ ID NO: 24837 - DNA, 22 bp, Homo sapiens
cagggcaggaggctcgcggggg

SEQ ID NO: 24838 - DNA, 18 bp, Homo sapiens
gggcacagcagcaggggg

SEQ ID NO: 24839 - DNA, 19 bp, Homo sapiens
cagggcagggagggcatag

SEQ ID NO: 24840 - DNA, 20 bp, Homo sapiens
aggcagggggcagttagggg

SEQ ID NO: 24841 - DNA, 19 bp, Homo sapiens
aggctggggagacgggggg

SEQ ID NO: 24842 - DNA, 23 bp, Homo sapiens
cagggcaagaaaagggcaggggg

SEQ ID NO: 24843 - DNA, 21 bp, Homo sapiens
cagggcaaggagtgaccctgg

SEQ ID NO: 24844 - DNA, 17 bp, Homo sapiens
cacggcaccagcagggg

SEQ ID NO: 24845 - DNA, 17 bp, Homo sapiens
cacggcagggagtgggg

SEQ ID NO: 24846 - DNA, 19 bp, Homo sapiens
cagggcaggggaccgaggg

SEQ ID NO: 24847 - DNA, 19 bp, Homo sapiens
ggcagcagagggcaggggg

SEQ ID NO: 24848 - DNA, 19 bp, Homo sapiens
gggctggggagcaagcggg

SEQ ID NO: 24849 - DNA, 16 bp, Homo sapiens
gggtagggagcaaggg

SEQ ID NO: 24850 - DNA, 19 bp, Homo sapiens
caggggatcaggcaggggg

SEQ ID NO: 24851 - DNA, 22 bp, Homo sapiens
gggcaggggcgaaaggtggggg

SEQ ID NO: 24852 - DNA, 19 bp, Homo sapiens
gggccagggagcagcaaag

SEQ ID NO: 24853 - DNA, 17 bp, Homo sapiens
cagggagggaggtgggg

SEQ ID NO: 24854 - DNA, 16 bp, Homo sapiens
agagcagggagcaggg

SEQ ID NO: 24855 - DNA, 21 bp, Homo sapiens
cagggcggagggcaaaggggg

SEQ ID NO: 24856 - DNA, 20 bp, Homo sapiens
gggcaggggggtggcagggg

SEQ ID NO: 24857 - DNA, 17 bp, Homo sapiens
gggtaggggcaaggggg

SEQ ID NO: 24858 - DNA, 21 bp, Homo sapiens
agggcagggaccaagttgggg

SEQ ID NO: 24859 - DNA, 17 bp, Homo sapiens
cagggtggggagccagg

SEQ ID NO: 24860 - DNA, 16 bp, Homo sapiens
gggcagggggccaggg

SEQ ID NO: 24861 - DNA, 19 bp, Homo sapiens
gggcaaggagcagccaggg

SEQ ID NO: 24862 - DNA, 21 bp, Homo sapiens
cagggcagggaggtcgcaggg

SEQ ID NO: 24863 - DNA, 18 bp, Homo sapiens
agggtggtaggcaggggg

SEQ ID NO: 24864 - DNA, 18 bp, Homo sapiens
ggcgcagggagggcgggg

SEQ ID NO: 24865 - DNA, 18 bp, Homo sapiens
ggggaggggtgcaggggg

SEQ ID NO: 24866 - DNA, 18 bp, Homo sapiens
cagggcagggaggccagg

SEQ ID NO: 24867 - DNA, 18 bp, Homo sapiens
cagggcagggggcagcgg

SEQ ID NO: 24868 - DNA, 16 bp, Homo sapiens
cagtgcagggcagggg

SEQ ID NO: 24869 - DNA, 17 bp, Homo sapiens
cagggcagggagcaggg

SEQ ID NO: 24870 - DNA, 18 bp, Homo sapiens
cagggcaggaggcggcgg

SEQ ID NO: 24871 - DNA, 18 bp, Homo sapiens
gggtgggagagcaggggg

SEQ ID NO: 24872 - DNA, 19 bp, Homo sapiens
cagggctgggagttggggg

SEQ ID NO: 24873 - DNA, 21 bp, Homo sapiens
caaggcagggggtagcgtggg

SEQ ID NO: 24874 - DNA, 22 bp, Homo sapiens
gggggaccccttcagcaggggg

SEQ ID NO: 24875 - DNA, 21 bp, Homo sapiens
cagggcagagggcggcaggag

SEQ ID NO: 24876 - DNA, 19 bp, Homo sapiens
gggcagagagcaccagggg

SEQ ID NO: 24877 - DNA, 17 bp, Homo sapiens
gggcagggaagaggggg

SEQ ID NO: 24878 - DNA, 19 bp, Homo sapiens
ggggtgggggcaggagggg

SEQ ID NO: 24879 - DNA, 20 bp, Homo sapiens
cagggcgggggacagcctgg

SEQ ID NO: 24880 - DNA, 17 bp, Homo sapiens
cagggcaggggccgggg

SEQ ID NO: 24881 - DNA, 17 bp, Homo sapiens
gggcaggaggcagaagg

SEQ ID NO: 24882 - DNA, 22 bp, Homo sapiens
caggggagaacagggtaggggg

SEQ ID NO: 24883 - DNA, 17 bp, Homo sapiens
gggcgggagcagcccag

SEQ ID NO: 24884 - DNA, 18 bp, Homo sapiens
agggtgggggacaggggg

SEQ ID NO: 24885 - DNA, 24 bp, Homo sapiens
cagggcaaggagctgtggtggggg

SEQ ID NO: 24886 - DNA, 17 bp, Homo sapiens
cagaggtagggaggggg

SEQ ID NO: 24887 - DNA, 19 bp, Homo sapiens
cagggcatggggggagggg

SEQ ID NO: 24888 - DNA, 22 bp, Homo sapiens
agggcacacatgcagcaggggg

SEQ ID NO: 24889 - DNA, 17 bp, Homo sapiens
agggcaggggcccgggg

SEQ ID NO: 24890 - DNA, 19 bp, Homo sapiens
cagggccaggggttggggg

SEQ ID NO: 24891 - DNA, 19 bp, Homo sapiens
cagggcaggggcctatggg

SEQ ID NO: 24892 - DNA, 21 bp, Homo sapiens
cagggcagagggcagcggggg

SEQ ID NO: 24893 - DNA, 20 bp, Homo sapiens
gggcagggcagggcaggggg

SEQ ID NO: 24894 - DNA, 16 bp, Homo sapiens
gggcgggaagaagggg

SEQ ID NO: 24895 - DNA, 16 bp, Homo sapiens
cagggagggggcgggg

SEQ ID NO: 24896 - DNA, 18 bp, Homo sapiens
cagggcagagggcacagg

SEQ ID NO: 24897 - DNA, 17 bp, Homo sapiens
caggtagggagcatggg

SEQ ID NO: 24898 - DNA, 17 bp, Homo sapiens
cagggcagggaggggaa

SEQ ID NO: 24899 - DNA, 17 bp, Homo sapiens
gggcagggagcaggggg

SEQ ID NO: 24900 - DNA, 16 bp, Homo sapiens
gggcggggcagcaggg

SEQ ID NO: 24901 - DNA, 16 bp, Homo sapiens
cagggcaggcacgggg

SEQ ID NO: 24902 - DNA, 18 bp, Homo sapiens
cagggcagtgagaagggg

SEQ ID NO: 24903 - DNA, 17 bp, Homo sapiens
cagggcagggacagcag

SEQ ID NO: 24904 - DNA, 21 bp, Homo sapiens
gggcaggggtggcacccaggg

SEQ ID NO: 24905 - DNA, 18 bp, Homo sapiens
cagcgcagggggcacggg

SEQ ID NO: 24906 - DNA, 22 bp, Homo sapiens
cagagtggggagtgattggggg

SEQ ID NO: 24907 - DNA, 24 bp, Homo sapiens
cagggcaagggggcagctacaggg

SEQ ID NO: 24908 - DNA, 20 bp, Homo sapiens
gggtcggggagggcaggggg

SEQ ID NO: 24909 - DNA, 19 bp, Homo sapiens
cagtgcggctggcaggggg

SEQ ID NO: 24910 - DNA, 21 bp, Homo sapiens
gggcaggggatgcggctgggg

SEQ ID NO: 24911 - DNA, 17 bp, Homo sapiens
tgaggcagggagtagag

SEQ ID NO: 24912 - DNA, 22 bp, Homo sapiens
cagggcagggtgggagctgggg

SEQ ID NO: 24913 - DNA, 17 bp, Homo sapiens
cagggcacggggcaggg

SEQ ID NO: 24914 - DNA, 18 bp, Homo sapiens
cagggcagggatcactgg

SEQ ID NO: 24915 - DNA, 18 bp, Homo sapiens
aggccggggagcgagcgg

SEQ ID NO: 24916 - DNA, 17 bp, Homo sapiens
caggccaggagcagggg

SEQ ID NO: 24917 - DNA, 19 bp, Homo sapiens
gggcacgccctgcaggggg

SEQ ID NO: 24918 - DNA, 20 bp, Homo sapiens
cagggtcagggagttgtggg

SEQ ID NO: 24919 - DNA, 22 bp, Homo sapiens
ggggagggggcggcgggcaggg

SEQ ID NO: 24920 - DNA, 18 bp, Homo sapiens
gggttggaagacaggggg

SEQ ID NO: 24921 - DNA, 20 bp, Homo sapiens
gggcaggggagagccggggg

SEQ ID NO: 24922 - DNA, 17 bp, Homo sapiens
agggcggggagccgggg

SEQ ID NO: 24923 - DNA, 18 bp, Homo sapiens
aggacagcgcgcaggggg

SEQ ID NO: 24924 - DNA, 16 bp, Homo sapiens
cagggcagggcagggg

SEQ ID NO: 24925 - DNA, 17 bp, Homo sapiens
cagggagggggcggcag

SEQ ID NO: 24926 - DNA, 20 bp, Homo sapiens
gggcagagagcacagcaggg

SEQ ID NO: 24927 - DNA, 21 bp, Homo sapiens
cagtgcaggggactgaggggg

SEQ ID NO: 24928 - DNA, 16 bp, Homo sapiens
cagggcaggggacagg

SEQ ID NO: 24929 - DNA, 20 bp, Homo sapiens
cagggtggggcagtggcagg

SEQ ID NO: 24930 - DNA, 16 bp, Homo sapiens
caaggcggggcagggg

SEQ ID NO: 24931 - DNA, 23 bp, Homo sapiens
caggacagcttgaaggtgggggg

SEQ ID NO: 24932 - DNA, 18 bp, Homo sapiens
caggagcagggggccggg

SEQ ID NO: 24933 - DNA, 22 bp, Homo sapiens
cagggtggggtgcaaacaaagg

SEQ ID NO: 24934 - DNA, 16 bp, Homo sapiens
cagggccaggcagggg

SEQ ID NO: 24935 - DNA, 21 bp, Homo sapiens
ggggagactggcagcaggggg

SEQ ID NO: 24936 - DNA, 17 bp, Homo sapiens
caggttagggagcaagg

SEQ ID NO: 24937 - DNA, 16 bp, Homo sapiens
agggcaggcagagggg

SEQ ID NO: 24938 - DNA, 15 bp, Homo sapiens
cagggcagggaggga

SEQ ID NO: 24939 - DNA, 18 bp, Homo sapiens
gggttagtcagcaggggg

SEQ ID NO: 24940 - DNA, 17 bp, Homo sapiens
gggcagagaggcagggg

SEQ ID NO: 24941 - DNA, 20 bp, Homo sapiens
gggcagcggaggatgggggg

SEQ ID NO: 24942 - DNA, 18 bp, Homo sapiens
agggcaggctccaggggg

SEQ ID NO: 24943 - DNA, 18 bp, Homo sapiens
gggcaggggcattccagg

SEQ ID NO: 24944 - DNA, 21 bp, Homo sapiens
cagggcggcgggcaaaggggg

SEQ ID NO: 24945 - DNA, 20 bp, Homo sapiens
tgaggcagggagctctgggg

SEQ ID NO: 24946 - DNA, 18 bp, Homo sapiens
cagggcagggggaagagg

SEQ ID NO: 24947 - DNA, 21 bp, Homo sapiens
ggggggagctcgggcaggggg

SEQ ID NO: 24948 - DNA, 16 bp, Homo sapiens
gggcaggggacagggg

SEQ ID NO: 24949 - DNA, 18 bp, Homo sapiens
caaggtagggggacgggg

SEQ ID NO: 24950 - DNA, 19 bp, Homo sapiens
aggcagggatgcctggggg

SEQ ID NO: 24951 - DNA, 21 bp, Homo sapiens
agaatcgggggtggcaggggg

SEQ ID NO: 24952 - DNA, 19 bp, Homo sapiens
aggggtggagggcaggggg

SEQ ID NO: 24953 - DNA, 18 bp, Homo sapiens
gggcaggggcgcagtggg

SEQ ID NO: 24954 - DNA, 20 bp, Homo sapiens
gggcaggaggtgcgaggggg

SEQ ID NO: 24955 - DNA, 19 bp, Homo sapiens
caggatggcaagcaggggg

SEQ ID NO: 24956 - DNA, 18 bp, Homo sapiens
ggcctgggcagcaggggg

SEQ ID NO: 24957 - DNA, 17 bp, Homo sapiens
aggcagggggccacggg

SEQ ID NO: 24958 - DNA, 17 bp, Homo sapiens
agggcagggggctaggg

SEQ ID NO: 24959 - DNA, 20 bp, Homo sapiens
cagggccagggggcagaggg

SEQ ID NO: 24960 - DNA, 18 bp, Homo sapiens
caggagtggggagagggg

SEQ ID NO: 24961 - DNA, 20 bp, Homo sapiens
cagggcagggaacgcccagg

SEQ ID NO: 24962 - DNA, 19 bp, Homo sapiens
caggacgggggcccggggg

SEQ ID NO: 24963 - DNA, 20 bp, Homo sapiens
cagggcagggaggacacggg

SEQ ID NO: 24964 - DNA, 18 bp, Homo sapiens
cagtggcagggggccggg

SEQ ID NO: 24965 - DNA, 18 bp, Homo sapiens
gggctggggcacaggggg

SEQ ID NO: 24966 - DNA, 17 bp, Homo sapiens
caaggtggggagcaggg

SEQ ID NO: 24967 - DNA, 18 bp, Homo sapiens
cagggcagggggtggagg

SEQ ID NO: 24968 - DNA, 19 bp, Homo sapiens
cagggtgaggggcagccag

SEQ ID NO: 24969 - DNA, 21 bp, Homo sapiens
cagggagggatctgcgggggg

SEQ ID NO: 24970 - DNA, 15 bp, Homo sapiens
gcgggcagcaggggg

SEQ ID NO: 24971 - DNA, 19 bp, Homo sapiens
gggcagggaggacgcaggg

SEQ ID NO: 24972 - DNA, 16 bp, Homo sapiens
agggagggagcagaag

SEQ ID NO: 24973 - DNA, 20 bp, Homo sapiens
cagggcgggagccagcaggg

SEQ ID NO: 24974 - DNA, 19 bp, Homo sapiens
gggccgaggtggcaggggg

SEQ ID NO: 24975 - DNA, 21 bp, Homo sapiens
cagggttagggatagaggggg

SEQ ID NO: 24976 - DNA, 22 bp, Homo sapiens
caggtagggagtggagaagggg

SEQ ID NO: 24977 - DNA, 21 bp, Homo sapiens
cagggccaggagtccaggggg

SEQ ID NO: 24978 - DNA, 21 bp, Homo sapiens
gggcagggggagacagcgggg

SEQ ID NO: 24979 - DNA, 20 bp, Homo sapiens
gcagtgtgggcggcaggggg

SEQ ID NO: 24980 - DNA, 16 bp, Homo sapiens
cagggcaggacagggg

SEQ ID NO: 24981 - DNA, 19 bp, Homo sapiens
gggtgggggacgcaggggg

SEQ ID NO: 24982 - DNA, 20 bp, Homo sapiens
ggtgtagtaggagcaggggg

SEQ ID NO: 24983 - DNA, 19 bp, Homo sapiens
cagggggggccgtgggggg

SEQ ID NO: 24984 - DNA, 18 bp, Homo sapiens
agggccgtgggcaggggg

SEQ ID NO: 24985 - DNA, 17 bp, Homo sapiens
cagtggcagagcagggg

SEQ ID NO: 24986 - DNA, 18 bp, Homo sapiens
cagggctgggggcagagg

SEQ ID NO: 24987 - DNA, 20 bp, Homo sapiens
agggcagggaggcatggggg

SEQ ID NO: 24988 - DNA, 20 bp, Homo sapiens
cagggcagggtggggagggg

SEQ ID NO: 24989 - DNA, 20 bp, Homo sapiens
cagggtggggaggggcgggg

SEQ ID NO: 24990 - DNA, 18 bp, Homo sapiens
gggcagggcagggtgggg

SEQ ID NO: 24991 - DNA, 18 bp, Homo sapiens
cagggcaggggcaggggg

SEQ ID NO: 24992 - DNA, 15 bp, Homo sapiens
gggcggggcgcaggg

SEQ ID NO: 24993 - DNA, 18 bp, Homo sapiens
cagggcaggcagcactgg

SEQ ID NO: 24994 - DNA, 20 bp, Homo sapiens
gcaggtctggcggcaggggg

SEQ ID NO: 24995 - DNA, 18 bp, Homo sapiens
ggcagggggcacacaggg

SEQ ID NO: 24996 - DNA, 20 bp, Homo sapiens
ggggtagggggaggcagggg

SEQ ID NO: 24997 - DNA, 21 bp, Homo sapiens
cagggcaggggagcaagctgg

SEQ ID NO: 24998 - DNA, 20 bp, Homo sapiens
cagggctgggggtgcacagg

SEQ ID NO: 24999 - DNA, 17 bp, Homo sapiens
cagagcagcagcagggg

SEQ ID NO: 25000 - DNA, 19 bp, Homo sapiens
cagagtagatcgcaggggg

SEQ ID NO: 25001 - DNA, 17 bp, Homo sapiens
cagggcggcgagcggaa

SEQ ID NO: 25002 - DNA, 22 bp, Homo sapiens
cagggcgataaatggcgggggg

SEQ ID NO: 25003 - DNA, 18 bp, Homo sapiens
cagggcagtggggcatgg

SEQ ID NO: 25004 - DNA, 17 bp, Homo sapiens
gggcaggggcatggggg

SEQ ID NO: 25005 - DNA, 16 bp, Homo sapiens
cagggagggggcaggg

SEQ ID NO: 25006 - DNA, 20 bp, Homo sapiens
gggcagggagcagaaggggg

SEQ ID NO: 25007 - DNA, 18 bp, Homo sapiens
cagggcagtgggtgcagg

SEQ ID NO: 25008 - DNA, 18 bp, Homo sapiens
caggagcggggagctggg

SEQ ID NO: 25009 - DNA, 19 bp, Homo sapiens
ggggagggagcacacctgg

SEQ ID NO: 25010 - DNA, 16 bp, Homo sapiens
gggcagggagcggaag

SEQ ID NO: 25011 - DNA, 16 bp, Homo sapiens
gggcagggggcagggg

SEQ ID NO: 25012 - DNA, 21 bp, Homo sapiens
aggacaggggctggcaggggg

SEQ ID NO: 25013 - DNA, 18 bp, Homo sapiens
gggcaggatcattggggg

SEQ ID NO: 25014 - DNA, 17 bp, Homo sapiens
gggtaaggagctggggg

SEQ ID NO: 25015 - DNA, 19 bp, Homo sapiens
cagggcagggatggcttgg

SEQ ID NO: 25016 - DNA, 21 bp, Homo sapiens
gggcaggggctcccgcggggg

SEQ ID NO: 25017 - DNA, 17 bp, Homo sapiens
cagggagggggcagcgg

SEQ ID NO: 25018 - DNA, 19 bp, Homo sapiens
gggcagggcagcgtcgggg

SEQ ID NO: 25019 - DNA, 65 bp, Human papillomavirus type 25
tccatggcgtctctgctgacgcagtgggaacatcagttcacacagttagttcaagacatacagga

SEQ ID NO: 25020 - DNA, 24 bp, Human papillomavirus type 25
acacagttagttcaagacatacag

SEQ ID NO: 25021 - DNA, 24 bp, Homo sapiens
acacagtagttcaagacatatcag

SEQ ID NO: 25022 - DNA, 22 bp, Homo sapiens
cacagttattttttagatacag

SEQ ID NO: 25023 - DNA, 21 bp, Homo sapiens
agcaggttttaagacatacag

SEQ ID NO: 25024 - DNA, 22 bp, Homo sapiens
acacagctggttcagattacag

SEQ ID NO: 25025 - DNA, 18 bp, Homo sapiens
gttagtcacactatacag

SEQ ID NO: 25026 - DNA, 19 bp, Homo sapiens
acagtagagaaacatacag

SEQ ID NO: 25027 - DNA, 20 bp, Homo sapiens
cactgttggtgaacatacag

SEQ ID NO: 25028 - DNA, 18 bp, Homo sapiens
acacagttagtacaaaac

SEQ ID NO: 25029 - DNA, 22 bp, Homo sapiens
cactgggctacaggacatacag

SEQ ID NO: 25030 - DNA, 24 bp, Homo sapiens
acacagtctggttgggacatgcag

SEQ ID NO: 25031 - DNA, 20 bp, Homo sapiens
agttagcccctggtatacag

SEQ ID NO: 25032 - DNA, 20 bp, Homo sapiens
acagtaagttcaagtccata

SEQ ID NO: 25033 - DNA, 23 bp, Homo sapiens
acatattataaatagacatacag

SEQ ID NO: 25034 - DNA, 19 bp, Homo sapiens
acacagttgttcaagtcat

SEQ ID NO: 25035 - DNA, 18 bp, Homo sapiens
cagttcagaggtatacag

SEQ ID NO: 25036 - DNA, 20 bp, Homo sapiens
acacagctggtggtagcata

SEQ ID NO: 25037 - DNA, 19 bp, Homo sapiens
acacagtctaaggcatgca

SEQ ID NO: 25038 - DNA, 18 bp, Homo sapiens
cagttattcaacacacag

SEQ ID NO: 25039 - DNA, 18 bp, Homo sapiens
cagtaacaagacatgcag

SEQ ID NO: 25040 - DNA, 20 bp, Homo sapiens
acagttagtcacaaatacag

SEQ ID NO: 25041 - DNA, 22 bp, Homo sapiens
cacagttgagtgctacatacag

SEQ ID NO: 25042 - DNA, 17 bp, Homo sapiens
cacatagttcaaaatca

SEQ ID NO: 25043 - DNA, 18 bp, Homo sapiens
atcagttttggacataca

SEQ ID NO: 25044 - DNA, 19 bp, Homo sapiens
acagctagaacgcatacag

SEQ ID NO: 25045 - DNA, 20 bp, Homo sapiens
cagttagtccaaattctcag

SEQ ID NO: 25046 - DNA, 21 bp, Homo sapiens
acactgtcccaggacatacag

SEQ ID NO: 25047 - DNA, 20 bp, Homo sapiens
cacagtggaaaaacatacag

SEQ ID NO: 25048 - DNA, 22 bp, Homo sapiens
agttagttcctgaagcatacag

SEQ ID NO: 25049 - DNA, 99 bp, Meleagrid herpesvirus 1
aaatacattttctctccgaggtgaggtattatgtacgtgccgggaatggttcaggcaaaacatagttaccaatgacttcgccaagggttcgttgtgttt

SEQ ID NO: 25050 - DNA, 24 bp, Meleagrid herpesvirus 1
aggcaaaacatagttaccaatgac

SEQ ID NO: 25051 - DNA, 23 bp, Homo sapiens
gcaaaacaggcagggctgatgac

SEQ ID NO: 25052 - DNA, 20 bp, Homo sapiens
aggtaatacatagcccaata

SEQ ID NO: 25053 - DNA, 22 bp, Homo sapiens
agacaaaacacagctcagtgac

SEQ ID NO: 25054 - DNA, 19 bp, Homo sapiens
aggcaaagctagtgaatga

SEQ ID NO: 25055 - DNA, 21 bp, Homo sapiens
aggcagatcgtctccaatgac

SEQ ID NO: 25056 - DNA, 23 bp, Homo sapiens
aggcaagagcaaacaccaatgac

SEQ ID NO: 25057 - DNA, 24 bp, Homo sapiens
ggccaaaacgtggattccaatgac

SEQ ID NO: 25058 - DNA, 23 bp, Homo sapiens
aagcaaaacaaaagcccagtgac

SEQ ID NO: 25059 - DNA, 20 bp, Homo sapiens
ggcaaaacatagataaatga

SEQ ID NO: 25060 - DNA, 26 bp, Homo sapiens
aggcaaaacgaagcccacaccaatga

SEQ ID NO: 25061 - DNA, 19 bp, Homo sapiens
aggtcaaaatcaccaatga

SEQ ID NO: 25062 - DNA, 21 bp, Homo sapiens
gggaaaatgaacaccaatgac

SEQ ID NO: 25063 - DNA, 20 bp, Homo sapiens
ggcaggatgcagttacctga

SEQ ID NO: 25064 - DNA, 20 bp, Homo sapiens
gcaaaacaggggtcagtgac

SEQ ID NO: 25065 - DNA, 20 bp, Homo sapiens
aggaagataggataccaatg

SEQ ID NO: 25066 - DNA, 22 bp, Homo sapiens
aggcaaaacgtggtcgcccaga

SEQ ID NO: 25067 - DNA, 19 bp, Homo sapiens
gcaggatatctaccaatga

SEQ ID NO: 25068 - DNA, 23 bp, Homo sapiens
agcaggacacatccgccaatgac

SEQ ID NO: 25069 - DNA, 20 bp, Homo sapiens
ggccaggacagctactaatg

SEQ ID NO: 25070 - DNA, 20 bp, Homo sapiens
aggcaaaatataataaatga

SEQ ID NO: 25071 - DNA, 20 bp, Homo sapiens
aggtaaaacatagttactca

SEQ ID NO: 25072 - DNA, 23 bp, Homo sapiens
ggaaagacagaaccaccaatgac

SEQ ID NO: 25073 - DNA, 16 bp, Homo sapiens
ggcaaagccaccaatg

SEQ ID NO: 25074 - DNA, 23 bp, Homo sapiens
aggcaaaatgcatgagcaatgac

SEQ ID NO: 25075 - DNA, 20 bp, Homo sapiens
aagtaaaacatagtttgcca

SEQ ID NO: 25076 - DNA, 23 bp, Homo sapiens
gacagagtagagcagccaatgac

SEQ ID NO: 25077 - DNA, 106 bp, Meleagrid herpesvirus 1
ggatgtcgggggtttgaaaatataggaacatcgagactcaattttccagtatcccaagggagggggtagatggtgtctgtttcaaggtcgggctcaccgaatagcc

SEQ ID NO: 25078 - DNA, 24 bp, Meleagrid herpesvirus 1
actcaattttccagtatcccaagg

SEQ ID NO: 25079 - DNA, 25 bp, Homo sapiens
ctcagttttccagcatagctgcagg

SEQ ID NO: 25080 - DNA, 20 bp, Homo sapiens
ccaattttcctcttccaagg

SEQ ID NO: 25081 - DNA, 23 bp, Homo sapiens
ctcagtttcccaaatgggcaagg

SEQ ID NO: 25082 - DNA, 21 bp, Homo sapiens
ccaattttattactcccaagg

SEQ ID NO: 25083 - DNA, 24 bp, Homo sapiens
tcaatttttcaataccttttaagg

SEQ ID NO: 25084 - DNA, 25 bp, Homo sapiens
tcaatttctcatcgatttcccaagg

SEQ ID NO: 25085 - DNA, 24 bp, Homo sapiens
actgcagtttcatccatcccaagg

SEQ ID NO: 25086 - DNA, 22 bp, Homo sapiens
ctcagtttccagccagccaggg

SEQ ID NO: 25087 - DNA, 22 bp, Homo sapiens
tcaattttctctcgtcctcagg

SEQ ID NO: 25088 - DNA, 23 bp, Homo sapiens
cttaactttcctacaatccaggg

SEQ ID NO: 25089 - DNA, 25 bp, Homo sapiens
acttgcttttccagcaccagtaagg

SEQ ID NO: 25090 - DNA, 25 bp, Homo sapiens
tcaatttttgcagtgccctttgagg

SEQ ID NO: 25091 - DNA, 18 bp, Homo sapiens
ctcaattcccatttcaag

SEQ ID NO: 25092 - DNA, 25 bp, Homo sapiens
actcaatttgctacatctcccaggg

SEQ ID NO: 25093 - DNA, 17 bp, Homo sapiens
tcgatttcccatccaag

SEQ ID NO: 25094 - DNA, 18 bp, Homo sapiens
ttttccatactcccaagg

SEQ ID NO: 25095 - DNA, 20 bp, Homo sapiens
attttccagcagtcctgagg

SEQ ID NO: 25096 - DNA, 21 bp, Homo sapiens
atcctcattagtatcccaagg

SEQ ID NO: 25097 - DNA, 17 bp, Homo sapiens
tcaatcttccagagaag

SEQ ID NO: 25098 - DNA, 70 bp, Meleagrid herpesvirus 1
gccggcgctttctatctcaccgtagaatgcttcgtccacgattacgggcgtgacaattagaagtaccggt

SEQ ID NO: 25099 - DNA, 24 bp, Meleagrid herpesvirus 1
tctcaccgtagaatgcttcgtcca

SEQ ID NO: 25100 - DNA, 18 bp, Homo sapiens
caccttaaaatgctttgt

SEQ ID NO: 25101 - DNA, 20 bp, Homo sapiens
tcgccgtagaaggctcccca

SEQ ID NO: 25102 - DNA, 15 bp, Homo sapiens
tctcaccgagttgtc

SEQ ID NO: 25103 - DNA, 19 bp, Homo sapiens
tctcgccgcagggcgttcg

SEQ ID NO: 25104 - DNA, 18 bp, Homo sapiens
tctcaccgtaggatatct

SEQ ID NO: 25105 - DNA, 21 bp, Homo sapiens
tctcaccgtggagtgtggcca

SEQ ID NO: 25106 - DNA, 20 bp, Homo sapiens
cctcattgtagaatttttca

SEQ ID NO: 25107 - DNA, 65 bp, Meleagrid herpesvirus 1
catttttcacaccggaatcgagtaaaacataatatgcaaaaaatagttcgggtattgatataatg

SEQ ID NO: 25108 - DNA, 24 bp, Meleagrid herpesvirus 1
caccggaatcgagtaaaacataat

SEQ ID NO: 25109 - DNA, 21 bp, Homo sapiens
cacttggaattaaaacataat

SEQ ID NO: 25110 - DNA, 20 bp, Homo sapiens
ggaaagtaataaaacataat

SEQ ID NO: 25111 - DNA, 15 bp, Homo sapiens
ggagagaaaacataa

SEQ ID NO: 25112 - DNA, 22 bp, Homo sapiens
cacacgggtcacctaaaacata

SEQ ID NO: 25113 - DNA, 21 bp, Homo sapiens
cggacatttgtaaaacataat

SEQ ID NO: 25114 - DNA, 21 bp, Homo sapiens
cagaatttaatggaacataat

SEQ ID NO: 25115 - DNA, 68 bp, Paramecium bursaria Chlorella virus 1
cgcaatcgaacatttgtagcatttcatattctcgtagaataatgtgtctggcatgcaatgttgattcg

SEQ ID NO: 25116 - DNA, 24 bp, Paramecium bursaria Chlorella virus 1
tcgaacatttgtagcatttcatat

SEQ ID NO: 25117 - DNA, 17 bp, Homo sapiens
tcagacatttgtacact

SEQ ID NO: 25118 - DNA, 21 bp, Homo sapiens
tcaacatttctataatttcat

SEQ ID NO: 25119 - DNA, 17 bp, Homo sapiens
catcatacatttcatat

SEQ ID NO: 25120 - DNA, 19 bp, Homo sapiens
gaacatttccatttcatat

SEQ ID NO: 25121 - DNA, 18 bp, Homo sapiens
atttgtagtgtttcatat

SEQ ID NO: 25122 - DNA, 21 bp, Homo sapiens
tcaatatgaaacatttcatat

SEQ ID NO: 25123 - DNA, 20 bp, Homo sapiens
gaacactggcaatttcatat

SEQ ID NO: 25124 - DNA, 21 bp, Homo sapiens
gatgattttagcatttcatat

SEQ ID NO: 25125 - DNA, 21 bp, Homo sapiens
gagcatttgcagtatacatat

SEQ ID NO: 25126 - DNA, 76 bp, Human herpesvirus 1
cgcgtatcggcgtcccggcgcggcgagcgtctgacggtctgtctctggcggtcccgcgtcgggtcgtggatccgtg

SEQ ID NO: 25127 - DNA, 24 bp, Human herpesvirus 1
tggcggtcccgcgtcgggtcgtgg

SEQ ID NO: 25128 - DNA, 18 bp, Homo sapiens
tggcggctcgcgtcctgg

SEQ ID NO: 25129 - DNA, 23 bp, Homo sapiens
tggtgattcttatctggtcgtgg

SEQ ID NO: 25130 - DNA, 21 bp, Homo sapiens
tggaggtcccgcggcgtgtgg

SEQ ID NO: 25131 - DNA, 26 bp, Homo sapiens
tggcggtcgctgcctcgctgtcgtgg

SEQ ID NO: 25132 - DNA, 16 bp, Homo sapiens
tggtggtcccacgtgt

SEQ ID NO: 25133 - DNA, 66 bp, Sheep astrovirus
gtttggggcccagaggcttatgtgaagtcatttgaaaaatttgattttgctgaccctgacccaaac

SEQ ID NO: 25134 - DNA, 22 bp, Sheep astrovirus
ttttgctgaccctgacccaaac

SEQ ID NO: 25135 - DNA, 19 bp, Homo sapiens
ttttgctgttgacctgaac

SEQ ID NO: 25136 - DNA, 18 bp, Homo sapiens
tttgtgttctgacccaaa

SEQ ID NO: 25137 - DNA, 19 bp, Homo sapiens
ttttgctgaactaaacaaa

SEQ ID NO: 25138 - DNA, 20 bp, Homo sapiens
tcttgctgattttgcaccca

SEQ ID NO: 25139 - DNA, 17 bp, Homo sapiens
tcttgctatgtgaccca

SEQ ID NO: 25140 - DNA, 23 bp, Homo sapiens
ttttgcagcactttctgactcaa

SEQ ID NO: 25141 - DNA, 23 bp, Homo sapiens
ctttgctggcttcttcccggccc

SEQ ID NO: 25142 - DNA, 15 bp, Homo sapiens
ctttacccctgaccc

SEQ ID NO: 25143 - DNA, 19 bp, Homo sapiens
ctctttgatcctgacccaa

SEQ ID NO: 25144 - DNA, 19 bp, Homo sapiens
ttctgctgactcttccaaa

SEQ ID NO: 25145 - DNA, 18 bp, Homo sapiens
tttgctgacaccatcaaa

SEQ ID NO: 25146 - DNA, 18 bp, Homo sapiens
ttttgctgctcccccaaa

SEQ ID NO: 25147 - DNA, 17 bp, Homo sapiens
ttctgctgattctccca

SEQ ID NO: 25148 - DNA, 16 bp, Homo sapiens
ttttgctggatcccaa

SEQ ID NO: 25149 - DNA, 28 bp, Homo sapiens
ttttgctgtttttcaccccattcaaacg

SEQ ID NO: 25150 - DNA, 18 bp, Homo sapiens
ttgctattctgatccaaa

SEQ ID NO: 25151 - DNA, 20 bp, Homo sapiens
ttgctccaccttgacccaaa

SEQ ID NO: 25152 - DNA, 16 bp, Homo sapiens
ttttgctgaacacaaa

SEQ ID NO: 25153 - DNA, 20 bp, Homo sapiens
tcttgctgacaagaactcaa

SEQ ID NO: 25154 - DNA, 20 bp, Homo sapiens
ctttgctgactttggtaacc

SEQ ID NO: 25155 - DNA, 20 bp, Homo sapiens
tcttgctaatttggtccaaa

SEQ ID NO: 25156 - DNA, 19 bp, Homo sapiens
ctttgctgaccctggtcca

SEQ ID NO: 25157 - DNA, 20 bp, Homo sapiens
ttttcctgaccctaatccca

SEQ ID NO: 25158 - DNA, 22 bp, Homo sapiens
tcttgctggagtaatcctgacc

SEQ ID NO: 25159 - DNA, 18 bp, Homo sapiens
ttttgctgtccctacaaa

SEQ ID NO: 25160 - DNA, 17 bp, Homo sapiens
ttttactgacaaagcca

SEQ ID NO: 25161 - DNA, 18 bp, Homo sapiens
ctttgctggccctggccc

SEQ ID NO: 25162 - DNA, 19 bp, Homo sapiens
ttctgctggtgctcccaaa

SEQ ID NO: 25163 - DNA, 24 bp, Homo sapiens
ttctgctggtcttcaccgacaaac

SEQ ID NO: 25164 - DNA, 17 bp, Homo sapiens
tcttgctgccatccaaa

SEQ ID NO: 25165 - DNA, 20 bp, Homo sapiens
ttttgctgactttcccaaac

SEQ ID NO: 25166 - DNA, 22 bp, Homo sapiens
ctttgctggcccttagttcaaa

SEQ ID NO: 25167 - DNA, 23 bp, Homo sapiens
ttctgctgagaaggagcctggac

SEQ ID NO: 25168 - DNA, 18 bp, Homo sapiens
tcttgctgtcacccagac

SEQ ID NO: 25169 - DNA, 20 bp, Homo sapiens
ttttgctgagtactgcaaac

SEQ ID NO: 25170 - DNA, 15 bp, Homo sapiens
tcttgctgctgccca

SEQ ID NO: 25171 - DNA, 20 bp, Homo sapiens
tttgctgaccggtccgtcca

SEQ ID NO: 25172 - DNA, 20 bp, Homo sapiens
ctttgctgtcactacctgac

SEQ ID NO: 25173 - DNA, 19 bp, Homo sapiens
ttttgctgactctccagac

SEQ ID NO: 25174 - DNA, 21 bp, Homo sapiens
ttctgctggaagactgtccaa

SEQ ID NO: 25175 - DNA, 17 bp, Homo sapiens
ttttcctggcccaaccc

SEQ ID NO: 25176 - DNA, 16 bp, Homo sapiens
ttttctgaccccaccc

SEQ ID NO: 25177 - DNA, 20 bp, Homo sapiens
tcttgctgattccgttctga

SEQ ID NO: 25178 - DNA, 19 bp, Homo sapiens
tcttgctgagccacggccc

SEQ ID NO: 25179 - DNA, 18 bp, Homo sapiens
tttcgctgatctcccaaa

SEQ ID NO: 25180 - DNA, 20 bp, Homo sapiens
ttctgctggtttggccacaa

SEQ ID NO: 25181 - DNA, 18 bp, Homo sapiens
ttctgctgagcttccaaa

SEQ ID NO: 25182 - DNA, 19 bp, Homo sapiens
ttttgctaccaagattcaa

SEQ ID NO: 25183 - DNA, 18 bp, Homo sapiens
ttttgctgactctgcaaa

SEQ ID NO: 25184 - DNA, 19 bp, Homo sapiens
ttttgctacctactcccaa

SEQ ID NO: 25185 - DNA, 67 bp, Amsacta moorei entomopoxvirus
ataatattgaacatattttattgtatatattttaaaaatagctttataagatatgtgaaagttttat

SEQ ID NO: 25186 - DNA, 24 bp, Amsacta moorei entomopoxvirus
tattttattgtatatattttaaaa

SEQ ID NO: 25187 - DNA, 18 bp, Homo sapiens
tattgtacatattttaaa

SEQ ID NO: 25188 - DNA, 22 bp, Homo sapiens
tattttaattgtatatatatca

SEQ ID NO: 25189 - DNA, 25 bp, Homo sapiens
tattctattgcttacaattttaaaa

SEQ ID NO: 25190 - DNA, 18 bp, Homo sapiens
ttttattgtgtacatttt

SEQ ID NO: 25191 - DNA, 18 bp, Homo sapiens
ttttattgtactattcta

SEQ ID NO: 25192 - DNA, 23 bp, Homo sapiens
tactttattgtattttttttaaa

SEQ ID NO: 25193 - DNA, 25 bp, Homo sapiens
tattttattataagatattttaaaa

SEQ ID NO: 25194 - DNA, 27 bp, Homo sapiens
tactttataaagatatatattttaaaa

SEQ ID NO: 25195 - DNA, 21 bp, Homo sapiens
ttttattgtatatctttaaaa

SEQ ID NO: 25196 - DNA, 18 bp, Homo sapiens
cattatatatattttaaa

SEQ ID NO: 25197 - DNA, 101 bp, Fowlpox virus
ggtgtaataggtttaagacttctactaaaatatttaaaatttttatcatgtttatgtatttgtattctttctccatcgtacttaaactctacaattatacc

SEQ ID NO: 25198 - DNA, 24 bp, Fowlpox virus
taataggtttaagacttctactaa

SEQ ID NO: 25199 - DNA, 18 bp, Homo sapiens
taatagatttgactgcta

SEQ ID NO: 25200 - DNA, 18 bp, Homo sapiens
taataggcttatctgcta

SEQ ID NO: 25201 - DNA, 20 bp, Homo sapiens
ggtttaagaggtctctgcta

SEQ ID NO: 25202 - DNA, 21 bp, Homo sapiens
taggtttttgcattctactaa

SEQ ID NO: 25203 - DNA, 19 bp, Homo sapiens
taataggtgttaaggcttc

SEQ ID NO: 25204 - DNA, 17 bp, Homo sapiens
agttaagacttttacta

SEQ ID NO: 25205 - DNA, 17 bp, Homo sapiens
aataggtttaagattct

SEQ ID NO: 25206 - DNA, 17 bp, Homo sapiens
ataggtttaccactact

SEQ ID NO: 25207 - DNA, 67 bp, Fowlpox virus
ccagaacactttgtaacagtgcaccatttttcagattttgtatcgtagcatcccataagaaaactgg

SEQ ID NO: 25208 - DNA, 22 bp, Fowlpox virus
tagcatcccataagaaaactgg

SEQ ID NO: 25209 - DNA, 24 bp, Homo sapiens
taacatcctgtaagttctccctgg

SEQ ID NO: 25210 - DNA, 20 bp, Homo sapiens
tagcacccccagaaggctgg

SEQ ID NO: 25211 - DNA, 20 bp, Homo sapiens
tagcctttcaccaaaactgg

SEQ ID NO: 25212 - DNA, 18 bp, Homo sapiens
catcataaagaaaactgg

SEQ ID NO: 25213 - DNA, 17 bp, Homo sapiens
gcatcccataaatctgg

SEQ ID NO: 25214 - DNA, 18 bp, Homo sapiens
gcagccacaagaaactgg

SEQ ID NO: 25215 - DNA, 20 bp, Homo sapiens
cagctaggtaagaaaactgg

SEQ ID NO: 25216 - DNA, 20 bp, Homo sapiens
aacacacataagaaagttgg

SEQ ID NO: 25217 - DNA, 17 bp, Homo sapiens
tagcatccttaaggctg

SEQ ID NO: 25218 - DNA, 17 bp, Homo sapiens
gcatcccaaagtgctgg

SEQ ID NO: 25219 - DNA, 17 bp, Homo sapiens
gcaaacaagaaaactgg

SEQ ID NO: 25220 - DNA, 17 bp, Homo sapiens
cagcatccatgaaactg

SEQ ID NO: 25221 - DNA, 20 bp, Homo sapiens
gcatcacaagacaaaactgg

SEQ ID NO: 25222 - DNA, 20 bp, Homo sapiens
gcaccccacctagaggttgg

SEQ ID NO: 25223 - DNA, 16 bp, Homo sapiens
tagtatccaaaaactg

SEQ ID NO: 25224 - DNA, 20 bp, Homo sapiens
gcatcccaggaaaaggctgg

SEQ ID NO: 25225 - DNA, 18 bp, Homo sapiens
gcatggccagaaaactgg

SEQ ID NO: 25226 - DNA, 19 bp, Homo sapiens
ccacaagtgggaaaactgg

SEQ ID NO: 25227 - DNA, 21 bp, Homo sapiens
cagcatcccatttcccactgg

SEQ ID NO: 25228 - DNA, 20 bp, Homo sapiens
agcatcccatgggcacgtgg

SEQ ID NO: 25229 - DNA, 18 bp, Homo sapiens
cattccataagaaagctg

SEQ ID NO: 25230 - DNA, 16 bp, Homo sapiens
taacatcccagagctg

SEQ ID NO: 25231 - DNA, 21 bp, Homo sapiens
agcatccccccaaaaaactgg

SEQ ID NO: 25232 - DNA, 18 bp, Homo sapiens
gcctcccataagtgctgg

SEQ ID NO: 25233 - DNA, 19 bp, Homo sapiens
cagcatcccaagaagctgg

SEQ ID NO: 25234 - DNA, 70 bp, Fowlpox virus
tccaaagatcgttgtactacctgttctaaattattacataatttgaatattccataagcgtctttatgga

SEQ ID NO: 25235 - DNA, 24 bp, Fowlpox virus
gatcgttgtactacctgttctaaa

SEQ ID NO: 25236 - DNA, 21 bp, Homo sapiens
tcttgtgagatctgttctaaa

SEQ ID NO: 25237 - DNA, 19 bp, Homo sapiens
ttgtgagactgcctgttct

SEQ ID NO: 25238 - DNA, 17 bp, Homo sapiens
gttgtaccctgttttaa

SEQ ID NO: 25239 - DNA, 19 bp, Homo sapiens
gatgttgtgcttgctctaa

SEQ ID NO: 25240 - DNA, 20 bp, Homo sapiens
gcacccctacttgttctaaa

SEQ ID NO: 25241 - DNA, 20 bp, Homo sapiens
gatcgttgtctatttcttct

SEQ ID NO: 25242 - DNA, 75 bp, Fujinami sarcoma virus
gcggggccggagagcggcggggccggaggcgcggagggccgcggtgcgctgctgcgaaataaaagtcggctctgc

SEQ ID NO: 25243 - DNA, 24 bp, Fujinami sarcoma virus
tgcgctgctgcgaaataaaagtcg

SEQ ID NO: 25244 - DNA, 23 bp, Homo sapiens
tgcgctgctttgcctataaaagt

SEQ ID NO: 25245 - DNA, 24 bp, Homo sapiens
tgcggctgctgcgcggtgaggtcg

SEQ ID NO: 25246 - DNA, 86 bp, Fujinami sarcoma virus
tagtataactgaggggaccatggtatgtataggcgctaggcggggcttcggttgtacgcggttaggggtcccctcaggaagtagta

SEQ ID NO: 25247 - DNA, 24 bp, Fujinami sarcoma virus
taactgaggggaccatggtatgta

SEQ ID NO: 25248 - DNA, 18 bp, Homo sapiens
tgaggggacagtggtgtg

SEQ ID NO: 25249 - DNA, 20 bp, Homo sapiens
ctgaggggagtgcaaattgt

SEQ ID NO: 25250 - DNA, 18 bp, Homo sapiens
ctgaggggctggccctgt

SEQ ID NO: 25251 - DNA, 19 bp, Homo sapiens
ctgaggggatcagatggta

SEQ ID NO: 25252 - DNA, 16 bp, Homo sapiens
ctggggggtggtatgt

SEQ ID NO: 25253 - DNA, 18 bp, Homo sapiens
ctgaggggatccggctgt

SEQ ID NO: 25254 - DNA, 18 bp, Homo sapiens
ctgaggaggctggtgtgt

SEQ ID NO: 25255 - DNA, 22 bp, Homo sapiens
taactaagtgatcatggtatgt

SEQ ID NO: 25256 - DNA, 19 bp, Homo sapiens
ggggaatacagtggtatgt

SEQ ID NO: 25257 - DNA, 18 bp, Homo sapiens
tgatgggaggtggtatgt

SEQ ID NO: 25258 - DNA, 20 bp, Homo sapiens
actgaggggaccctgcttgt

SEQ ID NO: 25259 - DNA, 19 bp, Homo sapiens
gggtgacaacatggtgtgt

SEQ ID NO: 25260 - DNA, 18 bp, Homo sapiens
ctgggtggatcagtatgt

SEQ ID NO: 25261 - DNA, 18 bp, Homo sapiens
ccgaggggaccgggtgtg

SEQ ID NO: 25262 - DNA, 18 bp, Homo sapiens
taactgaggtgaccatgg

SEQ ID NO: 25263 - DNA, 88 bp, Tupaia herpesvirus
caccgtcgagcagtccgtcacccggtcgcggcgccgacgacggccgagtcgtcggagtctctcgccgacggggtcgtctgagacggtg

SEQ ID NO: 25264 - DNA, 24 bp, Tupaia herpesvirus
gagcagtccgtcacccggtcgcgg

SEQ ID NO: 25265 - DNA, 28 bp, Homo sapiens
gagcagtccatttttgtggccgcgaccg

SEQ ID NO: 25266 - DNA, 19 bp, Homo sapiens
gagctgtttattggtcgcg

SEQ ID NO: 25267 - DNA, 19 bp, Homo sapiens
gcggttgtcacagccgcgg

SEQ ID NO: 25268 - DNA, 17 bp, Homo sapiens
gagcggtctgatcgcgg

SEQ ID NO: 25269 - DNA, 18 bp, Homo sapiens
gagcagtcgtcgctcgca

SEQ ID NO: 25270 - DNA, 27 bp, Homo sapiens
gcagtccgctcactcgagccgcgaccg

SEQ ID NO: 25271 - DNA, 20 bp, Homo sapiens
gcggtctttacccagcctgg

SEQ ID NO: 25272 - DNA, 22 bp, Homo sapiens
cagtccgcacgctcggtcgcgg

SEQ ID NO: 25273 - DNA, 21 bp, Homo sapiens
gaggtcagacgctggtcgcgg

SEQ ID NO: 25274 - DNA, 21 bp, Homo sapiens
gctgtttgtcgccaaccacgg

SEQ ID NO: 25275 - DNA, 22 bp, Homo sapiens
gagcagtccttgcgttaagcgg

SEQ ID NO: 25276 - DNA, 18 bp, Homo sapiens
ggcagtcgctcggtcgcg

SEQ ID NO: 25277 - DNA, 21 bp, Homo sapiens
gagcagccgtcacctgcagca

SEQ ID NO: 25278 - DNA, 21 bp, Homo sapiens
gccgccgctgcctggtcgcgg

SEQ ID NO: 25279 - DNA, 108 bp, Tupaia herpesvirus
cccggtgcctggcctctttctctgtgattcacccaacgcccttgacggacctccatactcgttgtctctaccggtgaggctttcatctatttcgagaccgggcacggg

SEQ ID NO: 25280 - DNA, 24 bp, Tupaia herpesvirus
tgtgattcacccaacgcccttgac

SEQ ID NO: 25281 - DNA, 16 bp, Homo sapiens
tgtaattcataccctt

SEQ ID NO: 25282 - DNA, 17 bp, Homo sapiens
gtgattcacccgtcttg

SEQ ID NO: 25283 - DNA, 18 bp, Homo sapiens
tgtgatccacccgccttg

SEQ ID NO: 25284 - DNA, 18 bp, Homo sapiens
tgtgatccgcctgccttg

SEQ ID NO: 25285 - DNA, 23 bp, Homo sapiens
tgtgattcgtcctgcctgctgac

SEQ ID NO: 25286 - DNA, 19 bp, Homo sapiens
tgtatcacagtgcccttga

SEQ ID NO: 25287 - DNA, 21 bp, Homo sapiens
tgtgattcaccagcaggagac

SEQ ID NO: 25288 - DNA, 17 bp, Homo sapiens
gtgattcacccgccttg

SEQ ID NO: 25289 - DNA, 21 bp, Homo sapiens
tgtgattcacccactaaatga

SEQ ID NO: 25290 - DNA, 17 bp, Homo sapiens
gtgattcacccaccttg

SEQ ID NO: 25291 - DNA, 17 bp, Homo sapiens
tgtgatccaccctcttg

SEQ ID NO: 25292 - DNA, 21 bp, Homo sapiens
tgtgattcatccttcaccttg

SEQ ID NO: 25293 - DNA, 18 bp, Homo sapiens
tgtggtccacccaccttg

SEQ ID NO: 25294 - DNA, 19 bp, Homo sapiens
tgattcactcagccctgac

SEQ ID NO: 25295 - DNA, 18 bp, Homo sapiens
tgtgattcacccacctcg

SEQ ID NO: 25296 - DNA, 18 bp, Homo sapiens
tgtgatccgcccgccttg

SEQ ID NO: 25297 - DNA, 18 bp, Homo sapiens
tatgattcacgcttcttg

SEQ ID NO: 25298 - DNA, 22 bp, Homo sapiens
tgtgattcagattatgcctttg

SEQ ID NO: 25299 - DNA, 81 bp, Gallid herpesvirus 2
cccaaatagtttaaatggtgcaattcgtcaataaatgaaagtttcatgtcgtgtatttattgcatcatatcttaacaaggg

SEQ ID NO: 25300 - DNA, 24 bp, Gallid herpesvirus 2
gtgcaattcgtcaataaatgaaag

SEQ ID NO: 25301 - DNA, 18 bp, Homo sapiens
ttcatacagtaaatgaaa

SEQ ID NO: 25302 - DNA, 17 bp, Homo sapiens
gtgcaactcgggatgaa

SEQ ID NO: 25303 - DNA, 22 bp, Homo sapiens
gtgcagatcgctgcaatgaaag

SEQ ID NO: 25304 - DNA, 61 bp, Gallid herpesvirus 2
gggcagatcgtaagcattgccgaactcacatttaataaggcgaggctcgtgtgaagaaccc

SEQ ID NO: 25305 - DNA, 19 bp, Gallid herpesvirus 2
aggctcgtgtgaagaaccc

SEQ ID NO: 25306 - DNA, 19 bp, Homo sapiens
ggctttgcgaagagaaccc

SEQ ID NO: 25307 - DNA, 16 bp, Homo sapiens
aagctcgtggtgaccc

SEQ ID NO: 25308 - DNA, 19 bp, Homo sapiens
aggctggcgtgcggagccc

SEQ ID NO: 25309 - DNA, 18 bp, Homo sapiens
agtcgcgagtgaagaacc

SEQ ID NO: 25310 - DNA, 17 bp, Homo sapiens
aagcttgtaaagaaccc

SEQ ID NO: 25311 - DNA, 17 bp, Homo sapiens
aggtcagtgaagaaccc

SEQ ID NO: 25312 - DNA, 18 bp, Homo sapiens
aggcccgcggcggagccc

SEQ ID NO: 25313 - DNA, 20 bp, Homo sapiens
aggcatgtgaaatcgagaac

SEQ ID NO: 25314 - DNA, 20 bp, Homo sapiens
gactcgtgcaccatgagaac

SEQ ID NO: 25315 - DNA, 17 bp, Homo sapiens
ggctcgtggaggaaccc

SEQ ID NO: 25316 - DNA, 18 bp, Homo sapiens
ggcttttgtgaaaagccc

SEQ ID NO: 25317 - DNA, 16 bp, Homo sapiens
aagctcgcgcgaaccc

SEQ ID NO: 25318 - DNA, 18 bp, Homo sapiens
agctcacagatagaaccc

SEQ ID NO: 25319 - DNA, 20 bp, Homo sapiens
aggccagcatcggaggaccc

SEQ ID NO: 25320 - DNA, 20 bp, Homo sapiens
aggctgtggctggggaaccc

SEQ ID NO: 25321 - DNA, 16 bp, Homo sapiens
aggcccgggtggaacc

SEQ ID NO: 25322 - DNA, 16 bp, Homo sapiens
ggcgtgtaaaaaaccc

SEQ ID NO: 25323 - DNA, 16 bp, Homo sapiens
agactttaaagaaccc

SEQ ID NO: 25324 - DNA, 16 bp, Homo sapiens
aagctcaagaagaacc

SEQ ID NO: 25325 - DNA, 15 bp, Homo sapiens
aggctggaagaaccc

SEQ ID NO: 25326 - DNA, 18 bp, Homo sapiens
aggctcatgggaaagtcc

SEQ ID NO: 25327 - DNA, 19 bp, Homo sapiens
agccttgtgaagaagaacc

SEQ ID NO: 25328 - DNA, 16 bp, Homo sapiens
ggctcatgcgggaccc

SEQ ID NO: 25329 - DNA, 19 bp, Homo sapiens
agactcagacaagagaacc

SEQ ID NO: 25330 - DNA, 20 bp, Homo sapiens
ggcccacatgtgagggaccc

SEQ ID NO: 25331 - DNA, 20 bp, Homo sapiens
aggctcattgtgcagagccc

SEQ ID NO: 25332 - DNA, 18 bp, Homo sapiens
gaccgcaaagaagaaccc

SEQ ID NO: 25333 - DNA, 17 bp, Homo sapiens
aagcccatgaagagtcc

SEQ ID NO: 25334 - DNA, 19 bp, Homo sapiens
agcctgagcggaagaaccc

SEQ ID NO: 25335 - DNA, 17 bp, Homo sapiens
aggcgcgtgtgcaaccc

SEQ ID NO: 25336 - DNA, 16 bp, Homo sapiens
aggttcatgtgaaacc

SEQ ID NO: 25337 - DNA, 19 bp, Homo sapiens
agtttcggctgaagaaccc

SEQ ID NO: 25338 - DNA, 15 bp, Homo sapiens
ggcccgtgaaagccc

SEQ ID NO: 25339 - DNA, 17 bp, Homo sapiens
aggcccgtgggagaccc

SEQ ID NO: 25340 - DNA, 19 bp, Homo sapiens
ggctgcggtggaagggccc

SEQ ID NO: 25341 - DNA, 16 bp, Homo sapiens
aggataagaagaaccc

SEQ ID NO: 25342 - DNA, 16 bp, Homo sapiens
aggctgcgtaaaagcc

SEQ ID NO: 25343 - DNA, 17 bp, Homo sapiens
agacagcagaaggaccc

SEQ ID NO: 25344 - DNA, 18 bp, Homo sapiens
aggcggcgggaagaaccc

SEQ ID NO: 25345 - DNA, 19 bp, Homo sapiens
aggctcacggaggggaccc

SEQ ID NO: 25346 - DNA, 16 bp, Homo sapiens
ggctcgtggaaaaccc

SEQ ID NO: 25347 - DNA, 15 bp, Homo sapiens
aggcccgtgaagacc

SEQ ID NO: 25348 - DNA, 18 bp, Homo sapiens
aggctgtgtgaagagtcc

SEQ ID NO: 25349 - DNA, 20 bp, Homo sapiens
aggcttatgtgaagaagccc

SEQ ID NO: 25350 - DNA, 18 bp, Homo sapiens
aggcccgtgtggaggccc

SEQ ID NO: 25351 - DNA, 18 bp, Homo sapiens
agcagtgtagaagaaccc

SEQ ID NO: 25352 - DNA, 17 bp, Homo sapiens
agcgccacgaagagccc

SEQ ID NO: 25353 - DNA, 17 bp, Homo sapiens
aggcccatgaagggccc

SEQ ID NO: 25354 - DNA, 16 bp, Homo sapiens
gactcgcgcaggaccc

SEQ ID NO: 25355 - DNA, 18 bp, Homo sapiens
aggcccgtctgggagccc

SEQ ID NO: 25356 - DNA, 18 bp, Homo sapiens
aggcatgtgaaccagaac

SEQ ID NO: 25357 - DNA, 19 bp, Homo sapiens
aggctcatggaacagagcc

SEQ ID NO: 25358 - DNA, 20 bp, Homo sapiens
agacttgtgctgcagaatcc

SEQ ID NO: 25359 - DNA, 17 bp, Homo sapiens
aggcttggcaaaaaccc

SEQ ID NO: 25360 - DNA, 20 bp, Homo sapiens
aggcacgaaacatgaggacc

SEQ ID NO: 25361 - DNA, 18 bp, Homo sapiens
aggctggttcaagaaccc

SEQ ID NO: 25362 - DNA, 17 bp, Homo sapiens
aggctcgtggaaacacc

SEQ ID NO: 25363 - DNA, 16 bp, Homo sapiens
aggctctgaaaagccc

SEQ ID NO: 25364 - DNA, 18 bp, Homo sapiens
ggctcgtgctcgaagtcc

SEQ ID NO: 25365 - DNA, 18 bp, Homo sapiens
agcctgtgtgaagaaccc

SEQ ID NO: 25366 - DNA, 19 bp, Homo sapiens
agctcagccccaagagccc

SEQ ID NO: 25367 - DNA, 19 bp, Homo sapiens
aagctcatcttggaggacc

SEQ ID NO: 25368 - DNA, 19 bp, Homo sapiens
agctttacccaaagaaccc

SEQ ID NO: 25369 - DNA, 15 bp, Homo sapiens
ggcccagaagaaccc

SEQ ID NO: 25370 - DNA, 17 bp, Homo sapiens
agctcctggaagaaccc

SEQ ID NO: 25371 - DNA, 19 bp, Homo sapiens
agcccatgtggaggggccc

SEQ ID NO: 25372 - DNA, 17 bp, Homo sapiens
ggcccgtggagagaccc

SEQ ID NO: 25373 - DNA, 17 bp, Homo sapiens
agctcctgtaagaaccc

SEQ ID NO: 25374 - DNA, 18 bp, Homo sapiens
aggctcgtttgtgaaccc

SEQ ID NO: 25375 - DNA, 17 bp, Homo sapiens
ggctcgcggaaggaccc

SEQ ID NO: 25376 - DNA, 20 bp, Homo sapiens
aggctcggtgtagcagaccc

SEQ ID NO: 25377 - DNA, 15 bp, Homo sapiens
aggctcatagaaacc

SEQ ID NO: 25378 - DNA, 18 bp, Homo sapiens
ggctgctgctgaagaacc

SEQ ID NO: 25379 - DNA, 18 bp, Homo sapiens
ggcgcccgtgaagaatcc

SEQ ID NO: 25380 - DNA, 16 bp, Homo sapiens
agtctcagaagaaccc

SEQ ID NO: 25381 - DNA, 18 bp, Homo sapiens
agcgtcatctgaagaacc

SEQ ID NO: 25382 - DNA, 16 bp, Homo sapiens
aggctcatgaaagtcc

SEQ ID NO: 25383 - DNA, 86 bp, Human herpesvirus 5
gcccgtcgtcgtggagttggactacgaagatatcgatattactggcgaacggcagcgacttcggttccatctcagcggactcgggt

SEQ ID NO: 25384 - DNA, 24 bp, Human herpesvirus 5
acgaagatatcgatattactggcg

SEQ ID NO: 25385 - DNA, 17 bp, Homo sapiens
aagagccatattactgg

SEQ ID NO: 25386 - DNA, 94 bp, Human herpesvirus 5
ggtattcgtaaccagcatttgagtatacggttaatgtatcctggggaaaaaaatacacaacagctgttggattctgatttcagttgcgaacgtc

SEQ ID NO: 25387 - DNA, 24 bp, Human herpesvirus 5
tacacaacagctgttggattctga

SEQ ID NO: 25388 - DNA, 18 bp, Homo sapiens
cacagcagctgctttctg

SEQ ID NO: 25389 - DNA, 25 bp, Homo sapiens
tacataaaagctgtcaaagttttga

SEQ ID NO: 25390 - DNA, 16 bp, Homo sapiens
cacagcagctgtcctg

SEQ ID NO: 25391 - DNA, 19 bp, Homo sapiens
tacacagtagctgctatga

SEQ ID NO: 25392 - DNA, 20 bp, Homo sapiens
acagctaccttggattttga

SEQ ID NO: 25393 - DNA, 16 bp, Homo sapiens
aacagccaagattctg

SEQ ID NO: 25394 - DNA, 22 bp, Homo sapiens
tacacaatacatagaattctga

SEQ ID NO: 25395 - DNA, 23 bp, Homo sapiens
tgacaacagcttacatattttga

SEQ ID NO: 25396 - DNA, 23 bp, Homo sapiens
tacacaaataggcctgattctga

SEQ ID NO: 25397 - DNA, 18 bp, Homo sapiens
acaacaactgcattctga

SEQ ID NO: 25398 - DNA, 18 bp, Homo sapiens
caacagttaggattctga

SEQ ID NO: 25399 - DNA, 18 bp, Homo sapiens
tacacagagctgaatctg

SEQ ID NO: 25400 - DNA, 18 bp, Homo sapiens
agctcttgttggattctg

SEQ ID NO: 25401 - DNA, 23 bp, Homo sapiens
cacacagcagccacctgttctga

SEQ ID NO: 25402 - DNA, 19 bp, Homo sapiens
tacgcaacattaaattctg

SEQ ID NO: 25403 - DNA, 19 bp, Homo sapiens
taacaacagccttgttctg

SEQ ID NO: 25404 - DNA, 18 bp, Homo sapiens
cagcctgctggattctga

SEQ ID NO: 25405 - DNA, 19 bp, Homo sapiens
tacacaggcatggattctg

SEQ ID NO: 25406 - DNA, 21 bp, Homo sapiens
cacaatagaaaatgattctga

SEQ ID NO: 25407 - DNA, 19 bp, Homo sapiens
acagctgttaacattctga

SEQ ID NO: 25408 - DNA, 18 bp, Homo sapiens
cacagggccaggattctg

SEQ ID NO: 25409 - DNA, 18 bp, Homo sapiens
tactgacagctgtccctg

SEQ ID NO: 25410 - DNA, 19 bp, Homo sapiens
tacacatagctgactctga

SEQ ID NO: 25411 - DNA, 18 bp, Homo sapiens
acacagcagtcacttctg

SEQ ID NO: 25412 - DNA, 18 bp, Homo sapiens
acacaatagctgttatct

SEQ ID NO: 25413 - DNA, 21 bp, Homo sapiens
acagtggttgctgaaattctg

SEQ ID NO: 25414 - DNA, 18 bp, Homo sapiens
cagcagctgtcctccctg

SEQ ID NO: 25415 - DNA, 23 bp, Homo sapiens
tacatggcaggtgtaaatcctga

SEQ ID NO: 25416 - DNA, 69 bp, Porcine adenovirus A
gtcgccgctgccgtctcttcagcctcgtcctcctcctcctcgctgaccaggggcttggcacgcgcgcgc

SEQ ID NO: 25417 - DNA, 24 bp, Porcine adenovirus A
tgaccaggggcttggcacgcgcgc

SEQ ID NO: 25418 - DNA, 21 bp, Homo sapiens
aggctggcggggcgcgcgcgc

SEQ ID NO: 25419 - DNA, 20 bp, Homo sapiens
tgaccaggggctttgcaaac

SEQ ID NO: 25420 - DNA, 18 bp, Homo sapiens
ccggggctgcacgcgcgc

SEQ ID NO: 25421 - DNA, 20 bp, Homo sapiens
accaggggtttcagacgtgc

SEQ ID NO: 25422 - DNA, 21 bp, Homo sapiens
tggccgtgggcttggctcagc

SEQ ID NO: 25423 - DNA, 20 bp, Homo sapiens
tggccaggggcctgcggtgc

SEQ ID NO: 25424 - DNA, 20 bp, Homo sapiens
tgggcaggggcttggtgagc

SEQ ID NO: 25425 - DNA, 28 bp, Homo sapiens
tgattaagggcttgcagtgtgcgcgcgg

SEQ ID NO: 25426 - DNA, 22 bp, Homo sapiens
cggccggggagggcgcgcgcgc

SEQ ID NO: 25427 - DNA, 19 bp, Homo sapiens
tggccaggagcttggtggc

SEQ ID NO: 25428 - DNA, 22 bp, Homo sapiens
tgatcaggggctggtgacttgc

SEQ ID NO: 25429 - DNA, 22 bp, Homo sapiens
tggcctggggctggcggtgtgc

SEQ ID NO: 25430 - DNA, 18 bp, Homo sapiens
aggtgccggcacgtgcgc

SEQ ID NO: 25431 - DNA, 17 bp, Homo sapiens
gggggagacacgcgcgc

SEQ ID NO: 25432 - DNA, 17 bp, Homo sapiens
ccaggggcttggtgcgc

SEQ ID NO: 25433 - DNA, 19 bp, Homo sapiens
tgggcaggggcttctgcgc

SEQ ID NO: 25434 - DNA, 29 bp, Homo sapiens
cggccaggggcttggggtagccgcgcgcg

SEQ ID NO: 25435 - DNA, 17 bp, Homo sapiens
gaccaggggcttggcca

SEQ ID NO: 25436 - DNA, 61 bp, Porcine adenovirus A
tccgggggtagcaggccttctggaaagccttgagctgctcgaaggcctgctgcgccttgga

SEQ ID NO: 25437 - DNA, 24 bp, Porcine adenovirus A
tagcaggccttctggaaagccttg

SEQ ID NO: 25438 - DNA, 18 bp, Homo sapiens
tagtgggcttctggaaaa

SEQ ID NO: 25439 - DNA, 22 bp, Homo sapiens
aggttcgctctgggaagccttg

SEQ ID NO: 25440 - DNA, 22 bp, Homo sapiens
aggttcgctctggaaagccttg

SEQ ID NO: 25441 - DNA, 18 bp, Homo sapiens
ggcccacagaaagccttg

SEQ ID NO: 25442 - DNA, 17 bp, Homo sapiens
gcaggccccaaggcctt

SEQ ID NO: 25443 - DNA, 21 bp, Homo sapiens
cagtgggccttctggaaggcc

SEQ ID NO: 25444 - DNA, 17 bp, Homo sapiens
gcaggcctctggggagc

SEQ ID NO: 25445 - DNA, 15 bp, Homo sapiens
acaggcagaaagcct

SEQ ID NO: 25446 - DNA, 18 bp, Homo sapiens
ggcagttcagaaagcctt

SEQ ID NO: 25447 - DNA, 19 bp, Homo sapiens
cagcaggtcttgcagcctt

SEQ ID NO: 25448 - DNA, 20 bp, Homo sapiens
ggtagcttctggaagctttg

SEQ ID NO: 25449 - DNA, 20 bp, Homo sapiens
gcgggctcccccaggccttg

SEQ ID NO: 25450 - DNA, 23 bp, Homo sapiens
tagagggccccccagaggctttg

SEQ ID NO: 25451 - DNA, 17 bp, Homo sapiens
gggctcccaaagccttg

SEQ ID NO: 25452 - DNA, 18 bp, Homo sapiens
agtaggttgaaaagcctt

SEQ ID NO: 25453 - DNA, 15 bp, Homo sapiens
ggtctggaaagcctt

SEQ ID NO: 25454 - DNA, 20 bp, Homo sapiens
gcagggtggaggaagccttg

SEQ ID NO: 25455 - DNA, 21 bp, Homo sapiens
actgggccttctggggccctg

SEQ ID NO: 25456 - DNA, 20 bp, Homo sapiens
gggcttcaatggaagccttg

SEQ ID NO: 25457 - DNA, 18 bp, Homo sapiens
acaggccttggaggcttt

SEQ ID NO: 25458 - DNA, 65 bp, Melanoplus sanguinipes entomopoxvirus
aatactgatgttgcttttcttggaaataaactattggtttttaatactagcattgcatcattatt

SEQ ID NO: 25459 - DNA, 24 bp, Melanoplus sanguinipes entomopoxvirus
tgatgttgcttttcttggaaataa

SEQ ID NO: 25460 - DNA, 18 bp, Homo sapiens
tgctgttgcttttagaga

SEQ ID NO: 25461 - DNA, 20 bp, Homo sapiens
tgatgttgtttttcccagaa

SEQ ID NO: 25462 - DNA, 18 bp, Homo sapiens
tgatgttattttgaggaa

SEQ ID NO: 25463 - DNA, 17 bp, Homo sapiens
tgatttgctttcggtgg

SEQ ID NO: 25464 - DNA, 23 bp, Homo sapiens
taatgaattttttttggaaataa

SEQ ID NO: 25465 - DNA, 16 bp, Homo sapiens
gatgtgtcttggaaat

SEQ ID NO: 25466 - DNA, 19 bp, Homo sapiens
atgttgcttttctttttgg

SEQ ID NO: 25467 - DNA, 18 bp, Homo sapiens
gatctcttttttcttgga

SEQ ID NO: 25468 - DNA, 18 bp, Homo sapiens
tgtgttgctgttggaaat

SEQ ID NO: 25469 - DNA, 18 bp, Homo sapiens
tgatgttgtttgttcttg

SEQ ID NO: 25470 - DNA, 16 bp, Homo sapiens
tgttgctttcaaaata

SEQ ID NO: 25471 - DNA, 18 bp, Homo sapiens
tgatattgctttgaaata

SEQ ID NO: 25472 - DNA, 18 bp, Homo sapiens
tgatgttgtctttcatga

SEQ ID NO: 25473 - DNA, 20 bp, Homo sapiens
tgatgttggctttaccgagg

SEQ ID NO: 25474 - DNA, 21 bp, Homo sapiens
tgatgtgcaagctggaaataa

SEQ ID NO: 25475 - DNA, 21 bp, Homo sapiens
gatgtgaggggtcttggaaat

SEQ ID NO: 25476 - DNA, 19 bp, Homo sapiens
tgatgttgacaggcttgga

SEQ ID NO: 25477 - DNA, 21 bp, Homo sapiens
tgatgttgctcttcttcatgg

SEQ ID NO: 25478 - DNA, 18 bp, Homo sapiens
tgtgttgcttttgataga

SEQ ID NO: 25479 - DNA, 22 bp, Homo sapiens
tgaggtccctcttcttgggaat

SEQ ID NO: 25480 - DNA, 22 bp, Homo sapiens
tgcaatactttttttggaaata

SEQ ID NO: 25481 - DNA, 22 bp, Homo sapiens
tgttgttgacattttggaaata

SEQ ID NO: 25482 - DNA, 15 bp, Homo sapiens
taatgttgcttggaa

SEQ ID NO: 25483 - DNA, 23 bp, Homo sapiens
tgcaatacttttttttggaaata

SEQ ID NO: 25484 - DNA, 19 bp, Homo sapiens
tggagttgcttttctatgg

SEQ ID NO: 25485 - DNA, 16 bp, Homo sapiens
tgaagttgcttttgga

SEQ ID NO: 25486 - DNA, 19 bp, Homo sapiens
tggtattgctttttaatgg

SEQ ID NO: 25487 - DNA, 19 bp, Homo sapiens
tgatgtttttttctactgg

SEQ ID NO: 25488 - DNA, 20 bp, Homo sapiens
tgaagttgtgacttggaaat

SEQ ID NO: 25489 - DNA, 127 bp, Melanoplus sanguinipes entomopoxvirus
aattaaatttgtaaatatatttaatggtggtctttgttgttgattattttcaattggttctttaaaatatttttcaacattttgatttaaaattaaatttttcttatcatatatttcattattaatt

SEQ ID NO: 25490 - DNA, 24 bp, Melanoplus sanguinipes entomopoxvirus
tatttaatggtggtctttgttgtt

SEQ ID NO: 25491 - DNA, 18 bp, Homo sapiens
tagtagtgttttgttgtt

SEQ ID NO: 25492 - DNA, 18 bp, Homo sapiens
tttgatggtggttgtagt

SEQ ID NO: 25493 - DNA, 18 bp, Homo sapiens
tggtttttctttgttgtt

SEQ ID NO: 25494 - DNA, 20 bp, Homo sapiens
tttgatggtggtgaaatgtt

SEQ ID NO: 25495 - DNA, 65 bp, Citrus tristeza virus
gaaagaaatgtatcgttagaccacactttgagttcgggtgtggtcgtccgtaggcagagtctttt

SEQ ID NO: 25496 - DNA, 24 bp, Citrus tristeza virus
tgtggtcgtccgtaggcagagtct

SEQ ID NO: 25497 - DNA, 19 bp, Homo sapiens
gtggggatgggcagagtct

SEQ ID NO: 25498 - DNA, 17 bp, Homo sapiens
tggggtccaggcagagt

SEQ ID NO: 25499 - DNA, 24 bp, Homo sapiens
tgtagtcgtcatgctgtagagtct

SEQ ID NO: 25500 - DNA, 25 bp, Homo sapiens
tgtggtcgttgttgagacggagtct

SEQ ID NO: 25501 - DNA, 16 bp, Homo sapiens
tgtggccaggcagggt

SEQ ID NO: 25502 - DNA, 22 bp, Homo sapiens
tgtggcaatttaggcagagtct

SEQ ID NO: 25503 - DNA, 15 bp, Homo sapiens
tggtcaaggcagagt

SEQ ID NO: 25504 - DNA, 24 bp, Homo sapiens
tgtgtttgttttgagacagagtct

SEQ ID NO: 25505 - DNA, 24 bp, Homo sapiens
tgttgttgttttgagacagagtct

SEQ ID NO: 25506 - DNA, 63 bp, Equine herpesvirus 2
ggctgggtggaccccttggcgaacacgtgaggccccgcggcgcactgccacaggtccaccgcc

SEQ ID NO: 25507 - DNA, 24 bp, Equine herpesvirus 2
accccttggcgaacacgtgaggcc

SEQ ID NO: 25508 - DNA, 18 bp, Homo sapiens
ctgtgaaatacgtgaggc

SEQ ID NO: 25509 - DNA, 18 bp, Homo sapiens
accctctgggtgtgaggc

SEQ ID NO: 25510 - DNA, 18 bp, Homo sapiens
ccccttggtgattgtgaa

SEQ ID NO: 25511 - DNA, 19 bp, Homo sapiens
ttggcgaagcacctaggcc

SEQ ID NO: 25512 - DNA, 16 bp, Homo sapiens
ccttggcaacatgaag

SEQ ID NO: 25513 - DNA, 24 bp, Homo sapiens
cctgcgccgcgggtgcgtgaggcc

SEQ ID NO: 25514 - DNA, 19 bp, Homo sapiens
accccttggtgaccagcgc

SEQ ID NO: 25515 - DNA, 19 bp, Homo sapiens
ccatggtgaacacgaaacc

SEQ ID NO: 25516 - DNA, 17 bp, Homo sapiens
ccccttggggcagaggc

SEQ ID NO: 25517 - DNA, 18 bp, Homo sapiens
ttggctacatgaggggcc

SEQ ID NO: 25518 - DNA, 21 bp, Homo sapiens
cctctaggagcgtgtgaggcc

SEQ ID NO: 25519 - DNA, 17 bp, Homo sapiens
ccccttgggagcagacc

SEQ ID NO: 25520 - DNA, 17 bp, Homo sapiens
cccctcggcgggtgggg

SEQ ID NO: 25521 - DNA, 18 bp, Homo sapiens
ccccttggtggagcagac

SEQ ID NO: 25522 - DNA, 21 bp, Homo sapiens
ccccttaccccatgtggggcc

SEQ ID NO: 25523 - DNA, 17 bp, Homo sapiens
ccccctggcggtggggc

SEQ ID NO: 25524 - DNA, 19 bp, Homo sapiens
accccttggggtgaggggc

SEQ ID NO: 25525 - DNA, 19 bp, Homo sapiens
ccctggtgaacagataggg

SEQ ID NO: 25526 - DNA, 17 bp, Homo sapiens
accccttgcggacaagg

SEQ ID NO: 25527 - DNA, 20 bp, Homo sapiens
ccctggtgaacatgagggcc

SEQ ID NO: 25528 - DNA, 24 bp, Homo sapiens
ccttttggagagcaaatcctggcc

SEQ ID NO: 25529 - DNA, 23 bp, Homo sapiens
cttgttacaacgcacgtgaggcc

SEQ ID NO: 25530 - DNA, 22 bp, Homo sapiens
cccacttggcgggcgcgaagcc

SEQ ID NO: 25531 - DNA, 19 bp, Homo sapiens
actccttggcagacatgtg

SEQ ID NO: 25532 - DNA, 18 bp, Homo sapiens
cccttgggctcgtgaggc

SEQ ID NO: 25533 - DNA, 21 bp, Homo sapiens
cccttggcataatgtggggcc

SEQ ID NO: 25534 - DNA, 17 bp, Homo sapiens
ccccctggcgctggggc

SEQ ID NO: 25535 - DNA, 23 bp, Homo sapiens
ccccttggcgaaccacacgacgc

SEQ ID NO: 25536 - DNA, 24 bp, Homo sapiens
ccccttggtgacacaatcagaggc

SEQ ID NO: 25537 - DNA, 17 bp, Homo sapiens
cccttggcaacatcagc

SEQ ID NO: 25538 - DNA, 23 bp, Homo sapiens
accccttgcgcagcagtgaggcc

SEQ ID NO: 25539 - DNA, 18 bp, Homo sapiens
cctcttagtgaacacatg

SEQ ID NO: 25540 - DNA, 16 bp, Homo sapiens
actcctccacgtgagg

SEQ ID NO: 25541 - DNA, 16 bp, Homo sapiens
accccttgggaggagg

SEQ ID NO: 25542 - DNA, 19 bp, Homo sapiens
ccccttgggtgaacgtcgc

SEQ ID NO: 25543 - DNA, 21 bp, Homo sapiens
ccccttaggaagatgtggggc

SEQ ID NO: 25544 - DNA, 20 bp, Homo sapiens
ccctggcggaggcggaggcc

SEQ ID NO: 25545 - DNA, 18 bp, Homo sapiens
cccctcggcggacgtggc

SEQ ID NO: 25546 - DNA, 19 bp, Homo sapiens
cctgcgggcacgtgaggcc

SEQ ID NO: 25547 - DNA, 23 bp, Homo sapiens
cccttggcgaaatgccaggggcc

SEQ ID NO: 25548 - DNA, 16 bp, Homo sapiens
ccttggcagcgtgagg

SEQ ID NO: 25549 - DNA, 20 bp, Homo sapiens
cccctggcgggcgggcgggc

SEQ ID NO: 25550 - DNA, 15 bp, Homo sapiens
ttgggaacataaggc

SEQ ID NO: 25551 - DNA, 15 bp, Homo sapiens
cttggcaaaatgaga

SEQ ID NO: 25552 - DNA, 20 bp, Homo sapiens
actcctcggcgaacgtgagg

SEQ ID NO: 25553 - DNA, 19 bp, Homo sapiens
accccttggggaacagggc

SEQ ID NO: 25554 - DNA, 19 bp, Homo sapiens
ctggtggaacggcgaggcc

SEQ ID NO: 25555 - DNA, 20 bp, Homo sapiens
acccctcggtgaaggagagg

SEQ ID NO: 25556 - DNA, 21 bp, Homo sapiens
cctacacgggtgcgtgaggcc

SEQ ID NO: 25557 - DNA, 19 bp, Homo sapiens
ctgtggcgggagcgaggcc

SEQ ID NO: 25558 - DNA, 20 bp, Homo sapiens
ccttggcgaggccccgggcc

SEQ ID NO: 25559 - DNA, 20 bp, Homo sapiens
cccctggcccatgtggggcc

SEQ ID NO: 25560 - DNA, 23 bp, Homo sapiens
cccttggggcagcgtgtgaggcc

SEQ ID NO: 25561 - DNA, 17 bp, Homo sapiens
cttggcaaatgtgcagg

SEQ ID NO: 25562 - DNA, 26 bp, Homo sapiens
ccccttggcgggcttagggacaggcc

SEQ ID NO: 25563 - DNA, 20 bp, Homo sapiens
ccccctgggagctgtggggc

SEQ ID NO: 25564 - DNA, 22 bp, Homo sapiens
ccccttggagagaaagagggcc

SEQ ID NO: 25565 - DNA, 17 bp, Homo sapiens
cccttggcaacatcaag

SEQ ID NO: 25566 - DNA, 87 bp, Citrus tristeza virus
gatttcgtgctcgatttacctaaattgaatatacacgatacaatggtggtggtgggtaatcaaatcagacagttagaatacgtagtc

SEQ ID NO: 25567 - DNA, 24 bp, Citrus tristeza virus
ttgaatatacacgatacaatggtg

SEQ ID NO: 25568 - DNA, 23 bp, Homo sapiens
ttgaatatacataattgttagtg

SEQ ID NO: 25569 - DNA, 22 bp, Homo sapiens
ttgaatgtacacaatgtaacaa

SEQ ID NO: 25570 - DNA, 115 bp, Citrus tristeza virus
tctatctcaacacgttgatttacgtttagcagcggacaatcccgatctacgcgttggtctgcgttgggcagggatgtttgtgtactacggtgtttatcggtgtgttgttgataga

SEQ ID NO: 25571 - DNA, 24 bp, Citrus tristeza virus
tagcagcggacaatcccgatctac

SEQ ID NO: 25572 - DNA, 18 bp, Homo sapiens
tagcagcgcacagtctga

SEQ ID NO: 25573 - DNA, 20 bp, Homo sapiens
cagcagcattttctcggtct

SEQ ID NO: 25574 - DNA, 17 bp, Homo sapiens
gcagcggagaatcacta

SEQ ID NO: 25575 - DNA, 19 bp, Homo sapiens
gcagcggagggtcccccac

SEQ ID NO: 25576 - DNA, 21 bp, Homo sapiens
agcagcaacattcttggtcta

SEQ ID NO: 25577 - DNA, 76 bp, Citrus tristeza virus
tcattgtacaagaaacattgcatgaaagacgatgattattttaatcttatcttacctatgtttaattgtttaatga

SEQ ID NO: 25578 - DNA, 24 bp, Citrus tristeza virus
tacaagaaacattgcatgaaagac

SEQ ID NO: 25579 - DNA, 17 bp, Homo sapiens
aagaaaacatgaaggac

SEQ ID NO: 25580 - DNA, 22 bp, Homo sapiens
tacagcaaacaaatatgaaaga

SEQ ID NO: 25581 - DNA, 16 bp, Homo sapiens
cacaagaaactggaag

SEQ ID NO: 25582 - DNA, 18 bp, Homo sapiens
agaaacatgctggaaaga

SEQ ID NO: 25583 - DNA, 22 bp, Homo sapiens
tacgcagaatcttgtgaaagac

SEQ ID NO: 25584 - DNA, 18 bp, Homo sapiens
tacagaaacatctgaaga

SEQ ID NO: 25585 - DNA, 19 bp, Homo sapiens
aagaatcacagatgaaaga

SEQ ID NO: 25586 - DNA, 21 bp, Homo sapiens
tacaagaacaatgcagaagga

SEQ ID NO: 25587 - DNA, 20 bp, Homo sapiens
caggagacattctgaaagac

SEQ ID NO: 25588 - DNA, 17 bp, Homo sapiens
tacaagaaattacaaga

SEQ ID NO: 25589 - DNA, 20 bp, Homo sapiens
tacaagaaacacccagaaag

SEQ ID NO: 25590 - DNA, 20 bp, Homo sapiens
caagaaatattgcacagaag

SEQ ID NO: 25591 - DNA, 17 bp, Homo sapiens
aagaaacatttaaaaga

SEQ ID NO: 25592 - DNA, 22 bp, Homo sapiens
tacatgaaataatgcagaaaga

SEQ ID NO: 25593 - DNA, 18 bp, Homo sapiens
agaaacaccgcggaggac

SEQ ID NO: 25594 - DNA, 18 bp, Homo sapiens
tacaagaacatgggaaga

SEQ ID NO: 25595 - DNA, 20 bp, Homo sapiens
tacagagaaagcatgaaaga

SEQ ID NO: 25596 - DNA, 18 bp, Homo sapiens
tacaagaaatatagcaca

SEQ ID NO: 25597 - DNA, 23 bp, Homo sapiens
agaaacactaattgtatgaagga

SEQ ID NO: 25598 - DNA, 15 bp, Homo sapiens
acaagagcatgaaag

SEQ ID NO: 25599 - DNA, 17 bp, Homo sapiens
gaaacatttataaaaga

SEQ ID NO: 25600 - DNA, 17 bp, Homo sapiens
tacaggaaacattcata

SEQ ID NO: 25601 - DNA, 21 bp, Homo sapiens
agagatatttacataaaagac

SEQ ID NO: 25602 - DNA, 18 bp, Homo sapiens
tacaagaaatgttgcgtg

SEQ ID NO: 25603 - DNA, 22 bp, Homo sapiens
caagagaaccttagtgaaagac

SEQ ID NO: 25604 - DNA, 23 bp, Homo sapiens
taaagaaacattgttttaaagac

SEQ ID NO: 25605 - DNA, 24 bp, Homo sapiens
agaaacatggcacttgcgtgaaag

SEQ ID NO: 25606 - DNA, 17 bp, Homo sapiens
acaagaaacaagaaaga

SEQ ID NO: 25607 - DNA, 24 bp, Homo sapiens
tacaggaaacattgtcaagtgtga

SEQ ID NO: 25608 - DNA, 17 bp, Homo sapiens
acaagaaacatttctga

SEQ ID NO: 25609 - DNA, 22 bp, Homo sapiens
tacaaaaatgtttgcaaaagac

SEQ ID NO: 25610 - DNA, 20 bp, Homo sapiens
tacaaagcacgacatgaaag

SEQ ID NO: 25611 - DNA, 22 bp, Homo sapiens
tacaagaatataaaagaaagac

SEQ ID NO: 25612 - DNA, 20 bp, Homo sapiens
agaaacatttattgaaagac

SEQ ID NO: 25613 - DNA, 18 bp, Homo sapiens
gagacattgctatgaaga

SEQ ID NO: 25614 - DNA, 17 bp, Homo sapiens
cacaaggagcataaaag

SEQ ID NO: 25615 - DNA, 17 bp, Homo sapiens
taccagaaacattgctg

SEQ ID NO: 25616 - DNA, 24 bp, Homo sapiens
tacagaaaacatttcatttgaaag

SEQ ID NO: 25617 - DNA, 18 bp, Homo sapiens
caagggacactgaaagac

SEQ ID NO: 25618 - DNA, 19 bp, Homo sapiens
tacagaaacatgctgtaga

SEQ ID NO: 25619 - DNA, 21 bp, Homo sapiens
acaagaagtatcctgaaagac

SEQ ID NO: 25620 - DNA, 19 bp, Homo sapiens
caagagacaaatgaaagac

SEQ ID NO: 25621 - DNA, 17 bp, Homo sapiens
gaaacatcccaaaagac

SEQ ID NO: 25622 - DNA, 20 bp, Homo sapiens
tacaacttttgcatgaagga

SEQ ID NO: 25623 - DNA, 19 bp, Homo sapiens
agaaacataacacaaagac

SEQ ID NO: 25624 - DNA, 80 bp, Human herpesvirus 2
ggcccggcgctccacgccggggttcccggcggcggaaaagcgcgaccgccgccgggtcttgtcgcggccgggcccgggcc

SEQ ID NO: 25625 - DNA, 24 bp, Human herpesvirus 2
cgccgggtcttgtcgcggccgggc

SEQ ID NO: 25626 - DNA, 17 bp, Homo sapiens
cgccgggtgcggtcggg

SEQ ID NO: 25627 - DNA, 21 bp, Homo sapiens
gctggatcttgggtgctgggc

SEQ ID NO: 25628 - DNA, 17 bp, Homo sapiens
cgctgggtgtggccggg

SEQ ID NO: 25629 - DNA, 18 bp, Homo sapiens
cggcggggcgcggccggg

SEQ ID NO: 25630 - DNA, 16 bp, Homo sapiens
cgccgggctgggctgg

SEQ ID NO: 25631 - DNA, 20 bp, Homo sapiens
ccgggtccggacggccgggc

SEQ ID NO: 25632 - DNA, 20 bp, Homo sapiens
cgccgggtcttctccccggg

SEQ ID NO: 25633 - DNA, 23 bp, Homo sapiens
gccggggtctagaccggccgggc

SEQ ID NO: 25634 - DNA, 22 bp, Homo sapiens
cgccggggccggacggccgggc

SEQ ID NO: 25635 - DNA, 16 bp, Homo sapiens
gggctccgcggccggg

SEQ ID NO: 25636 - DNA, 22 bp, Homo sapiens
gcgggtcagccagtggccgggc

SEQ ID NO: 25637 - DNA, 20 bp, Homo sapiens
cgctgggtcttggttgcggc

SEQ ID NO: 25638 - DNA, 18 bp, Homo sapiens
cggggctcggggctgggc

SEQ ID NO: 25639 - DNA, 18 bp, Homo sapiens
cgccggcgcgcggccggg

SEQ ID NO: 25640 - DNA, 18 bp, Homo sapiens
cgctggatcacggctggg

SEQ ID NO: 25641 - DNA, 18 bp, Homo sapiens
cgtcggggcccggccggg

SEQ ID NO: 25642 - DNA, 16 bp, Homo sapiens
cgggtccccggccggg

SEQ ID NO: 25643 - DNA, 19 bp, Homo sapiens
cgccgagtctctggccggg

SEQ ID NO: 25644 - DNA, 16 bp, Homo sapiens
cgcggggcgcggccgg

SEQ ID NO: 25645 - DNA, 18 bp, Homo sapiens
cgcagggccgcggccggg

SEQ ID NO: 25646 - DNA, 19 bp, Homo sapiens
cctgggccttgcggttggg

SEQ ID NO: 25647 - DNA, 22 bp, Homo sapiens
cgccaggtccttggtggccggg

SEQ ID NO: 25648 - DNA, 21 bp, Homo sapiens
gccgggtctggagggctgggc

SEQ ID NO: 25649 - DNA, 22 bp, Homo sapiens
cgcgggccgagcgcggccgggc

SEQ ID NO: 25650 - DNA, 18 bp, Homo sapiens
gctggtggagcggccggg

SEQ ID NO: 25651 - DNA, 20 bp, Homo sapiens
gccgggacagctggctgggc

SEQ ID NO: 25652 - DNA, 23 bp, Homo sapiens
gcgcggggggcgcgcggccgggc

SEQ ID NO: 25653 - DNA, 24 bp, Homo sapiens
cgccggggccgagaccggccgggc

SEQ ID NO: 25654 - DNA, 15 bp, Homo sapiens
cgcgggcgcggccgg

SEQ ID NO: 25655 - DNA, 21 bp, Homo sapiens
cgtccggtcgccgcggttggg

SEQ ID NO: 25656 - DNA, 20 bp, Homo sapiens
cgccgggtcttgtctccccg

SEQ ID NO: 25657 - DNA, 23 bp, Homo sapiens
cctgggaagctgcgtggccgggc

SEQ ID NO: 25658 - DNA, 19 bp, Homo sapiens
cgccgggtttgttgctccg

SEQ ID NO: 25659 - DNA, 22 bp, Homo sapiens
cgccgggtctagttgtactggc

SEQ ID NO: 25660 - DNA, 19 bp, Homo sapiens
cgctgggtcttgtggtggc

SEQ ID NO: 25661 - DNA, 23 bp, Homo sapiens
cgccgggctgggcgcggccgggc

SEQ ID NO: 25662 - DNA, 18 bp, Homo sapiens
cgccggtccttggccggg

SEQ ID NO: 25663 - DNA, 18 bp, Homo sapiens
gccaggtctgcggttggg

SEQ ID NO: 25664 - DNA, 17 bp, Homo sapiens
gggcggcgtggccgggc

SEQ ID NO: 25665 - DNA, 18 bp, Homo sapiens
gctgagtcttgggctggg

SEQ ID NO: 25666 - DNA, 18 bp, Homo sapiens
gggtcttgggctctgggc

SEQ ID NO: 25667 - DNA, 20 bp, Homo sapiens
gcgggtcttgggagctgggc

SEQ ID NO: 25668 - DNA, 20 bp, Homo sapiens
cgctgggaccgcggctgggc

SEQ ID NO: 25669 - DNA, 18 bp, Homo sapiens
gccgggtcttttgctcgc

SEQ ID NO: 25670 - DNA, 22 bp, Homo sapiens
cgctggggttgcagggctgggc

SEQ ID NO: 25671 - DNA, 19 bp, Homo sapiens
gccgggtaagcggccgggc

SEQ ID NO: 25672 - DNA, 18 bp, Homo sapiens
ccgggtgtggtggccggg

SEQ ID NO: 25673 - DNA, 19 bp, Homo sapiens
gggcgcagcgcggccgggc

SEQ ID NO: 25674 - DNA, 88 bp, Human papillomavirus type 12
cagtttctgaagcaaaagcaaaagaggctatagggataatgctgcaattgcaatctctacagaagtctgagtatgcttcggagaactg

SEQ ID NO: 25675 - DNA, 24 bp, Human papillomavirus type 12
acagaagtctgagtatgcttcgga

SEQ ID NO: 25676 - DNA, 18 bp, Homo sapiens
cagagggctgagtatcgg

SEQ ID NO: 25677 - DNA, 18 bp, Homo sapiens
cagaagtttggcctttgg

SEQ ID NO: 25678 - DNA, 22 bp, Homo sapiens
acaaggtctgagcacttttggg

SEQ ID NO: 25679 - DNA, 18 bp, Homo sapiens
cagcagtctgagtgcggg

SEQ ID NO: 25680 - DNA, 22 bp, Homo sapiens
acagaagctgggcatgattggg

SEQ ID NO: 25681 - DNA, 24 bp, Homo sapiens
acagaagtctttaaggtgtttcgg

SEQ ID NO: 25682 - DNA, 22 bp, Homo sapiens
aaagtctgggtgaaggcctggg

SEQ ID NO: 25683 - DNA, 20 bp, Homo sapiens
agaagtcttacatgtttgga

SEQ ID NO: 25684 - DNA, 23 bp, Homo sapiens
gaagtctgagaaacaagtttgga

SEQ ID NO: 25685 - DNA, 19 bp, Homo sapiens
agaactctgcacactttgg

SEQ ID NO: 25686 - DNA, 21 bp, Homo sapiens
cagaagtctgtgctgggtcgg

SEQ ID NO: 25687 - DNA, 21 bp, Homo sapiens
gaaatctgggtagtgccagga

SEQ ID NO: 25688 - DNA, 20 bp, Homo sapiens
cagggatctgaatacttcgg

SEQ ID NO: 25689 - DNA, 23 bp, Homo sapiens
acaggagtttgagaccaccctgg

SEQ ID NO: 25690 - DNA, 21 bp, Homo sapiens
acggaggcctgagtgaccgga

SEQ ID NO: 25691 - DNA, 25 bp, Homo sapiens
cagaagtctgaggtcattgcttgga

SEQ ID NO: 25692 - DNA, 18 bp, Homo sapiens
gaagtctgaggacttggg

SEQ ID NO: 25693 - DNA, 20 bp, Homo sapiens
cagaagtctgcgttactgga

SEQ ID NO: 25694 - DNA, 23 bp, Homo sapiens
agagctctgagtaggcagtcgga

SEQ ID NO: 25695 - DNA, 21 bp, Homo sapiens
gaggtctgagcgcgcgaccgg

SEQ ID NO: 25696 - DNA, 63 bp, Gallid herpesvirus 3
aagcgcgatacaaatcgacatctggttttcgagacccgcgtttcgtaccgcatgccggcgctt

SEQ ID NO: 25697 - DNA, 22 bp, Gallid herpesvirus 3
ttcgtaccgcatgccggcgctt

SEQ ID NO: 25698 - DNA, 17 bp, Homo sapiens
ttctaccgcatggcact

SEQ ID NO: 25699 - DNA, 17 bp, Homo sapiens
ttcataccgcatgcact

SEQ ID NO: 25700 - DNA, 61 bp, Human papillomavirus type 12
ggggagaaaggggcggtagggggaagcgacgagaccgatcatcctccacctcccccacccc

SEQ ID NO: 25701 - DNA, 24 bp, Human papillomavirus type 12
atcatcctccacctcccccacccc

SEQ ID NO: 25702 - DNA, 28 bp, Homo sapiens
atcagcctccaccttaactgcccacccc

SEQ ID NO: 25703 - DNA, 25 bp, Homo sapiens
accatcctaagattttcccctgccc

SEQ ID NO: 25704 - DNA, 17 bp, Homo sapiens
atcatcctcgccacccc

SEQ ID NO: 25705 - DNA, 21 bp, Homo sapiens
tcaggctgtctcccccattcc

SEQ ID NO: 25706 - DNA, 24 bp, Homo sapiens
accagtctctgcctcccccatccc

SEQ ID NO: 25707 - DNA, 25 bp, Homo sapiens
atcaccctaggttctcccctgtccc

SEQ ID NO: 25708 - DNA, 21 bp, Homo sapiens
catcctccgcctcccgcgccc

SEQ ID NO: 25709 - DNA, 19 bp, Homo sapiens
catccttccacctcactcc

SEQ ID NO: 25710 - DNA, 22 bp, Homo sapiens
accattttccacctccagctcc

SEQ ID NO: 25711 - DNA, 19 bp, Homo sapiens
accatcctccccatccacc

SEQ ID NO: 25712 - DNA, 22 bp, Homo sapiens
tcatcttccacccccgccgccc

SEQ ID NO: 25713 - DNA, 20 bp, Homo sapiens
tcccccactcacctctccca

SEQ ID NO: 25714 - DNA, 17 bp, Homo sapiens
tcttcccctcccacccc

SEQ ID NO: 25715 - DNA, 22 bp, Homo sapiens
atcatccttttacttctacccc

SEQ ID NO: 25716 - DNA, 22 bp, Homo sapiens
atcaccctgtgttccttacccc

SEQ ID NO: 25717 - DNA, 25 bp, Homo sapiens
ccatcttccaccccaaagccgttcc

SEQ ID NO: 25718 - DNA, 17 bp, Homo sapiens
tctcctccactcacccc

SEQ ID NO: 25719 - DNA, 21 bp, Homo sapiens
tcacctcccaaaggccccacc

SEQ ID NO: 25720 - DNA, 18 bp, Homo sapiens
ccccaccctcccctaccc

SEQ ID NO: 25721 - DNA, 23 bp, Homo sapiens
tcatcctctaccagttccactcc

SEQ ID NO: 25722 - DNA, 23 bp, Homo sapiens
tcatttgccccctcccccactcc

SEQ ID NO: 25723 - DNA, 21 bp, Homo sapiens
atcatcctcgtcccttgtcca

SEQ ID NO: 25724 - DNA, 20 bp, Homo sapiens
catccagacctcccctgccc

SEQ ID NO: 25725 - DNA, 28 bp, Homo sapiens
atcatcctccctcctcagtctctgcccc

SEQ ID NO: 25726 - DNA, 21 bp, Homo sapiens
atcacccttccaccccattcc

SEQ ID NO: 25727 - DNA, 19 bp, Homo sapiens
atcatccccacttcttgcc

SEQ ID NO: 25728 - DNA, 21 bp, Homo sapiens
catgcctgccttccccacccc

SEQ ID NO: 25729 - DNA, 24 bp, Homo sapiens
accattaatactcttccccacccc

SEQ ID NO: 25730 - DNA, 15 bp, Homo sapiens
catccctcccccacc

SEQ ID NO: 25731 - DNA, 24 bp, Homo sapiens
atcatccttccatttcttgaatcc

SEQ ID NO: 25732 - DNA, 21 bp, Homo sapiens
cccggccccgcctcccccgcc

SEQ ID NO: 25733 - DNA, 18 bp, Homo sapiens
atcctccactcaggcccc

SEQ ID NO: 25734 - DNA, 21 bp, Homo sapiens
tcatcagccctcccccattcc

SEQ ID NO: 25735 - DNA, 19 bp, Homo sapiens
ccatcctcctcgctcgccc

SEQ ID NO: 25736 - DNA, 19 bp, Homo sapiens
accatccttgcctctgccc

SEQ ID NO: 25737 - DNA, 22 bp, Homo sapiens
tcatcctctgtctgtccattcc

SEQ ID NO: 25738 - DNA, 21 bp, Homo sapiens
accatccctttcctctatccc

SEQ ID NO: 25739 - DNA, 19 bp, Homo sapiens
tcacatccacctcccctac

SEQ ID NO: 25740 - DNA, 19 bp, Homo sapiens
atcatcctctacacttctc

SEQ ID NO: 25741 - DNA, 20 bp, Homo sapiens
catgccacctcctttgcccc

SEQ ID NO: 25742 - DNA, 23 bp, Homo sapiens
atcctttccctctcccccacccc

SEQ ID NO: 25743 - DNA, 16 bp, Homo sapiens
ctccccttcccacccc

SEQ ID NO: 25744 - DNA, 17 bp, Homo sapiens
tcgcctccacctccgcc

SEQ ID NO: 25745 - DNA, 21 bp, Homo sapiens
caccccccacttccctcaccc

SEQ ID NO: 25746 - DNA, 19 bp, Homo sapiens
cctctgcccctcccacccc

SEQ ID NO: 25747 - DNA, 18 bp, Homo sapiens
atcctcctccacttctcc

SEQ ID NO: 25748 - DNA, 19 bp, Homo sapiens
tcattctctcccccacccc

SEQ ID NO: 25749 - DNA, 22 bp, Homo sapiens
atcatcttcctggacccacccc

SEQ ID NO: 25750 - DNA, 21 bp, Homo sapiens
tcctcctccccacctcatccc

SEQ ID NO: 25751 - DNA, 19 bp, Homo sapiens
tcatcctccagtctgtccc

SEQ ID NO: 25752 - DNA, 23 bp, Homo sapiens
atcatcctcattccctttgtccc

SEQ ID NO: 25753 - DNA, 20 bp, Homo sapiens
tccccctccacctcccccac

SEQ ID NO: 25754 - DNA, 24 bp, Homo sapiens
atcaatgtgggtctcccccacccc

SEQ ID NO: 25755 - DNA, 21 bp, Homo sapiens
accatcctccccttctgtccc

SEQ ID NO: 25756 - DNA, 19 bp, Homo sapiens
tcatcctcccacctcagcc

SEQ ID NO: 25757 - DNA, 18 bp, Homo sapiens
atcctccatcccctcccc

SEQ ID NO: 25758 - DNA, 17 bp, Homo sapiens
catctcccttcccccac

SEQ ID NO: 25759 - DNA, 22 bp, Homo sapiens
tcatctcccacctcctctaccc

SEQ ID NO: 25760 - DNA, 18 bp, Homo sapiens
atcctccctgcccccacc

SEQ ID NO: 25761 - DNA, 21 bp, Homo sapiens
accattttccacctccacacc

SEQ ID NO: 25762 - DNA, 21 bp, Homo sapiens
tcatcctcttcctcctcttcc

SEQ ID NO: 25763 - DNA, 17 bp, Homo sapiens
tctctccatcccacccc

SEQ ID NO: 25764 - DNA, 20 bp, Homo sapiens
tcatcctccaccaccacccc

SEQ ID NO: 25765 - DNA, 21 bp, Homo sapiens
tcctcccacctctcctgctcc

SEQ ID NO: 25766 - DNA, 21 bp, Homo sapiens
atcagccttcccacccacccc

SEQ ID NO: 25767 - DNA, 20 bp, Homo sapiens
ccatcctcccacctctgccc

SEQ ID NO: 25768 - DNA, 24 bp, Homo sapiens
atcacctctccaagaccccacccc

SEQ ID NO: 25769 - DNA, 20 bp, Homo sapiens
atcctcctccaccacaccac

SEQ ID NO: 25770 - DNA, 23 bp, Homo sapiens
accatcctctaattctctgcccc

SEQ ID NO: 25771 - DNA, 21 bp, Homo sapiens
atctcctccataacccccacc

SEQ ID NO: 25772 - DNA, 24 bp, Homo sapiens
atcatttccacctccccacatccc

SEQ ID NO: 25773 - DNA, 22 bp, Homo sapiens
ccatcccttccttccctgttcc

SEQ ID NO: 25774 - DNA, 22 bp, Homo sapiens
tctcctttggccaacccacccc

SEQ ID NO: 25775 - DNA, 18 bp, Homo sapiens
tctcctcccctcccaccc

SEQ ID NO: 25776 - DNA, 24 bp, Homo sapiens
accattctcctgaacccccacccc

SEQ ID NO: 25777 - DNA, 17 bp, Homo sapiens
catcctcggccccaccc

SEQ ID NO: 25778 - DNA, 20 bp, Homo sapiens
atcatcctttctcttgcccc

SEQ ID NO: 25779 - DNA, 20 bp, Homo sapiens
ccttccccagaccccacccc

SEQ ID NO: 25780 - DNA, 18 bp, Homo sapiens
tcgcctccccgcccaccc

SEQ ID NO: 25781 - DNA, 21 bp, Homo sapiens
atcatccttcactctaaatcc

SEQ ID NO: 25782 - DNA, 22 bp, Homo sapiens
cattttccacaccccccacccc

SEQ ID NO: 25783 - DNA, 18 bp, Homo sapiens
cctctgcactcccacccc

SEQ ID NO: 25784 - DNA, 18 bp, Homo sapiens
tccttccttccccacccc

SEQ ID NO: 25785 - DNA, 22 bp, Homo sapiens
catccttaacaacccccacccc

SEQ ID NO: 25786 - DNA, 17 bp, Homo sapiens
catcctcctgccccacc

SEQ ID NO: 25787 - DNA, 22 bp, Homo sapiens
ccatcctctactttccccccac

SEQ ID NO: 25788 - DNA, 17 bp, Homo sapiens
atcctccagctctaccc

SEQ ID NO: 25789 - DNA, 20 bp, Homo sapiens
atcatgctccacctttgccc

SEQ ID NO: 25790 - DNA, 25 bp, Homo sapiens
atcacccttcatctcttaatgcccc

SEQ ID NO: 25791 - DNA, 23 bp, Homo sapiens
atcatccccatggcacctacccc

SEQ ID NO: 25792 - DNA, 20 bp, Homo sapiens
atcttcctccacactgctcc

SEQ ID NO: 25793 - DNA, 24 bp, Homo sapiens
catccatcctacctcccctatccc

SEQ ID NO: 25794 - DNA, 19 bp, Homo sapiens
tcaccctcacctctctgcc

SEQ ID NO: 25795 - DNA, 25 bp, Homo sapiens
atcatccctccgcctttcattgcca

SEQ ID NO: 25796 - DNA, 19 bp, Homo sapiens
atcctcctcatctccaccc

SEQ ID NO: 25797 - DNA, 21 bp, Homo sapiens
atcctcaggtccccttacccc

SEQ ID NO: 25798 - DNA, 18 bp, Homo sapiens
tctcctccacctccaccc

SEQ ID NO: 25799 - DNA, 18 bp, Homo sapiens
tcatctctccctcgcccc

SEQ ID NO: 25800 - DNA, 21 bp, Homo sapiens
accatccttttgctctacccc

SEQ ID NO: 25801 - DNA, 22 bp, Homo sapiens
tctcctctctctcccccactcc

SEQ ID NO: 25802 - DNA, 18 bp, Homo sapiens
tcctctccaccccacccc

SEQ ID NO: 25803 - DNA, 21 bp, Homo sapiens
tcacccccctccttctccacc

SEQ ID NO: 25804 - DNA, 22 bp, Homo sapiens
atcatccttaccgagctgtccc

SEQ ID NO: 25805 - DNA, 21 bp, Homo sapiens
atcactctccaccccttcgcc

SEQ ID NO: 25806 - DNA, 19 bp, Homo sapiens
tcgtcctccacccccgccc

SEQ ID NO: 25807 - DNA, 24 bp, Homo sapiens
catcctccaggccatttccacccc

SEQ ID NO: 25808 - DNA, 18 bp, Homo sapiens
catcctccttcccctcca

SEQ ID NO: 25809 - DNA, 21 bp, Homo sapiens
catcctccacccacacatccc

SEQ ID NO: 25810 - DNA, 21 bp, Homo sapiens
atcacctcccaaggcctcacc

SEQ ID NO: 25811 - DNA, 22 bp, Homo sapiens
cctcagcacacttcccctaccc

SEQ ID NO: 25812 - DNA, 21 bp, Homo sapiens
tcccggcgcctcccccgcccc

SEQ ID NO: 25813 - DNA, 18 bp, Homo sapiens
ctccccccctcccacccc

SEQ ID NO: 25814 - DNA, 21 bp, Homo sapiens
tcttcttcttcttccccaccc

SEQ ID NO: 25815 - DNA, 19 bp, Homo sapiens
tccccacctcccccattcc

SEQ ID NO: 25816 - DNA, 21 bp, Homo sapiens
atctctctcctcccccacccc

SEQ ID NO: 25817 - DNA, 19 bp, Homo sapiens
accattctccaccctgccc

SEQ ID NO: 25818 - DNA, 22 bp, Homo sapiens
atcctccagattctcccattcc

SEQ ID NO: 25819 - DNA, 24 bp, Homo sapiens
ccatcctcaatgggcctccacccc

SEQ ID NO: 25820 - DNA, 22 bp, Homo sapiens
atcacctcccaaaagccccacc

SEQ ID NO: 25821 - DNA, 23 bp, Homo sapiens
catcttatattctcccccacccc

SEQ ID NO: 25822 - DNA, 20 bp, Homo sapiens
atcatcttcatcactactcc

SEQ ID NO: 25823 - DNA, 21 bp, Homo sapiens
tcatcctctgtctccccttcc

SEQ ID NO: 25824 - DNA, 20 bp, Homo sapiens
atcacctccctacctcatcc

SEQ ID NO: 25825 - DNA, 20 bp, Homo sapiens
tcatcctccatctttcatcc

SEQ ID NO: 25826 - DNA, 18 bp, Homo sapiens
atcttctgtcccccaccc

SEQ ID NO: 25827 - DNA, 21 bp, Homo sapiens
tcatccccattcccccactcc

SEQ ID NO: 25828 - DNA, 24 bp, Homo sapiens
accatcctctgtctctctccctac

SEQ ID NO: 25829 - DNA, 20 bp, Homo sapiens
tcatcctcgcttccttcacc

SEQ ID NO: 25830 - DNA, 20 bp, Homo sapiens
tcctctgacctccccattcc

SEQ ID NO: 25831 - DNA, 17 bp, Homo sapiens
tcatcccctcctccacc

SEQ ID NO: 25832 - DNA, 20 bp, Homo sapiens
atcctcctgactctccatcc

SEQ ID NO: 25833 - DNA, 19 bp, Homo sapiens
tcccctccaccttccccac

SEQ ID NO: 25834 - DNA, 18 bp, Homo sapiens
tcatcctcttccttcacc

SEQ ID NO: 25835 - DNA, 17 bp, Homo sapiens
tcatcccctccttcacc

SEQ ID NO: 25836 - DNA, 20 bp, Homo sapiens
atcattcctccctctacccc

SEQ ID NO: 25837 - DNA, 20 bp, Homo sapiens
atcaccccagtttcccaccc

SEQ ID NO: 25838 - DNA, 18 bp, Homo sapiens
accatcctttccccaccc

SEQ ID NO: 25839 - DNA, 22 bp, Homo sapiens
atcatccttacagctcctgtcc

SEQ ID NO: 25840 - DNA, 24 bp, Homo sapiens
atcctccacctcctcccccactcc

SEQ ID NO: 25841 - DNA, 18 bp, Homo sapiens
catcctaccttcccaccc

SEQ ID NO: 25842 - DNA, 18 bp, Homo sapiens
atcctcctctgcctcccc

SEQ ID NO: 25843 - DNA, 19 bp, Homo sapiens
tcatcttccacctcctgca

SEQ ID NO: 25844 - DNA, 23 bp, Homo sapiens
tcctccaccaccaggttcacccc

SEQ ID NO: 25845 - DNA, 24 bp, Homo sapiens
atcaccctcaagttctcccatccc

SEQ ID NO: 25846 - DNA, 19 bp, Homo sapiens
ccatcctccatagccatcc

SEQ ID NO: 25847 - DNA, 21 bp, Homo sapiens
cccccatgcctctctcatccc

SEQ ID NO: 25848 - DNA, 19 bp, Homo sapiens
ccatcctccactgcccacc

SEQ ID NO: 25849 - DNA, 22 bp, Homo sapiens
atcacctcccaaaggtcccacc

SEQ ID NO: 25850 - DNA, 21 bp, Homo sapiens
catcctccatctcctggtgcc

SEQ ID NO: 25851 - DNA, 19 bp, Homo sapiens
ccatcctcccctctctgcc

SEQ ID NO: 25852 - DNA, 22 bp, Homo sapiens
ccatctccaccttccttgctcc

SEQ ID NO: 25853 - DNA, 20 bp, Homo sapiens
catcgcccctcccccgttcc

SEQ ID NO: 25854 - DNA, 18 bp, Homo sapiens
tcatcctcactctgtccc

SEQ ID NO: 25855 - DNA, 21 bp, Homo sapiens
tccaagcaccttccccgtccc

SEQ ID NO: 25856 - DNA, 19 bp, Homo sapiens
tcttccactcaccccaccc

SEQ ID NO: 25857 - DNA, 21 bp, Homo sapiens
catcctccatgtcatccctac

SEQ ID NO: 25858 - DNA, 22 bp, Homo sapiens
tctcctccacccagagcgcccc

SEQ ID NO: 25859 - DNA, 22 bp, Homo sapiens
atcctccagcttcctccgcccc

SEQ ID NO: 25860 - DNA, 19 bp, Homo sapiens
tcctcctccaccttctgcc

SEQ ID NO: 25861 - DNA, 21 bp, Homo sapiens
tctggccccgcctcccccgcc

SEQ ID NO: 25862 - DNA, 19 bp, Homo sapiens
atcatcctgcatcaggcac

SEQ ID NO: 25863 - DNA, 17 bp, Homo sapiens
ccatccccctcccccac

SEQ ID NO: 25864 - DNA, 24 bp, Homo sapiens
atcatcctgttatccaaccgtccc

SEQ ID NO: 25865 - DNA, 18 bp, Homo sapiens
tctcccacctcccccacc

SEQ ID NO: 25866 - DNA, 22 bp, Homo sapiens
atcatcctttccatcctgcccc

SEQ ID NO: 25867 - DNA, 24 bp, Homo sapiens
catcctcccacaggcccctgcccc

SEQ ID NO: 25868 - DNA, 23 bp, Homo sapiens
atcatcctcccgcaccctgctcc

SEQ ID NO: 25869 - DNA, 18 bp, Homo sapiens
cattttccaccccacccc

SEQ ID NO: 25870 - DNA, 63 bp, Human papillomavirus type 12
tggctggagatagcactgagcgtctaggcaggcccagaatgctcattagctttacttcaacta

SEQ ID NO: 25871 - DNA, 24 bp, Human papillomavirus type 12
tagcactgagcgtctaggcaggcc

SEQ ID NO: 25872 - DNA, 21 bp, Homo sapiens
gcattgtagaagtaggcaggc

SEQ ID NO: 25873 - DNA, 19 bp, Homo sapiens
cactggggctacaggcagg

SEQ ID NO: 25874 - DNA, 19 bp, Homo sapiens
gcgctgagccgggcaggcc

SEQ ID NO: 25875 - DNA, 20 bp, Homo sapiens
acattgaggctgggcaggcc

SEQ ID NO: 25876 - DNA, 20 bp, Homo sapiens
gcgttgaacgtctcctggcc

SEQ ID NO: 25877 - DNA, 21 bp, Homo sapiens
acactgagactcaggcaggcc

SEQ ID NO: 25878 - DNA, 19 bp, Homo sapiens
ctgagcgtctaggaagacc

SEQ ID NO: 25879 - DNA, 21 bp, Homo sapiens
gcactgagtggggagcgggcc

SEQ ID NO: 25880 - DNA, 18 bp, Homo sapiens
gcctagagtttaggcagg

SEQ ID NO: 25881 - DNA, 21 bp, Homo sapiens
gcattgagcaggcctggcggg

SEQ ID NO: 25882 - DNA, 21 bp, Homo sapiens
cactgcaatcttaggcaggcc

SEQ ID NO: 25883 - DNA, 22 bp, Homo sapiens
gctgctgagggcagaaggcggg

SEQ ID NO: 25884 - DNA, 21 bp, Homo sapiens
cagcactgggtgtccagggcc

SEQ ID NO: 25885 - DNA, 18 bp, Homo sapiens
gcgctggttgaggcaggc

SEQ ID NO: 25886 - DNA, 22 bp, Homo sapiens
gcactggctgtgctggcaggcc

SEQ ID NO: 25887 - DNA, 21 bp, Homo sapiens
gcgctgggctgggagcaggcc

SEQ ID NO: 25888 - DNA, 18 bp, Homo sapiens
cagcactggtgaggcagg

SEQ ID NO: 25889 - DNA, 20 bp, Homo sapiens
gcgcgagcagaaagcaggcc

SEQ ID NO: 25890 - DNA, 22 bp, Homo sapiens
cagcactgggcctgggcaggcc

SEQ ID NO: 25891 - DNA, 17 bp, Homo sapiens
gcatcatctgggcaggc

SEQ ID NO: 25892 - DNA, 19 bp, Homo sapiens
gctctgaggcaggcaggcc

SEQ ID NO: 25893 - DNA, 19 bp, Homo sapiens
cagcactagctgggcaggc

SEQ ID NO: 25894 - DNA, 16 bp, Homo sapiens
gccctggcaggcaggc

SEQ ID NO: 25895 - DNA, 19 bp, Homo sapiens
gcgctgagcagagcaggcc

SEQ ID NO: 25896 - DNA, 17 bp, Homo sapiens
cacagtctgggcaggcc

SEQ ID NO: 25897 - DNA, 22 bp, Homo sapiens
gcctggggcaggcaggtaggcc

SEQ ID NO: 25898 - DNA, 19 bp, Homo sapiens
gcactggggtgggcaggcc

SEQ ID NO: 25899 - DNA, 21 bp, Homo sapiens
cagcactgggtggaacaggcc

SEQ ID NO: 25900 - DNA, 20 bp, Homo sapiens
tagcatgacatccaggtggg

SEQ ID NO: 25901 - DNA, 21 bp, Homo sapiens
agtgctgagcgtctttagggc

SEQ ID NO: 25902 - DNA, 22 bp, Homo sapiens
gcgctgaacgtgcccacgggcc

SEQ ID NO: 25903 - DNA, 23 bp, Homo sapiens
cagcactgggtgttttcctgggg

SEQ ID NO: 25904 - DNA, 21 bp, Homo sapiens
gcctgagcgtccttgagggcc

SEQ ID NO: 25905 - DNA, 22 bp, Homo sapiens
gccctgaggtgaggggcaggcc

SEQ ID NO: 25906 - DNA, 24 bp, Homo sapiens
agcactgagtgtttttattacagg

SEQ ID NO: 25907 - DNA, 22 bp, Homo sapiens
gcgctgagcgtgcccacgggcc

SEQ ID NO: 25908 - DNA, 20 bp, Homo sapiens
gcactgaagtcaggcaggcc

SEQ ID NO: 25909 - DNA, 21 bp, Homo sapiens
taacgctgagctgggcaggcc

SEQ ID NO: 25910 - DNA, 25 bp, Homo sapiens
tagaactgaacacttctgggcgggc

SEQ ID NO: 25911 - DNA, 17 bp, Homo sapiens
gccctacctaggcaggc

SEQ ID NO: 25912 - DNA, 71 bp, Ictalurid herpesvirus 1
ggatcaacatgtcactcaccagagcgtccacgtcctcgtggcagaactctctcggtaggaccacgggatcc

SEQ ID NO: 25913 - DNA, 24 bp, Ictalurid herpesvirus 1
tctctcggtaggaccacgggatcc

SEQ ID NO: 25914 - DNA, 18 bp, Homo sapiens
tctccgatctgcgggatc

SEQ ID NO: 25915 - DNA, 22 bp, Homo sapiens
tctctcggtggtgcagtggttc

SEQ ID NO: 25916 - DNA, 18 bp, Homo sapiens
tctctcggggaaggggtc

SEQ ID NO: 25917 - DNA, 23 bp, Homo sapiens
tctctcgggagggcctctggttc

SEQ ID NO: 25918 - DNA, 25 bp, Homo sapiens
ctttcatactagggctgtgggatcc

SEQ ID NO: 25919 - DNA, 20 bp, Homo sapiens
tctctcaggtagggccgcgg

SEQ ID NO: 25920 - DNA, 19 bp, Homo sapiens
tccggtaggatcagtagtc

SEQ ID NO: 25921 - DNA, 20 bp, Homo sapiens
cctcggtagggtcggcatcc

SEQ ID NO: 25922 - DNA, 19 bp, Homo sapiens
tctgtcggcccgcgggatc

SEQ ID NO: 25923 - DNA, 22 bp, Homo sapiens
tctttgggtgggagcaagatcc

SEQ ID NO: 25924 - DNA, 66 bp, Human papillomavirus type 83
taattgttattggccgggacgaagtgggattactgcttattattttaattctcatcgtaattatta

SEQ ID NO: 25925 - DNA, 24 bp, Human papillomavirus type 83
ttgttattggccgggacgaagtgg

SEQ ID NO: 25926 - DNA, 15 bp, Homo sapiens
ttgttattggcagtg

SEQ ID NO: 25927 - DNA, 21 bp, Homo sapiens
ttgttattgaggatggggtgg

SEQ ID NO: 25928 - DNA, 19 bp, Homo sapiens
tcgttattggttgggcatg

SEQ ID NO: 25929 - DNA, 22 bp, Homo sapiens
ttgttattggctggtgaggtgg

SEQ ID NO: 25930 - DNA, 79 bp, Lucerne transient streak virus
cctgtgagattgtttgtaaagaatgagccccaccctgccaacaaggtgcgggaagggcgctttagactaatctcatcgg

SEQ ID NO: 25931 - DNA, 24 bp, Lucerne transient streak virus
gattgtttgtaaagaatgagcccc

SEQ ID NO: 25932 - DNA, 18 bp, Homo sapiens
gattcctggggaatgagc

SEQ ID NO: 25933 - DNA, 17 bp, Homo sapiens
gattgtttgtgccaagc

SEQ ID NO: 25934 - DNA, 19 bp, Homo sapiens
ttgttgcacagatgagccc

SEQ ID NO: 25935 - DNA, 21 bp, Homo sapiens
tgcttaataagggatgagccc

SEQ ID NO: 25936 - DNA, 24 bp, Homo sapiens
gattgtttgctgaagatacaatcc

SEQ ID NO: 25937 - DNA, 19 bp, Homo sapiens
tgtttataaagggatgggc

SEQ ID NO: 25938 - DNA, 22 bp, Homo sapiens
gcttgtaaccagagtgagctcc

SEQ ID NO: 25939 - DNA, 17 bp, Homo sapiens
aattgtttgtgaagtcc

SEQ ID NO: 25940 - DNA, 19 bp, Homo sapiens
gtaggctcaagaatgagcc

SEQ ID NO: 25941 - DNA, 24 bp, Homo sapiens
attgtcctctgaagggtgagcccc

SEQ ID NO: 25942 - DNA, 17 bp, Homo sapiens
gactgtttaataatgag

SEQ ID NO: 25943 - DNA, 21 bp, Homo sapiens
ctgttgtgaggaatgagcccc

SEQ ID NO: 25944 - DNA, 21 bp, Homo sapiens
tgttggccaggaatgagctcc

SEQ ID NO: 25945 - DNA, 85 bp, Lucerne transient streak virus
tatttagatatctggaacaccctgacgactttgaggagttggcagtggaattgcagggttgtcagtggccgcggatatacaagta

SEQ ID NO: 25946 - DNA, 24 bp, Lucerne transient streak virus
tcagtggccgcggatatacaagta

SEQ ID NO: 25947 - DNA, 23 bp, Homo sapiens
tcagtggctgtattgaacaagta

SEQ ID NO: 25948 - DNA, 23 bp, Homo sapiens
tcagtaggcttcctatacaagta

SEQ ID NO: 25949 - DNA, 21 bp, Homo sapiens
tcagtagctggaactacaggt

SEQ ID NO: 25950 - DNA, 74 bp, Human papillomavirus type 30
gttgtaattggtacaacaaacatgtaatattgtattccacatgtaaatattattgtgtactatagttatacaac

SEQ ID NO: 25951 - DNA, 24 bp, Human papillomavirus type 30
tggtacaacaaacatgtaatattg

SEQ ID NO: 25952 - DNA, 24 bp, Homo sapiens
tggtacaatgcatgcatgttattg

SEQ ID NO: 25953 - DNA, 65 bp, Amsacta moorei entomopoxvirus
aatgattcaggagttataaaatttatgggccaattttcaaatgtttgtaatctttcagattcatt

SEQ ID NO: 25954 - DNA, 24 bp, Amsacta moorei entomopoxvirus
aaatgtttgtaatctttcagattc

SEQ ID NO: 25955 - DNA, 21 bp, Homo sapiens
gtttgatcctgtttcagattc

SEQ ID NO: 25956 - DNA, 23 bp, Homo sapiens
aaatgtttgataaggtacagatt

SEQ ID NO: 25957 - DNA, 16 bp, Homo sapiens
acgtttctttcagatt

SEQ ID NO: 25958 - DNA, 22 bp, Homo sapiens
aaatgtttggtagaaacagatt

SEQ ID NO: 25959 - DNA, 18 bp, Homo sapiens
aaatgtctgtagcagatt

SEQ ID NO: 25960 - DNA, 23 bp, Homo sapiens
gtcagaaataatttttcagattc

SEQ ID NO: 25961 - DNA, 21 bp, Homo sapiens
aaatggttgtttctcagattc

SEQ ID NO: 25962 - DNA, 18 bp, Homo sapiens
aaatgtatgtaatctttc

SEQ ID NO: 25963 - DNA, 22 bp, Homo sapiens
aaatgtttgtagtcaacagttc

SEQ ID NO: 25964 - DNA, 21 bp, Homo sapiens
aacgtcttcatttttcagatt

SEQ ID NO: 25965 - DNA, 17 bp, Homo sapiens
ttgttcttttcagattc

SEQ ID NO: 25966 - DNA, 20 bp, Homo sapiens
tgtttggattttttcagatt

SEQ ID NO: 25967 - DNA, 91 bp, Amsacta moorei entomopoxvirus
gacgatttgataaacgtggattgtgtcattactttttgaataaaatctttgccttttacaagtttaacataatcacatttatcaaaccatc

SEQ ID NO: 25968 - DNA, 24 bp, Amsacta moorei entomopoxvirus
tacaagtttaacataatcacattt

SEQ ID NO: 25969 - DNA, 23 bp, Homo sapiens
caagtttaagtgtatacacattt

SEQ ID NO: 25970 - DNA, 18 bp, Homo sapiens
caagacatagtcacattt

SEQ ID NO: 25971 - DNA, 17 bp, Homo sapiens
acaagtttattcacatt

SEQ ID NO: 25972 - DNA, 23 bp, Homo sapiens
caagtttacagttaattacattt

SEQ ID NO: 25973 - DNA, 18 bp, Homo sapiens
gttaactataatcacatt

SEQ ID NO: 25974 - DNA, 18 bp, Homo sapiens
tacaggcttaacaacatt

SEQ ID NO: 25975 - DNA, 19 bp, Homo sapiens
gtataacataaagcacatt

SEQ ID NO: 25976 - DNA, 18 bp, Homo sapiens
cttaacataatcacattt

SEQ ID NO: 25977 - DNA, 21 bp, Homo sapiens
tacaagtttaaaaatacattt

SEQ ID NO: 25978 - DNA, 20 bp, Homo sapiens
gcaggaccataatcacattt

SEQ ID NO: 25979 - DNA, 22 bp, Homo sapiens
cacaatgaacataattacattt

SEQ ID NO: 25980 - DNA, 111 bp, Bovine papillomavirus
gcacctaataaaaatcacttaatagcaatgtgctgtgtcagttgtttattggaaccacacccggtacacatcctgtccagcatttgcagtgcgtgcattgaattattgtgc

SEQ ID NO: 25981 - DNA, 24 bp, Bovine papillomavirus
tacacatcctgtccagcatttgca

SEQ ID NO: 25982 - DNA, 16 bp, Homo sapiens
tcctgtccagtttgca

SEQ ID NO: 25983 - DNA, 20 bp, Homo sapiens
acatcctgtctcccactgca

SEQ ID NO: 25984 - DNA, 16 bp, Homo sapiens
acattctggcatttgc

SEQ ID NO: 25985 - DNA, 17 bp, Homo sapiens
catcctgtcaggttgca

SEQ ID NO: 25986 - DNA, 29 bp, Homo sapiens
tacgtatcctgcctggggtgtgcaaatgc

SEQ ID NO: 25987 - DNA, 16 bp, Homo sapiens
acacattctcatttgc

SEQ ID NO: 25988 - DNA, 21 bp, Homo sapiens
cacatgcttgaaacatttgca

SEQ ID NO: 25989 - DNA, 19 bp, Homo sapiens
cacattttaacagcatttg

SEQ ID NO: 25990 - DNA, 18 bp, Homo sapiens
catcctgtccatcctgca

SEQ ID NO: 25991 - DNA, 22 bp, Homo sapiens
tacacatcctgttgatgaagca

SEQ ID NO: 25992 - DNA, 25 bp, Homo sapiens
cacacatcctgttttgtgtgcaaag

SEQ ID NO: 25993 - DNA, 25 bp, Homo sapiens
tacacatcttatcttgtatgcaaag

SEQ ID NO: 25994 - DNA, 18 bp, Homo sapiens
acatgtgctgacatttgc

SEQ ID NO: 25995 - DNA, 18 bp, Homo sapiens
tacactcctgaacatttg

SEQ ID NO: 25996 - DNA, 18 bp, Homo sapiens
catctttgtccatttgca

SEQ ID NO: 25997 - DNA, 21 bp, Homo sapiens
catctgtcacaagcatttgca

SEQ ID NO: 25998 - DNA, 20 bp, Homo sapiens
tacacatccgtctcctctgc

SEQ ID NO: 25999 - DNA, 17 bp, Homo sapiens
cacatgctaacatttgc

SEQ ID NO: 26000 - DNA, 18 bp, Homo sapiens
acacctagccagcatttg

SEQ ID NO: 26001 - DNA, 24 bp, Homo sapiens
tacacatcttgttctaagattgca

SEQ ID NO: 26002 - DNA, 22 bp, Homo sapiens
cacgtgtcttgcggcatttgca

SEQ ID NO: 26003 - DNA, 20 bp, Homo sapiens
tacacatctttctgcccgca

SEQ ID NO: 26004 - DNA, 25 bp, Homo sapiens
tacaacatcttgtccttcaattgca

SEQ ID NO: 26005 - DNA, 20 bp, Homo sapiens
atcctgtccacctctttgca

SEQ ID NO: 26006 - DNA, 61 bp, Bovine papillomavirus
ggctagacttcatggcgcctggcaccgaatcctgccttctcagcgaaaatgaataattgct

SEQ ID NO: 26007 - DNA, 22 bp, Bovine papillomavirus
tcagcgaaaatgaataattgct

SEQ ID NO: 26008 - DNA, 19 bp, Homo sapiens
ccagtgaaaatgaagtact

SEQ ID NO: 26009 - DNA, 19 bp, Homo sapiens
tcagcaaagtgatgacgct

SEQ ID NO: 26010 - DNA, 19 bp, Homo sapiens
tcagcgaaaatgctgtgct

SEQ ID NO: 26011 - DNA, 17 bp, Homo sapiens
agcaaaatgaatacagc

SEQ ID NO: 26012 - DNA, 18 bp, Homo sapiens
tcagcaaataaataattg

SEQ ID NO: 26013 - DNA, 19 bp, Homo sapiens
tcagcgaataaacccattg

SEQ ID NO: 26014 - DNA, 16 bp, Homo sapiens
tcagctgactaattgc

SEQ ID NO: 26015 - DNA, 20 bp, Homo sapiens
tcagctaaaatgaaacagcc

SEQ ID NO: 26016 - DNA, 19 bp, Homo sapiens
cagtgaaatactaattgct

SEQ ID NO: 26017 - DNA, 19 bp, Homo sapiens
gaacaaatgaatagttgct

SEQ ID NO: 26018 - DNA, 20 bp, Homo sapiens
ccagtgaaataaaaattgct

SEQ ID NO: 26019 - DNA, 21 bp, Homo sapiens
agtgaaaatgaaaaggttgct

SEQ ID NO: 26020 - DNA, 24 bp, Homo sapiens
tcagcaaaaaataatttggttgct

SEQ ID NO: 26021 - DNA, 19 bp, Homo sapiens
tcagcaaagatgcaatgct

SEQ ID NO: 26022 - DNA, 19 bp, Homo sapiens
tcagcaaaagtggataacc

SEQ ID NO: 26023 - DNA, 80 bp, Bovine papillomavirus
gtttccattgcgtctgggcttgtctatcattgcgtctctatggtttttggaggattagacggggccaccagtaatggtgc

SEQ ID NO: 26024 - DNA, 24 bp, Bovine papillomavirus
ggattagacggggccaccagtaat

SEQ ID NO: 26025 - DNA, 23 bp, Homo sapiens
ggattaaacgctaattcagtaat

SEQ ID NO: 26026 - DNA, 19 bp, Homo sapiens
ggattagatgggcttgagt

SEQ ID NO: 26027 - DNA, 19 bp, Homo sapiens
agatttgggctaccagtaa

SEQ ID NO: 26028 - DNA, 60 bp, Bovine papillomavirus
ccgccttaaactacagacaggtcccagccaagtaggcggatcaaaacctcaaaaaggcgg

SEQ ID NO: 26029 - DNA, 20 bp, Bovine papillomavirus
tcaaaacctcaaaaaggcgg

SEQ ID NO: 26030 - DNA, 22 bp, Homo sapiens
tcaaaaccctcaataccagtgg

SEQ ID NO: 26031 - DNA, 17 bp, Homo sapiens
ccaaaaccctgaggcgg

SEQ ID NO: 26032 - DNA, 19 bp, Homo sapiens
tcaagtcctcaaaaggtag

SEQ ID NO: 26033 - DNA, 18 bp, Homo sapiens
aaaacctcaaaatactgg

SEQ ID NO: 26034 - DNA, 15 bp, Homo sapiens
caaaacctcaagaca

SEQ ID NO: 26035 - DNA, 19 bp, Homo sapiens
tccaaacctcaaaaaaagg

SEQ ID NO: 26036 - DNA, 19 bp, Homo sapiens
tcaaaaccgtaaatcacgg

SEQ ID NO: 26037 - DNA, 18 bp, Homo sapiens
caaaaccttaaagactgg

SEQ ID NO: 26038 - DNA, 18 bp, Homo sapiens
tcaaaccccagagggcgg

SEQ ID NO: 26039 - DNA, 19 bp, Homo sapiens
tcaggaccccaaaacaagg

SEQ ID NO: 26040 - DNA, 18 bp, Homo sapiens
aaaccacaaaaaaggtgg

SEQ ID NO: 26041 - DNA, 17 bp, Homo sapiens
aaaacctcagcaagcgg

SEQ ID NO: 26042 - DNA, 19 bp, Homo sapiens
caaaaccttcaagaggtgg

SEQ ID NO: 26043 - DNA, 19 bp, Homo sapiens
caaaaaaaaaaaaaggcgg

SEQ ID NO: 26044 - DNA, 18 bp, Homo sapiens
aaagccccgaagaggcgg

SEQ ID NO: 26045 - DNA, 20 bp, Homo sapiens
tcagaacctcaaacaggggg

SEQ ID NO: 26046 - DNA, 18 bp, Homo sapiens
tcagcgacccaaaggcgg

SEQ ID NO: 26047 - DNA, 20 bp, Homo sapiens
tcagcacctcaaaaattagg

SEQ ID NO: 26048 - DNA, 17 bp, Homo sapiens
tcaaaaacctcaggagg

SEQ ID NO: 26049 - DNA, 17 bp, Homo sapiens
aaaactctcaaaggcgg

SEQ ID NO: 26050 - DNA, 19 bp, Homo sapiens
tcaagacctcaaaattcag

SEQ ID NO: 26051 - DNA, 68 bp, Human herpesvirus 2
ggagcagcagtggccgggggcccagacgggagtccgcgtcgccctggcgctcgtcgccgcctttgccc

SEQ ID NO: 26052 - DNA, 24 bp, Human herpesvirus 2
agtggccgggggcccagacgggag

SEQ ID NO: 26053 - DNA, 23 bp, Homo sapiens
agtggtttggggtccgacacgag

SEQ ID NO: 26054 - DNA, 16 bp, Homo sapiens
ggccgggggtcccggg

SEQ ID NO: 26055 - DNA, 17 bp, Homo sapiens
ggccgggggcggagggg

SEQ ID NO: 26056 - DNA, 19 bp, Homo sapiens
gcggccgggcgggggcggg

SEQ ID NO: 26057 - DNA, 19 bp, Homo sapiens
agggccgggggcccattgg

SEQ ID NO: 26058 - DNA, 22 bp, Homo sapiens
gtgaccgggggctcgccgccag

SEQ ID NO: 26059 - DNA, 16 bp, Homo sapiens
agggcccccagatggg

SEQ ID NO: 26060 - DNA, 17 bp, Homo sapiens
tggtcgggggcctcgag

SEQ ID NO: 26061 - DNA, 17 bp, Homo sapiens
agggctggggatacggg

SEQ ID NO: 26062 - DNA, 20 bp, Homo sapiens
ggccgggggccgctggggag

SEQ ID NO: 26063 - DNA, 22 bp, Homo sapiens
agtggccgaggggtcccagggg

SEQ ID NO: 26064 - DNA, 20 bp, Homo sapiens
aggggctgggtggaggtggg

SEQ ID NO: 26065 - DNA, 18 bp, Homo sapiens
ggctgggcgtgacgggag

SEQ ID NO: 26066 - DNA, 17 bp, Homo sapiens
ggccgggggccaggggg

SEQ ID NO: 26067 - DNA, 21 bp, Homo sapiens
gcggctggcctcggacgggag

SEQ ID NO: 26068 - DNA, 21 bp, Homo sapiens
aggggccgggggctgcgggag

SEQ ID NO: 26069 - DNA, 16 bp, Homo sapiens
gcggccgggagacggg

SEQ ID NO: 26070 - DNA, 19 bp, Homo sapiens
ggctgggaggggatgggag

SEQ ID NO: 26071 - DNA, 22 bp, Homo sapiens
tggccgggaatgggggtgggag

SEQ ID NO: 26072 - DNA, 18 bp, Homo sapiens
agaggttgggggacggga

SEQ ID NO: 26073 - DNA, 19 bp, Homo sapiens
gcggccggggccggtgggg

SEQ ID NO: 26074 - DNA, 24 bp, Homo sapiens
agtggctgggggctggttggtggg

SEQ ID NO: 26075 - DNA, 18 bp, Homo sapiens
agaggccgggggcgggga

SEQ ID NO: 26076 - DNA, 19 bp, Homo sapiens
agtggccgagtgtgatggg

SEQ ID NO: 26077 - DNA, 19 bp, Homo sapiens
agtggccaggggcctgcgg

SEQ ID NO: 26078 - DNA, 18 bp, Homo sapiens
agtggccaggggcttggg

SEQ ID NO: 26079 - DNA, 21 bp, Homo sapiens
gtggcggggcagggacgggag

SEQ ID NO: 26080 - DNA, 18 bp, Homo sapiens
gtgggcgggacgacggga

SEQ ID NO: 26081 - DNA, 21 bp, Homo sapiens
agcggccgcggtgggcgggag

SEQ ID NO: 26082 - DNA, 20 bp, Homo sapiens
agtggctgggggccctggcg

SEQ ID NO: 26083 - DNA, 17 bp, Homo sapiens
ggccggggagaggcggg

SEQ ID NO: 26084 - DNA, 17 bp, Homo sapiens
gtggccgggggcacggg

SEQ ID NO: 26085 - DNA, 18 bp, Homo sapiens
gtggtcaggggtcagggg

SEQ ID NO: 26086 - DNA, 18 bp, Homo sapiens
ggctgggggcccacgtgg

SEQ ID NO: 26087 - DNA, 18 bp, Homo sapiens
ggttgggggctaggggag

SEQ ID NO: 26088 - DNA, 19 bp, Homo sapiens
agtggccggggggccaggg

SEQ ID NO: 26089 - DNA, 19 bp, Homo sapiens
agctggcgcccggacggga

SEQ ID NO: 26090 - DNA, 19 bp, Homo sapiens
agtggctggcgggatcggg

SEQ ID NO: 26091 - DNA, 16 bp, Homo sapiens
ggccgggggccaggga

SEQ ID NO: 26092 - DNA, 17 bp, Homo sapiens
agtggccgggggccagg

SEQ ID NO: 26093 - DNA, 18 bp, Homo sapiens
agaggctgggggcccaga

SEQ ID NO: 26094 - DNA, 16 bp, Homo sapiens
ggccgggggcaggggg

SEQ ID NO: 26095 - DNA, 22 bp, Homo sapiens
gcggaccgagggcccaggtggg

SEQ ID NO: 26096 - DNA, 16 bp, Homo sapiens
agggccgggggcaggg

SEQ ID NO: 26097 - DNA, 20 bp, Homo sapiens
agaggccggagaaaggtggg

SEQ ID NO: 26098 - DNA, 19 bp, Homo sapiens
agtgccgggggcccggaca

SEQ ID NO: 26099 - DNA, 17 bp, Homo sapiens
gcggccggcagggcggg

SEQ ID NO: 26100 - DNA, 21 bp, Homo sapiens
agtgccgggggttcctccgga

SEQ ID NO: 26101 - DNA, 21 bp, Homo sapiens
aggggctgggggccaggggag

SEQ ID NO: 26102 - DNA, 22 bp, Homo sapiens
gtagctgggggccccgagggag

SEQ ID NO: 26103 - DNA, 20 bp, Homo sapiens
gtggccaggggtcttgggag

SEQ ID NO: 26104 - DNA, 20 bp, Homo sapiens
aggggtcgggggctgccggg

SEQ ID NO: 26105 - DNA, 18 bp, Homo sapiens
agggccggggggagcggg

SEQ ID NO: 26106 - DNA, 16 bp, Homo sapiens
ggccggggaggcggga

SEQ ID NO: 26107 - DNA, 17 bp, Homo sapiens
agtggccggaggccggg

SEQ ID NO: 26108 - DNA, 18 bp, Homo sapiens
gtcgccgggggttcggga

SEQ ID NO: 26109 - DNA, 20 bp, Homo sapiens
aggggctgggggctcagcca

SEQ ID NO: 26110 - DNA, 19 bp, Homo sapiens
aggggccgggggtccacag

SEQ ID NO: 26111 - DNA, 19 bp, Homo sapiens
aggggctgggggagctggg

SEQ ID NO: 26112 - DNA, 21 bp, Homo sapiens
ggcagagggctcaggcgggag

SEQ ID NO: 26113 - DNA, 20 bp, Homo sapiens
agtgctggggcgggagcggg

SEQ ID NO: 26114 - DNA, 25 bp, Homo sapiens
gtagctgggggcccggacacttggg

SEQ ID NO: 26115 - DNA, 19 bp, Homo sapiens
ggtcgggggaccctgggag

SEQ ID NO: 26116 - DNA, 22 bp, Homo sapiens
agggctgggggcctccagggag

SEQ ID NO: 26117 - DNA, 19 bp, Homo sapiens
agtggtggaccaggcggga

SEQ ID NO: 26118 - DNA, 23 bp, Homo sapiens
agtagccactttctggatgggag

SEQ ID NO: 26119 - DNA, 21 bp, Homo sapiens
gtgaccgggcggcggcgggag

SEQ ID NO: 26120 - DNA, 19 bp, Homo sapiens
gcggccgggggacctcggg

SEQ ID NO: 26121 - DNA, 19 bp, Homo sapiens
ggccgggggccgtgaggag

SEQ ID NO: 26122 - DNA, 16 bp, Homo sapiens
gcggccggagggcggg

SEQ ID NO: 26123 - DNA, 22 bp, Homo sapiens
gtggccggggtccccgagcggg

SEQ ID NO: 26124 - DNA, 97 bp, Amsacta moorei entomopoxvirus
ttatatcattacttacaaatgtatatagaatatttagaaaataataaaattattaaaggctattggataactatgaaattaaaagataatgatataa

SEQ ID NO: 26125 - DNA, 24 bp, Amsacta moorei entomopoxvirus
tagaatatttagaaaataataaaa

SEQ ID NO: 26126 - DNA, 19 bp, Homo sapiens
gaactacagaaaataataa

SEQ ID NO: 26127 - DNA, 18 bp, Homo sapiens
atacaagaaaataataaa

SEQ ID NO: 26128 - DNA, 96 bp, Gallid herpesvirus 3
gcctttctccggcaggtagcctacacgtacctcactatggccataaagatgcagccatagagaggtacgtgaagaagacccgtcggaatcagaagc

SEQ ID NO: 26129 - DNA, 24 bp, Gallid herpesvirus 3
tacacgtacctcactatggccata

SEQ ID NO: 26130 - DNA, 17 bp, Homo sapiens
catgcagtcactatggc

SEQ ID NO: 26131 - DNA, 19 bp, Homo sapiens
tacaatatactatggccat

SEQ ID NO: 26132 - DNA, 19 bp, Homo sapiens
tacagtgtcccctggccat

SEQ ID NO: 26133 - DNA, 19 bp, Homo sapiens
taacgtgtctcacagccat

SEQ ID NO: 26134 - DNA, 18 bp, Homo sapiens
acacgtacacgtggctat

SEQ ID NO: 26135 - DNA, 20 bp, Homo sapiens
tacacgtacctgccaccatg

SEQ ID NO: 26136 - DNA, 21 bp, Homo sapiens
tacatatactgccatggccat

SEQ ID NO: 26137 - DNA, 17 bp, Homo sapiens
cgtggtcccatggccat

SEQ ID NO: 26138 - DNA, 18 bp, Homo sapiens
tacaggtacctcatcatg

SEQ ID NO: 26139 - DNA, 18 bp, Homo sapiens
tacacgtgctcacgcatg

SEQ ID NO: 26140 - DNA, 23 bp, Homo sapiens
acacgtacttcagatctctcata

SEQ ID NO: 26141 - DNA, 21 bp, Homo sapiens
gcactgccacgcctggccata

SEQ ID NO: 26142 - DNA, 74 bp, Human herpesvirus 7
attatcaccttaatctcttcaggcgaacataaataactccagctgtgtacattctgaggatcggggtagataat

SEQ ID NO: 26143 - DNA, 24 bp, Human herpesvirus 7
tacattctgaggatcggggtagat

SEQ ID NO: 26144 - DNA, 27 bp, Homo sapiens
tacattctgcaggattttggtgtggat

SEQ ID NO: 26145 - DNA, 18 bp, Homo sapiens
taattctgaatagggtag

SEQ ID NO: 26146 - DNA, 16 bp, Homo sapiens
ttctggaaggggtaga

SEQ ID NO: 26147 - DNA, 17 bp, Homo sapiens
ttctgagactagggtag

SEQ ID NO: 26148 - DNA, 19 bp, Homo sapiens
cattctgagggttaaagat

SEQ ID NO: 26149 - DNA, 64 bp, Gallid herpesvirus 3
gggttaaggcctcggggttagggtctcaggcggcgtttggcttaggggcccggggttaggacct

SEQ ID NO: 26150 - DNA, 21 bp, Gallid herpesvirus 3
aggggcccggggttaggacct

SEQ ID NO: 26151 - DNA, 19 bp, Homo sapiens
gaggcccaacccaggatct

SEQ ID NO: 26152 - DNA, 20 bp, Homo sapiens
aggggcccgccgaagggcct

SEQ ID NO: 26153 - DNA, 18 bp, Homo sapiens
ggggctcggggtagacct

SEQ ID NO: 26154 - DNA, 19 bp, Homo sapiens
ggggcccggaggcgctcct

SEQ ID NO: 26155 - DNA, 18 bp, Homo sapiens
agggtctggggtcggcct

SEQ ID NO: 26156 - DNA, 19 bp, Homo sapiens
aggggctgccccaggacct

SEQ ID NO: 26157 - DNA, 21 bp, Homo sapiens
aggagcccccagctggggcct

SEQ ID NO: 26158 - DNA, 20 bp, Homo sapiens
ggggcccggggaggcagcct

SEQ ID NO: 26159 - DNA, 17 bp, Homo sapiens
ggggctagggaagacct

SEQ ID NO: 26160 - DNA, 15 bp, Homo sapiens
aagggcccagggacc

SEQ ID NO: 26161 - DNA, 19 bp, Homo sapiens
aggatggaggggttaggac

SEQ ID NO: 26162 - DNA, 22 bp, Homo sapiens
gggacccggcggtggggggcct

SEQ ID NO: 26163 - DNA, 17 bp, Homo sapiens
agggcgcctgggctgac

SEQ ID NO: 26164 - DNA, 22 bp, Homo sapiens
aggggccggggccgctgggcct

SEQ ID NO: 26165 - DNA, 20 bp, Homo sapiens
agggcccgggaggacggcct

SEQ ID NO: 26166 - DNA, 19 bp, Homo sapiens
ggtggcccggggcgctcct

SEQ ID NO: 26167 - DNA, 21 bp, Homo sapiens
aggaggcctgggccacagcct

SEQ ID NO: 26168 - DNA, 19 bp, Homo sapiens
ggtggcctaaccaggacct

SEQ ID NO: 26169 - DNA, 16 bp, Homo sapiens
ggcggcccgaggggcc

SEQ ID NO: 26170 - DNA, 17 bp, Homo sapiens
aggggtccagccaagac

SEQ ID NO: 26171 - DNA, 21 bp, Homo sapiens
aggggccagggggacggatct

SEQ ID NO: 26172 - DNA, 19 bp, Homo sapiens
ggagcccggagctggacct

SEQ ID NO: 26173 - DNA, 18 bp, Homo sapiens
agggtcccagcagggcct

SEQ ID NO: 26174 - DNA, 21 bp, Homo sapiens
ggtggcccgcatgccgggcct

SEQ ID NO: 26175 - DNA, 20 bp, Homo sapiens
aggggccctaaaaagggcct

SEQ ID NO: 26176 - DNA, 17 bp, Homo sapiens
ggggcgcggcggggcct

SEQ ID NO: 26177 - DNA, 16 bp, Homo sapiens
ggggtccagagctgac

SEQ ID NO: 26178 - DNA, 18 bp, Homo sapiens
ggggcctaagcagggcct

SEQ ID NO: 26179 - DNA, 24 bp, Homo sapiens
aggggtcaggggctcggtggacct

SEQ ID NO: 26180 - DNA, 19 bp, Homo sapiens
aggggtcagggagcagcct

SEQ ID NO: 26181 - DNA, 19 bp, Homo sapiens
aggggccctggaatacagg

SEQ ID NO: 26182 - DNA, 19 bp, Homo sapiens
ggggccagggggccggcct

SEQ ID NO: 26183 - DNA, 18 bp, Homo sapiens
ggggccaggagactggga

SEQ ID NO: 26184 - DNA, 18 bp, Homo sapiens
aggaggcctggctgacct

SEQ ID NO: 26185 - DNA, 21 bp, Homo sapiens
aggggtctggagtggccacct

SEQ ID NO: 26186 - DNA, 15 bp, Homo sapiens
aggggccagggaacc

SEQ ID NO: 26187 - DNA, 19 bp, Homo sapiens
ggggctaggtttgggatct

SEQ ID NO: 26188 - DNA, 18 bp, Homo sapiens
ggggccaggggcaacgct

SEQ ID NO: 26189 - DNA, 18 bp, Homo sapiens
ggggcccagtggtggcct

SEQ ID NO: 26190 - DNA, 18 bp, Homo sapiens
aggggccggggctggcct

SEQ ID NO: 26191 - DNA, 18 bp, Homo sapiens
agggacccatgaggacct

SEQ ID NO: 26192 - DNA, 21 bp, Homo sapiens
ggggcccggccgtgggggcct

SEQ ID NO: 26193 - DNA, 18 bp, Homo sapiens
aggggtctgggggaacct

SEQ ID NO: 26194 - DNA, 19 bp, Homo sapiens
ggggccgggaagcggacct

SEQ ID NO: 26195 - DNA, 17 bp, Homo sapiens
ggggccagggccggcct

SEQ ID NO: 26196 - DNA, 21 bp, Homo sapiens
ggggtctggggggcagaacct

SEQ ID NO: 26197 - DNA, 20 bp, Homo sapiens
ggagccaagggttagggcct

SEQ ID NO: 26198 - DNA, 18 bp, Homo sapiens
aggggtccggaggactct

SEQ ID NO: 26199 - DNA, 17 bp, Homo sapiens
gggacccggggcagcct

SEQ ID NO: 26200 - DNA, 19 bp, Homo sapiens
aggaggtctggcaggacct

SEQ ID NO: 26201 - DNA, 20 bp, Homo sapiens
ggggcccgggccgcccgcct

SEQ ID NO: 26202 - DNA, 21 bp, Homo sapiens
aggggccccgggagctggcct

SEQ ID NO: 26203 - DNA, 17 bp, Homo sapiens
ggggccgggggcagcct

SEQ ID NO: 26204 - DNA, 15 bp, Homo sapiens
aggggcccgcaggcc

SEQ ID NO: 26205 - DNA, 22 bp, Homo sapiens
ggagcccgggcagggcgggcct

SEQ ID NO: 26206 - DNA, 22 bp, Homo sapiens
agggacccggctcactgggcct

SEQ ID NO: 26207 - DNA, 22 bp, Homo sapiens
agggttctggggccagcgatct

SEQ ID NO: 26208 - DNA, 16 bp, Homo sapiens
aggggccagcgggacc

SEQ ID NO: 26209 - DNA, 15 bp, Homo sapiens
ggggcccgagggacc

SEQ ID NO: 26210 - DNA, 18 bp, Homo sapiens
agggcctggctgggatct

SEQ ID NO: 26211 - DNA, 20 bp, Homo sapiens
aggggctagccgcggggcct

SEQ ID NO: 26212 - DNA, 25 bp, Homo sapiens
aggggcccggcacttaggtcctaac

SEQ ID NO: 26213 - DNA, 22 bp, Homo sapiens
agggtccccattgttggggcct

SEQ ID NO: 26214 - DNA, 24 bp, Homo sapiens
aggggcccggggcaggcggggcct

SEQ ID NO: 26215 - DNA, 21 bp, Homo sapiens
aggtggtcccagttaggacct

SEQ ID NO: 26216 - DNA, 20 bp, Homo sapiens
aggagcccccagaaggacct

SEQ ID NO: 26217 - DNA, 19 bp, Homo sapiens
ggggcgcgggttaggatct

SEQ ID NO: 26218 - DNA, 19 bp, Homo sapiens
ggggaccaatatagggcct

SEQ ID NO: 26219 - DNA, 18 bp, Homo sapiens
ggtggcccgggtgggcct

SEQ ID NO: 26220 - DNA, 18 bp, Homo sapiens
aggggccctggcaggcct

SEQ ID NO: 26221 - DNA, 22 bp, Homo sapiens
aggggccggggctgcaggacct

SEQ ID NO: 26222 - DNA, 15 bp, Homo sapiens
aggagaaagttagga

SEQ ID NO: 26223 - DNA, 18 bp, Homo sapiens
aggagcccagaggggcct

SEQ ID NO: 26224 - DNA, 15 bp, Homo sapiens
ggggcccaggaagcc

SEQ ID NO: 26225 - DNA, 16 bp, Homo sapiens
agggcccaagtaggac

SEQ ID NO: 26226 - DNA, 22 bp, Homo sapiens
ggggcccaggagccctggatct

SEQ ID NO: 26227 - DNA, 17 bp, Homo sapiens
agggacctggggcaacc

SEQ ID NO: 26228 - DNA, 22 bp, Homo sapiens
aggggcccggccaggagggcct

SEQ ID NO: 26229 - DNA, 16 bp, Homo sapiens
agaggccctgggggcc

SEQ ID NO: 26230 - DNA, 24 bp, Homo sapiens
aggggccctgcccgactaggacct

SEQ ID NO: 26231 - DNA, 18 bp, Homo sapiens
ggggtcaggggcaagcct

SEQ ID NO: 26232 - DNA, 17 bp, Homo sapiens
agggggccgggcctgga

SEQ ID NO: 26233 - DNA, 16 bp, Homo sapiens
agggcccgtcagggcc

SEQ ID NO: 26234 - DNA, 18 bp, Homo sapiens
ggggcactgataggacct

SEQ ID NO: 26235 - DNA, 21 bp, Homo sapiens
ggggctcggggattaaggcct

SEQ ID NO: 26236 - DNA, 19 bp, Homo sapiens
aggagttcgggaccagcct

SEQ ID NO: 26237 - DNA, 19 bp, Homo sapiens
aggtggcagtttaggacct

SEQ ID NO: 26238 - DNA, 21 bp, Homo sapiens
agaggtctggattaggggcct

SEQ ID NO: 26239 - DNA, 20 bp, Homo sapiens
agaggcccggacagtgacct

SEQ ID NO: 26240 - DNA, 23 bp, Homo sapiens
aggggccagggtccttgggatct

SEQ ID NO: 26241 - DNA, 17 bp, Homo sapiens
gggtccgggacaggcct

SEQ ID NO: 26242 - DNA, 18 bp, Homo sapiens
ggggcctggcccaggcct

SEQ ID NO: 26243 - DNA, 19 bp, Homo sapiens
aggggcccaggagctgcct

SEQ ID NO: 26244 - DNA, 20 bp, Homo sapiens
agggttttggggagaactct

SEQ ID NO: 26245 - DNA, 17 bp, Homo sapiens
ggggcccggggaggcct

SEQ ID NO: 26246 - DNA, 15 bp, Homo sapiens
agaggcccggggacc

SEQ ID NO: 26247 - DNA, 17 bp, Homo sapiens
ggggcccgaaggggcct

SEQ ID NO: 26248 - DNA, 21 bp, Homo sapiens
aggggccagggggctgaggac

SEQ ID NO: 26249 - DNA, 18 bp, Homo sapiens
agggggccaaggggacct

SEQ ID NO: 26250 - DNA, 19 bp, Homo sapiens
ggggcccagaaaggggcct

SEQ ID NO: 26251 - DNA, 19 bp, Homo sapiens
agggcctgggggccagcct

SEQ ID NO: 26252 - DNA, 19 bp, Homo sapiens
aggggcccgggccgggcct

SEQ ID NO: 26253 - DNA, 19 bp, Homo sapiens
aggtgcttcaagttaggac

SEQ ID NO: 26254 - DNA, 15 bp, Homo sapiens
ggggcccagcaggcc

SEQ ID NO: 26255 - DNA, 21 bp, Homo sapiens
ggggcttgagtccggggacct

SEQ ID NO: 26256 - DNA, 18 bp, Homo sapiens
agggcctggaaaagatct

SEQ ID NO: 26257 - DNA, 16 bp, Homo sapiens
ggggcctccaggacct

SEQ ID NO: 26258 - DNA, 19 bp, Homo sapiens
aggggcccgaggcaagcct

SEQ ID NO: 26259 - DNA, 18 bp, Homo sapiens
ggggcctgggatgggcct

SEQ ID NO: 26260 - DNA, 19 bp, Homo sapiens
aagggcccggggactccct

SEQ ID NO: 26261 - DNA, 20 bp, Homo sapiens
aggtgcctggggcaagacct

SEQ ID NO: 26262 - DNA, 16 bp, Homo sapiens
gggcccaaagggacct

SEQ ID NO: 26263 - DNA, 16 bp, Homo sapiens
aggcgcccggggtccc

SEQ ID NO: 26264 - DNA, 19 bp, Homo sapiens
aggggcctgggagctgtgg

SEQ ID NO: 26265 - DNA, 16 bp, Homo sapiens
aggggccccgaaggcc

SEQ ID NO: 26266 - DNA, 16 bp, Homo sapiens
agggacccggggagaa

SEQ ID NO: 26267 - DNA, 17 bp, Homo sapiens
ggggcccattaggatct

SEQ ID NO: 26268 - DNA, 18 bp, Homo sapiens
agggacccggcagggcct

SEQ ID NO: 26269 - DNA, 18 bp, Homo sapiens
aggggtcagattggacct

SEQ ID NO: 26270 - DNA, 20 bp, Homo sapiens
aggggccctgggcgtggcct

SEQ ID NO: 26271 - DNA, 17 bp, Homo sapiens
ggggccagggctggcct

SEQ ID NO: 26272 - DNA, 20 bp, Homo sapiens
aggggccctgtcgctggcct

SEQ ID NO: 26273 - DNA, 16 bp, Homo sapiens
agaggccctggaggac

SEQ ID NO: 26274 - DNA, 20 bp, Homo sapiens
aggggccctgctaatggcct

SEQ ID NO: 26275 - DNA, 15 bp, Homo sapiens
ggagcccaggggacc

SEQ ID NO: 26276 - DNA, 21 bp, Homo sapiens
aggagccgatccctgggacct

SEQ ID NO: 26277 - DNA, 22 bp, Homo sapiens
aggggcccggggcgagaggcct

SEQ ID NO: 26278 - DNA, 16 bp, Homo sapiens
aggggcacccaggacc

SEQ ID NO: 26279 - DNA, 19 bp, Homo sapiens
aggggttcgagaccagcct

SEQ ID NO: 26280 - DNA, 17 bp, Homo sapiens
gaggcccggtagggcct

SEQ ID NO: 26281 - DNA, 21 bp, Homo sapiens
ggcggcccggggcgtgcgcct

SEQ ID NO: 26282 - DNA, 19 bp, Homo sapiens
agggccctgggaagcacct

SEQ ID NO: 26283 - DNA, 19 bp, Homo sapiens
agggacccggtggggatct

SEQ ID NO: 26284 - DNA, 18 bp, Homo sapiens
aggggcatggggggccct

SEQ ID NO: 26285 - DNA, 19 bp, Homo sapiens
agggcctggatgttaagga

SEQ ID NO: 26286 - DNA, 17 bp, Homo sapiens
gaggcccggggtcacct

SEQ ID NO: 26287 - DNA, 19 bp, Homo sapiens
ggggctttgggatcggcct

SEQ ID NO: 26288 - DNA, 19 bp, Homo sapiens
ggggctctgcaggaggcct

SEQ ID NO: 26289 - DNA, 18 bp, Homo sapiens
aggagcctggggacacct

SEQ ID NO: 26290 - DNA, 16 bp, Homo sapiens
gaggcccgggaaggac

SEQ ID NO: 26291 - DNA, 17 bp, Homo sapiens
ggggccaggctgggcct

SEQ ID NO: 26292 - DNA, 19 bp, Homo sapiens
aggagctgccataggacct

SEQ ID NO: 26293 - DNA, 23 bp, Homo sapiens
ggggccagggcagcgcggggcct

SEQ ID NO: 26294 - DNA, 16 bp, Homo sapiens
ggggccctggggaccc

SEQ ID NO: 26295 - DNA, 18 bp, Homo sapiens
aggggcctgagctgtagg

SEQ ID NO: 26296 - DNA, 18 bp, Homo sapiens
agggcccggggtggtcct

SEQ ID NO: 26297 - DNA, 19 bp, Homo sapiens
agggccctctccaggacct

SEQ ID NO: 26298 - DNA, 16 bp, Homo sapiens
aggggtccagggtccc

SEQ ID NO: 26299 - DNA, 18 bp, Homo sapiens
ggagtccgggccgggcct

SEQ ID NO: 26300 - DNA, 21 bp, Homo sapiens
gggtgctcatctccaggacct

SEQ ID NO: 26301 - DNA, 22 bp, Homo sapiens
agggccccggggctactggcct

SEQ ID NO: 26302 - DNA, 19 bp, Homo sapiens
aggggcctcgggagactct

SEQ ID NO: 26303 - DNA, 17 bp, Homo sapiens
ggggccagccagggact

SEQ ID NO: 26304 - DNA, 19 bp, Homo sapiens
ggtggctcccctaggacct

SEQ ID NO: 26305 - DNA, 18 bp, Homo sapiens
ggggccccgggacagcct

SEQ ID NO: 26306 - DNA, 20 bp, Homo sapiens
aggggcttggtgactggcct

SEQ ID NO: 26307 - DNA, 18 bp, Homo sapiens
ggcggcccgggccggcct

SEQ ID NO: 26308 - DNA, 18 bp, Homo sapiens
aggggctaggctggacct

SEQ ID NO: 26309 - DNA, 15 bp, Homo sapiens
aggagcccaaaggac

SEQ ID NO: 26310 - DNA, 16 bp, Homo sapiens
ggggccacaccaggac

SEQ ID NO: 26311 - DNA, 16 bp, Homo sapiens
aggggtcagggaagcc

SEQ ID NO: 26312 - DNA, 18 bp, Homo sapiens
ggggcccagaagggacct

SEQ ID NO: 26313 - DNA, 20 bp, Homo sapiens
agaggccttttctaggatct

SEQ ID NO: 26314 - DNA, 18 bp, Homo sapiens
aggggtcagggggctcct

SEQ ID NO: 26315 - DNA, 20 bp, Homo sapiens
agggcttggactctggacct

SEQ ID NO: 26316 - DNA, 17 bp, Homo sapiens
ggggcccaccagggcct

SEQ ID NO: 26317 - DNA, 20 bp, Homo sapiens
aggggctaagagtagggcct

SEQ ID NO: 26318 - DNA, 16 bp, Homo sapiens
agggggccgggaggcc

SEQ ID NO: 26319 - DNA, 19 bp, Homo sapiens
aggggccttggcagagcct

SEQ ID NO: 26320 - DNA, 17 bp, Homo sapiens
ggggccctgctaggcct

SEQ ID NO: 26321 - DNA, 18 bp, Homo sapiens
ggggtcccgggacagcct

SEQ ID NO: 26322 - DNA, 18 bp, Homo sapiens
ggggctctgggcaagcct

SEQ ID NO: 26323 - DNA, 15 bp, Homo sapiens
agggacctcaggacc

SEQ ID NO: 26324 - DNA, 21 bp, Homo sapiens
aggtggcccgggtctcagcct

SEQ ID NO: 26325 - DNA, 17 bp, Homo sapiens
gggacccaggaggacct

SEQ ID NO: 26326 - DNA, 18 bp, Homo sapiens
agggccctgggagcacct

SEQ ID NO: 26327 - DNA, 16 bp, Homo sapiens
aggtggccccaggacc

SEQ ID NO: 26328 - DNA, 20 bp, Homo sapiens
agggcctgggagaggggcct

SEQ ID NO: 26329 - DNA, 17 bp, Homo sapiens
gggcgcccgggggaccc

SEQ ID NO: 26330 - DNA, 18 bp, Homo sapiens
agcggcccggagagacct

SEQ ID NO: 26331 - DNA, 17 bp, Homo sapiens
ggggccaagaaggacct

SEQ ID NO: 26332 - DNA, 19 bp, Homo sapiens
aggagtttggggctagcct

SEQ ID NO: 26333 - DNA, 18 bp, Homo sapiens
ggggcccggggccgcagg

SEQ ID NO: 26334 - DNA, 18 bp, Homo sapiens
ggggtccggggctggcct

SEQ ID NO: 26335 - DNA, 19 bp, Homo sapiens
aggggcccgcttcggacct

SEQ ID NO: 26336 - DNA, 20 bp, Homo sapiens
ggggcccggcctcagggcct

SEQ ID NO: 26337 - DNA, 16 bp, Homo sapiens
aggggccccgaggacc

SEQ ID NO: 26338 - DNA, 20 bp, Homo sapiens
aggggcccaggtactgatct

SEQ ID NO: 26339 - DNA, 19 bp, Homo sapiens
agaggctcgactcgggcct

SEQ ID NO: 26340 - DNA, 18 bp, Homo sapiens
gggactcactcaggacct

SEQ ID NO: 26341 - DNA, 15 bp, Homo sapiens
agggcccaagaggac

SEQ ID NO: 26342 - DNA, 20 bp, Homo sapiens
gaggcccgggctcctggcct

SEQ ID NO: 26343 - DNA, 22 bp, Homo sapiens
aggggcccagagaggagggcct

SEQ ID NO: 26344 - DNA, 18 bp, Homo sapiens
agaggcctggggcgtcct

SEQ ID NO: 26345 - DNA, 17 bp, Homo sapiens
ggggcccagcagggcct

SEQ ID NO: 26346 - DNA, 16 bp, Homo sapiens
gggaccctggggacct

SEQ ID NO: 26347 - DNA, 18 bp, Homo sapiens
agggctcctgcaggacct

SEQ ID NO: 26348 - DNA, 18 bp, Homo sapiens
aggggccggggccagcct

SEQ ID NO: 26349 - DNA, 15 bp, Homo sapiens
gggacccagggggcc

SEQ ID NO: 26350 - DNA, 17 bp, Homo sapiens
ggtccgagccaggatct

SEQ ID NO: 26351 - DNA, 21 bp, Homo sapiens
aggggcccagcactgggacct

SEQ ID NO: 26352 - DNA, 18 bp, Homo sapiens
agggacccggcccggcct

SEQ ID NO: 26353 - DNA, 20 bp, Homo sapiens
aggggttaggcctgggacct

SEQ ID NO: 26354 - DNA, 18 bp, Homo sapiens
ggggctcaggcaaaacct

SEQ ID NO: 26355 - DNA, 15 bp, Homo sapiens
agaggcccctaggac

SEQ ID NO: 26356 - DNA, 23 bp, Homo sapiens
aggggcccgggaggaattgacct

SEQ ID NO: 26357 - DNA, 100 bp, Gallid herpesvirus 3
ttgcttctgattccgacgggtcttcttcacgtacctctctatggctgcatctttatggccatagtgaggtacgtgtaggctacctgccggagaaaggcgg

SEQ ID NO: 26358 - DNA, 24 bp, Gallid herpesvirus 3
tacgtgtaggctacctgccggaga

SEQ ID NO: 26359 - DNA, 21 bp, Homo sapiens
gcgtggggttacagcaggaga

SEQ ID NO: 26360 - DNA, 22 bp, Homo sapiens
gtgtaggctgagtcactggaga

SEQ ID NO: 26361 - DNA, 17 bp, Homo sapiens
cgtgtaggctgtggcgg

SEQ ID NO: 26362 - DNA, 18 bp, Homo sapiens
gtgtaggctgcactgaga

SEQ ID NO: 26363 - DNA, 23 bp, Homo sapiens
tactgtgggttgctgctcaggag

SEQ ID NO: 26364 - DNA, 22 bp, Homo sapiens
tacgtgtgggtgacttgttaag

SEQ ID NO: 26365 - DNA, 21 bp, Homo sapiens
tgctgggtgtacttgccggag

SEQ ID NO: 26366 - DNA, 22 bp, Homo sapiens
tacttgtaggctgaggtgggag

SEQ ID NO: 26367 - DNA, 74 bp, Human herpesvirus 7
ttttaaagatccgtgggctggagctttaaaattctctattgttctttcaagttctgcaaaaatggtttttaaag

SEQ ID NO: 26368 - DNA, 24 bp, Human herpesvirus 7
ttaaagatccgtgggctggagctt

SEQ ID NO: 26369 - DNA, 19 bp, Homo sapiens
agaacaatggttggagctt

SEQ ID NO: 26370 - DNA, 19 bp, Homo sapiens
ctaaagattagttggggct

SEQ ID NO: 26371 - DNA, 17 bp, Homo sapiens
agactgggttggagctt

SEQ ID NO: 26372 - DNA, 19 bp, Homo sapiens
tcaaagatttgtgggttgg

SEQ ID NO: 26373 - DNA, 17 bp, Homo sapiens
ttaaagatcagtgggtg

SEQ ID NO: 26374 - DNA, 19 bp, Homo sapiens
ttaaagactcaccggttgg

SEQ ID NO: 26375 - DNA, 108 bp, Gallid herpesvirus 3
gcctttaggggtagtgtcgttgtcggggttaggcctgtaggggtagtgtcgttgtcggggttaggcctttaggggtagtgtcggggtcggggttaggcctttaggggc

SEQ ID NO: 26376 - DNA, 24 bp, Gallid herpesvirus 3
taggggtagtgtcgttgtcggggt

SEQ ID NO: 26377 - DNA, 15 bp, Homo sapiens
ggggtagtggtcggg

SEQ ID NO: 26378 - DNA, 66 bp, Gallid herpesvirus 2
gaaccagccctgcgcgcttgcgctatatacgccctgcgcactcatcgcgcatgcgcacagacgttc

SEQ ID NO: 26379 - DNA, 23 bp, Gallid herpesvirus 2
atcgcgcatgcgcacagacgttc

SEQ ID NO: 26380 - DNA, 17 bp, Homo sapiens
gcgcgtgcgcacacgtt

SEQ ID NO: 26381 - DNA, 20 bp, Homo sapiens
gcatgcgcatcaaagcgttc

SEQ ID NO: 26382 - DNA, 20 bp, Homo sapiens
gcacgcgcgcgtaggtgttc

SEQ ID NO: 26383 - DNA, 16 bp, Homo sapiens
gcatgcacacgcgttc

SEQ ID NO: 26384 - DNA, 23 bp, Homo sapiens
gcgcaattactgtgtagacgttc

SEQ ID NO: 26385 - DNA, 18 bp, Homo sapiens
catggcacacaggtgttc

SEQ ID NO: 26386 - DNA, 69 bp, Gallid herpesvirus 2
tccattgatctgctcacgactgtagcacttagaatcgcacagtgcacagccagtgagctggccacagga

SEQ ID NO: 26387 - DNA, 24 bp, Gallid herpesvirus 2
tgcacagccagtgagctggccaca

SEQ ID NO: 26388 - DNA, 24 bp, Homo sapiens
tgcgggccagggctcctggccaca

SEQ ID NO: 26389 - DNA, 23 bp, Homo sapiens
tgcgcagccagttagcagccgca

SEQ ID NO: 26390 - DNA, 20 bp, Homo sapiens
tgacagccagtgagacttgg

SEQ ID NO: 26391 - DNA, 20 bp, Homo sapiens
gcaggcgtgagctggccaca

SEQ ID NO: 26392 - DNA, 20 bp, Homo sapiens
tgcgcagccagcggcctccc

SEQ ID NO: 26393 - DNA, 19 bp, Homo sapiens
tgcggcggcggaagctggc

SEQ ID NO: 26394 - DNA, 22 bp, Homo sapiens
tacatggccacccctggccaca

SEQ ID NO: 26395 - DNA, 20 bp, Homo sapiens
gccaggctcggctggccaca

SEQ ID NO: 26396 - DNA, 21 bp, Homo sapiens
tgtacggccagaaccggctac

SEQ ID NO: 26397 - DNA, 17 bp, Homo sapiens
tgcacagctagtaaatg

SEQ ID NO: 26398 - DNA, 18 bp, Homo sapiens
tgcccgccggagctggcc

SEQ ID NO: 26399 - DNA, 21 bp, Homo sapiens
tgcactggccagtgggccgca

SEQ ID NO: 26400 - DNA, 18 bp, Homo sapiens
gcaccccatcctggccac

SEQ ID NO: 26401 - DNA, 16 bp, Homo sapiens
tgcacagcagtggggc

SEQ ID NO: 26402 - DNA, 17 bp, Homo sapiens
tgccagctagtgagctg

SEQ ID NO: 26403 - DNA, 17 bp, Homo sapiens
tgcacagcagcagttgg

SEQ ID NO: 26404 - DNA, 22 bp, Homo sapiens
tgctggtccccaactggccaca

SEQ ID NO: 26405 - DNA, 22 bp, Homo sapiens
gcatggccagtggccaaccaca

SEQ ID NO: 26406 - DNA, 21 bp, Homo sapiens
tgccagccagtggtaggcaca

SEQ ID NO: 26407 - DNA, 20 bp, Homo sapiens
tgcaagctggctcttggcca

SEQ ID NO: 26408 - DNA, 23 bp, Homo sapiens
tgctggttggtgaactggccaca

SEQ ID NO: 26409 - DNA, 21 bp, Homo sapiens
tgcctgggcccggctggccac

SEQ ID NO: 26410 - DNA, 22 bp, Homo sapiens
tgtccagccagccagcggccac

SEQ ID NO: 26411 - DNA, 19 bp, Homo sapiens
ccggagtcgagctggccac

SEQ ID NO: 26412 - DNA, 22 bp, Homo sapiens
gccagttagtccaatggccaca

SEQ ID NO: 26413 - DNA, 19 bp, Homo sapiens
cagccacaccctggtcaca

SEQ ID NO: 26414 - DNA, 21 bp, Homo sapiens
tgcacagcggtggggctcaca

SEQ ID NO: 26415 - DNA, 23 bp, Homo sapiens
tgggcagccagtgatggactaca

SEQ ID NO: 26416 - DNA, 19 bp, Homo sapiens
cacagccactttggtcaca

SEQ ID NO: 26417 - DNA, 18 bp, Homo sapiens
tgcacagccatctggctg

SEQ ID NO: 26418 - DNA, 18 bp, Homo sapiens
tgaacagctggtgagcca

SEQ ID NO: 26419 - DNA, 18 bp, Homo sapiens
tgcaagccaggaggccac

SEQ ID NO: 26420 - DNA, 19 bp, Homo sapiens
tgtacagccagtggctccc

SEQ ID NO: 26421 - DNA, 22 bp, Homo sapiens
tacatagtcccacctggccaca

SEQ ID NO: 26422 - DNA, 19 bp, Homo sapiens
tgcaagccagtggagccag

SEQ ID NO: 26423 - DNA, 16 bp, Homo sapiens
gcacagccaggggcca

SEQ ID NO: 26424 - DNA, 21 bp, Homo sapiens
cacggccccgccctggccaca

SEQ ID NO: 26425 - DNA, 18 bp, Homo sapiens
tgcgctgccagtgaccac

SEQ ID NO: 26426 - DNA, 20 bp, Homo sapiens
tgcacaactagtgaggtctg

SEQ ID NO: 26427 - DNA, 19 bp, Homo sapiens
tgcacagcaggtgggaaac

SEQ ID NO: 26428 - DNA, 25 bp, Homo sapiens
tgagcagccagcttcattggctgca

SEQ ID NO: 26429 - DNA, 23 bp, Homo sapiens
tgtgcagcaggtggttggccaca

SEQ ID NO: 26430 - DNA, 21 bp, Homo sapiens
gcatggccagggctggtcaca

SEQ ID NO: 26431 - DNA, 21 bp, Homo sapiens
tacacagtcagtgagccttgg

SEQ ID NO: 26432 - DNA, 22 bp, Homo sapiens
tacacagccggtaaatgttaca

SEQ ID NO: 26433 - DNA, 17 bp, Homo sapiens
tgccagccagtgagagc

SEQ ID NO: 26434 - DNA, 20 bp, Homo sapiens
cagtcagagccatggccaca

SEQ ID NO: 26435 - DNA, 20 bp, Homo sapiens
tgcacagctgtggctgatca

SEQ ID NO: 26436 - DNA, 21 bp, Homo sapiens
tgcacagctgtgtccctcaca

SEQ ID NO: 26437 - DNA, 15 bp, Homo sapiens
agccagtgtagccac

SEQ ID NO: 26438 - DNA, 16 bp, Homo sapiens
tgcacagctgttggcc

SEQ ID NO: 26439 - DNA, 18 bp, Homo sapiens
tgcgtgagccagtggcgc

SEQ ID NO: 26440 - DNA, 19 bp, Homo sapiens
tgcacagctaatgagctga

SEQ ID NO: 26441 - DNA, 18 bp, Homo sapiens
gctagaccagctggccac

SEQ ID NO: 26442 - DNA, 19 bp, Homo sapiens
gcccggtgctgctggccac

SEQ ID NO: 26443 - DNA, 20 bp, Homo sapiens
catctagtgagctggccaca

SEQ ID NO: 26444 - DNA, 25 bp, Homo sapiens
tgcacagccaggggttcctgccaca

SEQ ID NO: 26445 - DNA, 18 bp, Homo sapiens
tgcgacagctctggccac

SEQ ID NO: 26446 - DNA, 84 bp, Gallid herpesvirus 2
ccgagcttaaaaaatattttattggcggtcaaagcatgctatccttcagcagatctgggaaatcatggatgtttggaggcttgg

SEQ ID NO: 26447 - DNA, 24 bp, Gallid herpesvirus 2
agatctgggaaatcatggatgttt

SEQ ID NO: 26448 - DNA, 19 bp, Homo sapiens
aatcacaattatggatgtt

SEQ ID NO: 26449 - DNA, 17 bp, Homo sapiens
agatttgggaaatttgg

SEQ ID NO: 26450 - DNA, 21 bp, Homo sapiens
tctgggaagtcaccattgttt

SEQ ID NO: 26451 - DNA, 20 bp, Homo sapiens
agatttgggaaacagtgctt

SEQ ID NO: 26452 - DNA, 20 bp, Homo sapiens
agggctgggaaattgtaaat

SEQ ID NO: 26453 - DNA, 17 bp, Homo sapiens
agatttgggagaatgtt

SEQ ID NO: 26454 - DNA, 18 bp, Homo sapiens
tctgggaaggaggtgttt

SEQ ID NO: 26455 - DNA, 16 bp, Homo sapiens
tctgggaaatggtgcc

SEQ ID NO: 26456 - DNA, 22 bp, Homo sapiens
agattgtgggagaagaatgttt

SEQ ID NO: 26457 - DNA, 16 bp, Homo sapiens
agatctgggtgattat

SEQ ID NO: 26458 - DNA, 18 bp, Homo sapiens
aggctctggggggatgtt

SEQ ID NO: 26459 - DNA, 73 bp, Gallid herpesvirus 2
gagcgcagagctattaccgaagaagtctatccccccaaaatggatattttcgcatggaccaggtattgcgctc

SEQ ID NO: 26460 - DNA, 24 bp, Gallid herpesvirus 2
tcgcatggaccaggtattgcgctc

SEQ ID NO: 26461 - DNA, 20 bp, Homo sapiens
tccatggaccagaggcctgc

SEQ ID NO: 26462 - DNA, 18 bp, Homo sapiens
gcatggaccaggctggct

SEQ ID NO: 26463 - DNA, 18 bp, Homo sapiens
tcgtgtggcccaggtacc

SEQ ID NO: 26464 - DNA, 19 bp, Homo sapiens
tcgcatggatggggacatc

SEQ ID NO: 26465 - DNA, 20 bp, Homo sapiens
tcgcatggactcggcgccct

SEQ ID NO: 26466 - DNA, 21 bp, Homo sapiens
tggtaacctaggtattgtgct

SEQ ID NO: 26467 - DNA, 19 bp, Homo sapiens
tcgcgtgattagttgcgct

SEQ ID NO: 26468 - DNA, 19 bp, Homo sapiens
ccgcgtgaggtattgcgct

SEQ ID NO: 26469 - DNA, 24 bp, Homo sapiens
tcacatggatctccgtctgtgctc

SEQ ID NO: 26470 - DNA, 20 bp, Homo sapiens
tcgcattgggttggttttgc

SEQ ID NO: 26471 - DNA, 21 bp, Homo sapiens
tagtccctaggtattgtgctc

SEQ ID NO: 26472 - DNA, 19 bp, Homo sapiens
tgtctcaggtattgtgctc

SEQ ID NO: 26473 - DNA, 16 bp, Homo sapiens
gcatggaccaagcgct

SEQ ID NO: 26474 - DNA, 82 bp, Fowl adenovirus D
cacgttgtgcgttctccgttgacctttgaaaaggcgcgtggtatttctcggtgtgtttttcgggcggattacgcgttacgtg

SEQ ID NO: 26475 - DNA, 24 bp, Fowl adenovirus D
ttcgggcggattacgcgttacgtg

SEQ ID NO: 26476 - DNA, 18 bp, Homo sapiens
gggtggttatgtcacgtg

SEQ ID NO: 26477 - DNA, 21 bp, Homo sapiens
ttctgcactacgtgttatgtg

SEQ ID NO: 26478 - DNA, 67 bp, Fowl adenovirus D
gatcgtcagagcacggatgagcgagcagccggactcaccgccggagctctatccgtctctcctggtc

SEQ ID NO: 26479 - DNA, 24 bp, Fowl adenovirus D
tcagagcacggatgagcgagcagc

SEQ ID NO: 26480 - DNA, 22 bp, Homo sapiens
ccagagcgcatgagcgagcggc

SEQ ID NO: 26481 - DNA, 19 bp, Homo sapiens
cagtgcggatgaactgcag

SEQ ID NO: 26482 - DNA, 20 bp, Homo sapiens
tcgcagcaccctgcgagcag

SEQ ID NO: 26483 - DNA, 16 bp, Homo sapiens
ccagggcgggcgagca

SEQ ID NO: 26484 - DNA, 20 bp, Homo sapiens
tcagagcaggggtggaaagc

SEQ ID NO: 26485 - DNA, 19 bp, Homo sapiens
gagcacgggtgcccgcggc

SEQ ID NO: 26486 - DNA, 21 bp, Homo sapiens
ccaggcaggtgagcgagcagc

SEQ ID NO: 26487 - DNA, 20 bp, Homo sapiens
ccaggcggtgggcgagcagc

SEQ ID NO: 26488 - DNA, 22 bp, Homo sapiens
tcagggtgctattggcgagcag

SEQ ID NO: 26489 - DNA, 17 bp, Homo sapiens
cagagcatgggcagcag

SEQ ID NO: 26490 - DNA, 20 bp, Homo sapiens
gcacgccgaccgcgagcagc

SEQ ID NO: 26491 - DNA, 21 bp, Homo sapiens
tcagagcaggggtgaggaagc

SEQ ID NO: 26492 - DNA, 19 bp, Homo sapiens
tcagagcatggatgctagc

SEQ ID NO: 26493 - DNA, 18 bp, Homo sapiens
tcagagcactgatggggc

SEQ ID NO: 26494 - DNA, 21 bp, Homo sapiens
tcagggctggggacaagcagc

SEQ ID NO: 26495 - DNA, 20 bp, Homo sapiens
agagcacggggcccggcggc

SEQ ID NO: 26496 - DNA, 23 bp, Homo sapiens
cagggtacatcagagcgagcagc

SEQ ID NO: 26497 - DNA, 17 bp, Homo sapiens
tcagagcatggggcagc

SEQ ID NO: 26498 - DNA, 21 bp, Homo sapiens
ccagagcacggagaaggcggc

SEQ ID NO: 26499 - DNA, 19 bp, Homo sapiens
gcacagatgagggaggcag

SEQ ID NO: 26500 - DNA, 17 bp, Homo sapiens
caggccggtgggcgagc

SEQ ID NO: 26501 - DNA, 18 bp, Homo sapiens
tcagagcagggctaagca

SEQ ID NO: 26502 - DNA, 20 bp, Homo sapiens
tcagagcaggctgcgggcag

SEQ ID NO: 26503 - DNA, 21 bp, Homo sapiens
tcagagcatagaaaaagtagc

SEQ ID NO: 26504 - DNA, 23 bp, Homo sapiens
tcagagtggtggttacgagcagc

SEQ ID NO: 26505 - DNA, 19 bp, Homo sapiens
tcagggccgtggcgagcag

SEQ ID NO: 26506 - DNA, 107 bp, Fowl adenovirus D
cccgtactccgttcgttttggacatcagccgtttgcccgtggtgccggagcgcattttgctgcacgactttccgaacggaccctggtcggaaacgatttggtacggg

SEQ ID NO: 26507 - DNA, 24 bp, Fowl adenovirus D
agccgtttgcccgtggtgccggag

SEQ ID NO: 26508 - DNA, 21 bp, Homo sapiens
agtcgtttgcctgctaaggag

SEQ ID NO: 26509 - DNA, 18 bp, Homo sapiens
gccgtttgtttggcgtga

SEQ ID NO: 26510 - DNA, 18 bp, Homo sapiens
gctgcttgcccgtgtggg

SEQ ID NO: 26511 - DNA, 18 bp, Homo sapiens
gccgtctgctcagctgga

SEQ ID NO: 26512 - DNA, 21 bp, Homo sapiens
agccatttgcccctccaccgg

SEQ ID NO: 26513 - DNA, 19 bp, Homo sapiens
gctgtttgccccagctggg

SEQ ID NO: 26514 - DNA, 19 bp, Homo sapiens
agctgttgcccgtgaccag

SEQ ID NO: 26515 - DNA, 22 bp, Homo sapiens
atttgtggtggtggtgctggag

SEQ ID NO: 26516 - DNA, 73 bp, Human papillomavirus type 14
ttttgctaggcaaaatggtgtgacacgacttggataccaagttgtgcctacattagccatttcagaagcaaaa

SEQ ID NO: 26517 - DNA, 24 bp, Human papillomavirus type 14
tgtgcctacattagccatttcaga

SEQ ID NO: 26518 - DNA, 23 bp, Homo sapiens
tgtccttgtgttagtacttcaga

SEQ ID NO: 26519 - DNA, 18 bp, Homo sapiens
tatgtttacacatttcag

SEQ ID NO: 26520 - DNA, 20 bp, Homo sapiens
gtgtctacacaacatttcag

SEQ ID NO: 26521 - DNA, 20 bp, Homo sapiens
tgtgcctaccattgggtcag

SEQ ID NO: 26522 - DNA, 18 bp, Homo sapiens
tgtgtccacattagccac

SEQ ID NO: 26523 - DNA, 18 bp, Homo sapiens
tgttctacattagctcag

SEQ ID NO: 26524 - DNA, 22 bp, Homo sapiens
tgtgctacattagaacactaga

SEQ ID NO: 26525 - DNA, 23 bp, Homo sapiens
tgtgtccagtgaagtcatttcag

SEQ ID NO: 26526 - DNA, 21 bp, Homo sapiens
tgcttacaaatgaatttcaga

SEQ ID NO: 26527 - DNA, 20 bp, Homo sapiens
tgcttacattaaaaatcaga

SEQ ID NO: 26528 - DNA, 20 bp, Homo sapiens
tgtgcctatatggttaccat

SEQ ID NO: 26529 - DNA, 20 bp, Homo sapiens
gtgtctatcttcatttcaga

SEQ ID NO: 26530 - DNA, 22 bp, Homo sapiens
tgtgtcacattagcccagtcag

SEQ ID NO: 26531 - DNA, 21 bp, Homo sapiens
tgttcctacaccagtttcaga

SEQ ID NO: 26532 - DNA, 18 bp, Homo sapiens
tgtgcctatttccttcag

SEQ ID NO: 26533 - DNA, 21 bp, Homo sapiens
tgtggctgccacccatttcag

SEQ ID NO: 26534 - DNA, 19 bp, Homo sapiens
tgttcctgtatcatttcag

SEQ ID NO: 26535 - DNA, 24 bp, Homo sapiens
tgtgcctgtcatcccagctttcag

SEQ ID NO: 26536 - DNA, 23 bp, Homo sapiens
tgtgttgatggcagccatttcag

SEQ ID NO: 26537 - DNA, 80 bp, Human papillomavirus type 14
gcggcagaggcggagatcgaggtccaagtccaggtcgcggtcgaggtcgcggtctcggctccgatctagatcccggtcgc

SEQ ID NO: 26538 - DNA, 24 bp, Human papillomavirus type 14
cggctccgatctagatcccggtcg

SEQ ID NO: 26539 - DNA, 22 bp, Homo sapiens
cagctcctcatggtcccggtcg

SEQ ID NO: 26540 - DNA, 16 bp, Homo sapiens
cggctccggctagggc

SEQ ID NO: 26541 - DNA, 16 bp, Homo sapiens
cggctccgctcccggt

SEQ ID NO: 26542 - DNA, 17 bp, Homo sapiens
ggctccgaatcctggtc

SEQ ID NO: 26543 - DNA, 21 bp, Homo sapiens
gctccgccttggtcccggtcg

SEQ ID NO: 26544 - DNA, 17 bp, Homo sapiens
cggctccgtctaggggt

SEQ ID NO: 26545 - DNA, 19 bp, Homo sapiens
cgttctgatctagatggcc

SEQ ID NO: 26546 - DNA, 19 bp, Homo sapiens
cggcctcgaggtcccggtc

SEQ ID NO: 26547 - DNA, 62 bp, Human papillomavirus type 14
ggccgtggggggagcagggggagacggtcatcctccacctcccccacctcctccaaacggtc

SEQ ID NO: 26548 - DNA, 22 bp, Human papillomavirus type 14
cccccacctcctccaaacggtc

SEQ ID NO: 26549 - DNA, 19 bp, Homo sapiens
cctgcatttcctccaagtc

SEQ ID NO: 26550 - DNA, 20 bp, Homo sapiens
cccccacccccttttaggtc

SEQ ID NO: 26551 - DNA, 16 bp, Homo sapiens
cccccacccccacagt

SEQ ID NO: 26552 - DNA, 20 bp, Homo sapiens
cccctgccccttccttagtc

SEQ ID NO: 26553 - DNA, 20 bp, Homo sapiens
ccccatttctttccagagtc

SEQ ID NO: 26554 - DNA, 23 bp, Homo sapiens
cctctcctgaaggacagacggtc

SEQ ID NO: 26555 - DNA, 25 bp, Homo sapiens
cctccacctcctgggtacaagcggt

SEQ ID NO: 26556 - DNA, 22 bp, Homo sapiens
cccccacctcctatggacagtc

SEQ ID NO: 26557 - DNA, 19 bp, Homo sapiens
cctccccctcctcccagtc

SEQ ID NO: 26558 - DNA, 23 bp, Homo sapiens
cctcacacctcctcccgcctgtc

SEQ ID NO: 26559 - DNA, 20 bp, Homo sapiens
cccccctcctcatcttggtc

SEQ ID NO: 26560 - DNA, 25 bp, Homo sapiens
cccccacctctctttgaccgtttgg

SEQ ID NO: 26561 - DNA, 20 bp, Homo sapiens
cctccagctccaggacggtc

SEQ ID NO: 26562 - DNA, 21 bp, Homo sapiens
cccccaccccctcctagggtc

SEQ ID NO: 26563 - DNA, 18 bp, Homo sapiens
cctccccctccttcaggc

SEQ ID NO: 26564 - DNA, 25 bp, Homo sapiens
cccccacctccctttgaccgtttgg

SEQ ID NO: 26565 - DNA, 19 bp, Homo sapiens
cctccaactcttccaagtc

SEQ ID NO: 26566 - DNA, 19 bp, Homo sapiens
cccccaccccccttgtggt

SEQ ID NO: 26567 - DNA, 22 bp, Homo sapiens
cctcctcctcctcttccaagtc

SEQ ID NO: 26568 - DNA, 19 bp, Homo sapiens
cctcctcctcttccaagtc

SEQ ID NO: 26569 - DNA, 16 bp, Homo sapiens
cccccaccttcctggc

SEQ ID NO: 26570 - DNA, 23 bp, Homo sapiens
cccccacctgcctctagtaggtc

SEQ ID NO: 26571 - DNA, 15 bp, Homo sapiens
ccccaccccctcggt

SEQ ID NO: 26572 - DNA, 19 bp, Homo sapiens
ccccacctgggcagcggtc

SEQ ID NO: 26573 - DNA, 18 bp, Homo sapiens
ccctttcctcctccaggc

SEQ ID NO: 26574 - DNA, 19 bp, Homo sapiens
cccccaccccctctccggt

SEQ ID NO: 26575 - DNA, 20 bp, Homo sapiens
cctccaccccccgcccggtc

SEQ ID NO: 26576 - DNA, 23 bp, Homo sapiens
ccccgccatttcctcctgcggtc

SEQ ID NO: 26577 - DNA, 23 bp, Homo sapiens
cccccaccttcctccagaaggtc

SEQ ID NO: 26578 - DNA, 18 bp, Homo sapiens
cctccaccccactacggt

SEQ ID NO: 26579 - DNA, 20 bp, Homo sapiens
cccccaccactgtcgcggtc

SEQ ID NO: 26580 - DNA, 18 bp, Homo sapiens
ccctcacctccttcaaac

SEQ ID NO: 26581 - DNA, 21 bp, Homo sapiens
ccatgcctcctcctaccagtc

SEQ ID NO: 26582 - DNA, 19 bp, Homo sapiens
cccccacttccaccccgtc

SEQ ID NO: 26583 - DNA, 19 bp, Homo sapiens
cctccctttcctccagaac

SEQ ID NO: 26584 - DNA, 18 bp, Homo sapiens
cccccgccccctccaggc

SEQ ID NO: 26585 - DNA, 16 bp, Homo sapiens
cctcctcctccagatc

SEQ ID NO: 26586 - DNA, 21 bp, Homo sapiens
cctcctcctcctcttacagtc

SEQ ID NO: 26587 - DNA, 18 bp, Homo sapiens
ccccgccccctccgggcc

SEQ ID NO: 26588 - DNA, 21 bp, Homo sapiens
ccgctgcctcctccgcgcgtc

SEQ ID NO: 26589 - DNA, 18 bp, Homo sapiens
cctccacctccgcccagt

SEQ ID NO: 26590 - DNA, 21 bp, Homo sapiens
cctccccctcctcttcagggt

SEQ ID NO: 26591 - DNA, 22 bp, Homo sapiens
cctccacctcctcctcctgggt

SEQ ID NO: 26592 - DNA, 25 bp, Homo sapiens
cccccacctctcttcgaccgtttgg

SEQ ID NO: 26593 - DNA, 18 bp, Homo sapiens
cctccttctcctccaggc

SEQ ID NO: 26594 - DNA, 19 bp, Homo sapiens
cctcctcctcctcctggtc

SEQ ID NO: 26595 - DNA, 20 bp, Homo sapiens
cccacacctcctctagtgtc

SEQ ID NO: 26596 - DNA, 20 bp, Homo sapiens
cccctccagctcaaacggtc

SEQ ID NO: 26597 - DNA, 18 bp, Homo sapiens
ccccacctctctgaggtc

SEQ ID NO: 26598 - DNA, 21 bp, Homo sapiens
ccctcatgctctcctctggtc

SEQ ID NO: 26599 - DNA, 22 bp, Homo sapiens
cctcctcctcctcccgcgcgtc

SEQ ID NO: 26600 - DNA, 23 bp, Homo sapiens
cctccacctcccattgcaatggt

SEQ ID NO: 26601 - DNA, 17 bp, Homo sapiens
cctccccctcctccggc

SEQ ID NO: 26602 - DNA, 20 bp, Homo sapiens
cccccgccccctccccggtc

SEQ ID NO: 26603 - DNA, 16 bp, Homo sapiens
cccccaccccgccggt

SEQ ID NO: 26604 - DNA, 20 bp, Homo sapiens
cctcccatcttcctgtggtc

SEQ ID NO: 26605 - DNA, 16 bp, Homo sapiens
cccccttcctccaaac

SEQ ID NO: 26606 - DNA, 20 bp, Homo sapiens
ccaccacctcctctgcagtc

SEQ ID NO: 26607 - DNA, 19 bp, Homo sapiens
cccttccctcctccagaac

SEQ ID NO: 26608 - DNA, 22 bp, Homo sapiens
cctcccctcctccccattggtc

SEQ ID NO: 26609 - DNA, 20 bp, Homo sapiens
cccccacctcctactgcggt

SEQ ID NO: 26610 - DNA, 17 bp, Homo sapiens
cccccacactcctgggt

SEQ ID NO: 26611 - DNA, 26 bp, Homo sapiens
cccccacctccttgttgaccgtttgg

SEQ ID NO: 26612 - DNA, 24 bp, Homo sapiens
ccgccgcctcctcctgcgcgggtc

SEQ ID NO: 26613 - DNA, 22 bp, Homo sapiens
cctccacttctcatcttgggtc

SEQ ID NO: 26614 - DNA, 21 bp, Homo sapiens
cctacacctcctcccgtggtc

SEQ ID NO: 26615 - DNA, 20 bp, Homo sapiens
cccctgccccccagctggtc

SEQ ID NO: 26616 - DNA, 25 bp, Homo sapiens
cccccacccccggttgaccgtttgg

SEQ ID NO: 26617 - DNA, 20 bp, Homo sapiens
cccccacctcctcacaaggt

SEQ ID NO: 26618 - DNA, 19 bp, Homo sapiens
ccccacccacccggacggt

SEQ ID NO: 26619 - DNA, 19 bp, Homo sapiens
cctcacctcccgcatggtc

SEQ ID NO: 26620 - DNA, 25 bp, Homo sapiens
cccccatccctccttgaccgtttgg

SEQ ID NO: 26621 - DNA, 19 bp, Homo sapiens
cctgccccctccaagaagt

SEQ ID NO: 26622 - DNA, 18 bp, Homo sapiens
cccacctcccttcaaaac

SEQ ID NO: 26623 - DNA, 22 bp, Homo sapiens
cccccacctctcaattccggtc

SEQ ID NO: 26624 - DNA, 16 bp, Homo sapiens
cctccacctccccggt

SEQ ID NO: 26625 - DNA, 17 bp, Homo sapiens
ccgccacctcctccggc

SEQ ID NO: 26626 - DNA, 19 bp, Homo sapiens
cccatctgccttccaggtc

SEQ ID NO: 26627 - DNA, 19 bp, Homo sapiens
cctcagcctcctcctggtc

SEQ ID NO: 26628 - DNA, 25 bp, Homo sapiens
cccccacctccctgcgaccgtttgg

SEQ ID NO: 26629 - DNA, 21 bp, Homo sapiens
cctccctcctctctcagggtc

SEQ ID NO: 26630 - DNA, 22 bp, Homo sapiens
ccccacctcctctgtagtgggt

SEQ ID NO: 26631 - DNA, 18 bp, Homo sapiens
cctgcccccaaaatggtc

SEQ ID NO: 26632 - DNA, 20 bp, Homo sapiens
ccactacttcctccaaaggt

SEQ ID NO: 26633 - DNA, 18 bp, Homo sapiens
cccacctcctccagggtc

SEQ ID NO: 26634 - DNA, 19 bp, Homo sapiens
ccccacattccccatggtc

SEQ ID NO: 26635 - DNA, 19 bp, Homo sapiens
cctgcctcccccagcagtc

SEQ ID NO: 26636 - DNA, 19 bp, Homo sapiens
cctccgtctcctccagggc

SEQ ID NO: 26637 - DNA, 21 bp, Homo sapiens
cccccacccttttcccctgtc

SEQ ID NO: 26638 - DNA, 20 bp, Homo sapiens
ccctgcctcctccaagaagc

SEQ ID NO: 26639 - DNA, 25 bp, Homo sapiens
cccccacctcctttcgaccgtttgg

SEQ ID NO: 26640 - DNA, 18 bp, Homo sapiens
cccacctcctctctagtc

SEQ ID NO: 26641 - DNA, 18 bp, Homo sapiens
cctctcctcctccaaggt

SEQ ID NO: 26642 - DNA, 18 bp, Homo sapiens
cccccacctcttcagaac

SEQ ID NO: 26643 - DNA, 20 bp, Homo sapiens
cctcccctccagactctggt

SEQ ID NO: 26644 - DNA, 20 bp, Homo sapiens
ccccgcccctccaaatggtc

SEQ ID NO: 26645 - DNA, 19 bp, Homo sapiens
ccctcacctccctttcagt

SEQ ID NO: 26646 - DNA, 20 bp, Homo sapiens
cctcctcctcctcctcccgg

SEQ ID NO: 26647 - DNA, 18 bp, Homo sapiens
cctccacctcctcccagc

SEQ ID NO: 26648 - DNA, 19 bp, Homo sapiens
ccccacctcaccccttggt

SEQ ID NO: 26649 - DNA, 19 bp, Homo sapiens
cctcctcctcctccaccac

SEQ ID NO: 26650 - DNA, 20 bp, Homo sapiens
ccgccgcctcctccctcagt

SEQ ID NO: 26651 - DNA, 25 bp, Homo sapiens
ccccatctctatgcacccaatggtc

SEQ ID NO: 26652 - DNA, 22 bp, Homo sapiens
ccccacctgcctccatacagtc

SEQ ID NO: 26653 - DNA, 22 bp, Homo sapiens
cccccaccgcctcccctgtatc

SEQ ID NO: 26654 - DNA, 21 bp, Homo sapiens
cccctagctcctccagccagt

SEQ ID NO: 26655 - DNA, 23 bp, Homo sapiens
cctccccctctaacaaggtggtc

SEQ ID NO: 26656 - DNA, 19 bp, Homo sapiens
cctccacctccacctccag

SEQ ID NO: 26657 - DNA, 19 bp, Homo sapiens
cccctcctcccccttggtc

SEQ ID NO: 26658 - DNA, 19 bp, Homo sapiens
ccccacccctccccaccgg

SEQ ID NO: 26659 - DNA, 17 bp, Homo sapiens
ccccacctcctactgcc

SEQ ID NO: 26660 - DNA, 17 bp, Homo sapiens
ccacctcctcccaagtc

SEQ ID NO: 26661 - DNA, 19 bp, Homo sapiens
ccctttcctcctccagggc

SEQ ID NO: 26662 - DNA, 17 bp, Homo sapiens
cccccacctctcctggt

SEQ ID NO: 26663 - DNA, 19 bp, Homo sapiens
ccttcacctcctccccagt

SEQ ID NO: 26664 - DNA, 21 bp, Homo sapiens
ccattgtctcctccagaggtc

SEQ ID NO: 26665 - DNA, 22 bp, Homo sapiens
cctttacctctctgccagtgtc

SEQ ID NO: 26666 - DNA, 21 bp, Homo sapiens
cccccgcccctccccgcagtc

SEQ ID NO: 26667 - DNA, 18 bp, Homo sapiens
cccctgcctcctccaggc

SEQ ID NO: 26668 - DNA, 19 bp, Homo sapiens
ccctcccctcctcccggtc

SEQ ID NO: 26669 - DNA, 19 bp, Homo sapiens
cctcatcctcctcctggtc

SEQ ID NO: 26670 - DNA, 25 bp, Homo sapiens
cctccacctcccaggtttaagcggt

SEQ ID NO: 26671 - DNA, 17 bp, Homo sapiens
cctgcctcccccagatc

SEQ ID NO: 26672 - DNA, 19 bp, Homo sapiens
cctcctccttcctgcagtc

SEQ ID NO: 26673 - DNA, 19 bp, Homo sapiens
cccccaccttccctcagtc

SEQ ID NO: 26674 - DNA, 18 bp, Homo sapiens
cccccgccttccccaggc

SEQ ID NO: 26675 - DNA, 21 bp, Homo sapiens
cccccatcccctgaattcagt

SEQ ID NO: 26676 - DNA, 17 bp, Homo sapiens
cccccacctcccctgat

SEQ ID NO: 26677 - DNA, 20 bp, Homo sapiens
cctgcctccccctccaggtc

SEQ ID NO: 26678 - DNA, 18 bp, Homo sapiens
ccttcacctccccaggcc

SEQ ID NO: 26679 - DNA, 22 bp, Homo sapiens
ccccctccacccctggatggtc

SEQ ID NO: 26680 - DNA, 19 bp, Homo sapiens
cctcctcctcctcccgctc

SEQ ID NO: 26681 - DNA, 19 bp, Homo sapiens
cccccagttcctcctgatc

SEQ ID NO: 26682 - DNA, 20 bp, Homo sapiens
cccacctccctcctgccagt

SEQ ID NO: 26683 - DNA, 21 bp, Homo sapiens
cccccatttcctataacggtc

SEQ ID NO: 26684 - DNA, 17 bp, Homo sapiens
cccccgccccctccggc

SEQ ID NO: 26685 - DNA, 19 bp, Homo sapiens
cctcctcctcctcctagtc

SEQ ID NO: 26686 - DNA, 17 bp, Homo sapiens
cccgtctcctccagatc

SEQ ID NO: 26687 - DNA, 19 bp, Homo sapiens
cccccaccgcctccgggtc

SEQ ID NO: 26688 - DNA, 18 bp, Homo sapiens
ccccaccttccccctggt

SEQ ID NO: 26689 - DNA, 18 bp, Homo sapiens
ccccgccccctccagggc

SEQ ID NO: 26690 - DNA, 19 bp, Homo sapiens
cctgcatctcctccaggtc

SEQ ID NO: 26691 - DNA, 23 bp, Homo sapiens
cctctgcctcccccaaccgtgtc

SEQ ID NO: 26692 - DNA, 26 bp, Homo sapiens
cccccagccccggggctccaggcggt

SEQ ID NO: 26693 - DNA, 18 bp, Homo sapiens
cctcctcctcctccgaac

SEQ ID NO: 26694 - DNA, 22 bp, Homo sapiens
ccaccacctcctccaagaagtc

SEQ ID NO: 26695 - DNA, 23 bp, Homo sapiens
ccctctcctcctcctacctggtc

SEQ ID NO: 26696 - DNA, 25 bp, Homo sapiens
ccccctcctcccgggttcaagcggt

SEQ ID NO: 26697 - DNA, 19 bp, Homo sapiens
cctcctcctcctccctgcc

SEQ ID NO: 26698 - DNA, 26 bp, Homo sapiens
cccccacctccttggcgaccgtttgg

SEQ ID NO: 26699 - DNA, 20 bp, Homo sapiens
cctttccctcctcctaaagt

SEQ ID NO: 26700 - DNA, 21 bp, Homo sapiens
cctccacctcctcccccactc

SEQ ID NO: 26701 - DNA, 17 bp, Homo sapiens
cctaacctcctccaggc

SEQ ID NO: 26702 - DNA, 18 bp, Homo sapiens
ccctacctccccagtgtc

SEQ ID NO: 26703 - DNA, 15 bp, Homo sapiens
ccacctcctcacagt

SEQ ID NO: 26704 - DNA, 21 bp, Homo sapiens
ccccttctcctccaccatgtc

SEQ ID NO: 26705 - DNA, 20 bp, Homo sapiens
cccgcctcctcccaccactc

SEQ ID NO: 26706 - DNA, 21 bp, Homo sapiens
ccctcacctcctctccctatc

SEQ ID NO: 26707 - DNA, 21 bp, Homo sapiens
cccggcctcctccctctggtc

SEQ ID NO: 26708 - DNA, 16 bp, Homo sapiens
cctccacctccccggc

SEQ ID NO: 26709 - DNA, 24 bp, Homo sapiens
ccccagcctcctcctgacctggtc

SEQ ID NO: 26710 - DNA, 19 bp, Homo sapiens
cccccaccccctcttgatc

SEQ ID NO: 26711 - DNA, 19 bp, Homo sapiens
cccgcctcctccgccggtc

SEQ ID NO: 26712 - DNA, 17 bp, Homo sapiens
ccagctcctccaagatc

SEQ ID NO: 26713 - DNA, 19 bp, Homo sapiens
ccgccgcctcctcccgctc

SEQ ID NO: 26714 - DNA, 20 bp, Homo sapiens
ccccctacttcctctatgtc

SEQ ID NO: 26715 - DNA, 19 bp, Homo sapiens
cctcctcttcctccaggtc

SEQ ID NO: 26716 - DNA, 22 bp, Homo sapiens
cctcctcctcttcctccaggtc

SEQ ID NO: 26717 - DNA, 17 bp, Homo sapiens
cccccacccctccccac

SEQ ID NO: 26718 - DNA, 19 bp, Homo sapiens
cccccaccacctcccgctc

SEQ ID NO: 26719 - DNA, 18 bp, Homo sapiens
ccccctcctcctccaggc

SEQ ID NO: 26720 - DNA, 19 bp, Homo sapiens
cctccacgtcctccagggc

SEQ ID NO: 26721 - DNA, 19 bp, Homo sapiens
ccttcacctcctcaagatc

SEQ ID NO: 26722 - DNA, 17 bp, Homo sapiens
ccgccgcctcctccgat

SEQ ID NO: 26723 - DNA, 21 bp, Homo sapiens
cccacctcctccaggaaggtc

SEQ ID NO: 26724 - DNA, 18 bp, Homo sapiens
cccctgccccctccagac

SEQ ID NO: 26725 - DNA, 18 bp, Homo sapiens
cctcctcctccaaggatc

SEQ ID NO: 26726 - DNA, 20 bp, Homo sapiens
ccccctcctcctccagaggt

SEQ ID NO: 26727 - DNA, 15 bp, Homo sapiens
cccacctccccagat

SEQ ID NO: 26728 - DNA, 19 bp, Homo sapiens
ccactgcctcctccagggc

SEQ ID NO: 26729 - DNA, 20 bp, Homo sapiens
cctccatctcctccagggtc

SEQ ID NO: 26730 - DNA, 21 bp, Homo sapiens
cccctgccccctccaaccagt

SEQ ID NO: 26731 - DNA, 20 bp, Homo sapiens
ccccactgtcctctccactc

SEQ ID NO: 26732 - DNA, 19 bp, Homo sapiens
cccacctcctccaagaagc

SEQ ID NO: 26733 - DNA, 100 bp, African swine fever virus
gcgtacctttttttcatccgatccctgccgggtaatacgtcccaagatttgctccatgttgtttctgcggggcgttgccatgatgatcgatgtcatatgc

SEQ ID NO: 26734 - DNA, 24 bp, African swine fever virus
tgccatgatgatcgatgtcatatg

SEQ ID NO: 26735 - DNA, 19 bp, Homo sapiens
tgtcacgatgattggtgtc

SEQ ID NO: 26736 - DNA, 20 bp, Homo sapiens
tgccatgatgatgatgtcac

SEQ ID NO: 26737 - DNA, 18 bp, Homo sapiens
tgccctggtgatcatatg

SEQ ID NO: 26738 - DNA, 21 bp, Homo sapiens
tgcaatgcatgctggtgtcat

SEQ ID NO: 26739 - DNA, 16 bp, Homo sapiens
tgatgagagtcatatg

SEQ ID NO: 26740 - DNA, 18 bp, Homo sapiens
tggcatgatttgtcatat

SEQ ID NO: 26741 - DNA, 92 bp, African swine fever virus
gccgataccttttcattaatacacacagggctaacgaagtcaggatgtccctgatattcgatttccctcacgtacccggaaaaggttgtggt

SEQ ID NO: 26742 - DNA, 24 bp, African swine fever virus
taccttttcattaatacacacagg

SEQ ID NO: 26743 - DNA, 18 bp, Homo sapiens
ctttttaaatcacacagg

SEQ ID NO: 26744 - DNA, 18 bp, Homo sapiens
cccttctgatacacacag

SEQ ID NO: 26745 - DNA, 17 bp, Homo sapiens
tttccaccacgcacagg

SEQ ID NO: 26746 - DNA, 21 bp, Homo sapiens
tttcttagaaatacacacggg

SEQ ID NO: 26747 - DNA, 23 bp, Homo sapiens
ctttttttaaacacacacacagg

SEQ ID NO: 26748 - DNA, 17 bp, Homo sapiens
ccttttcacatacacag

SEQ ID NO: 26749 - DNA, 20 bp, Homo sapiens
ttttcagaaatgcacacagg

SEQ ID NO: 26750 - DNA, 18 bp, Homo sapiens
ccttctcatttcacgcgg

SEQ ID NO: 26751 - DNA, 18 bp, Homo sapiens
ccttttcaaacacacagg

SEQ ID NO: 26752 - DNA, 22 bp, Homo sapiens
taccttctcattttagcacagg

SEQ ID NO: 26753 - DNA, 18 bp, Homo sapiens
taccttgtcaacacatag

SEQ ID NO: 26754 - DNA, 20 bp, Homo sapiens
taccttttcgtttaatatac

SEQ ID NO: 26755 - DNA, 23 bp, Homo sapiens
ttttcactaacagtacacatagg

SEQ ID NO: 26756 - DNA, 17 bp, Homo sapiens
ttttcgccacacacagg

SEQ ID NO: 26757 - DNA, 20 bp, Homo sapiens
tcttcaccaatacgtacagg

SEQ ID NO: 26758 - DNA, 20 bp, Homo sapiens
ttttcattggtacagacagg

SEQ ID NO: 26759 - DNA, 20 bp, Homo sapiens
cctttccattgattcccagg

SEQ ID NO: 26760 - DNA, 130 bp, African swine fever virus
agcgacacggggcgcgtcgtgtaaaccatgttaaacatttcaaactgctttcgcagcaatatgggaaaataaatgtattccccctgcagcgtgaaggcagtttcctgtcttatggctatgtgctttggct

SEQ ID NO: 26761 - DNA, 24 bp, African swine fever virus
cccctgcagcgtgaaggcagtttc

SEQ ID NO: 26762 - DNA, 18 bp, Homo sapiens
ctgcagtgtgaacagttc

SEQ ID NO: 26763 - DNA, 18 bp, Homo sapiens
ccttagagagggcagttt

SEQ ID NO: 26764 - DNA, 16 bp, Homo sapiens
ctgagcatggcagttt

SEQ ID NO: 26765 - DNA, 19 bp, Homo sapiens
cccttgcagtgtgaggggc

SEQ ID NO: 26766 - DNA, 21 bp, Homo sapiens
cccctgtgtttacagcagttt

SEQ ID NO: 26767 - DNA, 18 bp, Homo sapiens
ctccatggaaggcagttt

SEQ ID NO: 26768 - DNA, 18 bp, Homo sapiens
cccttccagtgtgaaggc

SEQ ID NO: 26769 - DNA, 18 bp, Homo sapiens
ccctggggaaggcagttt

SEQ ID NO: 26770 - DNA, 20 bp, Homo sapiens
cctcaggaaggaggcagttt

SEQ ID NO: 26771 - DNA, 22 bp, Homo sapiens
ctgcttgagcgaaggcagtttc

SEQ ID NO: 26772 - DNA, 21 bp, Homo sapiens
tgcttgagatgggggcagttt

SEQ ID NO: 26773 - DNA, 22 bp, Homo sapiens
cttcagtgtgtccagcagtttc

SEQ ID NO: 26774 - DNA, 20 bp, Homo sapiens
cctgcctcctgaggcagttt

SEQ ID NO: 26775 - DNA, 21 bp, Homo sapiens
cctgggagtaataggcagttt

SEQ ID NO: 26776 - DNA, 19 bp, Homo sapiens
cccttcagttaggcagttt

SEQ ID NO: 26777 - DNA, 21 bp, Homo sapiens
ctgcagctccgaggcggtttc

SEQ ID NO: 26778 - DNA, 22 bp, Homo sapiens
cctcccagggggaggcagtttc

SEQ ID NO: 26779 - DNA, 20 bp, Homo sapiens
cctactgtaagaggcagttt

SEQ ID NO: 26780 - DNA, 20 bp, Homo sapiens
cctgcgcgtcatgcagtttc

SEQ ID NO: 26781 - DNA, 17 bp, Homo sapiens
ccctacacaggcagttt

SEQ ID NO: 26782 - DNA, 18 bp, Homo sapiens
cccctgcagcagcagttt

SEQ ID NO: 26783 - DNA, 18 bp, Homo sapiens
ctgcagcgtcggttgttt

SEQ ID NO: 26784 - DNA, 20 bp, Homo sapiens
cttccagcggaaacagtttc

SEQ ID NO: 26785 - DNA, 17 bp, Homo sapiens
tgcagcgtgcatgtttc

SEQ ID NO: 26786 - DNA, 19 bp, Homo sapiens
tgctcacaaaggcagtttc

SEQ ID NO: 26787 - DNA, 21 bp, Homo sapiens
ccccttagtcaaaggcagttt

SEQ ID NO: 26788 - DNA, 17 bp, Homo sapiens
tgcagcacaggcagttt

SEQ ID NO: 26789 - DNA, 18 bp, Homo sapiens
ccctgagctgggcagttt

SEQ ID NO: 26790 - DNA, 19 bp, Homo sapiens
cctgtatcaaaggcagttt

SEQ ID NO: 26791 - DNA, 18 bp, Homo sapiens
cctcttacaaggcagttt

SEQ ID NO: 26792 - DNA, 19 bp, Homo sapiens
cctgcagcgtggggtagtc

SEQ ID NO: 26793 - DNA, 18 bp, Homo sapiens
ccctgcagcgggggattc

SEQ ID NO: 26794 - DNA, 19 bp, Homo sapiens
cctctcccagggcagtttc

SEQ ID NO: 26795 - DNA, 20 bp, Homo sapiens
ccctgcaggtaaagggtttc

SEQ ID NO: 26796 - DNA, 17 bp, Homo sapiens
tgcatatggggcagttt

SEQ ID NO: 26797 - DNA, 19 bp, Homo sapiens
cccctgcagatgacagttt

SEQ ID NO: 26798 - DNA, 18 bp, Homo sapiens
cccgtgcagcgtggaggc

SEQ ID NO: 26799 - DNA, 22 bp, Homo sapiens
cctttgaagctagggcagtttc

SEQ ID NO: 26800 - DNA, 16 bp, Homo sapiens
ctgggtgaaacagttt

SEQ ID NO: 26801 - DNA, 19 bp, Homo sapiens
ctccagtgtgagatatttc

SEQ ID NO: 26802 - DNA, 20 bp, Homo sapiens
ccgcaggccgagggcagttt

SEQ ID NO: 26803 - DNA, 20 bp, Homo sapiens
cctgcgcgtcacgcagtttc

SEQ ID NO: 26804 - DNA, 17 bp, Homo sapiens
cccctgcagcgtgcagt

SEQ ID NO: 26805 - DNA, 18 bp, Homo sapiens
cccctgtgggtggcattt

SEQ ID NO: 26806 - DNA, 18 bp, Homo sapiens
ctgtaacacagcagtttc

SEQ ID NO: 26807 - DNA, 21 bp, Homo sapiens
cctcttgccggaggcagtttc

SEQ ID NO: 26808 - DNA, 21 bp, Homo sapiens
tgcttgtgtgccaggcagttt

SEQ ID NO: 26809 - DNA, 21 bp, Homo sapiens
cctctcagtattgggcagttt

SEQ ID NO: 26810 - DNA, 80 bp, African swine fever virus
tagggctgctgatagctagcgctgcacttaaaaatggggtagccctttttcttgtaaatccggtgcctgtcgtagacctg

SEQ ID NO: 26811 - DNA, 22 bp, African swine fever virus
tccggtgcctgtcgtagacctg

SEQ ID NO: 26812 - DNA, 22 bp, Homo sapiens
tccggggctcggggtagacctg

SEQ ID NO: 26813 - DNA, 21 bp, Homo sapiens
ggtgcctggtaagttgatctg

SEQ ID NO: 26814 - DNA, 20 bp, Homo sapiens
ggtgcctgaaatgaggtctg

SEQ ID NO: 26815 - DNA, 19 bp, Homo sapiens
cctggtgcctgtgtctctg

SEQ ID NO: 26816 - DNA, 17 bp, Homo sapiens
cggttttgtcatagctg

SEQ ID NO: 26817 - DNA, 19 bp, Homo sapiens
cggggccaccacagacctg

SEQ ID NO: 26818 - DNA, 20 bp, Homo sapiens
tccggtgctggcttagtctg

SEQ ID NO: 26819 - DNA, 16 bp, Homo sapiens
tcctgtgcctgcaaac

SEQ ID NO: 26820 - DNA, 19 bp, Homo sapiens
tccggtgctgggggatctg

SEQ ID NO: 26821 - DNA, 18 bp, Homo sapiens
ggttcctgagcagacctg

SEQ ID NO: 26822 - DNA, 20 bp, Homo sapiens
tccggcgcctgctcagtctg

SEQ ID NO: 26823 - DNA, 21 bp, Homo sapiens
tcaggtgcctgtcactgtctg

SEQ ID NO: 26824 - DNA, 22 bp, Homo sapiens
cctggtgcctgtgaatagggct

SEQ ID NO: 26825 - DNA, 19 bp, Homo sapiens
tcaggtgcctgtccaagcc

SEQ ID NO: 26826 - DNA, 22 bp, Homo sapiens
tccagtgcctgtctggtgtctg

SEQ ID NO: 26827 - DNA, 16 bp, Homo sapiens
ggggcctgccagcctg

SEQ ID NO: 26828 - DNA, 19 bp, Homo sapiens
tccgtgctcaccagacctg

SEQ ID NO: 26829 - DNA, 19 bp, Homo sapiens
ccgagtggttgtagacctg

SEQ ID NO: 26830 - DNA, 20 bp, Homo sapiens
tccaggtgcctgtggtactg

SEQ ID NO: 26831 - DNA, 17 bp, Homo sapiens
tccggcgcctgtttcct

SEQ ID NO: 26832 - DNA, 17 bp, Homo sapiens
cggtgcccttagatctg

SEQ ID NO: 26833 - DNA, 18 bp, Homo sapiens
gtgctgatagtagacctg

SEQ ID NO: 26834 - DNA, 21 bp, Homo sapiens
tcttgtgcctggagccgcctg

SEQ ID NO: 26835 - DNA, 22 bp, Homo sapiens
tccggttctgaccccagatctg

SEQ ID NO: 26836 - DNA, 19 bp, Homo sapiens
ggggcctccctcagacctg

SEQ ID NO: 26837 - DNA, 20 bp, Homo sapiens
ggtgcctgtacacaggcctg

SEQ ID NO: 26838 - DNA, 18 bp, Homo sapiens
ggcgtttccgcagacctg

SEQ ID NO: 26839 - DNA, 67 bp, Human herpesvirus 4
gggtggctatctatccataggcaggcatccggcgtctttggtgcattggagatagtagctttcaccc

SEQ ID NO: 26840 - DNA, 24 bp, Human herpesvirus 4
gtgcattggagatagtagctttca

SEQ ID NO: 26841 - DNA, 23 bp, Homo sapiens
gtgcattgggtaatcagtgcttt

SEQ ID NO: 26842 - DNA, 23 bp, Homo sapiens
gtgcattggaggcctggctttca

SEQ ID NO: 26843 - DNA, 24 bp, Homo sapiens
gtgcattgtggatggtaagtcctc

SEQ ID NO: 26844 - DNA, 20 bp, Homo sapiens
gtgcagtgctggtagctttc

SEQ ID NO: 26845 - DNA, 21 bp, Homo sapiens
gtgtttggagatggcatcttt

SEQ ID NO: 26846 - DNA, 15 bp, Homo sapiens
gcattgggcagcttt

SEQ ID NO: 26847 - DNA, 125 bp, Variola virus
cgaggaataataagaacaaagtaatgcctgtaaaaataaacatcaacattgtatgatggtcattaaaccaattagtatgacgttgaactaatttcacagtagattttattccggtgttatcctcg

SEQ ID NO: 26848 - DNA, 24 bp, Variola virus
tttcacagtagattttattccggt

SEQ ID NO: 26849 - DNA, 19 bp, Homo sapiens
gcagactcattattctggt

SEQ ID NO: 26850 - DNA, 21 bp, Homo sapiens
tttcacagtgatttctggggt

SEQ ID NO: 26851 - DNA, 15 bp, Homo sapiens
ttcacagtgattctg

SEQ ID NO: 26852 - DNA, 24 bp, Homo sapiens
tttcttaataaattttattttggt

SEQ ID NO: 26853 - DNA, 21 bp, Homo sapiens
tttcacagtaaataaactggt

SEQ ID NO: 26854 - DNA, 25 bp, Homo sapiens
cttcacagtaggtgctgtatttggt

SEQ ID NO: 26855 - DNA, 24 bp, Homo sapiens
tttcacagtggatgtacagatggt

SEQ ID NO: 26856 - DNA, 96 bp, Human herpesvirus 4
gtggcccaacctctgctcccctctattctcctcttgcgttatctccaatagaatttgcttgaggtcatacgttttagggtgctcgacctgggccgc

SEQ ID NO: 26857 - DNA, 24 bp, Human herpesvirus 4
cttgaggtcatacgttttagggtg

SEQ ID NO: 26858 - DNA, 22 bp, Homo sapiens
cttgaggtctgctgtgggggtg

SEQ ID NO: 26859 - DNA, 21 bp, Homo sapiens
ttggggtctgctgccagggtg

SEQ ID NO: 26860 - DNA, 21 bp, Homo sapiens
cttaaggtatattttagggtg

SEQ ID NO: 26861 - DNA, 18 bp, Homo sapiens
cttgaggtcggtgttggt

SEQ ID NO: 26862 - DNA, 18 bp, Homo sapiens
tgaggcttgttttagggt

SEQ ID NO: 26863 - DNA, 18 bp, Homo sapiens
cttgaggtttgtgttaag

SEQ ID NO: 26864 - DNA, 22 bp, Homo sapiens
cttgaggcaggcctttggggtg

SEQ ID NO: 26865 - DNA, 105 bp, Variola virus
agtacacggaataatgatggtatcattgcacgccgtatactctatagtctttgtagatgttataaccacaaaagtgcagaggtatatcaacaatattctaactct

SEQ ID NO: 26866 - DNA, 24 bp, Variola virus
cattgcacgccgtatactctatag

SEQ ID NO: 26867 - DNA, 18 bp, Homo sapiens
actgcacgccttttctat

SEQ ID NO: 26868 - DNA, 87 bp, Aedes albopictus densovirus
cgtcaggagcaacaacgaggcaaaccctattcaggaacagaacatcatatccaagaatgcacattgcacaaccacaagttccagacg

SEQ ID NO: 26869 - DNA, 24 bp, Aedes albopictus densovirus
aggcaaaccctattcaggaacaga

SEQ ID NO: 26870 - DNA, 18 bp, Homo sapiens
ggcacgctctcggaacag

SEQ ID NO: 26871 - DNA, 23 bp, Homo sapiens
aggcaaacctgttcacactcagg

SEQ ID NO: 26872 - DNA, 23 bp, Homo sapiens
agacagaatcattcaggggcaga

SEQ ID NO: 26873 - DNA, 21 bp, Homo sapiens
ggctaaaccctacttggcagg

SEQ ID NO: 26874 - DNA, 22 bp, Homo sapiens
aggaaactaatataggaacaga

SEQ ID NO: 26875 - DNA, 19 bp, Homo sapiens
aggcaaactcattcctcag

SEQ ID NO: 26876 - DNA, 19 bp, Homo sapiens
agcaaactgtagggaacag

SEQ ID NO: 26877 - DNA, 23 bp, Homo sapiens
aggaaatagatgccaggaacaga

SEQ ID NO: 26878 - DNA, 23 bp, Homo sapiens
aggcaaacttggaagaaagcaga

SEQ ID NO: 26879 - DNA, 22 bp, Homo sapiens
aggctgaacccccaggaatgga

SEQ ID NO: 26880 - DNA, 19 bp, Homo sapiens
aggcatgtccaaggaacag

SEQ ID NO: 26881 - DNA, 17 bp, Homo sapiens
agcaaatgccaggaacg

SEQ ID NO: 26882 - DNA, 21 bp, Homo sapiens
ggcaggcccatgtagaacaga

SEQ ID NO: 26883 - DNA, 22 bp, Homo sapiens
aggtggccctagaaggaacaga

SEQ ID NO: 26884 - DNA, 21 bp, Homo sapiens
agcaaaccgcgaaggaacaga

SEQ ID NO: 26885 - DNA, 20 bp, Homo sapiens
aggcaaaatcttaaaaacag

SEQ ID NO: 26886 - DNA, 17 bp, Homo sapiens
ggcagacctaggaacag

SEQ ID NO: 26887 - DNA, 21 bp, Homo sapiens
aggtgaactgcaaggaacaga

SEQ ID NO: 26888 - DNA, 19 bp, Homo sapiens
aggcaaactctgcagacag

SEQ ID NO: 26889 - DNA, 18 bp, Homo sapiens
aggcgcacccaggaacag

SEQ ID NO: 26890 - DNA, 22 bp, Homo sapiens
agcaaactaatgcaggaacaga

SEQ ID NO: 26891 - DNA, 21 bp, Homo sapiens
ggcaaaccattagggaatgga

SEQ ID NO: 26892 - DNA, 21 bp, Homo sapiens
aggcaaaccattgataacaga

SEQ ID NO: 26893 - DNA, 18 bp, Homo sapiens
aggcaaacactgacagga

SEQ ID NO: 26894 - DNA, 24 bp, Homo sapiens
agacaaactcttcccaggaacaga

SEQ ID NO: 26895 - DNA, 19 bp, Homo sapiens
aggcagggcctgggaacag

SEQ ID NO: 26896 - DNA, 23 bp, Homo sapiens
agccaaacagtgttgggaacaga

SEQ ID NO: 26897 - DNA, 19 bp, Homo sapiens
aggcaaaccttactgtgga

SEQ ID NO: 26898 - DNA, 20 bp, Homo sapiens
aggcaaactgctagggcagg

SEQ ID NO: 26899 - DNA, 21 bp, Homo sapiens
aggcaggcccatccaaatgga

SEQ ID NO: 26900 - DNA, 24 bp, Homo sapiens
agctagaccctatcaggtgaacag

SEQ ID NO: 26901 - DNA, 21 bp, Homo sapiens
ggcaggccctagcaggaacag

SEQ ID NO: 26902 - DNA, 21 bp, Homo sapiens
aggcagtgtccagggaacaga

SEQ ID NO: 26903 - DNA, 22 bp, Homo sapiens
ggggaaccctacgagggggcag

SEQ ID NO: 26904 - DNA, 20 bp, Homo sapiens
ggctgagctgtcaggaacag

SEQ ID NO: 26905 - DNA, 16 bp, Homo sapiens
agcaaacccaggagca

SEQ ID NO: 26906 - DNA, 23 bp, Homo sapiens
aggcaaaccttaggtgggggcag

SEQ ID NO: 26907 - DNA, 17 bp, Homo sapiens
gacaagccaaggaacag

SEQ ID NO: 26908 - DNA, 21 bp, Homo sapiens
aggtaagccctatcagggcag

SEQ ID NO: 26909 - DNA, 23 bp, Homo sapiens
aggcaaactccagagagggcaga

SEQ ID NO: 26910 - DNA, 23 bp, Homo sapiens
aagcaaaccacctttgggggcag

SEQ ID NO: 26911 - DNA, 19 bp, Homo sapiens
aggcagactcagaaacaaa

SEQ ID NO: 26912 - DNA, 22 bp, Homo sapiens
agcaaactaacacaggaacaga

SEQ ID NO: 26913 - DNA, 24 bp, Homo sapiens
agacaaacctttttagggaacgga

SEQ ID NO: 26914 - DNA, 19 bp, Homo sapiens
aagcaaaccctgtgacagg

SEQ ID NO: 26915 - DNA, 20 bp, Homo sapiens
ggtcaaagcatcaggaacag

SEQ ID NO: 26916 - DNA, 22 bp, Homo sapiens
aggcagacagagaaggaacaga

SEQ ID NO: 26917 - DNA, 20 bp, Homo sapiens
ggcaggctccaggaagacag

SEQ ID NO: 26918 - DNA, 20 bp, Homo sapiens
ggcgactgtgcaggaacaga

SEQ ID NO: 26919 - DNA, 21 bp, Homo sapiens
aggaaggcctggtggaacaga

SEQ ID NO: 26920 - DNA, 20 bp, Homo sapiens
aggaaaccctgccccagcag

SEQ ID NO: 26921 - DNA, 19 bp, Homo sapiens
ggctaaaccccagggacag

SEQ ID NO: 26922 - DNA, 24 bp, Homo sapiens
aggcaaacccatatctggagtaga

SEQ ID NO: 26923 - DNA, 22 bp, Homo sapiens
aggctaacccagaaggaacaga

SEQ ID NO: 26924 - DNA, 19 bp, Homo sapiens
aaaccctatagtctacaga

SEQ ID NO: 26925 - DNA, 19 bp, Homo sapiens
aggcaaacccataaacagg

SEQ ID NO: 26926 - DNA, 24 bp, Homo sapiens
agacaagccctattctaagcgtag

SEQ ID NO: 26927 - DNA, 18 bp, Homo sapiens
aaacaaaccaggggcaga

SEQ ID NO: 26928 - DNA, 130 bp, Aedes albopictus densovirus
ggcgaagcttaggtttactgacgtcacttcaaatacactcaaaaaaattaagtttctattagaaacaacgtaatacgttttaatttttttgagtgtatttgaagtgacgtcagtaaacctaagcttcgcc

SEQ ID NO: 26929 - DNA, 24 bp, Aedes albopictus densovirus
tcaaaaaaattaagtttctattag

SEQ ID NO: 26930 - DNA, 18 bp, Homo sapiens
aaaaaaattaagtaacta

SEQ ID NO: 26931 - DNA, 60 bp, Cowpox virus
tgtcggagagtaaacattgacggataaaacaaaaatgctccgcataactctaccatggca

SEQ ID NO: 26932 - DNA, 24 bp, Cowpox virus
tcggagagtaaacattgacggata

SEQ ID NO: 26933 - DNA, 19 bp, Homo sapiens
ggagagtacagtgtgagat

SEQ ID NO: 26934 - DNA, 19 bp, Homo sapiens
tcggggagtaaacaggagg

SEQ ID NO: 26935 - DNA, 22 bp, Homo sapiens
tcagagagtaaagctggtggat

SEQ ID NO: 26936 - DNA, 16 bp, Homo sapiens
gggagtaaacataaca

SEQ ID NO: 26937 - DNA, 17 bp, Homo sapiens
tcggagagtaaagagga

SEQ ID NO: 26938 - DNA, 21 bp, Homo sapiens
tcggagagctgggcaaaggat

SEQ ID NO: 26939 - DNA, 131 bp, Cowpox virus
cgatttcgagaaataataagaataaagtaatgcctgtaaagataaacatcaacattgtttggtaatcattaaaccaattagtatgacgttgaactaatttcacagtagattttattccagtgttatcctcg

SEQ ID NO: 26940 - DNA, 24 bp, Cowpox virus
tgtaaagataaacatcaacattgt

SEQ ID NO: 26941 - DNA, 21 bp, Homo sapiens
tgtaatgattagcaacattgt

SEQ ID NO: 26942 - DNA, 20 bp, Homo sapiens
taaagataaaccaatattgt

SEQ ID NO: 26943 - DNA, 18 bp, Homo sapiens
taaagataaacatcagca

SEQ ID NO: 26944 - DNA, 19 bp, Homo sapiens
tataaaggtaaacatcaca

SEQ ID NO: 26945 - DNA, 18 bp, Homo sapiens
tgtaaagataatatcaac

SEQ ID NO: 26946 - DNA, 24 bp, Homo sapiens
tgtaatcagtagcatcaacattgt

SEQ ID NO: 26947 - DNA, 28 bp, Homo sapiens
tgtaaagatacagcaatctaaacattgt

SEQ ID NO: 26948 - DNA, 119 bp, Ectromelia virus
ggatcacgccatttagtcataacagtaatccaaaattttttaaagtatattttaacgaaagaagttgtatcatcgttaggatttggaaaatcttgtctacagtgtatggcacgagatcc

SEQ ID NO: 26949 - DNA, 24 bp, Ectromelia virus
tccaaaattttttaaagtatattt

SEQ ID NO: 26950 - DNA, 26 bp, Homo sapiens
tcctaaaatttcctagaagtgtattt

SEQ ID NO: 26951 - DNA, 24 bp, Homo sapiens
tccaaacattttttaagtacacct

SEQ ID NO: 26952 - DNA, 22 bp, Homo sapiens
tccaaaaatttttgcaatatat

SEQ ID NO: 26953 - DNA, 22 bp, Homo sapiens
caaaattaaccaaagtatattt

SEQ ID NO: 26954 - DNA, 22 bp, Homo sapiens
tccaaaatttttgagtccattt

SEQ ID NO: 26955 - DNA, 61 bp, Rice yellow mottle virus
tccacatcggcagatgcgacgacatacgattgtgtgccgtttaatctgcctcgggtgtgga

SEQ ID NO: 26956 - DNA, 24 bp, Rice yellow mottle virus
catcggcagatgcgacgacatacg

SEQ ID NO: 26957 - DNA, 18 bp, Homo sapiens
ggtagaataagacatacg

SEQ ID NO: 26958 - DNA, 107 bp, Murid herpesvirus 4
ctgggtttgtgtgccgacttgttccttttaccctttgatgacttactgccctgacctgacccgtctaccgcctcctcatcacctttagaacactccctcacgcccag

SEQ ID NO: 26959 - DNA, 24 bp, Murid herpesvirus 4
accctttgatgacttactgccctg

SEQ ID NO: 26960 - DNA, 18 bp, Homo sapiens
tttgtgtttactgccctg

SEQ ID NO: 26961 - DNA, 21 bp, Homo sapiens
cccttggtcacagctgctctg

SEQ ID NO: 26962 - DNA, 20 bp, Homo sapiens
cttgttcccttactgctctg

SEQ ID NO: 26963 - DNA, 21 bp, Homo sapiens
accctctgaaacaggctgtct

SEQ ID NO: 26964 - DNA, 21 bp, Homo sapiens
ctttggtatgctgctgccctg

SEQ ID NO: 26965 - DNA, 16 bp, Homo sapiens
cccttcttactgccct

SEQ ID NO: 26966 - DNA, 16 bp, Homo sapiens
cttgatgatacttcct

SEQ ID NO: 26967 - DNA, 22 bp, Homo sapiens
accctgtgttcctattgccctg

SEQ ID NO: 26968 - DNA, 22 bp, Homo sapiens
accctttgtggggccagccctg

SEQ ID NO: 26969 - DNA, 21 bp, Homo sapiens
ccttttgatgatgactccctg

SEQ ID NO: 26970 - DNA, 19 bp, Homo sapiens
ccattggtccactgccctg

SEQ ID NO: 26971 - DNA, 19 bp, Homo sapiens
ctctggacttgctgccctg

SEQ ID NO: 26972 - DNA, 20 bp, Homo sapiens
cctttaatgactgatccctg

SEQ ID NO: 26973 - DNA, 15 bp, Homo sapiens
ccccttgatctgccc

SEQ ID NO: 26974 - DNA, 23 bp, Homo sapiens
cccttctgacctctactgccctg

SEQ ID NO: 26975 - DNA, 21 bp, Homo sapiens
accctttggtcgcttgaactg

SEQ ID NO: 26976 - DNA, 18 bp, Homo sapiens
cccttgatgacttttcct

SEQ ID NO: 26977 - DNA, 24 bp, Homo sapiens
cctttgatggaatcccctgctctg

SEQ ID NO: 26978 - DNA, 18 bp, Homo sapiens
ctttgatgccctgctctg

SEQ ID NO: 26979 - DNA, 21 bp, Homo sapiens
ctttggatgacttaaaccctg

SEQ ID NO: 26980 - DNA, 23 bp, Homo sapiens
acccttgatggtgcaaggccctg

SEQ ID NO: 26981 - DNA, 17 bp, Homo sapiens
cccttcgatgactccct

SEQ ID NO: 26982 - DNA, 18 bp, Homo sapiens
accctttaatgactccct

SEQ ID NO: 26983 - DNA, 21 bp, Homo sapiens
cctttgggtcacttactgtct

SEQ ID NO: 26984 - DNA, 20 bp, Homo sapiens
ctttgatgatttagcttctg

SEQ ID NO: 26985 - DNA, 20 bp, Homo sapiens
cttttgtgtgtactgccctg

SEQ ID NO: 26986 - DNA, 18 bp, Homo sapiens
accctaacctcttgctgc

SEQ ID NO: 26987 - DNA, 18 bp, Homo sapiens
cccttggtgactcacgcc

SEQ ID NO: 26988 - DNA, 19 bp, Homo sapiens
cctttgtcaccctgccctg

SEQ ID NO: 26989 - DNA, 19 bp, Homo sapiens
acccttgggccactgccct

SEQ ID NO: 26990 - DNA, 22 bp, Homo sapiens
acccactgggcttgctgtcctg

SEQ ID NO: 26991 - DNA, 19 bp, Homo sapiens
ctctccatttactgccctg

SEQ ID NO: 26992 - DNA, 24 bp, Homo sapiens
cccttttgatgataacagctcctg

SEQ ID NO: 26993 - DNA, 17 bp, Homo sapiens
ccccttggcgctgccct

SEQ ID NO: 26994 - DNA, 17 bp, Homo sapiens
cccttgacagctgccct

SEQ ID NO: 26995 - DNA, 60 bp, Murid herpesvirus 4
acatagcccaaatggacacttgcggttaggacaaaaccgcaagcggtcgataggccatgt

SEQ ID NO: 26996 - DNA, 24 bp, Murid herpesvirus 4
aaatggacacttgcggttaggaca

SEQ ID NO: 26997 - DNA, 17 bp, Homo sapiens
tggacacctgtgccaag

SEQ ID NO: 26998 - DNA, 16 bp, Homo sapiens
tggctgctgttaggac

SEQ ID NO: 26999 - DNA, 18 bp, Homo sapiens
aaatagacatttgtagac

SEQ ID NO: 27000 - DNA, 18 bp, Homo sapiens
ggatggacactgatcaag

SEQ ID NO: 27001 - DNA, 20 bp, Homo sapiens
tgggcacttacagaagggca

SEQ ID NO: 27002 - DNA, 20 bp, Homo sapiens
ggatggacattttgaggaca

SEQ ID NO: 27003 - DNA, 18 bp, Homo sapiens
tggacgtcttatcaggac

SEQ ID NO: 27004 - DNA, 18 bp, Homo sapiens
aaatggacatttggggac

SEQ ID NO: 27005 - DNA, 20 bp, Homo sapiens
aatggaggtttgggaggaca

SEQ ID NO: 27006 - DNA, 20 bp, Homo sapiens
tggacactggactggtttgg

SEQ ID NO: 27007 - DNA, 20 bp, Homo sapiens
ggatgaacacttgcaccagg

SEQ ID NO: 27008 - DNA, 16 bp, Homo sapiens
tagacacttgagtagg

SEQ ID NO: 27009 - DNA, 18 bp, Homo sapiens
ggatggccacttgcagac

SEQ ID NO: 27010 - DNA, 18 bp, Homo sapiens
aaatggacattgtagtgg

SEQ ID NO: 27011 - DNA, 18 bp, Homo sapiens
aaatggacgcttggaagc

SEQ ID NO: 27012 - DNA, 16 bp, Homo sapiens
tggatacttgcaaaga

SEQ ID NO: 27013 - DNA, 16 bp, Homo sapiens
atggacacttggggac

SEQ ID NO: 27014 - DNA, 19 bp, Homo sapiens
tgggcacttgtggctagaa

SEQ ID NO: 27015 - DNA, 18 bp, Homo sapiens
gacacttggatggggaca

SEQ ID NO: 27016 - DNA, 20 bp, Homo sapiens
aaatggacatctgattggga

SEQ ID NO: 27017 - DNA, 18 bp, Homo sapiens
tggacacttgtgaaaaca

SEQ ID NO: 27018 - DNA, 18 bp, Homo sapiens
ggatgggcacctacgggg

SEQ ID NO: 27019 - DNA, 63 bp, Lymphocystis disease virus 1
aaattaaacctgatttaaatgatttacatgttgatgcaaaatcttttgctaaaattttaattt

SEQ ID NO: 27020 - DNA, 23 bp, Lymphocystis disease virus 1
atcttttgctaaaattttaattt

SEQ ID NO: 27021 - DNA, 18 bp, Homo sapiens
tcttttgccttttaattt

SEQ ID NO: 27022 - DNA, 21 bp, Homo sapiens
atctcttgctatgcttaattt

SEQ ID NO: 27023 - DNA, 18 bp, Homo sapiens
atcttttgctgtaacttt

SEQ ID NO: 27024 - DNA, 21 bp, Homo sapiens
atctcttgctgtgcctaattt

SEQ ID NO: 27025 - DNA, 19 bp, Homo sapiens
tctcgcaaaattttaattt

SEQ ID NO: 27026 - DNA, 26 bp, Homo sapiens
atcttttactcaggtaattttaattt

SEQ ID NO: 27027 - DNA, 20 bp, Homo sapiens
ttttgctaggactctaattt

SEQ ID NO: 27028 - DNA, 20 bp, Homo sapiens
atcttttgccagctcaattt

SEQ ID NO: 27029 - DNA, 122 bp, Lymphocystis disease virus 1
tttaactttcgctttattttttatggttttaaaatcatatgctacattagtacttaagcctaaataaattgcatttgtagctgtaaatttgtattctaaaaagtaattatttggtagttgaa

SEQ ID NO: 27030 - DNA, 24 bp, Lymphocystis disease virus 1
tgtaaatttgtattctaaaaagta

SEQ ID NO: 27031 - DNA, 21 bp, Homo sapiens
tgtacaaaattctaaaaagta

SEQ ID NO: 27032 - DNA, 24 bp, Homo sapiens
tgtatatttagcatgctaaaaagt

SEQ ID NO: 27033 - DNA, 24 bp, Homo sapiens
tgtaaattctacagctgaaaagta

SEQ ID NO: 27034 - DNA, 103 bp, Human herpesvirus 6B
ctaggtttcagacacgtttatccattcgccgggtattgatcgggtcatatcattagccgtgaataatctctggcttcatttcgatacaacgtgtgaaaactag

SEQ ID NO: 27035 - DNA, 19 bp, Human herpesvirus 6B
tacaacgtgtgaaaactag

SEQ ID NO: 27036 - DNA, 19 bp, Homo sapiens
cacaaaatttgaaaactag

SEQ ID NO: 27037 - DNA, 19 bp, Homo sapiens
acagactgatgaaaactag

SEQ ID NO: 27038 - DNA, 19 bp, Homo sapiens
tactttatatgaaaactag

SEQ ID NO: 27039 - DNA, 17 bp, Homo sapiens
acaacatagagaactag

SEQ ID NO: 27040 - DNA, 18 bp, Homo sapiens
acaccacctgaaaactag

SEQ ID NO: 27041 - DNA, 20 bp, Homo sapiens
tacaaagcataaaaaactag

SEQ ID NO: 27042 - DNA, 19 bp, Homo sapiens
acatgtgaacctaaactag

SEQ ID NO: 27043 - DNA, 18 bp, Homo sapiens
cacaacatgatgagctag

SEQ ID NO: 27044 - DNA, 110 bp, Human herpesvirus 6B
ttaagcaagtgtaatttttagcagtccaagtttttatgcaacgcagattttaatgatgtgtccctcgataactatacgctggaaactaaactaacttacatcttggttga

SEQ ID NO: 27045 - DNA, 24 bp, Human herpesvirus 6B
tacgctggaaactaaactaactta

SEQ ID NO: 27046 - DNA, 19 bp, Homo sapiens
ctggaaactaaaacaacct

SEQ ID NO: 27047 - DNA, 22 bp, Homo sapiens
tacgtctaaactaagttaactt

SEQ ID NO: 27048 - DNA, 16 bp, Homo sapiens
cactttaaactaactt

SEQ ID NO: 27049 - DNA, 68 bp, Ground squirrel hepatitis virus
agttggagaattattttggacctttaactactaatgaaaaaaggagactaaaacttgtatttccagct

SEQ ID NO: 27050 - DNA, 24 bp, Ground squirrel hepatitis virus
tggagaattattttggacctttaa

SEQ ID NO: 27051 - DNA, 18 bp, Homo sapiens
tggagaataatgccttta

SEQ ID NO: 27052 - DNA, 18 bp, Homo sapiens
tggagagttattttgtac

SEQ ID NO: 27053 - DNA, 20 bp, Homo sapiens
tggggaattgtgaaaccttt

SEQ ID NO: 27054 - DNA, 21 bp, Homo sapiens
gggaattattccgttttttaa

SEQ ID NO: 27055 - DNA, 20 bp, Homo sapiens
aagttattttggacctttaa

SEQ ID NO: 27056 - DNA, 18 bp, Homo sapiens
tagagaactacattttgg

SEQ ID NO: 27057 - DNA, 22 bp, Homo sapiens
tggaagattattctattgcttt

SEQ ID NO: 27058 - DNA, 23 bp, Homo sapiens
tggagaatttttcttaattttag

SEQ ID NO: 27059 - DNA, 22 bp, Homo sapiens
ggagatcattttggacttttaa

SEQ ID NO: 27060 - DNA, 62 bp, Ground squirrel hepatitis virus
gctgcatggtggccaacagtgggaacttattatacacccactaccaccgtgacaaatccagc

SEQ ID NO: 27061 - DNA, 20 bp, Ground squirrel hepatitis virus
accaccgtgacaaatccagc

SEQ ID NO: 27062 - DNA, 18 bp, Homo sapiens
ccagtgagggaaatccag

SEQ ID NO: 27063 - DNA, 15 bp, Homo sapiens
ccaccataatccagc

SEQ ID NO: 27064 - DNA, 17 bp, Homo sapiens
ccccagaaaaaatccag

SEQ ID NO: 27065 - DNA, 18 bp, Homo sapiens
cacagtaaccaaatccag

SEQ ID NO: 27066 - DNA, 16 bp, Homo sapiens
cacccacaaatccagc

SEQ ID NO: 27067 - DNA, 17 bp, Homo sapiens
caacatacaaatccagc

SEQ ID NO: 27068 - DNA, 20 bp, Homo sapiens
accacgttttgaaatccagc

SEQ ID NO: 27069 - DNA, 18 bp, Homo sapiens
accaatgggaaaatccag

SEQ ID NO: 27070 - DNA, 20 bp, Homo sapiens
acccctgctgcaggtccagc

SEQ ID NO: 27071 - DNA, 17 bp, Homo sapiens
accccgtgacagtccag

SEQ ID NO: 27072 - DNA, 20 bp, Homo sapiens
ccgtgacctgtaaatccagc

SEQ ID NO: 27073 - DNA, 17 bp, Homo sapiens
accaccatggcaccggc

SEQ ID NO: 27074 - DNA, 17 bp, Homo sapiens
caccactccaatccagc

SEQ ID NO: 27075 - DNA, 21 bp, Homo sapiens
accagtgcattaaaaatccag

SEQ ID NO: 27076 - DNA, 17 bp, Homo sapiens
cactgtgacaaattagc

SEQ ID NO: 27077 - DNA, 21 bp, Homo sapiens
accgccgagtcaagattcagc

SEQ ID NO: 27078 - DNA, 18 bp, Homo sapiens
accccagcacagtccagc

SEQ ID NO: 27079 - DNA, 17 bp, Homo sapiens
caccatgagaattcagc

SEQ ID NO: 27080 - DNA, 17 bp, Homo sapiens
accaccgtgattctcag

SEQ ID NO: 27081 - DNA, 16 bp, Homo sapiens
catcatgaaatccagc

SEQ ID NO: 27082 - DNA, 16 bp, Homo sapiens
cagccatgaatccagc

SEQ ID NO: 27083 - DNA, 17 bp, Homo sapiens
ccagagccaaatccagc

SEQ ID NO: 27084 - DNA, 17 bp, Homo sapiens
ccaccgtgactcccagc

SEQ ID NO: 27085 - DNA, 19 bp, Homo sapiens
accatcctttaaatccagc

SEQ ID NO: 27086 - DNA, 19 bp, Homo sapiens
ccaagaccctgaatccagc

SEQ ID NO: 27087 - DNA, 22 bp, Homo sapiens
accaccatggttcgccatcagc

SEQ ID NO: 27088 - DNA, 15 bp, Homo sapiens
ccaccgcaatccagc

SEQ ID NO: 27089 - DNA, 19 bp, Homo sapiens
accaccatgagacaccagc

SEQ ID NO: 27090 - DNA, 18 bp, Homo sapiens
ccatggactgaatccagc

SEQ ID NO: 27091 - DNA, 17 bp, Homo sapiens
cctaccgtgacatcagc

SEQ ID NO: 27092 - DNA, 20 bp, Homo sapiens
ccaccagctccaaatccagc

SEQ ID NO: 27093 - DNA, 22 bp, Homo sapiens
caccgtgacgcagaccttcagc

SEQ ID NO: 27094 - DNA, 17 bp, Homo sapiens
accaccgtgagcccggc

SEQ ID NO: 27095 - DNA, 16 bp, Homo sapiens
ccaccatggactccag

SEQ ID NO: 27096 - DNA, 16 bp, Homo sapiens
ccactcagaatccagc

SEQ ID NO: 27097 - DNA, 18 bp, Homo sapiens
accaccgtggcccacagc

SEQ ID NO: 27098 - DNA, 16 bp, Homo sapiens
accacctaaatccagc

SEQ ID NO: 27099 - DNA, 21 bp, Homo sapiens
caccgtgacaccgcctccagc

SEQ ID NO: 27100 - DNA, 17 bp, Homo sapiens
ccccaggacaaatccag

SEQ ID NO: 27101 - DNA, 15 bp, Homo sapiens
ccccgtgacaacagc

SEQ ID NO: 27102 - DNA, 17 bp, Homo sapiens
accacagctaatccagc

SEQ ID NO: 27103 - DNA, 19 bp, Homo sapiens
accacatttagaatccagc

SEQ ID NO: 27104 - DNA, 18 bp, Homo sapiens
caccgcgacgagtccagc

SEQ ID NO: 27105 - DNA, 23 bp, Homo sapiens
ccaccatggagacagagtccagc

SEQ ID NO: 27106 - DNA, 18 bp, Homo sapiens
ccaatcatagaatccagc

SEQ ID NO: 27107 - DNA, 19 bp, Homo sapiens
cacttgtggtaaatccagc

SEQ ID NO: 27108 - DNA, 17 bp, Homo sapiens
catcacgaaaatccagc

SEQ ID NO: 27109 - DNA, 19 bp, Homo sapiens
ccaccatggtgaccgcagc

SEQ ID NO: 27110 - DNA, 18 bp, Homo sapiens
ccagaactcaaatccagc

SEQ ID NO: 27111 - DNA, 20 bp, Homo sapiens
ccccgtgacatgttcttagc

SEQ ID NO: 27112 - DNA, 16 bp, Homo sapiens
ccaccgtaactctagc

SEQ ID NO: 27113 - DNA, 19 bp, Homo sapiens
accaccttaaaaaatccag

SEQ ID NO: 27114 - DNA, 20 bp, Homo sapiens
actgccatgacagacagagc

SEQ ID NO: 27115 - DNA, 17 bp, Homo sapiens
cctgcgcgcaatccagc

SEQ ID NO: 27116 - DNA, 17 bp, Homo sapiens
accaccgcgacgacagc

SEQ ID NO: 27117 - DNA, 22 bp, Homo sapiens
ccaccatgggtgaccgtccagc

SEQ ID NO: 27118 - DNA, 20 bp, Homo sapiens
caccgtgacttccttccagc

SEQ ID NO: 27119 - DNA, 16 bp, Homo sapiens
ccaccatgaattcagc

SEQ ID NO: 27120 - DNA, 17 bp, Homo sapiens
caacggagaaatccagc

SEQ ID NO: 27121 - DNA, 20 bp, Homo sapiens
accctggctccaaatccagc

SEQ ID NO: 27122 - DNA, 20 bp, Homo sapiens
ccaaaataaataaatccagc

SEQ ID NO: 27123 - DNA, 17 bp, Homo sapiens
ccaccgtgcactccggc

SEQ ID NO: 27124 - DNA, 17 bp, Homo sapiens
cctcatgaaaatccagc

SEQ ID NO: 27125 - DNA, 17 bp, Homo sapiens
ccactgtgaaacccagc

SEQ ID NO: 27126 - DNA, 16 bp, Homo sapiens
accaccataatccagc

SEQ ID NO: 27127 - DNA, 18 bp, Homo sapiens
ccatccccagaatccagc

SEQ ID NO: 27128 - DNA, 18 bp, Homo sapiens
accaccgctgatcctagc

SEQ ID NO: 27129 - DNA, 60 bp, Human herpesvirus 6B
gctggtcccattctcttggcacagattccattttccatcaccaaaaacaaaacaaccagc

SEQ ID NO: 27130 - DNA, 60 bp, Human herpesvirus 6B; identical to SEQ ID NO: 27129

SEQ ID NO: 27131 - DNA, 23 bp, Homo sapiens
caccaaaccacacagcaaccagc

SEQ ID NO: 27132 - DNA, 17 bp, Homo sapiens
tcaccaaaagaaaacaa

SEQ ID NO: 27133 - DNA, 22 bp, Homo sapiens
tcaccaaagccactggaccagc

SEQ ID NO: 27134 - DNA, 18 bp, Homo sapiens
aaagacaattcaaccagc

SEQ ID NO: 27135 - DNA, 19 bp, Homo sapiens
ccgaaaaagcacaaccagc

SEQ ID NO: 27136 - DNA, 16 bp, Homo sapiens
ccaaaaaacaaaccag

SEQ ID NO: 27137 - DNA, 23 bp, Homo sapiens
caccaaaaataagcaatttcagc

SEQ ID NO: 27138 - DNA, 21 bp, Homo sapiens
accaaaaaataaacaaccagc

SEQ ID NO: 27139 - DNA, 24 bp, Homo sapiens
tcaccaaatgcaaaaatcaaaagc

SEQ ID NO: 27140 - DNA, 23 bp, Homo sapiens
tcaccaaaataaacttccttagc

SEQ ID NO: 27141 - DNA, 18 bp, Homo sapiens
caaaaacaaaacaaaagc

SEQ ID NO: 27142 - DNA, 22 bp, Homo sapiens
tcaccaaatacaaagctgtcag

SEQ ID NO: 27143 - DNA, 19 bp, Homo sapiens
cagaaacaaaatatccagc

SEQ ID NO: 27144 - DNA, 22 bp, Homo sapiens
tcaccaaacacgaggagccagc

SEQ ID NO: 27145 - DNA, 21 bp, Homo sapiens
cctaaaaacaaaactacacag

SEQ ID NO: 27146 - DNA, 21 bp, Homo sapiens
ccaccgaccatcaacaaccag

SEQ ID NO: 27147 - DNA, 22 bp, Homo sapiens
ccaccaaaaatacaaaatcagc

SEQ ID NO: 27148 - DNA, 18 bp, Homo sapiens
ccactaagaacaaaacaa

SEQ ID NO: 27149 - DNA, 23 bp, Homo sapiens
ccaccaaaaatacaaaaattagc

SEQ ID NO: 27150 - DNA, 20 bp, Homo sapiens
caaaaacaaaatgtaccaac

SEQ ID NO: 27151 - DNA, 17 bp, Homo sapiens
tcacagaaaacaaccag

SEQ ID NO: 27152 - DNA, 21 bp, Homo sapiens
caccaaaggcctaacaaccag

SEQ ID NO: 27153 - DNA, 19 bp, Homo sapiens
caccaaaattaacagccag

SEQ ID NO: 27154 - DNA, 22 bp, Homo sapiens
tcctcaaaatttagcaaccagc

SEQ ID NO: 27155 - DNA, 19 bp, Homo sapiens
accaaaaacaaaaaccagc

SEQ ID NO: 27156 - DNA, 19 bp, Homo sapiens
tcactcaaaacaacaacag

SEQ ID NO: 27157 - DNA, 18 bp, Homo sapiens
caaaaacaagcagccagc

SEQ ID NO: 27158 - DNA, 20 bp, Homo sapiens
tcaccaaaagaaagcagcca

SEQ ID NO: 27159 - DNA, 18 bp, Homo sapiens
tcccaacaaaacaatcag

SEQ ID NO: 27160 - DNA, 17 bp, Homo sapiens
caaaatcaccaaccagc

SEQ ID NO: 27161 - DNA, 23 bp, Homo sapiens
tcaatcttaacaaaacagtcagc

SEQ ID NO: 27162 - DNA, 20 bp, Homo sapiens
accaaaaacaaggtagccag

SEQ ID NO: 27163 - DNA, 19 bp, Homo sapiens
ccaaaaacagcagaaccag

SEQ ID NO: 27164 - DNA, 20 bp, Homo sapiens
tcaccaaaaggaaatccagc

SEQ ID NO: 27165 - DNA, 23 bp, Homo sapiens
tcaccaaagggcatccagccagc

SEQ ID NO: 27166 - DNA, 19 bp, Homo sapiens
caccaaaaacaagacccag

SEQ ID NO: 27167 - DNA, 20 bp, Homo sapiens
accaaaaatacaaaatcagc

SEQ ID NO: 27168 - DNA, 24 bp, Homo sapiens
tccccaaaaacaaacaaacccggc

SEQ ID NO: 27169 - DNA, 18 bp, Homo sapiens
ccaaagtcagcaaccagc

SEQ ID NO: 27170 - DNA, 18 bp, Homo sapiens
tcaccaataacaaaacaa

SEQ ID NO: 27171 - DNA, 23 bp, Homo sapiens
caccagaaagaactgcaaccagc

SEQ ID NO: 27172 - DNA, 18 bp, Homo sapiens
ccaaaacaaaacaaaagc

SEQ ID NO: 27173 - DNA, 19 bp, Homo sapiens
tcccaaaaaccacagtcag

SEQ ID NO: 27174 - DNA, 19 bp, Homo sapiens
cagtcacaaaacagccagc

SEQ ID NO: 27175 - DNA, 19 bp, Homo sapiens
accaaaaaccaaaaccagc

SEQ ID NO: 27176 - DNA, 16 bp, Homo sapiens
ccaaaaacaaatccaa

SEQ ID NO: 27177 - DNA, 20 bp, Homo sapiens
tcaccaaaaacaacaacaac

SEQ ID NO: 27178 - DNA, 20 bp, Homo sapiens
accaaaggccaacaaccagc

SEQ ID NO: 27179 - DNA, 20 bp, Homo sapiens
tcatttgaaacaaaaccagc

SEQ ID NO: 27180 - DNA, 18 bp, Homo sapiens
tcatccaaaacaaaacaa

SEQ ID NO: 27181 - DNA, 19 bp, Homo sapiens
ccaaggtcatacaaccagc

SEQ ID NO: 27182 - DNA, 22 bp, Homo sapiens
aaaaacaaaacaaggacccagc

SEQ ID NO: 27183 - DNA, 18 bp, Homo sapiens
tcctcaaaaacaaaacaa

SEQ ID NO: 27184 - DNA, 23 bp, Homo sapiens
tcaccaaaggccagaaacccagc

SEQ ID NO: 27185 - DNA, 22 bp, Homo sapiens
tcccacgcacaagacaaccagc

SEQ ID NO: 27186 - DNA, 21 bp, Homo sapiens
ccaccaaaggcattttccagc

SEQ ID NO: 27187 - DNA, 73 bp, Human herpesvirus 6B
cagcaaggcgatattcgataacgaattctcattctccgatgataacttcactctcgatacccacgtttacctg

SEQ ID NO: 27188 - DNA, 24 bp, Human herpesvirus 6B
taacttcactctcgatacccacgt

SEQ ID NO: 27189 - DNA, 20 bp, Homo sapiens
acttcactctcagtgcacgt

SEQ ID NO: 27190 - DNA, 22 bp, Homo sapiens
acttcacttgatccatccatgt

SEQ ID NO: 27191 - DNA, 18 bp, Homo sapiens
taacctcactgtgcccag

SEQ ID NO: 27192 - DNA, 19 bp, Homo sapiens
cttcacacactacccacgt

SEQ ID NO: 27193 - DNA, 18 bp, Homo sapiens
taacttcacctctctgac

SEQ ID NO: 27194 - DNA, 18 bp, Homo sapiens
taacttgctcagcccacg

SEQ ID NO: 27195 - DNA, 115 bp, Gallid herpesvirus 2
gagtctctgcaaacatggggcgaagccacgagggaggagttgtcgatgatgagacaaatctactgtctcatgaaacataccccttcccccgcttcctatctcagcagaaaaactc

SEQ ID NO: 27196 - DNA, 24 bp, Gallid herpesvirus 2
atgaaacataccccttcccccgct

SEQ ID NO: 27197 - DNA, 22 bp, Homo sapiens
acacccccaccttttttccgct

SEQ ID NO: 27198 - DNA, 18 bp, Homo sapiens
tgggacacacccctccgc

SEQ ID NO: 27199 - DNA, 20 bp, Homo sapiens
tgaagtggccccttccagcc

SEQ ID NO: 27200 - DNA, 18 bp, Homo sapiens
tgacacataccccttccc

SEQ ID NO: 27201 - DNA, 19 bp, Homo sapiens
ataaatgtaccccttgggc

SEQ ID NO: 27202 - DNA, 25 bp, Homo sapiens
atgaaacatatccttggaaactgct

SEQ ID NO: 27203 - DNA, 22 bp, Homo sapiens
atgaaacatacccttctctgct

SEQ ID NO: 27204 - DNA, 17 bp, Homo sapiens
tgaaacatgccccttgc

SEQ ID NO: 27205 - DNA, 19 bp, Homo sapiens
gaaataccccctggctgct

SEQ ID NO: 27206 - DNA, 24 bp, Homo sapiens
atgaaacagcaaatctctcctgct

SEQ ID NO: 27207 - DNA, 18 bp, Homo sapiens
atgaaaaatgccccttcc

SEQ ID NO: 27208 - DNA, 86 bp, Gallid herpesvirus 2
acagtgacattacctcataaaaaaaaaacatatacacctgagtatgatcacgatacgatttattctcagttgttaaggttcattgt

SEQ ID NO: 27209 - DNA, 21 bp, Gallid herpesvirus 2
tcagttgttaaggttcattgt

SEQ ID NO: 27210 - DNA, 20 bp, Homo sapiens
tcagttgttaagcagtttgt

SEQ ID NO: 27211 - DNA, 17 bp, Homo sapiens
tcaggtgttaaggacac

SEQ ID NO: 27212 - DNA, 18 bp, Homo sapiens
tcagttattgggtacact

SEQ ID NO: 27213 - DNA, 20 bp, Homo sapiens
tcagttttagtcttcattgt

SEQ ID NO: 27214 - DNA, 18 bp, Homo sapiens
atctttaaggttcattgt

SEQ ID NO: 27215 - DNA, 17 bp, Homo sapiens
gttgttggtttcattgt

SEQ ID NO: 27216 - DNA, 20 bp, Homo sapiens
cagttgttagggaggcctgt

SEQ ID NO: 27217 - DNA, 19 bp, Homo sapiens
tcagtgttaaggcaactgt

SEQ ID NO: 27218 - DNA, 19 bp, Homo sapiens
tcagttgttacttgattgt

SEQ ID NO: 27219 - DNA, 18 bp, Homo sapiens
tcagctgttggtttttgt

SEQ ID NO: 27220 - DNA, 16 bp, Homo sapiens
tcagttgttggttttg

SEQ ID NO: 27221 - DNA, 16 bp, Homo sapiens
tcacttggattcattg

SEQ ID NO: 27222 - DNA, 22 bp, Homo sapiens
tcatttgttaaagtgacattgt

SEQ ID NO: 27223 - DNA, 16 bp, Homo sapiens
agttgttaaccactgt

SEQ ID NO: 27224 - DNA, 21 bp, Homo sapiens
tcaaagtcaaaggttcattgt

SEQ ID NO: 27225 - DNA, 18 bp, Homo sapiens
attgcccccattcattgt

SEQ ID NO: 27226 - DNA, 22 bp, Homo sapiens
tcagttgtatgaaatcagttgt

SEQ ID NO: 27227 - DNA, 21 bp, Homo sapiens
tcagttttaacactccattgt

SEQ ID NO: 27228 - DNA, 18 bp, Homo sapiens
agtggttgggttcattgt

SEQ ID NO: 27229 - DNA, 18 bp, Homo sapiens
tcaattgtccttcattgt

SEQ ID NO: 27230 - DNA, 17 bp, Homo sapiens
cagttcaggttcattgt

SEQ ID NO: 27231 - DNA, 16 bp, Homo sapiens
agttgtcaatcattgt

SEQ ID NO: 27232 - DNA, 19 bp, Homo sapiens
tcagttattaatttattgt

SEQ ID NO: 27233 - DNA, 19 bp, Homo sapiens
aattgtttacattcattgt

SEQ ID NO: 27234 - DNA, 23 bp, Homo sapiens
tcagttgtataaggttcaattgt

SEQ ID NO: 27235 - DNA, 70 bp, Human herpesvirus 6
ctatgtgaactgatggcagcttccaaacaagattacctatttttaaaatatctacatcagagcatcatgg

SEQ ID NO: 27236 - DNA, 24 bp, Human herpesvirus 6
ttaaaatatctacatcagagcatc

SEQ ID NO: 27237 - DNA, 22 bp, Homo sapiens
ttaaaatattttatcaaagcat

SEQ ID NO: 27238 - DNA, 20 bp, Homo sapiens
ttaaaatatctgaatcaaaa

SEQ ID NO: 27239 - DNA, 20 bp, Homo sapiens
ttaaaatatttacacatagc

SEQ ID NO: 27240 - DNA, 18 bp, Homo sapiens
ctaaaatgtccagagcat

SEQ ID NO: 27241 - DNA, 20 bp, Homo sapiens
taaaatatttacatcacatc

SEQ ID NO: 27242 - DNA, 15 bp, Homo sapiens
tcaaaatatctgagc

SEQ ID NO: 27243 - DNA, 60 bp, Human herpesvirus 6
gctggtcccattcttttggcacagattccattttctatcaccaaaaacaaaacaaccagc

SEQ ID NO: 27244 - DNA, 71 bp, Human herpesvirus 6
atcgccgatatcttcgagaagacaaaaatacacacgcacgtcaaaaatctttccgactacagcaaggcgat

SEQ ID NO: 27245 - DNA, 24 bp, Human herpesvirus 6
ttcgagaagacaaaaatacacacg

SEQ ID NO: 27246 - DNA, 21 bp, Homo sapiens
gaaaagctgtagatacacacg

SEQ ID NO: 27247 - DNA, 19 bp, Homo sapiens
gaaagacaaagggaacaca

SEQ ID NO: 27248 - DNA, 18 bp, Homo sapiens
ttcagaagacatcacgca

SEQ ID NO: 27249 - DNA, 26 bp, Homo sapiens
ttcaagaagacctgctgaaatacaca

SEQ ID NO: 27250 - DNA, 19 bp, Homo sapiens
gaaggcaaaaatatgcacg

SEQ ID NO: 27251 - DNA, 19 bp, Homo sapiens
ttcggacagtgaatacaca

SEQ ID NO: 27252 - DNA, 64 bp, Gallid herpesvirus 2
gtaacaacgataatattgcttcaaaggatttagctgagggggcaaagtctgaaaatgttggcac

SEQ ID NO: 27253 - DNA, 24 bp, Gallid herpesvirus 2
taatattgcttcaaaggatttagc

SEQ ID NO: 27254 - DNA, 21 bp, Homo sapiens
taatattgctttcaaaaagat

SEQ ID NO: 27255 - DNA, 18 bp, Homo sapiens
taatgatgtttcaaagga

SEQ ID NO: 27256 - DNA, 16 bp, Homo sapiens
ttgtttcaaaggtagc

SEQ ID NO: 27257 - DNA, 16 bp, Homo sapiens
attgcttcaagtccag

SEQ ID NO: 27258 - DNA, 21 bp, Homo sapiens
taattacactgaaggatttag

SEQ ID NO: 27259 - DNA, 19 bp, Homo sapiens
taatagtgcttcaagaaga

SEQ ID NO: 27260 - DNA, 26 bp, Homo sapiens
taatattgctgtggtagtcatttagc

SEQ ID NO: 27261 - DNA, 24 bp, Homo sapiens
taatactgctttaaaaataatagc

SEQ ID NO: 27262 - DNA, 21 bp, Homo sapiens
atattgctttaaaaaaatagc

SEQ ID NO: 27263 - DNA, 22 bp, Homo sapiens
atattgcttttgttgatttagc

SEQ ID NO: 27264 - DNA, 23 bp, Homo sapiens
taatatttctttaaaaaatttag

SEQ ID NO: 27265 - DNA, 23 bp, Homo sapiens
caatattacatgaaggatttggc

SEQ ID NO: 27266 - DNA, 16 bp, Homo sapiens
tattgcttctatttag

SEQ ID NO: 27267 - DNA, 72 bp, Gallid herpesvirus 2
ctcagaagaggggattatctatagtttttatactacggtagtatggaaggctatatgagtttttctgctgag

SEQ ID NO: 27268 - DNA, 24 bp, Gallid herpesvirus 2
tctatagtttttatactacggtag

SEQ ID NO: 27269 - DNA, 18 bp, Homo sapiens
tatagtttttacaagggt

SEQ ID NO: 27270 - DNA, 16 bp, Homo sapiens
ctataaatactacggt

SEQ ID NO: 27271 - DNA, 121 bp, Human papillomavirus type 52
ggaagtacatgtgggtggtcaggtaattgtttgtcctgcatctgtatctagtaacgaagtatccactactgaaactgctgtccacctatgcaccgaaacctccaagacctccgcagtgtcc

SEQ ID NO: 27272 - DNA, 24 bp, Human papillomavirus type 52
aaactgctgtccacctatgcaccg

SEQ ID NO: 27273 - DNA, 17 bp, Homo sapiens
ctgctgtcccctcacac

SEQ ID NO: 27274 - DNA, 20 bp, Homo sapiens
ggactgccgtccacctgcac

SEQ ID NO: 27275 - DNA, 19 bp, Homo sapiens
ggactgtgtccacctgatg

SEQ ID NO: 27276 - DNA, 16 bp, Homo sapiens
aaactgcttccactgc

SEQ ID NO: 27277 - DNA, 18 bp, Homo sapiens
aaccgctgtccaagtacc

SEQ ID NO: 27278 - DNA, 18 bp, Homo sapiens
actctgtccacctcctgc

SEQ ID NO: 27279 - DNA, 20 bp, Homo sapiens
actgctgtgcatcaccctgc

SEQ ID NO: 27280 - DNA, 17 bp, Homo sapiens
ctgctgcccatcatccg

SEQ ID NO: 27281 - DNA, 18 bp, Homo sapiens
ggactgctgttgcgacca

SEQ ID NO: 27282 - DNA, 16 bp, Homo sapiens
ctgctgtccccgcgcc

SEQ ID NO: 27283 - DNA, 17 bp, Homo sapiens
aactgctgcccatccgc

SEQ ID NO: 27284 - DNA, 19 bp, Homo sapiens
aaactgctctctgcctggc

SEQ ID NO: 27285 - DNA, 22 bp, Homo sapiens
aaactgctctttatccgtgcac

SEQ ID NO: 27286 - DNA, 17 bp, Homo sapiens
ctctgtccacctagtca

SEQ ID NO: 27287 - DNA, 19 bp, Homo sapiens
gccgccatcttgtgcgccg

SEQ ID NO: 27288 - DNA, 18 bp, Homo sapiens
aaactgctgcttgcggcc

SEQ ID NO: 27289 - DNA, 21 bp, Homo sapiens
aaactgctgtccccttttcac

SEQ ID NO: 27290 - DNA, 20 bp, Homo sapiens
ggactgctgctgcctgcacc

SEQ ID NO: 27291 - DNA, 16 bp, Homo sapiens
ctgctgccacacacac

SEQ ID NO: 27292 - DNA, 18 bp, Homo sapiens
ctgctgccatagccaccg

SEQ ID NO: 27293 - DNA, 18 bp, Homo sapiens
ggactgctgtcctccacg

SEQ ID NO: 27294 - DNA, 15 bp, Homo sapiens
tgctgcccactgacc

SEQ ID NO: 27295 - DNA, 19 bp, Homo sapiens
ctgctgccgtctccgaccg

SEQ ID NO: 27296 - DNA, 20 bp, Homo sapiens
aactgcttccgctccatccg

SEQ ID NO: 27297 - DNA, 20 bp, Homo sapiens
aaactgctttccacagtggc

SEQ ID NO: 27298 - DNA, 20 bp, Homo sapiens
ggactgctgttatttgccca

SEQ ID NO: 27299 - DNA, 18 bp, Homo sapiens
aactgctgtccacgtagc

SEQ ID NO: 27300 - DNA, 21 bp, Homo sapiens
actgctgcaggctgtgcgccg

SEQ ID NO: 27301 - DNA, 22 bp, Homo sapiens
ggactgctgccgccaccatccg

SEQ ID NO: 27302 - DNA, 67 bp, Gallid herpesvirus 2
cccccagaaagaataatcactgcttcgaacggagctcgattcatcatccgggattatgctttggggg

SEQ ID NO: 27303 - DNA, 24 bp, Gallid herpesvirus 2
agaataatcactgcttcgaacgga

SEQ ID NO: 27304 - DNA, 19 bp, Homo sapiens
gaaggtcactgctcagcgg

SEQ ID NO: 27305 - DNA, 18 bp, Homo sapiens
tcactgcctggaggacgg

SEQ ID NO: 27306 - DNA, 20 bp, Homo sapiens
gaataatcactggctcttgg

SEQ ID NO: 27307 - DNA, 21 bp, Homo sapiens
agggtaaccactgactggcgg

SEQ ID NO: 27308 - DNA, 20 bp, Homo sapiens
agaataactgttgcttccag

SEQ ID NO: 27309 - DNA, 75 bp, Gallid herpesvirus 2
aggaagcgggggaaggggtatgtttcatgagacagtagatttgtctcatcatcgacaactcctccctcgtggctt

SEQ ID NO: 27310 - DNA, 24 bp, Gallid herpesvirus 2
aggggtatgtttcatgagacagta

SEQ ID NO: 27311 - DNA, 22 bp, Homo sapiens
aggggttgtgagtggagacagt

SEQ ID NO: 27312 - DNA, 23 bp, Homo sapiens
aggggatgttcacgaaggatagt

SEQ ID NO: 27313 - DNA, 21 bp, Homo sapiens
agggcgtacagatgggacagt

SEQ ID NO: 27314 - DNA, 20 bp, Homo sapiens
ggtatgttctgccaggcagt

SEQ ID NO: 27315 - DNA, 24 bp, Homo sapiens
agggatatgcggtggtgagatggt

SEQ ID NO: 27316 - DNA, 17 bp, Homo sapiens
ggggtattaaagacagt

SEQ ID NO: 27317 - DNA, 19 bp, Homo sapiens
agggctatggagagacagt

SEQ ID NO: 27318 - DNA, 16 bp, Homo sapiens
agggctgtggagacag

SEQ ID NO: 27319 - DNA, 18 bp, Homo sapiens
ggtggtatgttttgtgga

SEQ ID NO: 27320 - DNA, 18 bp, Homo sapiens
ggggtgatgggagacagt

SEQ ID NO: 27321 - DNA, 68 bp, Human papillomavirus type 52
ggtattgtaacaataacgtacagtgatgaaacacaacgtcaacaatttttaaaaactgttaaaatacc

SEQ ID NO: 27322 - DNA, 24 bp, Human papillomavirus type 52
tattgtaacaataacgtacagtga

SEQ ID NO: 27323 - DNA, 19 bp, Homo sapiens
tgtaacaggcgttacagtg

SEQ ID NO: 27324 - DNA, 16 bp, Homo sapiens
tattataacagtcagt

SEQ ID NO: 27325 - DNA, 21 bp, Homo sapiens
ctgcaaagtaatgtacagtga

SEQ ID NO: 27326 - DNA, 25 bp, Homo sapiens
tatcgtaataatgacaaggcagtga

SEQ ID NO: 27327 - DNA, 21 bp, Homo sapiens
ttgtaacactcattacagtga

SEQ ID NO: 27328 - DNA, 19 bp, Homo sapiens
ttgtaacagtaacacatga

SEQ ID NO: 27329 - DNA, 19 bp, Homo sapiens
tattgtgaatagcacagtg

SEQ ID NO: 27330 - DNA, 19 bp, Homo sapiens
tattgtaaaagccacagtg

SEQ ID NO: 27331 - DNA, 76 bp, Cercopithecine herpesvirus 7
cggtttttttttcctcccgttgcccccggggggtccccggccccccccggccctctcccgggtcccgaaaaaaccg

SEQ ID NO: 27332 - DNA, 21 bp, Cercopithecine herpesvirus 7
tcccgggtcccgaaaaaaccg

SEQ ID NO: 27333 - DNA, 19 bp, Homo sapiens
tcccggaggccgaggaccg

SEQ ID NO: 27334 - DNA, 20 bp, Homo sapiens
tcccgggcctgcggggaccg

SEQ ID NO: 27335 - DNA, 18 bp, Homo sapiens
cctgggtccccaaaaccg

SEQ ID NO: 27336 - DNA, 19 bp, Homo sapiens
tcccgggccccgaacccca

SEQ ID NO: 27337 - DNA, 19 bp, Homo sapiens
tcccgggtcccgggtcccg

SEQ ID NO: 27338 - DNA, 20 bp, Homo sapiens
cccgggccggaggaagaccg

SEQ ID NO: 27339 - DNA, 19 bp, Homo sapiens
tcccgggccctgagccccg

SEQ ID NO: 27340 - DNA, 21 bp, Homo sapiens
tcccgggccccgcccaagccg

SEQ ID NO: 27341 - DNA, 18 bp, Homo sapiens
tcccgagttacagaaaaa

SEQ ID NO: 27342 - DNA, 18 bp, Homo sapiens
tcccgggtttaaaagccg

SEQ ID NO: 27343 - DNA, 21 bp, Homo sapiens
tcccaggtcctcaggaggccg

SEQ ID NO: 27344 - DNA, 18 bp, Homo sapiens
ccccgggcaaggaaaccg

SEQ ID NO: 27345 - DNA, 22 bp, Homo sapiens
tcccgggcctgctccagggccg

SEQ ID NO: 27346 - DNA, 22 bp, Homo sapiens
tcccgggcctgttccagagccg

SEQ ID NO: 27347 - DNA, 23 bp, Homo sapiens
tcccaggcacgcctcctgaaaaa

SEQ ID NO: 27348 - DNA, 21 bp, Homo sapiens
tcccgggcccggccccgaccg

SEQ ID NO: 27349 - DNA, 23 bp, Homo sapiens
tcccgggccctctcgcgaagccg

SEQ ID NO: 27350 - DNA, 23 bp, Homo sapiens
ccgggtcctcaggaaaggaaccg

SEQ ID NO: 27351 - DNA, 20 bp, Homo sapiens
ccacggtgtcctgaagaaac

SEQ ID NO: 27352 - DNA, 16 bp, Homo sapiens
ccaggtggaaaaaccg

SEQ ID NO: 27353 - DNA, 19 bp, Homo sapiens
ccccgggtctccgaagccg

SEQ ID NO: 27354 - DNA, 19 bp, Homo sapiens
cccgggcccgggggaaccg

SEQ ID NO: 27355 - DNA, 19 bp, Homo sapiens
ccctgggtcccaaaggccg

SEQ ID NO: 27356 - DNA, 23 bp, Homo sapiens
tcccaggtcctagaggggggccg

SEQ ID NO: 27357 - DNA, 18 bp, Homo sapiens
cccgggcccggaagaccg

SEQ ID NO: 27358 - DNA, 18 bp, Homo sapiens
ccccgaaggaaagaaccg

SEQ ID NO: 27359 - DNA, 21 bp, Homo sapiens
tcccgggtctgtccgtggccg

SEQ ID NO: 27360 - DNA, 22 bp, Homo sapiens
tccggggtcccgctaccaaaac

SEQ ID NO: 27361 - DNA, 18 bp, Homo sapiens
tcccaggtctcggcaccg

SEQ ID NO: 27362 - DNA, 69 bp, Human herpesvirus 3
ggggcgcggtaccccgccgatggggagggggcgcggtaccccgccgatggggagggggcgcggtacccc

SEQ ID NO: 27363 - DNA, 24 bp, Human herpesvirus 3
cgatggggagggggcgcggtaccc

SEQ ID NO: 27364 - DNA, 20 bp, Homo sapiens
gaggggaggacactggtgcc

SEQ ID NO: 27365 - DNA, 20 bp, Homo sapiens
ccatggggagggggtgcagt

SEQ ID NO: 27366 - DNA, 19 bp, Homo sapiens
gaggggagggggtggtggt

SEQ ID NO: 27367 - DNA, 20 bp, Homo sapiens
gaaggggagggggcagggac

SEQ ID NO: 27368 - DNA, 19 bp, Homo sapiens
tggggaggggttgagaccc

SEQ ID NO: 27369 - DNA, 20 bp, Homo sapiens
tggggagggggaccaagccc

SEQ ID NO: 27370 - DNA, 21 bp, Homo sapiens
cgtggggaggggggcaaaccc

SEQ ID NO: 27371 - DNA, 15 bp, Homo sapiens
ggggaggggggaacc

SEQ ID NO: 27372 - DNA, 20 bp, Homo sapiens
ggtgggggggcccggtaccc

SEQ ID NO: 27373 - DNA, 18 bp, Homo sapiens
cggcggggagggggcgcg

SEQ ID NO: 27374 - DNA, 20 bp, Homo sapiens
ggggggaggaccaggtatcc

SEQ ID NO: 27375 - DNA, 20 bp, Homo sapiens
tggggagggtcagggtgccc

SEQ ID NO: 27376 - DNA, 18 bp, Homo sapiens
tggggagggtggggtgcc

SEQ ID NO: 27377 - DNA, 18 bp, Homo sapiens
cggtggggaggggcgcgg

SEQ ID NO: 27378 - DNA, 17 bp, Homo sapiens
ggggagggggctcatcc

SEQ ID NO: 27379 - DNA, 18 bp, Homo sapiens
gaaggggggggggggccc

SEQ ID NO: 27380 - DNA, 24 bp, Homo sapiens
cgaggggagggggcgagggtgccc

SEQ ID NO: 27381 - DNA, 22 bp, Homo sapiens
cgatgggggcggggtcggcggc

SEQ ID NO: 27382 - DNA, 18 bp, Homo sapiens
ggtggagggggtggtgcc

SEQ ID NO: 27383 - DNA, 18 bp, Homo sapiens
tggggagggggagggtcc

SEQ ID NO: 27384 - DNA, 23 bp, Homo sapiens
tggggaggcggcagcaaatgccc

SEQ ID NO: 27385 - DNA, 24 bp, Homo sapiens
gatggggaggaggtgaggctgccc

SEQ ID NO: 27386 - DNA, 19 bp, Homo sapiens
caatggggaggggtggata

SEQ ID NO: 27387 - DNA, 18 bp, Homo sapiens
tggggagggggcacaggt

SEQ ID NO: 27388 - DNA, 22 bp, Homo sapiens
tggggagggggtgcagatgtcc

SEQ ID NO: 27389 - DNA, 21 bp, Homo sapiens
cgatggggtggggggtgtggt

SEQ ID NO: 27390 - DNA, 18 bp, Homo sapiens
cgatggggggcgggtggc

SEQ ID NO: 27391 - DNA, 24 bp, Homo sapiens
gatggagagtcaggcgtggtgccc

SEQ ID NO: 27392 - DNA, 19 bp, Homo sapiens
tggggaggggggtctgccc

SEQ ID NO: 27393 - DNA, 18 bp, Homo sapiens
tggtggaggagacatggt

SEQ ID NO: 27394 - DNA, 19 bp, Homo sapiens
gatggtgggggggcctggt

SEQ ID NO: 27395 - DNA, 22 bp, Homo sapiens
cggtggggaggggatgggcagc

SEQ ID NO: 27396 - DNA, 19 bp, Homo sapiens
ccatggggaggggggcggc

SEQ ID NO: 27397 - DNA, 18 bp, Homo sapiens
gatggggagggggtggac

SEQ ID NO: 27398 - DNA, 17 bp, Homo sapiens
tggggacggggctgtcc

SEQ ID NO: 27399 - DNA, 19 bp, Homo sapiens
ggggagggggtacaggtcc

SEQ ID NO: 27400 - DNA, 22 bp, Homo sapiens
gaaggggagggggcattggtcc

SEQ ID NO: 27401 - DNA, 20 bp, Homo sapiens
gaggggagggggtgacaacc

SEQ ID NO: 27402 - DNA, 22 bp, Homo sapiens
ggggagggggccgtggctgccc

SEQ ID NO: 27403 - DNA, 19 bp, Homo sapiens
cgtggggagggggcgaggc

SEQ ID NO: 27404 - DNA, 17 bp, Homo sapiens
gatggggagggggctgg

SEQ ID NO: 27405 - DNA, 21 bp, Homo sapiens
cgtggggagggggtgcgaccc

SEQ ID NO: 27406 - DNA, 22 bp, Homo sapiens
atggggagggggcggagggccc

SEQ ID NO: 27407 - DNA, 18 bp, Homo sapiens
gatggggagggagccagt

SEQ ID NO: 27408 - DNA, 21 bp, Homo sapiens
gatgggagggggctagaatcc

SEQ ID NO: 27409 - DNA, 20 bp, Homo sapiens
gagggggaggagctggtacc

SEQ ID NO: 27410 - DNA, 21 bp, Homo sapiens
gaggggaggggaggagtgccc

SEQ ID NO: 27411 - DNA, 22 bp, Homo sapiens
gatggggagggggcctaagccc

SEQ ID NO: 27412 - DNA, 22 bp, Homo sapiens
cggtggggaggggcttctgtac

SEQ ID NO: 27413 - DNA, 20 bp, Homo sapiens
cggtgggggcggggggtggt

SEQ ID NO: 27414 - DNA, 18 bp, Homo sapiens
tggtggtgggggggcacc

SEQ ID NO: 27415 - DNA, 19 bp, Homo sapiens
gaggggagggggcggcagc

SEQ ID NO: 27416 - DNA, 63 bp, Human herpesvirus 3
gacaaccccaattgtgtttatgtatattatatatcgtctgtagacacacgatgattggttgtt

SEQ ID NO: 27417 - DNA, 24 bp, Human herpesvirus 3
accccaattgtgtttatgtatatt

SEQ ID NO: 27418 - DNA, 21 bp, Homo sapiens
caatcatgtattatgtatatt

SEQ ID NO: 27419 - DNA, 17 bp, Homo sapiens
accacaattatgtatgt

SEQ ID NO: 27420 - DNA, 20 bp, Homo sapiens
ccccagttgtgtttccgagt

SEQ ID NO: 27421 - DNA, 19 bp, Homo sapiens
cctcggttgtgttttgtac

SEQ ID NO: 27422 - DNA, 18 bp, Homo sapiens
ctgtgaagtatgtatatt

SEQ ID NO: 27423 - DNA, 24 bp, Homo sapiens
acacctgattgtgtttccaacatt

SEQ ID NO: 27424 - DNA, 19 bp, Homo sapiens
attgtgtttagaatatatt

SEQ ID NO: 27425 - DNA, 20 bp, Homo sapiens
ccaaatgtcttgtgtatatt

SEQ ID NO: 27426 - DNA, 17 bp, Homo sapiens
accccaatgtgtttctg

SEQ ID NO: 27427 - DNA, 19 bp, Homo sapiens
aattgagtttgtgtatatt

SEQ ID NO: 27428 - DNA, 117 bp, Human papillomavirus type 83
gcccctaaaaaggatccttatgatggccttgtattttgggaggttgatttaaaggacaaactatccacagatttagatcagtttcctttgggccgtaagtttcttttgcaactgggt

SEQ ID NO: 27429 - DNA, 24 bp, Human papillomavirus type 83
ttagatcagtttcctttgggccgt

SEQ ID NO: 27430 - DNA, 18 bp, Homo sapiens
ttagatcagattcttttg

SEQ ID NO: 27431 - DNA, 17 bp, Homo sapiens
ttacatcagtttcttta

SEQ ID NO: 27432 - DNA, 19 bp, Homo sapiens
ttaggttggtttcctttag

SEQ ID NO: 27433 - DNA, 22 bp, Homo sapiens
ttagaccagtttccctctccgt

SEQ ID NO: 27434 - DNA, 73 bp, Human papillomavirus type 83
ccaggcacatctgctaatagtaggaacactcttaccagctacatctatgctcctactcctagtggctccctgg

SEQ ID NO: 27435 - DNA, 24 bp, Human papillomavirus type 83
ctcctactcctagtggctccctgg

SEQ ID NO: 27436 - DNA, 16 bp, Homo sapiens
ctcctactctaactct

SEQ ID NO: 27437 - DNA, 16 bp, Homo sapiens
ctcctcctccctccct

SEQ ID NO: 27438 - DNA, 21 bp, Homo sapiens
cctgcttcaccctctccctgg

SEQ ID NO: 27439 - DNA, 21 bp, Homo sapiens
ctccttttctgaagcccctgg

SEQ ID NO: 27440 - DNA, 19 bp, Homo sapiens
cctactccccgctccctgg

SEQ ID NO: 27441 - DNA, 23 bp, Homo sapiens
ctccctatttgagtgctccttgg

SEQ ID NO: 27442 - DNA, 21 bp, Homo sapiens
ctactcctacagtgtttctgg

SEQ ID NO: 27443 - DNA, 22 bp, Homo sapiens
ctactcctacaagtttttctgg

SEQ ID NO: 27444 - DNA, 20 bp, Homo sapiens
ctcctactggggcttcctgg

SEQ ID NO: 27445 - DNA, 20 bp, Homo sapiens
tcctttctcctcctccctgg

SEQ ID NO: 27446 - DNA, 21 bp, Homo sapiens
ctctggctcccctctccctgg

SEQ ID NO: 27447 - DNA, 24 bp, Homo sapiens
cccctactcgctcgggttttctgg

SEQ ID NO: 27448 - DNA, 20 bp, Homo sapiens
cctactccacgtctccttgg

SEQ ID NO: 27449 - DNA, 19 bp, Homo sapiens
cttttcctagcaaccctgg

SEQ ID NO: 27450 - DNA, 20 bp, Homo sapiens
tacttttgctagctccctgg

SEQ ID NO: 27451 - DNA, 24 bp, Homo sapiens
tcctatcctagtgggtgagactgg

SEQ ID NO: 27452 - DNA, 19 bp, Homo sapiens
ctcctcttactgttctctg

SEQ ID NO: 27453 - DNA, 23 bp, Homo sapiens
ccctgctcctagtttccacttgg

SEQ ID NO: 27454 - DNA, 21 bp, Homo sapiens
tcccactcctagtccagctgg

SEQ ID NO: 27455 - DNA, 18 bp, Homo sapiens
ctcagagtggctctctgg

SEQ ID NO: 27456 - DNA, 21 bp, Homo sapiens
ctcctacttgtgtgatcttgg

SEQ ID NO: 27457 - DNA, 19 bp, Homo sapiens
ctcccgctctgcctccctg

SEQ ID NO: 27458 - DNA, 17 bp, Homo sapiens
tccttctccctccctgg

SEQ ID NO: 27459 - DNA, 24 bp, Homo sapiens
ctcctgctgcctcttcctccctgg

SEQ ID NO: 27460 - DNA, 21 bp, Homo sapiens
ctccagctcctgccttcttgg

SEQ ID NO: 27461 - DNA, 17 bp, Homo sapiens
tacttcagtagctctgg

SEQ ID NO: 27462 - DNA, 25 bp, Homo sapiens
ctcctaacttctgttccctccctgg

SEQ ID NO: 27463 - DNA, 21 bp, Homo sapiens
ctcctttcctagtagaattgg

SEQ ID NO: 27464 - DNA, 22 bp, Homo sapiens
tcctgctcctagtcacttttgg

SEQ ID NO: 27465 - DNA, 22 bp, Homo sapiens
ctccactcaggtggctccctgg

SEQ ID NO: 27466 - DNA, 21 bp, Homo sapiens
ctcctgttcctggggctccct

SEQ ID NO: 27467 - DNA, 19 bp, Homo sapiens
ctgctgctcttgctccctg

SEQ ID NO: 27468 - DNA, 22 bp, Homo sapiens
ctccagctcccaccctccctgg

SEQ ID NO: 27469 - DNA, 18 bp, Homo sapiens
tcctcttggcccccttgg

SEQ ID NO: 27470 - DNA, 19 bp, Homo sapiens
ctccactcctgggggtctg

SEQ ID NO: 27471 - DNA, 23 bp, Homo sapiens
ctcctacctgttctcttctctgg

SEQ ID NO: 27472 - DNA, 26 bp, Homo sapiens
ctcctgctgctgggaaccctccctgg

SEQ ID NO: 27473 - DNA, 18 bp, Homo sapiens
ctcctattcctagtgtct

SEQ ID NO: 27474 - DNA, 19 bp, Homo sapiens
ctgctccccttctccctgg

SEQ ID NO: 27475 - DNA, 18 bp, Homo sapiens
ctcctgttcccctccctg

SEQ ID NO: 27476 - DNA, 16 bp, Homo sapiens
ctcctactcccaacct

SEQ ID NO: 27477 - DNA, 21 bp, Homo sapiens
ctcctagtgaaggcttcttgg

SEQ ID NO: 27478 - DNA, 18 bp, Homo sapiens
ctcctctcatgctccctg

SEQ ID NO: 27479 - DNA, 23 bp, Homo sapiens
ctcccactctaccaactttctgg

SEQ ID NO: 27480 - DNA, 18 bp, Homo sapiens
ctcttaaaagctccctgg

SEQ ID NO: 27481 - DNA, 19 bp, Homo sapiens
ctcctactcccccttcctg

SEQ ID NO: 27482 - DNA, 22 bp, Homo sapiens
ctcctaccttggtaacctctgg

SEQ ID NO: 27483 - DNA, 26 bp, Homo sapiens
ctctggctccccctttggctccctgg

SEQ ID NO: 27484 - DNA, 23 bp, Homo sapiens
tccttctttccagccctccctgg

SEQ ID NO: 27485 - DNA, 18 bp, Homo sapiens
ctcctacccttacctctg

SEQ ID NO: 27486 - DNA, 20 bp, Homo sapiens
ctactccctgctttccctgg

SEQ ID NO: 27487 - DNA, 21 bp, Homo sapiens
ctcccacttttgctttcctgg

SEQ ID NO: 27488 - DNA, 21 bp, Homo sapiens
ctcctaatcctctattcttgg

SEQ ID NO: 27489 - DNA, 19 bp, Homo sapiens
cttgccctacagctcctgg

SEQ ID NO: 27490 - DNA, 21 bp, Homo sapiens
tcttattcctggggctcccta

SEQ ID NO: 27491 - DNA, 21 bp, Homo sapiens
tcctacccctgcctcctctgg

SEQ ID NO: 27492 - DNA, 16 bp, Homo sapiens
ctccacttctgctcct

SEQ ID NO: 27493 - DNA, 23 bp, Homo sapiens
ctcctgctttatcagctccctgg

SEQ ID NO: 27494 - DNA, 19 bp, Homo sapiens
ctcccgcttctcctccctg

SEQ ID NO: 27495 - DNA, 21 bp, Homo sapiens
ctcccacttctctttccttgg

SEQ ID NO: 27496 - DNA, 18 bp, Homo sapiens
ctcctgtctccctccctg

SEQ ID NO: 27497 - DNA, 24 bp, Homo sapiens
cctttgctcctggggcctccctgg

SEQ ID NO: 27498 - DNA, 21 bp, Homo sapiens
ctcctgcctcagcctccctgg

SEQ ID NO: 27499 - DNA, 20 bp, Homo sapiens
tctcactcccattttcctgg

SEQ ID NO: 27500 - DNA, 66 bp, Amsacta moorei entomopoxvirus
agttaatatatattttatttttgaaaatattaattttttttgaaaaataatatattattattaact

SEQ ID NO: 27501 - DNA, 24 bp, Amsacta moorei entomopoxvirus
tattttatttttgaaaatattaat

SEQ ID NO: 27502 - DNA, 20 bp, Homo sapiens
ttacttttgaaaatgttaat

SEQ ID NO: 27503 - DNA, 19 bp, Homo sapiens
ttttatttttgaaacctca

SEQ ID NO: 27504 - DNA, 24 bp, Homo sapiens
tattctatcatctgaaatattaat

SEQ ID NO: 27505 - DNA, 22 bp, Homo sapiens
tttacacattgaaaatattaat

SEQ ID NO: 27506 - DNA, 98 bp, Camelpox virus
tcagaaagaggtttaatatttttgtgagaccatcgaagagagaaagagataaaactttttttacgactccatcagaaagaggtttaatatttttgtga

SEQ ID NO: 27507 - DNA, 24 bp, Camelpox virus
tccatcagaaagaggtttaatatt

SEQ ID NO: 27508 - DNA, 27 bp, Homo sapiens
tccatcagggaaaggtcagatcatatt

SEQ ID NO: 27509 - DNA, 17 bp, Homo sapiens
tccacgggaagaggttt

SEQ ID NO: 27510 - DNA, 23 bp, Homo sapiens
tccatcaggagacctctaatatt

SEQ ID NO: 27511 - DNA, 17 bp, Homo sapiens
agaaagcattcaatatt

SEQ ID NO: 27512 - DNA, 20 bp, Homo sapiens
ccatcttaaggtttaatatt

SEQ ID NO: 27513 - DNA, 16 bp, Homo sapiens
agaaagaggaaacatt

SEQ ID NO: 27514 - DNA, 23 bp, Homo sapiens
atcagaaactataatttaatatt

SEQ ID NO: 27515 - DNA, 21 bp, Homo sapiens
catcagaaaactggtaatatt

SEQ ID NO: 27516 - DNA, 19 bp, Homo sapiens
tccatgggaaggaggctca

SEQ ID NO: 27517 - DNA, 21 bp, Homo sapiens
atcaggtccaggtttaatatt

SEQ ID NO: 27518 - DNA, 23 bp, Homo sapiens
tccatcaggagtgaagacatatt

SEQ ID NO: 27519 - DNA, 19 bp, Homo sapiens
tccattaaaagaggtaaaa

SEQ ID NO: 27520 - DNA, 21 bp, Homo sapiens
tcagtggggggaggtttaata

SEQ ID NO: 27521 - DNA, 19 bp, Homo sapiens
atcagaaaaaggtaacatt

SEQ ID NO: 27522 - DNA, 19 bp, Homo sapiens
tccgtcagcaagaggttca

SEQ ID NO: 27523 - DNA, 84 bp, Encephalomyocarditis virus
ttgaaagccgggggtgggagatccggattgccagtctgctcgatatcgcaggctgggtccgtgactacccactccccctttcaa

SEQ ID NO: 27524 - DNA, 24 bp, Encephalomyocarditis virus
ctgggtccgtgactacccactccc

SEQ ID NO: 27525 - DNA, 16 bp, Homo sapiens
ctgggtgcacccactc

SEQ ID NO: 27526 - DNA, 23 bp, Homo sapiens
ctgggtccgctccagccgctccc

SEQ ID NO: 27527 - DNA, 17 bp, Homo sapiens
ctgggcccgggcccact

SEQ ID NO: 27528 - DNA, 18 bp, Homo sapiens
tgggtccatggcccttcc

SEQ ID NO: 27529 - DNA, 19 bp, Homo sapiens
tgggatctgcccccactcc

SEQ ID NO: 27530 - DNA, 21 bp, Homo sapiens
tgggtccgtgacagatggctc

SEQ ID NO: 27531 - DNA, 20 bp, Homo sapiens
aggcccaggctgcccgttcc

SEQ ID NO: 27532 - DNA, 23 bp, Homo sapiens
ctgggcctcaagagcccactccc

SEQ ID NO: 27533 - DNA, 18 bp, Homo sapiens
ggtctgtccccacccact

SEQ ID NO: 27534 - DNA, 21 bp, Homo sapiens
ctgggtccttgtgctgctccc

SEQ ID NO: 27535 - DNA, 18 bp, Homo sapiens
ggggacactgcccactcc

SEQ ID NO: 27536 - DNA, 22 bp, Homo sapiens
ctgggtccgccactcccgctcc

SEQ ID NO: 27537 - DNA, 19 bp, Homo sapiens
gggtccgctctccgctccc

SEQ ID NO: 27538 - DNA, 22 bp, Homo sapiens
ctggctccgccacgcccactcc

SEQ ID NO: 27539 - DNA, 23 bp, Homo sapiens
tggttccgtcccctcccactccc

SEQ ID NO: 27540 - DNA, 20 bp, Homo sapiens
ctggatccatgtacctgctc

SEQ ID NO: 27541 - DNA, 18 bp, Homo sapiens
gggtccaccatccattcc

SEQ ID NO: 27542 - DNA, 18 bp, Homo sapiens
ctgggtcctgggactccc

SEQ ID NO: 27543 - DNA, 20 bp, Homo sapiens
ctgggtccagtcgctgctcc

SEQ ID NO: 27544 - DNA, 21 bp, Homo sapiens
tgggtccagtaaagtccattc

SEQ ID NO: 27545 - DNA, 20 bp, Homo sapiens
tgggcttgctggcccactcc

SEQ ID NO: 27546 - DNA, 22 bp, Homo sapiens
ctgggtgtgtccccacccactc

SEQ ID NO: 27547 - DNA, 18 bp, Homo sapiens
ctgggtcctgcttgttcc

SEQ ID NO: 27548 - DNA, 21 bp, Homo sapiens
ctgagtccattactcattccc

SEQ ID NO: 27549 - DNA, 23 bp, Homo sapiens
ctgggactccctggtccattccc

SEQ ID NO: 27550 - DNA, 23 bp, Homo sapiens
tgggtctgggagaccccactccc

SEQ ID NO: 27551 - DNA, 21 bp, Homo sapiens
ctgggtccgggcgaggctccc

SEQ ID NO: 27552 - DNA, 22 bp, Homo sapiens
ccgggtctccacacccactccc

SEQ ID NO: 27553 - DNA, 18 bp, Homo sapiens
ctggttccgcctactctc

SEQ ID NO: 27554 - DNA, 20 bp, Homo sapiens
ctgggtccccggcctgctcc

SEQ ID NO: 27555 - DNA, 17 bp, Homo sapiens
gggtccgctctcattcc

SEQ ID NO: 27556 - DNA, 23 bp, Homo sapiens
ctgggtcctggttacgtgggccc

SEQ ID NO: 27557 - DNA, 23 bp, Homo sapiens
ctgggtccttggacctctgctcc

SEQ ID NO: 27558 - DNA, 23 bp, Homo sapiens
ctggtgtttggacaacccactcc

SEQ ID NO: 27559 - DNA, 18 bp, Homo sapiens
ctgggttcctggtgctcc

SEQ ID NO: 27560 - DNA, 21 bp, Homo sapiens
ctgggtccgtgtctccgctcc

SEQ ID NO: 27561 - DNA, 22 bp, Homo sapiens
ctgtgtccgcatccccactccc

SEQ ID NO: 27562 - DNA, 22 bp, Homo sapiens
ctgggtccagtttgccattccc

SEQ ID NO: 27563 - DNA, 19 bp, Homo sapiens
ctggtttgtgaccagctcc

SEQ ID NO: 27564 - DNA, 26 bp, Homo sapiens
ctgggtcctgactgggggctgctccc

SEQ ID NO: 27565 - DNA, 23 bp, Homo sapiens
ctgggtgtggagtggcccactcc

SEQ ID NO: 27566 - DNA, 23 bp, Homo sapiens
ctgggtcctggcttaggcactcc

SEQ ID NO: 27567 - DNA, 24 bp, Homo sapiens
ctgggtcctgtggccagcatgctc

SEQ ID NO: 27568 - DNA, 22 bp, Homo sapiens
ctgggtcctgagcgctattctc

SEQ ID NO: 27569 - DNA, 21 bp, Homo sapiens
gggtccaggcatgcccactcc

SEQ ID NO: 27570 - DNA, 18 bp, Homo sapiens
ctggatccggcttgctcc

SEQ ID NO: 27571 - DNA, 18 bp, Homo sapiens
gggtccgcagtccactcc

SEQ ID NO: 27572 - DNA, 21 bp, Homo sapiens
tgggtccaagagctgcttact

SEQ ID NO: 27573 - DNA, 22 bp, Homo sapiens
ctgtgtccccgtgcccactccc

SEQ ID NO: 27574 - DNA, 17 bp, Homo sapiens
tgggctgctctcactcc

SEQ ID NO: 27575 - DNA, 73 bp, Rat cytomegalovirus
gtccctcttccgtcgggagcgcgcccggctctcggccgaccccggcccgggcgtcccggccttctacggggac

SEQ ID NO: 27576 - DNA, 22 bp, Rat cytomegalovirus
cgtcccggccttctacggggac

SEQ ID NO: 27577 - DNA, 15 bp, Homo sapiens
gtcccagcctcgggg

SEQ ID NO: 27578 - DNA, 18 bp, Homo sapiens
cgcccggcttcagtgggg

SEQ ID NO: 27579 - DNA, 19 bp, Homo sapiens
cgtcccggtcatctcggga

SEQ ID NO: 27580 - DNA, 17 bp, Homo sapiens
cggcccggcctttcggg

SEQ ID NO: 27581 - DNA, 17 bp, Homo sapiens
cggcccggccttcctgg

SEQ ID NO: 27582 - DNA, 16 bp, Homo sapiens
cgtctggccttctaga

SEQ ID NO: 27583 - DNA, 20 bp, Homo sapiens
cgccccggcctgggctgggg

SEQ ID NO: 27584 - DNA, 19 bp, Homo sapiens
gtcctggtctcaaggggac

SEQ ID NO: 27585 - DNA, 15 bp, Homo sapiens
gccccggccccgggg

SEQ ID NO: 27586 - DNA, 16 bp, Homo sapiens
gtcctggcccacgggg

SEQ ID NO: 27587 - DNA, 18 bp, Homo sapiens
tcccggcctttcatcaga

SEQ ID NO: 27588 - DNA, 18 bp, Homo sapiens
cgtcccggctctccacgg

SEQ ID NO: 27589 - DNA, 21 bp, Homo sapiens
cgtccaggccttcctgtgggg

SEQ ID NO: 27590 - DNA, 16 bp, Homo sapiens
cgcccggccttctcgg

SEQ ID NO: 27591 - DNA, 18 bp, Homo sapiens
ccggtttccgacggggac

SEQ ID NO: 27592 - DNA, 15 bp, Homo sapiens
cgtcccggctctggg

SEQ ID NO: 27593 - DNA, 20 bp, Homo sapiens
cgctcggctccggctcgggg

SEQ ID NO: 27594 - DNA, 16 bp, Homo sapiens
gtcccggcccagggga

SEQ ID NO: 27595 - DNA, 18 bp, Homo sapiens
cgtcccggctttcctcag

SEQ ID NO: 27596 - DNA, 17 bp, Homo sapiens
cgtcccgggtttcaagg

SEQ ID NO: 27597 - DNA, 21 bp, Homo sapiens
cgcctggcaggagacggggac

SEQ ID NO: 27598 - DNA, 16 bp, Homo sapiens
gtctcggcccacgggg

SEQ ID NO: 27599 - DNA, 17 bp, Homo sapiens
cgccttggcctacaggg

SEQ ID NO: 27600 - DNA, 15 bp, Homo sapiens
gtcccggccccgggg

SEQ ID NO: 27601 - DNA, 15 bp, Homo sapiens
cgccccggcggggac

SEQ ID NO: 27602 - DNA, 17 bp, Homo sapiens
tcctggccttcctaggg

SEQ ID NO: 27603 - DNA, 18 bp, Homo sapiens
gcctggcctcccctgggg

SEQ ID NO: 27604 - DNA, 20 bp, Homo sapiens
cgccttggccttccaaaggg

SEQ ID NO: 27605 - DNA, 24 bp, Homo sapiens
cgtcccgacctccccggcggggac

SEQ ID NO: 27606 - DNA, 16 bp, Homo sapiens
cgtcccggcttctagg

SEQ ID NO: 27607 - DNA, 19 bp, Homo sapiens
gtcccggcctcccaaaggg

SEQ ID NO: 27608 - DNA, 20 bp, Homo sapiens
cggcctggctcccaccgggg

SEQ ID NO: 27609 - DNA, 21 bp, Homo sapiens
gtcccagcctccaggcgggga

SEQ ID NO: 27610 - DNA, 18 bp, Homo sapiens
cgcctcggcctcctggga

SEQ ID NO: 27611 - DNA, 17 bp, Homo sapiens
cgctcggccttctggga

SEQ ID NO: 27612 - DNA, 20 bp, Homo sapiens
cgccccggctttcctgcagg

SEQ ID NO: 27613 - DNA, 17 bp, Homo sapiens
cggcccggcctctgggg

SEQ ID NO: 27614 - DNA, 20 bp, Homo sapiens
cgttccagccttgctttggg

SEQ ID NO: 27615 - DNA, 16 bp, Homo sapiens
cgcccggccttcctgg

SEQ ID NO: 27616 - DNA, 16 bp, Homo sapiens
gccccggccttcaagg

SEQ ID NO: 27617 - DNA, 15 bp, Homo sapiens
cgccccggcttgggg

SEQ ID NO: 27618 - DNA, 21 bp, Homo sapiens
cggcccggcctgggcgcgggg

SEQ ID NO: 27619 - DNA, 16 bp, Homo sapiens
gtcccggcctccggga

SEQ ID NO: 27620 - DNA, 17 bp, Homo sapiens
cgcccggcctgctgggg

SEQ ID NO: 27621 - DNA, 17 bp, Homo sapiens
cgtcccagcctggggga

SEQ ID NO: 27622 - DNA, 21 bp, Homo sapiens
gtcccggcgctgcgcccgggg

SEQ ID NO: 27623 - DNA, 25 bp, Homo sapiens
gcctcggccttccaaagtgcgggga

SEQ ID NO: 27624 - DNA, 28 bp, Homo sapiens
cgccttggccttccaagtaatggggacg

SEQ ID NO: 27625 - DNA, 16 bp, Homo sapiens
gcctggcctcctgggg

SEQ ID NO: 27626 - DNA, 19 bp, Homo sapiens
cctcctggtcttctggggg

SEQ ID NO: 27627 - DNA, 16 bp, Homo sapiens
gcccggccccaggggg

SEQ ID NO: 27628 - DNA, 17 bp, Homo sapiens
cgccccggccttctcag

SEQ ID NO: 27629 - DNA, 18 bp, Homo sapiens
gtcccagcctgggcgggg

SEQ ID NO: 27630 - DNA, 16 bp, Homo sapiens
gcctcggccttctgag

SEQ ID NO: 27631 - DNA, 16 bp, Homo sapiens
cgccctggccttccgg

SEQ ID NO: 27632 - DNA, 15 bp, Homo sapiens
gcccggccctgggga

SEQ ID NO: 27633 - DNA, 19 bp, Homo sapiens
cctcccggcctccaagggg

SEQ ID NO: 27634 - DNA, 18 bp, Homo sapiens
cgtcctgaccttcctagg

SEQ ID NO: 27635 - DNA, 17 bp, Homo sapiens
gtgtcggccttctgggg

SEQ ID NO: 27636 - DNA, 18 bp, Homo sapiens
gcccggccttctataaga

SEQ ID NO: 27637 - DNA, 17 bp, Homo sapiens
cgcccggccttttaagg

SEQ ID NO: 27638 - DNA, 17 bp, Homo sapiens
cgtcccggacctcgggg

SEQ ID NO: 27639 - DNA, 18 bp, Homo sapiens
gcccgcggcctacgggga

SEQ ID NO: 27640 - DNA, 130 bp, Camelpox virus
ttttttacgactccatcagaaagaggtttaatatttttgtgagaccatcgaagagagaaagagataaaactttttttacgactccatcagaaagaggtttaatatttttgtgagaccatcgaagagagaa

SEQ ID NO: 27641 - DNA, 129 bp, Camelpox virus
cttttttacgactccatcagaaagaggtttaatatttttgtgagaccatcgaagagagaaagagataaaactttttttacgactccatcagaaagaggtttaatatttttgtgagaccatcgaagagag

SEQ ID NO: 27642 - DNA, 126 bp, Camelpox virus
acctctttctgatggagtcgtaaaaaaagttttatctctttctctcttcgatggtctcacaaaaatattaaacctctttctgatggagtcgtaaaaaaagttttatctctttctctcttcgatggt

SEQ ID NO: 27643 - DNA, 24 bp, Camelpox virus
tgatggagtcgtaaaaaaagtttt

SEQ ID NO: 27644 - DNA, 24 bp, Homo sapiens
tgatgaagagggaggaaaagtttt

SEQ ID NO: 27645 - DNA, 18 bp, Homo sapiens
taggtgtaaaaaaagttt

SEQ ID NO: 27646 - DNA, 18 bp, Homo sapiens
gagacataaaaaaagttt

SEQ ID NO: 27647 - DNA, 19 bp, Homo sapiens
tgatagagctggaaagttt

SEQ ID NO: 27648 - DNA, 125 bp, Camelpox virus
acctctttctgatggagtcgtaaaaaagttttatctctttctctcttcgatggtctcacaaaaatattaaacctctttctgatggagtcgtaaaaaaagttttatctctttctctcttcgatggt

SEQ ID NO: 27649 - DNA, 66 bp, Swinepox virus
tctcaataaagaaataaatatatctttgttaaatatgttaactttttgtatatttctatattgtga

SEQ ID NO: 27650 - DNA, 24 bp, Swinepox virus
agaaataaatatatctttgttaaa

SEQ ID NO: 27651 - DNA, 17 bp, Homo sapiens
agaataaatatatcccc

SEQ ID NO: 27652 - DNA, 21 bp, Homo sapiens
agaggtaaatgcatctttgtt

SEQ ID NO: 27653 - DNA, 22 bp, Homo sapiens
gaaataaaaaccatttgttaaa

SEQ ID NO: 27654 - DNA, 20 bp, Homo sapiens
taaactctatctttgttaaa

SEQ ID NO: 27655 - DNA, 21 bp, Homo sapiens
agaagaaaatgtctctgttaa

SEQ ID NO: 27656 - DNA, 23 bp, Homo sapiens
aaaaataaatacactgtttgtta

SEQ ID NO: 27657 - DNA, 24 bp, Homo sapiens
aaataaatatactctgctttgtta

SEQ ID NO: 27658 - DNA, 23 bp, Homo sapiens
agaaatatagtcactttgttaaa

SEQ ID NO: 27659 - DNA, 18 bp, Homo sapiens
gaaataaatatttcccca

SEQ ID NO: 27660 - DNA, 19 bp, Homo sapiens
agaaatagatataccccca

SEQ ID NO: 27661 - DNA, 21 bp, Homo sapiens
gaaataaatatctttgattaa

SEQ ID NO: 27662 - DNA, 18 bp, Homo sapiens
gaaatatatacacctttg

SEQ ID NO: 27663 - DNA, 26 bp, Homo sapiens
agaaataaggatatcatgctttgtta

SEQ ID NO: 27664 - DNA, 60 bp, Equine herpesvirus 1
tggctgatgtcaagtctatgtggaattagaaactccacatccccagaagtttatgagcca

SEQ ID NO: 27665 - DNA, 18 bp, Equine herpesvirus 1
ccagaagtttatgagcca

SEQ ID NO: 27666 - DNA, 16 bp, Homo sapiens
ccagatccatgagtca

SEQ ID NO: 27667 - DNA, 18 bp, Homo sapiens
ccagaaattgcacttcca

SEQ ID NO: 27668 - DNA, 17 bp, Homo sapiens
ccaggagtcataagcca

SEQ ID NO: 27669 - DNA, 16 bp, Homo sapiens
ccagaagcctgagcca

SEQ ID NO: 27670 - DNA, 17 bp, Homo sapiens
ccggagctcacgtgcca

SEQ ID NO: 27671 - DNA, 15 bp, Homo sapiens
ccagaaatttatcca

SEQ ID NO: 27672 - DNA, 18 bp, Homo sapiens
tgagaagtttggagacca

SEQ ID NO: 27673 - DNA, 17 bp, Homo sapiens
ccagagcccacgagcca

SEQ ID NO: 27674 - DNA, 15 bp, Homo sapiens
ccagaacatgagcca

SEQ ID NO: 27675 - DNA, 16 bp, Homo sapiens
ccacaagccctggcca

SEQ ID NO: 27676 - DNA, 18 bp, Homo sapiens
ccagaggatataaagcca

SEQ ID NO: 27677 - DNA, 19 bp, Homo sapiens
ccagaaatcctggcagcca

SEQ ID NO: 27678 - DNA, 18 bp, Homo sapiens
ccagcagttcacaagcca

SEQ ID NO: 27679 - DNA, 16 bp, Homo sapiens
ccagaagctcaagcca

SEQ ID NO: 27680 - DNA, 17 bp, Homo sapiens
ccagaagtctgaagtca

SEQ ID NO: 27681 - DNA, 21 bp, Homo sapiens
ccaaaagttacagtggggcca

SEQ ID NO: 27682 - DNA, 19 bp, Homo sapiens
cctggaagaccatgagcca

SEQ ID NO: 27683 - DNA, 19 bp, Homo sapiens
cagaagttgcagtgagcca

SEQ ID NO: 27684 - DNA, 19 bp, Homo sapiens
cctagaagccccctggcca

SEQ ID NO: 27685 - DNA, 16 bp, Homo sapiens
ccatgaagcccagcca

SEQ ID NO: 27686 - DNA, 21 bp, Homo sapiens
tgagaggttcacaaagagcca

SEQ ID NO: 27687 - DNA, 16 bp, Homo sapiens
ccaaaagtttgaacca

SEQ ID NO: 27688 - DNA, 17 bp, Homo sapiens
ccaggagtatataacca

SEQ ID NO: 27689 - DNA, 15 bp, Homo sapiens
ccagagtccatgcca

SEQ ID NO: 27690 - DNA, 17 bp, Homo sapiens
ccatgagccatgagcca

SEQ ID NO: 27691 - DNA, 16 bp, Homo sapiens
cctgagccatgagcca

SEQ ID NO: 27692 - DNA, 17 bp, Homo sapiens
ccagaagtttgagacca

SEQ ID NO: 27693 - DNA, 16 bp, Homo sapiens
ccaaaagcgatggcca

SEQ ID NO: 27694 - DNA, 18 bp, Homo sapiens
ccagagtgagacgagcca

SEQ ID NO: 27695 - DNA, 18 bp, Homo sapiens
ccacgaagctccctgagc

SEQ ID NO: 27696 - DNA, 17 bp, Homo sapiens
ccagaagtttgaaacca

SEQ ID NO: 27697 - DNA, 16 bp, Homo sapiens
ccaagaagataagcca

SEQ ID NO: 27698 - DNA, 20 bp, Homo sapiens
ccagaagtttccaggagtca

SEQ ID NO: 27699 - DNA, 19 bp, Homo sapiens
ccaaagtttaatgaggcca

SEQ ID NO: 27700 - DNA, 18 bp, Homo sapiens
cagaagttttcatgggcc

SEQ ID NO: 27701 - DNA, 15 bp, Homo sapiens
ccaaaagcctggcca

SEQ ID NO: 27702 - DNA, 15 bp, Homo sapiens
ccagaaaatgagcca

SEQ ID NO: 27703 - DNA, 16 bp, Homo sapiens
ccagagctgacagcca

SEQ ID NO: 27704 - DNA, 16 bp, Homo sapiens
ccagaagctactgcca

SEQ ID NO: 27705 - DNA, 22 bp, Homo sapiens
ccagaaattaaacaatgagtca

SEQ ID NO: 27706 - DNA, 17 bp, Homo sapiens
ccaggtttgatgagcca

SEQ ID NO: 27707 - DNA, 17 bp, Homo sapiens
ccaaaagcccttagcca

SEQ ID NO: 27708 - DNA, 18 bp, Homo sapiens
cctaagaattatgagcca

SEQ ID NO: 27709 - DNA, 19 bp, Homo sapiens
ccggaaattcacgtagcca

SEQ ID NO: 27710 - DNA, 17 bp, Homo sapiens
ccaaagttcagtggcca

SEQ ID NO: 27711 - DNA, 17 bp, Homo sapiens
ccagaaatccagagcca

SEQ ID NO: 27712 - DNA, 17 bp, Homo sapiens
ccacgaagcatgagtca

SEQ ID NO: 27713 - DNA, 15 bp, Homo sapiens
ccagaatctatgcca

SEQ ID NO: 27714 - DNA, 17 bp, Homo sapiens
ccaaaagtcttcagcca

SEQ ID NO: 27715 - DNA, 18 bp, Homo sapiens
ccagaaatctagaagtca

SEQ ID NO: 27716 - DNA, 18 bp, Homo sapiens
ccagaagctttggctcca

SEQ ID NO: 27717 - DNA, 17 bp, Homo sapiens
ccagaggccatgagcca

SEQ ID NO: 27718 - DNA, 20 bp, Homo sapiens
ccacaagtcctcctgagcca

SEQ ID NO: 27719 - DNA, 22 bp, Homo sapiens
ccagaaatttggacaaatgagc

SEQ ID NO: 27720 - DNA, 18 bp, Homo sapiens
ccaggagcctgggagcca

SEQ ID NO: 27721 - DNA, 16 bp, Homo sapiens
ccagaagcatgagtca

SEQ ID NO: 27722 - DNA, 19 bp, Homo sapiens
ccaaaagttcaaggagcca

SEQ ID NO: 27723 - DNA, 20 bp, Homo sapiens
cagaaattacctatgagtca

SEQ ID NO: 27724 - DNA, 17 bp, Homo sapiens
ccaaagtttagagtcca

SEQ ID NO: 27725 - DNA, 18 bp, Homo sapiens
cagaagctgcactggcca

SEQ ID NO: 27726 - DNA, 18 bp, Homo sapiens
ccaggtggttcacagcca

SEQ ID NO: 27727 - DNA, 17 bp, Homo sapiens
ccagacagctggagcca

SEQ ID NO: 27728 - DNA, 18 bp, Homo sapiens
ccaaaagccctagagtca

SEQ ID NO: 27729 - DNA, 18 bp, Homo sapiens
taagaaggccatgagcca

SEQ ID NO: 27730 - DNA, 17 bp, Homo sapiens
taagaagtgataagcca

SEQ ID NO: 27731 - DNA, 16 bp, Homo sapiens
ccagaagtatgggcca

SEQ ID NO: 27732 - DNA, 16 bp, Homo sapiens
ccaaaagctgaggcca

SEQ ID NO: 27733 - DNA, 16 bp, Homo sapiens
cctgaaacatgagcca

SEQ ID NO: 27734 - DNA, 17 bp, Homo sapiens
ccagagtcctctggcca

SEQ ID NO: 27735 - DNA, 18 bp, Homo sapiens
ccagaagctccctgcagc

SEQ ID NO: 27736 - DNA, 18 bp, Homo sapiens
ccaggaaaccatgagcca

SEQ ID NO: 27737 - DNA, 16 bp, Homo sapiens
ccagtagttcatgcca

SEQ ID NO: 27738 - DNA, 18 bp, Homo sapiens
ccagggatttatacgcca

SEQ ID NO: 27739 - DNA, 22 bp, Homo sapiens
ccacgaggctgtgtgtgagcca

SEQ ID NO: 27740 - DNA, 18 bp, Homo sapiens
cagaagttgcagtgagcc

SEQ ID NO: 27741 - DNA, 19 bp, Homo sapiens
ccaaagagtctatgggcca

SEQ ID NO: 27742 - DNA, 17 bp, Homo sapiens
ccaggagtttgagacca

SEQ ID NO: 27743 - DNA, 15 bp, Homo sapiens
ccagaagctcagcca

SEQ ID NO: 27744 - DNA, 16 bp, Homo sapiens
ccaaaagctgtggcca

SEQ ID NO: 27745 - DNA, 16 bp, Homo sapiens
ccgaagtttaagctca

SEQ ID NO: 27746 - DNA, 18 bp, Homo sapiens
taagaagtaaataagcca

SEQ ID NO: 27747 - DNA, 18 bp, Homo sapiens
ccagagtgaaatgagcca

SEQ ID NO: 27748 - DNA, 18 bp, Homo sapiens
ccagaaatcagaaagcca

SEQ ID NO: 27749 - DNA, 16 bp, Homo sapiens
ccagaaattagagcca

SEQ ID NO: 27750 - DNA, 18 bp, Homo sapiens
ccacaagtttacgtggcc

SEQ ID NO: 27751 - DNA, 17 bp, Homo sapiens
ccacgaagtcatggcca

SEQ ID NO: 27752 - DNA, 20 bp, Homo sapiens
cagaagtcgatattgagcca

SEQ ID NO: 27753 - DNA, 17 bp, Homo sapiens
ccaaaagttatgaatca

SEQ ID NO: 27754 - DNA, 17 bp, Homo sapiens
ccaaaagtcagaggcca

SEQ ID NO: 27755 - DNA, 19 bp, Homo sapiens
ccagaagtacatggagcca

SEQ ID NO: 27756 - DNA, 18 bp, Homo sapiens
ccagaagtttgggaggcc

SEQ ID NO: 27757 - DNA, 15 bp, Homo sapiens
ccagaaattaagcca

SEQ ID NO: 27758 - DNA, 17 bp, Homo sapiens
ccgagagtttacagcca

SEQ ID NO: 27759 - DNA, 16 bp, Homo sapiens
ccagaagcataagcca

SEQ ID NO: 27760 - DNA, 16 bp, Homo sapiens
ccaaaggcatgagcca

SEQ ID NO: 27761 - DNA, 18 bp, Homo sapiens
cagaagtttcagtgagcc

SEQ ID NO: 27762 - DNA, 17 bp, Homo sapiens
ccagaagttgtgagaca

SEQ ID NO: 27763 - DNA, 16 bp, Homo sapiens
ccagaaatccaagcca

SEQ ID NO: 27764 - DNA, 18 bp, Homo sapiens
ccagaaatgcatgggcca

SEQ ID NO: 27765 - DNA, 109 bp, Human herpesvirus 5
tatgaggttcgaccagcggctgctggaagagggcgacgaggaggatgaagtgaccgtgatgtcgccgtcacccgagcccgtgcaacagcagccgccggtcgagcccgtg

SEQ ID NO: 27766 - DNA, 24 bp, Human herpesvirus 5
agcggctgctggaagagggcgacg

SEQ ID NO: 27767 - DNA, 18 bp, Homo sapiens
agcggctgtggggaggcg

SEQ ID NO: 27768 - DNA, 20 bp, Homo sapiens
ggctgctgttggagaaggcg

SEQ ID NO: 27769 - DNA, 19 bp, Homo sapiens
agcgggtgttggaagagcg

SEQ ID NO: 27770 - DNA, 18 bp, Homo sapiens
gcggctgtgggaagtacg

SEQ ID NO: 27771 - DNA, 18 bp, Homo sapiens
gcggctgcaggaaggggc

SEQ ID NO: 27772 - DNA, 18 bp, Homo sapiens
agggcttgtggagggcga

SEQ ID NO: 27773 - DNA, 22 bp, Homo sapiens
gcggctgcgggaggccagggcg

SEQ ID NO: 27774 - DNA, 17 bp, Homo sapiens
agggctgctgggagagc

SEQ ID NO: 27775 - DNA, 16 bp, Homo sapiens
gcggcggcgggggcgc

SEQ ID NO: 27776 - DNA, 17 bp, Homo sapiens
gcggctgctggtgagca

SEQ ID NO: 27777 - DNA, 23 bp, Homo sapiens
gcggctgcggctcccgggcggcg

SEQ ID NO: 27778 - DNA, 23 bp, Homo sapiens
ggctgctggatgctttggcggcg

SEQ ID NO: 27779 - DNA, 20 bp, Homo sapiens
agctttctgggagagggcga

SEQ ID NO: 27780 - DNA, 17 bp, Homo sapiens
gcggcgctggagggaac

SEQ ID NO: 27781 - DNA, 16 bp, Homo sapiens
ggtgttggagaagacg

SEQ ID NO: 27782 - DNA, 23 bp, Homo sapiens
gcggctgcgggactcgcgtggcg

SEQ ID NO: 27783 - DNA, 21 bp, Homo sapiens
agggctgctggggcttgaggg

SEQ ID NO: 27784 - DNA, 21 bp, Homo sapiens
gctggctgctgggactgggcg

SEQ ID NO: 27785 - DNA, 16 bp, Homo sapiens
gctgctgctgggggca

SEQ ID NO: 27786 - DNA, 21 bp, Homo sapiens
gcggctgcggcctcggcggcg

SEQ ID NO: 27787 - DNA, 21 bp, Homo sapiens
gcggctgcgtcctgggcggcg

SEQ ID NO: 27788 - DNA, 23 bp, Homo sapiens
ggctgcccgtagggagggcgacg

SEQ ID NO: 27789 - DNA, 16 bp, Homo sapiens
gcggcagagagggcgc

SEQ ID NO: 27790 - DNA, 21 bp, Homo sapiens
agcggctgcagggccgcggcg

SEQ ID NO: 27791 - DNA, 22 bp, Homo sapiens
agggctcccggagggggcgacg

SEQ ID NO: 27792 - DNA, 22 bp, Homo sapiens
ggctgtgcaggagggggcgacg

SEQ ID NO: 27793 - DNA, 22 bp, Homo sapiens
agtggcagctggagttacaggg

SEQ ID NO: 27794 - DNA, 22 bp, Homo sapiens
agcgatggccgagagggcggcg

SEQ ID NO: 27795 - DNA, 19 bp, Homo sapiens
cggtgccaagggggcgacg

SEQ ID NO: 27796 - DNA, 21 bp, Homo sapiens
agcagctgctggagcgcggcg

SEQ ID NO: 27797 - DNA, 20 bp, Homo sapiens
gcggtggggtggagagggcg

SEQ ID NO: 27798 - DNA, 24 bp, Homo sapiens
ggctgctggagcccggaggtggcg

SEQ ID NO: 27799 - DNA, 19 bp, Homo sapiens
ggctgctgggaggagagga

SEQ ID NO: 27800 - DNA, 15 bp, Homo sapiens
ggctgctgagggcaa

SEQ ID NO: 27801 - DNA, 18 bp, Homo sapiens
agcggctgtggcgcggcg

SEQ ID NO: 27802 - DNA, 18 bp, Homo sapiens
agtggcgctgggagagag

SEQ ID NO: 27803 - DNA, 18 bp, Homo sapiens
gcagctgttggaggagcg

SEQ ID NO: 27804 - DNA, 18 bp, Homo sapiens
agtggctgctgtgggaca

SEQ ID NO: 27805 - DNA, 17 bp, Homo sapiens
gctggctgctgggaggg

SEQ ID NO: 27806 - DNA, 15 bp, Homo sapiens
gcggcgctggaggcg

SEQ ID NO: 27807 - DNA, 19 bp, Homo sapiens
agtggctgcgggaggagcg

SEQ ID NO: 27808 - DNA, 19 bp, Homo sapiens
agtggctgctgcagggacg

SEQ ID NO: 27809 - DNA, 20 bp, Homo sapiens
gcggctgccggagggcggcg

SEQ ID NO: 27810 - DNA, 19 bp, Homo sapiens
gccgctgctggggcaggcg

SEQ ID NO: 27811 - DNA, 20 bp, Homo sapiens
agtggctgctgggtgagaca

SEQ ID NO: 27812 - DNA, 20 bp, Homo sapiens
agggctgctgggagagaaca

SEQ ID NO: 27813 - DNA, 19 bp, Homo sapiens
ggctgctgggagaataggg

SEQ ID NO: 27814 - DNA, 19 bp, Homo sapiens
agcagctgttggaggttaa

SEQ ID NO: 27815 - DNA, 29 bp, Homo sapiens
gcggctgcctgggggctgctgggcggcgc

SEQ ID NO: 27816 - DNA, 17 bp, Homo sapiens
agcagctgctggggagg

SEQ ID NO: 27817 - DNA, 21 bp, Homo sapiens
gcggctgctcgggctgcggcg

SEQ ID NO: 27818 - DNA, 25 bp, Homo sapiens
agctgctgttggaagcaaagtggcg

SEQ ID NO: 27819 - DNA, 21 bp, Homo sapiens
gcggctgcagcttaggcggcg

SEQ ID NO: 27820 - DNA, 19 bp, Homo sapiens
ggctgctgctgaggcggcg

SEQ ID NO: 27821 - DNA, 18 bp, Homo sapiens
ggccgccagggagggcga

SEQ ID NO: 27822 - DNA, 17 bp, Homo sapiens
gcggctgctgcgagacg

SEQ ID NO: 27823 - DNA, 18 bp, Homo sapiens
gcggctgcgggaggctcg

SEQ ID NO: 27824 - DNA, 20 bp, Homo sapiens
gcggctgctggagaatgtga

SEQ ID NO: 27825 - DNA, 23 bp, Homo sapiens
agcgctgccctcttggagggtga

SEQ ID NO: 27826 - DNA, 25 bp, Homo sapiens
gcggcggcgaaagaggggggcggcg

SEQ ID NO: 27827 - DNA, 20 bp, Homo sapiens
gggttgaaatgagggcgacg

SEQ ID NO: 27828 - DNA, 18 bp, Homo sapiens
agtggctggctggagaga

SEQ ID NO: 27829 - DNA, 17 bp, Homo sapiens
agcgcctgctggaaggc

SEQ ID NO: 27830 - DNA, 19 bp, Homo sapiens
gcggctgctggggaaggcg

SEQ ID NO: 27831 - DNA, 19 bp, Homo sapiens
agcgctgctggccgtggcg

SEQ ID NO: 27832 - DNA, 21 bp, Homo sapiens
gcggctgcaggaggagcggcg

SEQ ID NO: 27833 - DNA, 22 bp, Homo sapiens
agcgctgctggggtcgctggcg

SEQ ID NO: 27834 - DNA, 17 bp, Homo sapiens
gctgctgaagggtgacg

SEQ ID NO: 27835 - DNA, 22 bp, Homo sapiens
agcggctgcggctaaagcggcg

SEQ ID NO: 27836 - DNA, 22 bp, Homo sapiens
agggctccccgagggggcgacg

SEQ ID NO: 27837 - DNA, 19 bp, Homo sapiens
gcggctgcggggaccggcg

SEQ ID NO: 27838 - DNA, 18 bp, Homo sapiens
agcggctgctggcagagg

SEQ ID NO: 27839 - DNA, 22 bp, Homo sapiens
gccgagccgggagagggcggcg

SEQ ID NO: 27840 - DNA, 21 bp, Homo sapiens
agggctgctgggggtgggcga

SEQ ID NO: 27841 - DNA, 19 bp, Homo sapiens
agggctgctggagggaggg

SEQ ID NO: 27842 - DNA, 16 bp, Homo sapiens
agtggctgctgaaggc

SEQ ID NO: 27843 - DNA, 21 bp, Homo sapiens
aggggctgctggagacgggcg

SEQ ID NO: 27844 - DNA, 23 bp, Homo sapiens
aggggctgctggggctccagacg

SEQ ID NO: 27845 - DNA, 21 bp, Homo sapiens
gacctggtggagagggcggcg

SEQ ID NO: 27846 - DNA, 21 bp, Homo sapiens
agcggctgtttgggtctggcg

SEQ ID NO: 27847 - DNA, 16 bp, Homo sapiens
gcggcgtcgggggcgc

SEQ ID NO: 27848 - DNA, 18 bp, Homo sapiens
agcggctgctggcggggc

SEQ ID NO: 27849 - DNA, 15 bp, Homo sapiens
agcagctgctggggc

SEQ ID NO: 27850 - DNA, 24 bp, Homo sapiens
agtggttgcggggcgcgggcgacg

SEQ ID NO: 27851 - DNA, 20 bp, Homo sapiens
agcgctgctggaaaatggcg

SEQ ID NO: 27852 - DNA, 64 bp, Murid herpesvirus 4
ctatatgaacttatgtgcctgtcatgccagccagagttgtggacaacaaacataattattatag

SEQ ID NO: 27853 - DNA, 24 bp, Murid herpesvirus 4
tgtggacaacaaacataattatta

SEQ ID NO: 27854 - DNA, 22 bp, Homo sapiens
tgtggacagctgaatccttatt

SEQ ID NO: 27855 - DNA, 21 bp, Homo sapiens
tgtcgataacaaacatcacta

SEQ ID NO: 27856 - DNA, 23 bp, Homo sapiens
tgcggacagtaaaccgtttatta

SEQ ID NO: 27857 - DNA, 96 bp, Tupaia herpesvirus
gtggttgtaacagttgcttcgagttgtgaattagaatcgttacaaatcttacgtgcgacgttcagtccgatatcggagaaagtaccgtttgaccac

SEQ ID NO: 27858 - DNA, 24 bp, Tupaia herpesvirus
cgttcagtccgatatcggagaaag

SEQ ID NO: 27859 - DNA, 19 bp, Homo sapiens
gttcgatccttggagaaag

SEQ ID NO: 27860 - DNA, 27 bp, Homo sapiens
gttcagcctggggtcaagttgggggaa

SEQ ID NO: 27861 - DNA, 20 bp, Homo sapiens
ctcagcggtgtcggagaaag

SEQ ID NO: 27862 - DNA, 23 bp, Homo sapiens
atttagtctttaagtggagaaag

SEQ ID NO: 27863 - DNA, 22 bp, Homo sapiens
cgctcagttcgaatggtgggaa

SEQ ID NO: 27864 - DNA, 20 bp, Homo sapiens
cgttcggttccaggagaaag

SEQ ID NO: 27865 - DNA, 21 bp, Homo sapiens
gttcagtctatgacctcaaag

SEQ ID NO: 27866 - DNA, 18 bp, Homo sapiens
gttcggtctgcaaagaaa

SEQ ID NO: 27867 - DNA, 20 bp, Homo sapiens
gctcagtctgagtaggggag

SEQ ID NO: 27868 - DNA, 18 bp, Homo sapiens
ttcagtctgatatcagag

SEQ ID NO: 27869 - DNA, 19 bp, Homo sapiens
cgttcagtctggatagaag

SEQ ID NO: 27870 - DNA, 66 bp, Tupaia herpesvirus
gcgttccgttgagagtgactgtattcacccttatgtccaagttcactgactcttgataagagctgc

SEQ ID NO: 27871 - DNA, 24 bp, Tupaia herpesvirus
tccaagttcactgactcttgataa

SEQ ID NO: 27872 - DNA, 22 bp, Homo sapiens
tccaagtttgctcaagtcgata

SEQ ID NO: 27873 - DNA, 21 bp, Homo sapiens
tccaagttcatggttcactcc

SEQ ID NO: 27874 - DNA, 16 bp, Homo sapiens
tccaaattctcttgat

SEQ ID NO: 27875 - DNA, 18 bp, Homo sapiens
catagtttgctcttgata

SEQ ID NO: 27876 - DNA, 20 bp, Homo sapiens
tctcagttcactaatttgat

SEQ ID NO: 27877 - DNA, 15 bp, Homo sapiens
gttcactcctgataa

SEQ ID NO: 27878 - DNA, 18 bp, Homo sapiens
cctgagttcactggctct

SEQ ID NO: 27879 - DNA, 19 bp, Homo sapiens
caagttcattgacatgtga

SEQ ID NO: 27880 - DNA, 20 bp, Homo sapiens
caagttcatttgctgcctga

SEQ ID NO: 27881 - DNA, 20 bp, Homo sapiens
tccgagtcgctgatggcttg

SEQ ID NO: 27882 - DNA, 18 bp, Homo sapiens
tccagtttcactgactct

SEQ ID NO: 27883 - DNA, 18 bp, Homo sapiens
tccaagttcatcatgata

SEQ ID NO: 27884 - DNA, 21 bp, Homo sapiens
aagttctccaactcttgataa

SEQ ID NO: 27885 - DNA, 21 bp, Homo sapiens
catgttcactgactttgcctg

SEQ ID NO: 27886 - DNA, 20 bp, Homo sapiens
tccaagtcactggcctggat

SEQ ID NO: 27887 - DNA, 22 bp, Homo sapiens
tccaagttttttggccaacttg

SEQ ID NO: 27888 - DNA, 24 bp, Homo sapiens
tctgagtttcataacccttgataa

SEQ ID NO: 27889 - DNA, 18 bp, Homo sapiens
ccaggttcactgtggata

SEQ ID NO: 27890 - DNA, 22 bp, Homo sapiens
tctgagttcctgataagcctga

SEQ ID NO: 27891 - DNA, 23 bp, Homo sapiens
tccaagattccaggtcttgataa

SEQ ID NO: 27892 - DNA, 18 bp, Homo sapiens
tccaagttcacctggact

SEQ ID NO: 27893 - DNA, 16 bp, Homo sapiens
aagttcaactcttgat

SEQ ID NO: 27894 - DNA, 21 bp, Homo sapiens
tccgcagtacattcttgataa

SEQ ID NO: 27895 - DNA, 121 bp, Murid herpesvirus 4
gatacatcgatgtggacaacaactgggccctctttataaataataagcgctgtctggatactgaattctcccatatgctaaaagttatggagtacggcctgccagttacagacgaagtatt

SEQ ID NO: 27896 - DNA, 24 bp, Murid herpesvirus 4
ccatatgctaaaagttatggagta

SEQ ID NO: 27897 - DNA, 19 bp, Homo sapiens
ccaaatgctaagagcaagt

SEQ ID NO: 27898 - DNA, 18 bp, Homo sapiens
catgtgccaaaagttatg

SEQ ID NO: 27899 - DNA, 20 bp, Homo sapiens
ccatatgcaaaggcacaaag

SEQ ID NO: 27900 - DNA, 23 bp, Homo sapiens
ccatatgttgacaggatggagta

SEQ ID NO: 27901 - DNA, 20 bp, Homo sapiens
atatactaggcactggagta

SEQ ID NO: 27902 - DNA, 22 bp, Homo sapiens
catatgctgggaagaacctagt

SEQ ID NO: 27903 - DNA, 20 bp, Homo sapiens
catggctaagagctataggt

SEQ ID NO: 27904 - DNA, 20 bp, Homo sapiens
tgatatgctaaacaaggggt

SEQ ID NO: 27905 - DNA, 19 bp, Homo sapiens
atatgctaaacaaagggta

SEQ ID NO: 27906 - DNA, 21 bp, Homo sapiens
tatgctaaaagttttcaaagt

SEQ ID NO: 27907 - DNA, 66 bp, Murid herpesvirus 4
tatgcttcctttaaacaggtgttggattctgatggctttttagaatctcacaccagggacaacata

SEQ ID NO: 27908 - DNA, 21 bp, Murid herpesvirus 4
tctcacaccagggacaacata

SEQ ID NO: 27909 - DNA, 19 bp, Homo sapiens
tcccacaccaaaatggaca

SEQ ID NO: 27910 - DNA, 20 bp, Homo sapiens
ctcttagcctggacaacata

SEQ ID NO: 27911 - DNA, 16 bp, Homo sapiens
cccacagggacagcat

SEQ ID NO: 27912 - DNA, 19 bp, Homo sapiens
tcaacaattggacaacata

SEQ ID NO: 27913 - DNA, 15 bp, Homo sapiens
cctcacacccaacat

SEQ ID NO: 27914 - DNA, 18 bp, Homo sapiens
tcccacgggggacaacat

SEQ ID NO: 27915 - DNA, 17 bp, Homo sapiens
ctcacatcaacaacata

SEQ ID NO: 27916 - DNA, 21 bp, Homo sapiens
tctcacacgggcttctccaac

SEQ ID NO: 27917 - DNA, 17 bp, Homo sapiens
cctcacacagacagcat

SEQ ID NO: 27918 - DNA, 19 bp, Homo sapiens
tcttatacacgacaacata

SEQ ID NO: 27919 - DNA, 19 bp, Homo sapiens
tcccacgccaggaaccaac

SEQ ID NO: 27920 - DNA, 20 bp, Homo sapiens
tctacacggcggacaacata

SEQ ID NO: 27921 - DNA, 22 bp, Homo sapiens
tctccaccaaaataacaatata

SEQ ID NO: 27922 - DNA, 18 bp, Homo sapiens
tcacataagcacaacata

SEQ ID NO: 27923 - DNA, 17 bp, Homo sapiens
tcttcacaaaacaacat

SEQ ID NO: 27924 - DNA, 18 bp, Homo sapiens
tcacaacactacaacata

SEQ ID NO: 27925 - DNA, 18 bp, Homo sapiens
tctctaccaaacaacata

SEQ ID NO: 27926 - DNA, 19 bp, Homo sapiens
tctcacactgggccccata

SEQ ID NO: 27927 - DNA, 16 bp, Homo sapiens
tcccacaggacaacat

SEQ ID NO: 27928 - DNA, 16 bp, Homo sapiens
cctcacacagcagcat

SEQ ID NO: 27929 - DNA, 21 bp, Homo sapiens
tctccacatccacacaacata

SEQ ID NO: 27930 - DNA, 20 bp, Homo sapiens
tctgcagcacagacaacata

SEQ ID NO: 27931 - DNA, 18 bp, Homo sapiens
tctaacaccagggaacaa

SEQ ID NO: 27932 - DNA, 17 bp, Homo sapiens
tcacaccccgacaacat

SEQ ID NO: 27933 - DNA, 24 bp, Homo sapiens
tctcacacattcttgaataacata

SEQ ID NO: 27934 - DNA, 17 bp, Homo sapiens
cctcacactaaccacat

SEQ ID NO: 27935 - DNA, 20 bp, Homo sapiens
acattaggaacaaggacata

SEQ ID NO: 27936 - DNA, 18 bp, Homo sapiens
ccacattcaaaacaacat

SEQ ID NO: 27937 - DNA, 16 bp, Homo sapiens
tcacaagaacagcata

SEQ ID NO: 27938 - DNA, 19 bp, Homo sapiens
cacaccaacacaaagcata

SEQ ID NO: 27939 - DNA, 20 bp, Homo sapiens
tcccacacgcaaaccaacat

SEQ ID NO: 27940 - DNA, 21 bp, Homo sapiens
ctcacgcacacacacaacata

SEQ ID NO: 27941 - DNA, 69 bp, Murid herpesvirus 4
agttggctttctacccctctttacagacaaggaaaggttccctgtatagtttgtgtgggatctccaact

SEQ ID NO: 27942 - DNA, 23 bp, Murid herpesvirus 4
tagtttgtgtgggatctccaact

SEQ ID NO: 27943 - DNA, 19 bp, Homo sapiens
gtttgtgtcagctctaact

SEQ ID NO: 27944 - DNA, 15 bp, Homo sapiens
gttttgtgccccaac

SEQ ID NO: 27945 - DNA, 17 bp, Homo sapiens
gtctactgggatcttca

SEQ ID NO: 27946 - DNA, 20 bp, Homo sapiens
gttttgtattttctccaact

SEQ ID NO: 27947 - DNA, 17 bp, Homo sapiens
gtctgtgtgggctccaa

SEQ ID NO: 27948 - DNA, 21 bp, Homo sapiens
tagtttgtttaggttctaact

SEQ ID NO: 27949 - DNA, 16 bp, Homo sapiens
gtttgtgtaggttcca

SEQ ID NO: 27950 - DNA, 15 bp, Homo sapiens
tagcttgtgtggctc

SEQ ID NO: 27951 - DNA, 20 bp, Homo sapiens
cagtttgcccatctctgact

SEQ ID NO: 27952 - DNA, 97 bp, Murid herpesvirus 4
tttacctgtccaattgtctgtgaggtctataatcagactttccaaaaatataaagaaaaagttaatcttacagaaattaccataatggactggttga

SEQ ID NO: 27953 - DNA, 24 bp, Murid herpesvirus 4
tacctgtccaattgtctgtgaggt

SEQ ID NO: 27954 - DNA, 19 bp, Homo sapiens
ctgtccatgaccatgaggt

SEQ ID NO: 27955 - DNA, 21 bp, Homo sapiens
tacctgtttgtgttgtgaggt

SEQ ID NO: 27956 - DNA, 18 bp, Homo sapiens
ctgtctgtttgtctgggt

SEQ ID NO: 27957 - DNA, 20 bp, Homo sapiens
ctgtctatggatggtgaggt

SEQ ID NO: 27958 - DNA, 16 bp, Homo sapiens
tgtctgtctgcgacgt

SEQ ID NO: 27959 - DNA, 16 bp, Homo sapiens
tacttgtctgttgtgg

SEQ ID NO: 27960 - DNA, 18 bp, Homo sapiens
tacttgttgattgtctgc

SEQ ID NO: 27961 - DNA, 18 bp, Homo sapiens
ctgtccaattgtttagat

SEQ ID NO: 27962 - DNA, 20 bp, Homo sapiens
ctgtgcagttgtgtggaggt

SEQ ID NO: 27963 - DNA, 21 bp, Homo sapiens
ctgcttggctgtctgtgaggt

SEQ ID NO: 27964 - DNA, 20 bp, Homo sapiens
tgcgtgcttgtctgtggggt

SEQ ID NO: 27965 - DNA, 19 bp, Homo sapiens
cctgccttgtctgtggggt

SEQ ID NO: 27966 - DNA, 19 bp, Homo sapiens
tacctgtctaattttctgt

SEQ ID NO: 27967 - DNA, 75 bp, Tupaia herpesvirus
gtctcggtcagcgtgccataaacgaatattatatggtacgtcgaacattcgcttatcatggcatgctgaccgaac

SEQ ID NO: 27968 - DNA, 17 bp, Tupaia herpesvirus
tggcatgctgaccgaac

SEQ ID NO: 27969 - DNA, 18 bp, Homo sapiens
tggcatgctccacagaac

SEQ ID NO: 27970 - DNA, 65 bp, Human papillomavirus type 89
gggcacaatttcttgcacgtgtgcatataccaaagggtatacaggctatgcaaggtcatatgtcc

SEQ ID NO: 27971 - DNA, 24 bp, Human papillomavirus type 89
tatacaggctatgcaaggtcatat

SEQ ID NO: 27972 - DNA, 25 bp, Homo sapiens
atataggctatgtacagaattatat

SEQ ID NO: 27973 - DNA, 19 bp, Homo sapiens
tgacaggctatgttcacat

SEQ ID NO: 27974 - DNA, 23 bp, Homo sapiens
tgacaggctagtgatcaggtcat

SEQ ID NO: 27975 - DNA, 18 bp, Homo sapiens
tatacaggcagtgtaaga

SEQ ID NO: 27976 - DNA, 20 bp, Homo sapiens
tatacaggctgtgacagaat

SEQ ID NO: 27977 - DNA, 22 bp, Homo sapiens
tacacaggtgggtaggttatat

SEQ ID NO: 27978 - DNA, 18 bp, Homo sapiens
tatacagctatgttcagt

SEQ ID NO: 27979 - DNA, 18 bp, Homo sapiens
aggacactgaggtcatat

SEQ ID NO: 27980 - DNA, 16 bp, Homo sapiens
tacaggctatttcata

SEQ ID NO: 27981 - DNA, 62 bp, Human papillomavirus type 89
atgtttgtggagtgatatacttgtgctgcttatttgcttttggctttcgcatttgcctgcat

SEQ ID NO: 27982 - DNA, 24 bp, Human papillomavirus type 89
ggagtgatatacttgtgctgctta

SEQ ID NO: 27983 - DNA, 21 bp, Homo sapiens
gagcgtctgtttgtgctgctt

SEQ ID NO: 27984 - DNA, 17 bp, Homo sapiens
gggtaataaacactgct

SEQ ID NO: 27985 - DNA, 22 bp, Homo sapiens
ggagtgattggcaagctgctta

SEQ ID NO: 27986 - DNA, 22 bp, Homo sapiens
ggagtgatgggttgggggctta

SEQ ID NO: 27987 - DNA, 19 bp, Homo sapiens
ggatgataatttgctgctt

SEQ ID NO: 27988 - DNA, 22 bp, Homo sapiens
ggtggtgtagtcccagctgctt

SEQ ID NO: 27989 - DNA, 25 bp, Homo sapiens
gggtaatataaagcttgtgctgctt

SEQ ID NO: 27990 - DNA, 67 bp, Human papillomavirus type 89
acatggtggtatttgacagacatgatgttgggttactaggcatattgttgttacttattgctcttgt

SEQ ID NO: 27991 - DNA, 24 bp, Human papillomavirus type 89
tttgacagacatgatgttgggtta

SEQ ID NO: 27992 - DNA, 20 bp, Homo sapiens
tttggcagacatgcatctta

SEQ ID NO: 27993 - DNA, 23 bp, Homo sapiens
tttggcagatacgaaaccaagtt

SEQ ID NO: 27994 - DNA, 18 bp, Homo sapiens
ttgatagacaattgggtt

SEQ ID NO: 27995 - DNA, 18 bp, Homo sapiens
tttgacagacagatgctg

SEQ ID NO: 27996 - DNA, 19 bp, Homo sapiens
tttgacaacatggtgactg

SEQ ID NO: 27997 - DNA, 19 bp, Homo sapiens
tttgtcaggcatgatggct

SEQ ID NO: 27998 - DNA, 20 bp, Homo sapiens
tttgacaggtggtgattttg

SEQ ID NO: 27999 - DNA, 19 bp, Homo sapiens
tgacaggtaggactgggtt

SEQ ID NO: 28000 - DNA, 23 bp, Homo sapiens
tttgacaacatggtcacacagtt

SEQ ID NO: 28001 - DNA, 18 bp, Homo sapiens
tttggcagacatggggtc

SEQ ID NO: 28002 - DNA, 18 bp, Homo sapiens
tttggcaaacatggtttg

SEQ ID NO: 28003 - DNA, 20 bp, Homo sapiens
tttgacagatgaggacgttg

SEQ ID NO: 28004 - DNA, 66 bp, Fowl adenovirus A
gcaagtgctactacttttcggagtcagagtccaattggagtgaagccgaaaaattttgtagacagc

SEQ ID NO: 28005 - DNA, 24 bp, Fowl adenovirus A
agtgaagccgaaaaattttgtaga

SEQ ID NO: 28006 - DNA, 21 bp, Homo sapiens
aggaaagaaaaattttgtaga

SEQ ID NO: 28007 - DNA, 20 bp, Homo sapiens
agtgaagctgaacggggcag

SEQ ID NO: 28008 - DNA, 23 bp, Homo sapiens
agtgaagctagaagagatgtgga

SEQ ID NO: 28009 - DNA, 24 bp, Homo sapiens
agtggggccggtagccctcgtaga

SEQ ID NO: 28010 - DNA, 20 bp, Homo sapiens
agtgaaactgaaaacattag

SEQ ID NO: 28011 - DNA, 18 bp, Homo sapiens
agtaaggcctttttgtag

SEQ ID NO: 28012 - DNA, 22 bp, Homo sapiens
gtggagctgacctatttgtaga

SEQ ID NO: 28013 - DNA, 18 bp, Homo sapiens
agctttaaattttgtaga

SEQ ID NO: 28014 - DNA, 19 bp, Homo sapiens
aatggagctgaaaaattcc

SEQ ID NO: 28015 - DNA, 23 bp, Homo sapiens
agtgaactgaaaaatttcttaga

SEQ ID NO: 28016 - DNA, 22 bp, Homo sapiens
agtgaagcctggaagtgcctcg

SEQ ID NO: 28017 - DNA, 20 bp, Homo sapiens
aggaagccgaaagagatctg

SEQ ID NO: 28018 - DNA, 23 bp, Homo sapiens
agtgaagcagaaggaaacccaga

SEQ ID NO: 28019 - DNA, 22 bp, Homo sapiens
gtgaatctggacctcctgtaga

SEQ ID NO: 28020 - DNA, 17 bp, Homo sapiens
agagaagccgatttgtg

SEQ ID NO: 28021 - DNA, 23 bp, Homo sapiens
gtggaattgaaaagccttgtaga

SEQ ID NO: 28022 - DNA, 18 bp, Homo sapiens
atgaggcccattttgtag

SEQ ID NO: 28023 - DNA, 23 bp, Homo sapiens
agtgaggccaaaaaaccacaaga

SEQ ID NO: 28024 - DNA, 20 bp, Homo sapiens
agtggagccaaaaaattttg

SEQ ID NO: 28025 - DNA, 24 bp, Homo sapiens
agtaaggctgagaggccttgtaga

SEQ ID NO: 28026 - DNA, 21 bp, Homo sapiens
atgaagctggtggtttgtaga

SEQ ID NO: 28027 - DNA, 20 bp, Homo sapiens
agcgaggctgtattttgtag

SEQ ID NO: 28028 - DNA, 23 bp, Homo sapiens
agtgaagcaggaaggtttagcag

SEQ ID NO: 28029 - DNA, 20 bp, Homo sapiens
gtagaggccgggcctgtaga

SEQ ID NO: 28030 - DNA, 20 bp, Homo sapiens
agtgatggaagttttgtaga

SEQ ID NO: 28031 - DNA, 61 bp, Melanoplus sanguinipes entomopoxvirus
tagtttagtaaatagattcaataatacaataaattattttataaaatataataccgaatta

SEQ ID NO: 28032 - DNA, 20 bp, Melanoplus sanguinipes entomopoxvirus
taaaatataataccgaatta

SEQ ID NO: 28033 - DNA, 18 bp, Homo sapiens
aaaatataatccaaatta

SEQ ID NO: 28034 - DNA, 19 bp, Homo sapiens
aatattaaataccgaatta

SEQ ID NO: 28035 - DNA, 91 bp, Melanoplus sanguinipes entomopoxvirus
tttcaaataatatatgctaaaattagttcattaaaatttatagataactatgatatatctttaactaaagtagcatatgttactcatgaaa

SEQ ID NO: 28036 - DNA, 24 bp, Melanoplus sanguinipes entomopoxvirus
taatatatgctaaaattagttcat

SEQ ID NO: 28037 - DNA, 18 bp, Homo sapiens
tatgctccaatagttcat

SEQ ID NO: 28038 - DNA, 21 bp, Homo sapiens
taatattgctagacagttcat

SEQ ID NO: 28039 - DNA, 20 bp, Homo sapiens
atatatgctgagaagttcac

SEQ ID NO: 28040 - DNA, 20 bp, Homo sapiens
atatatgctgtaatgttcat

SEQ ID NO: 28041 - DNA, 19 bp, Homo sapiens
taatatttgctaaaataag

SEQ ID NO: 28042 - DNA, 103 bp, Southern cowpea mosaic virus
ctcctccactaattcgcggatacgttgccttatggctgagcttattggttccccatggtgcatcgccatgggtgacgactccgtggagggttttgtggagggg

SEQ ID NO: 28043 - DNA, 24 bp, Southern cowpea mosaic virus
gtgcatcgccatgggtgacgactc

SEQ ID NO: 28044 - DNA, 19 bp, Homo sapiens
gtgcatctgccataatgac

SEQ ID NO: 28045 - DNA, 20 bp, Homo sapiens
gtgtgtcgccgtggaaactc

SEQ ID NO: 28046 - DNA, 21 bp, Homo sapiens
gtgcatccatcatgacgactc

SEQ ID NO: 28047 - DNA, 99 bp, Melanoplus sanguinipes entomopoxvirus
cgtttaataaattaaatataaatattttaatttataatataggtaacaaatatatgcctaaaaaattaaatgtttatatattaatgaaaatattaaatg

SEQ ID NO: 28048 - DNA, 24 bp, Melanoplus sanguinipes entomopoxvirus
taaattaaatataaatattttaat

SEQ ID NO: 28049 - DNA, 18 bp, Homo sapiens
aaatataaatattttaat

SEQ ID NO: 28050 - DNA, 60 bp, Porcine adenovirus A
tgaccccgcccctcggactttgaccgttcccacgccacgtcattttcccacgcgacgtca

SEQ ID NO: 28051 - DNA, 24 bp, Porcine adenovirus A
cctcggactttgaccgttcccacg

SEQ ID NO: 28052 - DNA, 21 bp, Homo sapiens
tcggactttaccactgctacg

SEQ ID NO: 28053 - DNA, 15 bp, Homo sapiens
aaccccgttcccacg

SEQ ID NO: 28054 - DNA, 15 bp, Homo sapiens
cctggacctcgcgtt

SEQ ID NO: 28055 - DNA, 19 bp, Homo sapiens
ccttggactctggctgtcc

SEQ ID NO: 28056 - DNA, 81 bp, Melanoplus sanguinipes entomopoxvirus
aataatatagatagcagattacttaaaatatttataaaaaataaaacttttatttctggtagttttgtatcatatatgatt

SEQ ID NO: 28057 - DNA, 24 bp, Melanoplus sanguinipes entomopoxvirus
taatatagatagcagattacttaa

SEQ ID NO: 28058 - DNA, 18 bp, Homo sapiens
gatttaaacagattactt

SEQ ID NO: 28059 - DNA, 22 bp, Homo sapiens
taatagaggcagcaattactta

SEQ ID NO: 28060 - DNA, 18 bp, Homo sapiens
taacatagatagtaacca

SEQ ID NO: 28061 - DNA, 20 bp, Homo sapiens
atatagatagatatacttaa

SEQ ID NO: 28062 - DNA, 22 bp, Homo sapiens
tagagtgcaaacagattactta

SEQ ID NO: 28063 - DNA, 19 bp, Homo sapiens
taatattgatagcagctca

SEQ ID NO: 28064 - DNA, 19 bp, Homo sapiens
tagaggcagggttacttaa

SEQ ID NO: 28065 - DNA, 28 bp, Homo sapiens
taatatagaaacataaaagattgcttaa

SEQ ID NO: 28066 - DNA, 20 bp, Homo sapiens
ggataaagagcagattactt

SEQ ID NO: 28067 - DNA, 17 bp, Homo sapiens
atatagacagatactta

SEQ ID NO: 28068 - DNA, 62 bp, Porcine adenovirus A
gcgctcatgtcgctgggagtacacccggacccgggcctggatgtactccagcacctgatcgc

SEQ ID NO: 28069 - DNA, 24 bp, Porcine adenovirus A
tcgctgggagtacacccggacccg

SEQ ID NO: 28070 - DNA, 19 bp, Homo sapiens
gctgggagtgcactacaga

SEQ ID NO: 28071 - DNA, 18 bp, Homo sapiens
tcgccggggtccgggccc

SEQ ID NO: 28072 - DNA, 18 bp, Homo sapiens
cctggaggacccggaccc

SEQ ID NO: 28073 - DNA, 23 bp, Homo sapiens
tcgctggggggcaggggaggacc

SEQ ID NO: 28074 - DNA, 17 bp, Homo sapiens
tcgctgggagtgcccag

SEQ ID NO: 28075 - DNA, 22 bp, Homo sapiens
gctgggagggcaggacagggcc

SEQ ID NO: 28076 - DNA, 25 bp, Homo sapiens
ccgctggaaatggcgtccgggcccg

SEQ ID NO: 28077 - DNA, 22 bp, Homo sapiens
cgctgggagtgcaaccggcccg

SEQ ID NO: 28078 - DNA, 24 bp, Homo sapiens
gctgggagtgtcagcctgcgggtc

SEQ ID NO: 28079 - DNA, 21 bp, Homo sapiens
tcgctgaggaggtagctccgg

SEQ ID NO: 28080 - DNA, 17 bp, Homo sapiens
actggctgtccggaccc

SEQ ID NO: 28081 - DNA, 18 bp, Homo sapiens
gctggagtacaccagccc

SEQ ID NO: 28082 - DNA, 17 bp, Homo sapiens
tcactgggagtacaaga

SEQ ID NO: 28083 - DNA, 19 bp, Homo sapiens
tcgccgggaggccaccggg

SEQ ID NO: 28084 - DNA, 20 bp, Homo sapiens
gctgggagagcgcggatccg

SEQ ID NO: 28085 - DNA, 17 bp, Homo sapiens
tcgctgggaggcagacc

SEQ ID NO: 28086 - DNA, 18 bp, Homo sapiens
tccctcacacctgggccc

SEQ ID NO: 28087 - DNA, 91 bp, Melanoplus sanguinipes entomopoxvirus
attgataattatatgagtgaatttaatgataacacatcacatcctgaatttaatatagttaaagttgctcaaaaacgtgtaatatatcaat

SEQ ID NO: 28088 - DNA, 24 bp, Melanoplus sanguinipes entomopoxvirus
tgagtgaatttaatgataacacat

SEQ ID NO: 28089 - DNA, 22 bp, Homo sapiens
taagtgaataaaaatagcacat

SEQ ID NO: 28090 - DNA, 24 bp, Homo sapiens
tgggtgaatctgtggctgacacat

SEQ ID NO: 28091 - DNA, 17 bp, Homo sapiens
gagtaaatgatgataca

SEQ ID NO: 28092 - DNA, 19 bp, Homo sapiens
tgagtaaatgaatgataca

SEQ ID NO: 28093 - DNA, 22 bp, Homo sapiens
atgaattttaatgataacacat

SEQ ID NO: 28094 - DNA, 21 bp, Homo sapiens
taagtgaatttcataacacat

SEQ ID NO: 28095 - DNA, 19 bp, Homo sapiens
tgagtgaagttaaggaaca

SEQ ID NO: 28096 - DNA, 17 bp, Homo sapiens
tgagtgaattgatgaca

SEQ ID NO: 28097 - DNA, 17 bp, Homo sapiens
tgagtgagttaatgaca

SEQ ID NO: 28098 - DNA, 22 bp, Homo sapiens
tgaatgagtttatttaacacat

SEQ ID NO: 28099 - DNA, 65 bp, Tupaia herpesvirus
ccgccgtctcgtagaccgaatccagacgacgcagcccgtctttgatgaggacgtcgaaattgtgg

SEQ ID NO: 28100 - DNA, 24 bp, Tupaia herpesvirus
tttgatgaggacgtcgaaattgtg

SEQ ID NO: 28101 - DNA, 22 bp, Homo sapiens
tttggctgggactgaaattgtg

SEQ ID NO: 28102 - DNA, 19 bp, Homo sapiens
tttgatgaggctgtgctgt

SEQ ID NO: 28103 - DNA, 68 bp, Melon necrotic spot virus
caaaccgggtgcaatatcagctcctgtcgctattagtcggcgagtggctggtatgaagcctaggtttg

SEQ ID NO: 28104 - DNA, 20 bp, Melon necrotic spot virus
tggtatgaagcctaggtttg

SEQ ID NO: 28105 - DNA, 18 bp, Homo sapiens
ggctcgagtttaggtttg

SEQ ID NO: 28106 - DNA, 17 bp, Homo sapiens
tggggtgaataggtttg

SEQ ID NO: 28107 - DNA, 20 bp, Homo sapiens
tggtatagacgccaggtttg

SEQ ID NO: 28108 - DNA, 17 bp, Homo sapiens
tggatgaagcagatttg

SEQ ID NO: 28109 - DNA, 19 bp, Homo sapiens
tgatatgcctgcaggtttg

SEQ ID NO: 28110 - DNA, 21 bp, Homo sapiens
tggtatgaaagggattgtttg

SEQ ID NO: 28111 - DNA, 19 bp, Homo sapiens
tggtatgaaggccattctg

SEQ ID NO: 28112 - DNA, 16 bp, Homo sapiens
ggtatgaagaactttg

SEQ ID NO: 28113 - DNA, 17 bp, Homo sapiens
ggtatgaaggggatttg

SEQ ID NO: 28114 - DNA, 19 bp, Homo sapiens
tggtatgaaaagaagtttg

SEQ ID NO: 28115 - DNA, 18 bp, Homo sapiens
tggtatgaatctcattta

SEQ ID NO: 28116 - DNA, 19 bp, Homo sapiens
ggtataccatctaggtttg

SEQ ID NO: 28117 - DNA, 18 bp, Homo sapiens
ggaacttgcctaggtttg

SEQ ID NO: 28118 - DNA, 20 bp, Homo sapiens
tggtatgagacccatctttg

SEQ ID NO: 28119 - DNA, 18 bp, Homo sapiens
tggagtgaggctaagttt

SEQ ID NO: 28120 - DNA, 17 bp, Homo sapiens
tggatggtgcaggtttg

SEQ ID NO: 28121 - DNA, 20 bp, Homo sapiens
tgatatgaggactgggtttg

SEQ ID NO: 28122 - DNA, 19 bp, Homo sapiens
tggtatgacacactgtttg

SEQ ID NO: 28123 - DNA, 18 bp, Homo sapiens
tggtatgaagtctgggtt

SEQ ID NO: 28124 - DNA, 18 bp, Homo sapiens
tggtatgaaataactttg

SEQ ID NO: 28125 - DNA, 16 bp, Homo sapiens
ggtatgaaagggtttg

SEQ ID NO: 28126 - DNA, 18 bp, Homo sapiens
tggtctgaagcctctgtt

SEQ ID NO: 28127 - DNA, 18 bp, Homo sapiens
tggtatgagagccaaatt

SEQ ID NO: 28128 - DNA, 20 bp, Homo sapiens
tggtatgaaagctttagatt

SEQ ID NO: 28129 - DNA, 19 bp, Homo sapiens
ggtatgagacataggtttg

SEQ ID NO: 28130 - DNA, 22 bp, Homo sapiens
ggtatgaagcctcttttatttg

SEQ ID NO: 28131 - DNA, 16 bp, Homo sapiens
tggatgaagccaggct

SEQ ID NO: 28132 - DNA, 20 bp, Homo sapiens
tgggatgaggctcagatttg

SEQ ID NO: 28133 - DNA, 19 bp, Homo sapiens
tggtggaggctcagatttg

SEQ ID NO: 28134 - DNA, 71 bp, Tupaia herpesvirus
gtaacggggatcgcgagcggtcgagtcgggaccctgcaggcgaccgaacggcagcagatcttccccgcaac

SEQ ID NO: 28135 - DNA, 24 bp, Tupaia herpesvirus
acggggatcgcgagcggtcgagtc

SEQ ID NO: 28136 - DNA, 22 bp, Homo sapiens
acgaggattgtgggcttcgagt

SEQ ID NO: 28137 - DNA, 22 bp, Homo sapiens
cgcggccggcagcggtcgggtc

SEQ ID NO: 28138 - DNA, 18 bp, Homo sapiens
gggggcggcggtcgagtc

SEQ ID NO: 28139 - DNA, 26 bp, Homo sapiens
acggagatcgcggaggtcggtcgggt

SEQ ID NO: 28140 - DNA, 21 bp, Homo sapiens
cggggatcgcgaggcggcgtc

SEQ ID NO: 28141 - DNA, 18 bp, Homo sapiens
cggggatgcgcgggcgtc

SEQ ID NO: 28142 - DNA, 18 bp, Homo sapiens
ggggatcgcgaggaagtc

SEQ ID NO: 28143 - DNA, 124 bp, Melon necrotic spot virus
agggtgtcaattacattgctgatcgtgatgtgataactactgggggtaatattggtgttaacatcaatattcccgggacttatctcgtcacgattgttcttaatgctacatcgattggtcccct

SEQ ID NO: 28144 - DNA, 24 bp, Melon necrotic spot virus
ttcccgggacttatctcgtcacga

SEQ ID NO: 28145 - DNA, 16 bp, Homo sapiens
ttcccgggacttctgc

SEQ ID NO: 28146 - DNA, 20 bp, Homo sapiens
tcccgggatttatctcagcc

SEQ ID NO: 28147 - DNA, 21 bp, Homo sapiens
ttcccgggacctgccgctgcg

SEQ ID NO: 28148 - DNA, 21 bp, Homo sapiens
ttcccgggtttaaaagccgcg

SEQ ID NO: 28149 - DNA, 20 bp, Homo sapiens
ttcccggatagctcgtcgcg

SEQ ID NO: 28150 - DNA, 17 bp, Homo sapiens
ttcttgggactatctca

SEQ ID NO: 28151 - DNA, 21 bp, Homo sapiens
ttcccggagctggatgtcacg

SEQ ID NO: 28152 - DNA, 19 bp, Homo sapiens
ttcctgaggctgtgtcacg

SEQ ID NO: 28153 - DNA, 74 bp, Melon necrotic spot virus
cgtgctgccattagctcttatgctcattccgctgattcagcgccttgggctgagaatgttctagtggtcccatg

SEQ ID NO: 28154 - DNA, 24 bp, Melon necrotic spot virus
tgccattagctcttatgctcattc

SEQ ID NO: 28155 - DNA, 23 bp, Homo sapiens
tgccttagccctgcatgctcatt

SEQ ID NO: 28156 - DNA, 20 bp, Homo sapiens
tgacattagctcttaatact

SEQ ID NO: 28157 - DNA, 21 bp, Homo sapiens
tgccttggctcttaccgtctc

SEQ ID NO: 28158 - DNA, 19 bp, Homo sapiens
tgccatcagttctccaatg

SEQ ID NO: 28159 - DNA, 21 bp, Homo sapiens
tgccattatctattgcttatt

SEQ ID NO: 28160 - DNA, 17 bp, Homo sapiens
tgctttagctctctgcc

SEQ ID NO: 28161 - DNA, 18 bp, Homo sapiens
attagctctcttatcatt

SEQ ID NO: 28162 - DNA, 19 bp, Homo sapiens
tgccattagttttatcatc

SEQ ID NO: 28163 - DNA, 18 bp, Homo sapiens
tgccttagctcttaggct

SEQ ID NO: 28164 - DNA, 18 bp, Homo sapiens
tgtcatcagctgacttat

SEQ ID NO: 28165 - DNA, 80 bp, Tupaia herpesvirus
ggtgagcggacgaacagatagccgcgcgcacacgcgagtctcccggtgagcgagcgactgtctcgagtcgcacgcacacc

SEQ ID NO: 28166 - DNA, 24 bp, Tupaia herpesvirus
tgagcgagcgactgtctcgagtcg

SEQ ID NO: 28167 - DNA, 23 bp, Homo sapiens
gagcgagcgtcaccctcgagtcg

SEQ ID NO: 28168 - DNA, 19 bp, Homo sapiens
cgggccgctgtctcgagtc

SEQ ID NO: 28169 - DNA, 131 bp, Human papillomavirus type 70
ttttgttaataaagtatgtatggaggtttcatttgtggttgcaccctgtgactaaggtgttgtccctgttttacatataataggagtgtgattaccaacatttcctacataattttatgccctaccctaag

SEQ ID NO: 28170 - DNA, 24 bp, Human papillomavirus type 70
taaagtatgtatggaggtttcatt

SEQ ID NO: 28171 - DNA, 21 bp, Homo sapiens
gtatgtattcacattttcatt

SEQ ID NO: 28172 - DNA, 20 bp, Homo sapiens
gtgtgtgtgggggtttcatt

SEQ ID NO: 28173 - DNA, 21 bp, Homo sapiens
taaggtatgtatgaccttgtt

SEQ ID NO: 28174 - DNA, 20 bp, Homo sapiens
aaagtatgtgtgtgaacttt

SEQ ID NO: 28175 - DNA, 21 bp, Homo sapiens
taaagtatgtacaaattgttt

SEQ ID NO: 28176 - DNA, 22 bp, Homo sapiens
aagtgtgctgctcggtttcatt

SEQ ID NO: 28177 - DNA, 21 bp, Homo sapiens
aaagtggtagggggtttcatt

SEQ ID NO: 28178 - DNA, 16 bp, Homo sapiens
agtatgtatggatcat

SEQ ID NO: 28179 - DNA, 17 bp, Homo sapiens
taaggtgtgtatggggc

SEQ ID NO: 28180 - DNA, 19 bp, Homo sapiens
taaagacaatatgaggttt

SEQ ID NO: 28181 - DNA, 19 bp, Homo sapiens
taaagtatgtatgaaaatt

SEQ ID NO: 28182 - DNA, 25 bp, Homo sapiens
taaagtatggattttgattttcatt

SEQ ID NO: 28183 - DNA, 21 bp, Homo sapiens
aaagctgttggaggtttcatt

SEQ ID NO: 28184 - DNA, 16 bp, Homo sapiens
aagtatgtattttcat

SEQ ID NO: 28185 - DNA, 19 bp, Homo sapiens
atggaaaagaggtttcatt

SEQ ID NO: 28186 - DNA, 18 bp, Homo sapiens
taaagtatgtacctcatt

SEQ ID NO: 28187 - DNA, 101 bp, Equine herpesvirus 2
gaggtgcttgcatggagccatctctattggataaacagcaaaggtgaattggcattttcccctctttttatcaaaagatggagaggcctgtaaagtccttc

SEQ ID NO: 28188 - DNA, 24 bp, Equine herpesvirus 2
tattggataaacagcaaaggtgaa

SEQ ID NO: 28189 - DNA, 21 bp, Homo sapiens
tactggatctactcaagggtg

SEQ ID NO: 28190 - DNA, 19 bp, Homo sapiens
tattggataaatacatgca

SEQ ID NO: 28191 - DNA, 17 bp, Homo sapiens
ttggaaggcaaaggtga

SEQ ID NO: 28192 - DNA, 22 bp, Homo sapiens
tattggatagcacagccctaga

SEQ ID NO: 28193 - DNA, 23 bp, Homo sapiens
ttggataaggcaggctctatgaa

SEQ ID NO: 28194 - DNA, 15 bp, Homo sapiens
tattggataaaagtg

SEQ ID NO: 28195 - DNA, 22 bp, Homo sapiens
cattggatggagaagaaaggtg

SEQ ID NO: 28196 - DNA, 20 bp, Homo sapiens
tattggatgagcagaaaaga

SEQ ID NO: 28197 - DNA, 19 bp, Homo sapiens
tggataaatcacaggtgaa

SEQ ID NO: 28198 - DNA, 21 bp, Homo sapiens
ttgggaaacagcaacacatga

SEQ ID NO: 28199 - DNA, 19 bp, Homo sapiens
ttggattccataaaggtga

SEQ ID NO: 28200 - DNA, 18 bp, Homo sapiens
tattggaagaaaaggtga

SEQ ID NO: 28201 - DNA, 23 bp, Homo sapiens
tattggatagatagagaaggtga

SEQ ID NO: 28202 - DNA, 25 bp, Homo sapiens
tactggatattaacctaaaggtgaa

SEQ ID NO: 28203 - DNA, 22 bp, Homo sapiens
tattaagaaatggcaaaggtga

SEQ ID NO: 28204 - DNA, 20 bp, Homo sapiens
ggataaactgcagggggtga

SEQ ID NO: 28205 - DNA, 20 bp, Homo sapiens
ggagtgaaacagcaagggtg

SEQ ID NO: 28206 - DNA, 19 bp, Homo sapiens
ttggataaacggccctaga

SEQ ID NO: 28207 - DNA, 17 bp, Homo sapiens
ggagacagcaaaggtga

SEQ ID NO: 28208 - DNA, 22 bp, Homo sapiens
tattagacgtggcaaaggtgaa

SEQ ID NO: 28209 - DNA, 64 bp, Equine herpesvirus 2
ttcacatggttgtgaatcttggcacaggccttaaagttttccacgttcagagccatacagtggg

SEQ ID NO: 28210 - DNA, 24 bp, Equine herpesvirus 2
tgtgaatcttggcacaggccttaa

SEQ ID NO: 28211 - DNA, 24 bp, Homo sapiens
gtgaaataagagtgcaggccttaa

SEQ ID NO: 28212 - DNA, 22 bp, Homo sapiens
tgcgaatctactaggggtctta

SEQ ID NO: 28213 - DNA, 16 bp, Homo sapiens
tgaatcttggagtctc

SEQ ID NO: 28214 - DNA, 18 bp, Homo sapiens
tgtcagtcttggcacaag

SEQ ID NO: 28215 - DNA, 15 bp, Homo sapiens
tgtgagccaggcctt

SEQ ID NO: 28216 - DNA, 17 bp, Homo sapiens
tgtgaatcttagcagac

SEQ ID NO: 28217 - DNA, 19 bp, Homo sapiens
atgaaaccacacaggcctt

SEQ ID NO: 28218 - DNA, 19 bp, Homo sapiens
tgtgggggccacaggcctt

SEQ ID NO: 28219 - DNA, 25 bp, Homo sapiens
tgagagtcactgctgcaggtcttaa

SEQ ID NO: 28220 - DNA, 18 bp, Homo sapiens
tgtgaactctcaggcctt

SEQ ID NO: 28221 - DNA, 20 bp, Homo sapiens
gtgaaatgcacaggccttaa

SEQ ID NO: 28222 - DNA, 18 bp, Homo sapiens
tgtgaatctgtatgcctt

SEQ ID NO: 28223 - DNA, 20 bp, Homo sapiens
tggacacggcacaggcctta

SEQ ID NO: 28224 - DNA, 23 bp, Homo sapiens
tgtggatcttgattgggccttaa

SEQ ID NO: 28225 - DNA, 21 bp, Homo sapiens
tgtgattaaacagcaggcctt

SEQ ID NO: 28226 - DNA, 87 bp, Molluscum contagiosum virus
gcacgtccgcgggcgcgtaggccagcacctgagccagcaggtcaaagtgctcgccggccagcagcgtgcgcgccagcgcgggcatgt

SEQ ID NO: 28227 - DNA, 24 bp, Molluscum contagiosum virus
gcgcgtaggccagcacctgagcca

SEQ ID NO: 28228 - DNA, 23 bp, Homo sapiens
gcgcgtggtatcggcctgagcca

SEQ ID NO: 28229 - DNA, 17 bp, Homo sapiens
gcgcgaggccagcgagc

SEQ ID NO: 28230 - DNA, 21 bp, Homo sapiens
gcgctgggcagcgcctgagcc

SEQ ID NO: 28231 - DNA, 22 bp, Homo sapiens
ggcaaggtcagcacctgggcca

SEQ ID NO: 28232 - DNA, 19 bp, Homo sapiens
cagagctggcacctgagcc

SEQ ID NO: 28233 - DNA, 19 bp, Homo sapiens
gcagcgtgggtcctgagcc

SEQ ID NO: 28234 - DNA, 23 bp, Homo sapiens
gcggtagtctcagtgcctgagcc

SEQ ID NO: 28235 - DNA, 20 bp, Homo sapiens
gtgagccagcacttgagcca

SEQ ID NO: 28236 - DNA, 21 bp, Homo sapiens
gcgcgtaggccagggtgtcct

SEQ ID NO: 28237 - DNA, 20 bp, Homo sapiens
gcgcgtaggcagcagcggcc

SEQ ID NO: 28238 - DNA, 16 bp, Homo sapiens
gtagacagacctgagc

SEQ ID NO: 28239 - DNA, 21 bp, Homo sapiens
gcacgtgggccttacctgagc

SEQ ID NO: 28240 - DNA, 17 bp, Homo sapiens
gcggggccagctaagcc

SEQ ID NO: 28241 - DNA, 21 bp, Homo sapiens
gccgtggccctgcctgagcca

SEQ ID NO: 28242 - DNA, 16 bp, Homo sapiens
gcggtgggccctgagc

SEQ ID NO: 28243 - DNA, 17 bp, Homo sapiens
gcgaggcccgctgagcc

SEQ ID NO: 28244 - DNA, 20 bp, Homo sapiens
gcgcgaggctggcatgttcc

SEQ ID NO: 28245 - DNA, 19 bp, Homo sapiens
gcgcgtaggcagcatcgcc

SEQ ID NO: 28246 - DNA, 18 bp, Homo sapiens
gcgtccggcacctgagcc

SEQ ID NO: 28247 - DNA, 22 bp, Homo sapiens
gcgcggggccagcagagaagcc

SEQ ID NO: 28248 - DNA, 20 bp, Homo sapiens
gcgtaggaccctctgagcca

SEQ ID NO: 28249 - DNA, 23 bp, Homo sapiens
gccgtaggccagggcgggagcca

SEQ ID NO: 28250 - DNA, 18 bp, Homo sapiens
ggcctagcacctgggcca

SEQ ID NO: 28251 - DNA, 17 bp, Homo sapiens
gttgccacacctgagcc

SEQ ID NO: 28252 - DNA, 19 bp, Homo sapiens
gttgaccgcatctgagcca

SEQ ID NO: 28253 - DNA, 20 bp, Homo sapiens
gcgcgtagtgtcagaccagc

SEQ ID NO: 28254 - DNA, 77 bp, Saimiriine herpesvirus 2
ctcaaattacttcagagctttcattttaaaaaattacatcctcttcctgtgtaatgtttgagtgctgaatttttgag

SEQ ID NO: 28255 - DNA, 24 bp, Saimiriine herpesvirus 2
tacttcagagctttcattttaaaa

SEQ ID NO: 28256 - DNA, 22 bp, Homo sapiens
tacttcaaagttgtctttaaaa

SEQ ID NO: 28257 - DNA, 19 bp, Homo sapiens
ctttagagctctcatccca

SEQ ID NO: 28258 - DNA, 17 bp, Homo sapiens
ttcagaactgtatttta

SEQ ID NO: 28259 - DNA, 22 bp, Homo sapiens
tacttcagagacttttatttta

SEQ ID NO: 28260 - DNA, 19 bp, Homo sapiens
ttcatcagctttcatttta

SEQ ID NO: 28261 - DNA, 20 bp, Homo sapiens
ctttagaactttcaatttta

SEQ ID NO: 28262 - DNA, 19 bp, Homo sapiens
cttcagagttttttccaaa

SEQ ID NO: 28263 - DNA, 18 bp, Homo sapiens
ctctagaactcattttaa

SEQ ID NO: 28264 - DNA, 19 bp, Homo sapiens
acttcagagcttttgttct

SEQ ID NO: 28265 - DNA, 17 bp, Homo sapiens
ttcagagcaattttaaa

SEQ ID NO: 28266 - DNA, 17 bp, Homo sapiens
ctttggagctttccttt

SEQ ID NO: 28267 - DNA, 18 bp, Homo sapiens
acttcagagccccacttt

SEQ ID NO: 28268 - DNA, 18 bp, Homo sapiens
ttcagtgttcattttaaa

SEQ ID NO: 28269 - DNA, 22 bp, Homo sapiens
ttcagagctggttcattttaaa

SEQ ID NO: 28270 - DNA, 21 bp, Homo sapiens
agagcttttccagtcttaaaa

SEQ ID NO: 28271 - DNA, 18 bp, Homo sapiens
ttcatatctttcatttta

SEQ ID NO: 28272 - DNA, 19 bp, Homo sapiens
tcagagcttttgttttaaa

SEQ ID NO: 28273 - DNA, 25 bp, Homo sapiens
tacttcaaaaaactatattttaaaa

SEQ ID NO: 28274 - DNA, 20 bp, Homo sapiens
ttcagtaaatcattttaaaa

SEQ ID NO: 28275 - DNA, 19 bp, Homo sapiens
agcaactttcattttaaaa

SEQ ID NO: 28276 - DNA, 20 bp, Homo sapiens
tacttcaaatacattttaaa

SEQ ID NO: 28277 - DNA, 18 bp, Homo sapiens
cttcagagttttcctcta

SEQ ID NO: 28278 - DNA, 21 bp, Homo sapiens
tactccttttgcttcatttta

SEQ ID NO: 28279 - DNA, 21 bp, Homo sapiens
ctacagagctttgacataaaa

SEQ ID NO: 28280 - DNA, 17 bp, Homo sapiens
tacttcagagttccact

SEQ ID NO: 28281 - DNA, 18 bp, Homo sapiens
agatttctcattttaaaa

SEQ ID NO: 28282 - DNA, 19 bp, Homo sapiens
cctctgcttttattttaaa

SEQ ID NO: 28283 - DNA, 20 bp, Homo sapiens
cacttcaaagttattttaaa

SEQ ID NO: 28284 - DNA, 21 bp, Homo sapiens
ttcagagctctgattttaaaa

SEQ ID NO: 28285 - DNA, 21 bp, Homo sapiens
tacttcaggacttcaactaaa

SEQ ID NO: 28286 - DNA, 20 bp, Homo sapiens
ctcagagctgatttttaaaa

SEQ ID NO: 28287 - DNA, 78 bp, Saimiriine herpesvirus 2
ccagagccttcaaaaattgctgagtgcttctgaaactgagaagctccaactgtatgaacctgaagagtaactctctgg

SEQ ID NO: 28288 - DNA, 24 bp, Saimiriine herpesvirus 2
caactgtatgaacctgaagagtaa

SEQ ID NO: 28289 - DNA, 17 bp, Homo sapiens
gtgtaaaatgaagagta

SEQ ID NO: 28290 - DNA, 17 bp, Homo sapiens
actgtgtatgaagagta

SEQ ID NO: 28291 - DNA, 22 bp, Homo sapiens
cagccaatctaacttgaagagt

SEQ ID NO: 28292 - DNA, 18 bp, Homo sapiens
actgtatgagctaactgt

SEQ ID NO: 28293 - DNA, 22 bp, Homo sapiens
caactgtagaaaatacagagta

SEQ ID NO: 28294 - DNA, 22 bp, Homo sapiens
caactgtactgggcccctgtag

SEQ ID NO: 28295 - DNA, 21 bp, Homo sapiens
tatatgtaatctgaagagtaa

SEQ ID NO: 28296 - DNA, 17 bp, Homo sapiens
accccagcctgaagagt

SEQ ID NO: 28297 - DNA, 23 bp, Homo sapiens
caactgtagtgaaccatctgtaa

SEQ ID NO: 28298 - DNA, 21 bp, Homo sapiens
gagtgtacctttgaagagtaa

SEQ ID NO: 28299 - DNA, 21 bp, Homo sapiens
cagctgtttggtggaagagta

SEQ ID NO: 28300 - DNA, 65 bp, Human herpesvirus 6
acagtagttttcacggtattttttgaaattaaattttaaatcgggtacatgataaagcatgctgt

SEQ ID NO: 28301 - DNA, 24 bp, Human herpesvirus 6
ttaaatcgggtacatgataaagca

SEQ ID NO: 28302 - DNA, 16 bp, Homo sapiens
atcggctgataaagca

SEQ ID NO: 28303 - DNA, 18 bp, Homo sapiens
ttaaatttggtacaaagc

SEQ ID NO: 28304 - DNA, 22 bp, Homo sapiens
ttaaattgagtacatttgggca

SEQ ID NO: 28305 - DNA, 18 bp, Homo sapiens
ttaaatttggtacataat

SEQ ID NO: 28306 - DNA, 16 bp, Homo sapiens
tcagaatgataaagca

SEQ ID NO: 28307 - DNA, 19 bp, Homo sapiens
cagtgcaatcatgataaag

SEQ ID NO: 28308 - DNA, 75 bp, Human herpesvirus 6
tcgtcgtccacctcaggtacaatagtatattatatatatattattttaataaacttattgaggacgggagaacga

SEQ ID NO: 28309 - DNA, 24 bp, Human herpesvirus 6
tattattttaataaacttattgag

SEQ ID NO: 28310 - DNA, 19 bp, Homo sapiens
ttacttaaaacttattgag

SEQ ID NO: 28311 - DNA, 21 bp, Homo sapiens
ttaagaaataaacttattgag

SEQ ID NO: 28312 - DNA, 21 bp, Homo sapiens
attattttaataaactaacca

SEQ ID NO: 28313 - DNA, 22 bp, Homo sapiens
ttattttaataaacattcagag

SEQ ID NO: 28314 - DNA, 65 bp, Saimiriine herpesvirus 2
ttacaactttcattttaaaagtcgcgtcttcttccggtagcgtcttattaaagtttaagttgtag

SEQ ID NO: 28315 - DNA, 24 bp, Saimiriine herpesvirus 2
tagcgtcttattaaagtttaagtt

SEQ ID NO: 28316 - DNA, 21 bp, Homo sapiens
taccgtcttgaaatttaagtt

SEQ ID NO: 28317 - DNA, 19 bp, Homo sapiens
gcatcttatatattaagtt

SEQ ID NO: 28318 - DNA, 19 bp, Homo sapiens
gtcttattagagggcagtt

SEQ ID NO: 28319 - DNA, 82 bp, Saimiriine herpesvirus 2
aaaattatgtgtaagcctagcgtgagtgcgcacagtcagattcttgcattgtgtttactttatttagcaataacatcttttt

SEQ ID NO: 28320 - DNA, 24 bp, Saimiriine herpesvirus 2
cattgtgtttactttatttagcaa

SEQ ID NO: 28321 - DNA, 20 bp, Homo sapiens
attgttttactcctaagcaa

SEQ ID NO: 28322 - DNA, 20 bp, Homo sapiens
cattgtgtttcttacatgca

SEQ ID NO: 28323 - DNA, 19 bp, Homo sapiens
attgtagtttactcaatag

SEQ ID NO: 28324 - DNA, 20 bp, Homo sapiens
ttgtgtttctttttccctca

SEQ ID NO: 28325 - DNA, 16 bp, Homo sapiens
ttgtgttactttatgc

SEQ ID NO: 28326 - DNA, 24 bp, Homo sapiens
attgtgtctacctcccattggcaa

SEQ ID NO: 28327 - DNA, 22 bp, Homo sapiens
tgtgtcagtctttatttggcaa

SEQ ID NO: 28328 - DNA, 23 bp, Homo sapiens
tatgcaacaaattttatttagca

SEQ ID NO: 28329 - DNA, 19 bp, Homo sapiens
ctgtgctcttgtttagcaa

SEQ ID NO: 28330 - DNA, 21 bp, Homo sapiens
attctgtttagcacttagcaa

SEQ ID NO: 28331 - DNA, 23 bp, Homo sapiens
atcataattattttatttagcaa

SEQ ID NO: 28332 - DNA, 23 bp, Homo sapiens
attgtgttaataactgcttagca

SEQ ID NO: 28333 - DNA, 21 bp, Homo sapiens
catagtgtttactttatttaa

SEQ ID NO: 28334 - DNA, 20 bp, Homo sapiens
attgtgtttatatcataaag

SEQ ID NO: 28335 - DNA, 17 bp, Homo sapiens
gtgtttactctttggca

SEQ ID NO: 28336 - DNA, 20 bp, Homo sapiens
cattatgtttgctttattgc

SEQ ID NO: 28337 - DNA, 18 bp, Homo sapiens
gtttaaatttatttagca

SEQ ID NO: 28338 - DNA, 22 bp, Homo sapiens
tgtgtttataatcctttagcaa

SEQ ID NO: 28339 - DNA, 19 bp, Homo sapiens
cattgtgttacttttactt

SEQ ID NO: 28340 - DNA, 16 bp, Homo sapiens
ttggtttactttacgc

SEQ ID NO: 28341 - DNA, 62 bp, Camelpox virus
atctctttcagtatgtgaatagataggtattttatctctattcatcatcgaatttaagagat

SEQ ID NO: 28342 - DNA, 62 bp, Camelpox virus; identical to SEQ ID NO: 28341

SEQ ID NO: 28343 - DNA, 18 bp, Homo sapiens
tatgtgaaaggtacctta

SEQ ID NO: 28344 - DNA, 22 bp, Homo sapiens
tatgttggtagaagtattttat

SEQ ID NO: 28345 - DNA, 19 bp, Homo sapiens
gtgaatagagtccttttat

SEQ ID NO: 28346 - DNA, 19 bp, Homo sapiens
tatgtgaaaaggtaattta

SEQ ID NO: 28347 - DNA, 21 bp, Homo sapiens
tgtgagtagtaattattttat

SEQ ID NO: 28348 - DNA, 23 bp, Homo sapiens
tatgtgaagaagtcatattttat

SEQ ID NO: 28349 - DNA, 18 bp, Homo sapiens
tatgtgaataataggcat

SEQ ID NO: 28350 - DNA, 19 bp, Homo sapiens
tgtgggatagaggcatttt

SEQ ID NO: 28351 - DNA, 72 bp, Satellite tobacco mosaic virus
gagctggaagctatcctaaggtcaatccgactccaacgtgggtcagagccatacctttcgaagtgtcagttc

SEQ ID NO: 28352 - DNA, 24 bp, Satellite tobacco mosaic virus
tatcctaaggtcaatccgactcca

SEQ ID NO: 28353 - DNA, 16 bp, Homo sapiens
cctaggtctcgactcc

SEQ ID NO: 28354 - DNA, 27 bp, Homo sapiens
tatcctaacactaatgatttggctcca

SEQ ID NO: 28355 - DNA, 18 bp, Homo sapiens
tatcctaaggtcactact

SEQ ID NO: 28356 - DNA, 22 bp, Homo sapiens
tatcctaagctcatctaggctc

SEQ ID NO: 28357 - DNA, 22 bp, Homo sapiens
tcctaaggtcacagcagttcca

SEQ ID NO: 28358 - DNA, 19 bp, Homo sapiens
tatcctgaggtcaacggga

SEQ ID NO: 28359 - DNA, 16 bp, Homo sapiens
cctgggtccccgactc

SEQ ID NO: 28360 - DNA, 19 bp, Homo sapiens
ctcggggcaatcgactcca

SEQ ID NO: 28361 - DNA, 23 bp, Homo sapiens
caaggtcagaagtaatgactcca

SEQ ID NO: 28362 - DNA, 18 bp, Homo sapiens
ctaaacaatccgacttca

SEQ ID NO: 28363 - DNA, 19 bp, Homo sapiens
tcttaaggtcaatcttctc

SEQ ID NO: 28364 - DNA, 21 bp, Homo sapiens
tatcctgagatcaaccctcca

SEQ ID NO: 28365 - DNA, 21 bp, Homo sapiens
tatcctaaggtgatggacgcc

SEQ ID NO: 28366 - DNA, 17 bp, Homo sapiens
ctaaagtcaagagtcca

SEQ ID NO: 28367 - DNA, 21 bp, Homo sapiens
tatcctgagatcaaccttcca

SEQ ID NO: 28368 - DNA, 21 bp, Homo sapiens
tcctaaagtcatggcgtgctc

SEQ ID NO: 28369 - DNA, 97 bp, Camelpox virus
attttaggaactacgttcatggtatcctggcgaatattaaaactatcaatgatatgattatcgttttcatcttttatcaccatatagtttctaagat

SEQ ID NO: 28370 - DNA, 24 bp, Camelpox virus
ttcatcttttatcaccatatagtt

SEQ ID NO: 28371 - DNA, 27 bp, Homo sapiens
ttcatctttatatggatgtatatagtt

SEQ ID NO: 28372 - DNA, 18 bp, Homo sapiens
ttcatcttttattacaat

SEQ ID NO: 28373 - DNA, 19 bp, Homo sapiens
ttcatcttttgttccccat

SEQ ID NO: 28374 - DNA, 16 bp, Homo sapiens
ttttatcaccagagtt

SEQ ID NO: 28375 - DNA, 19 bp, Homo sapiens
ttcatcttttatttatagt

SEQ ID NO: 28376 - DNA, 25 bp, Homo sapiens
ttcatctcttattgtatcccaagtt

SEQ ID NO: 28377 - DNA, 20 bp, Homo sapiens
ttcatcctttgtcacctcac

SEQ ID NO: 28378 - DNA, 18 bp, Homo sapiens
tcttgaccaccatatagt

SEQ ID NO: 28379 - DNA, 18 bp, Homo sapiens
ttcatcttattattacca

SEQ ID NO: 28380 - DNA, 22 bp, Homo sapiens
ttcaccttttatcaatgcagtt

SEQ ID NO: 28381 - DNA, 27 bp, Homo sapiens
ttcatcttttattccacagcaatagtt

SEQ ID NO: 28382 - DNA, 70 bp, Equine herpesvirus 2
tgggctacactgataggctgcccgttctgaaggggcacctgatttacaaaacagactttattgtgggcca

SEQ ID NO: 28383 - DNA, 24 bp, Equine herpesvirus 2
cacctgatttacaaaacagacttt

SEQ ID NO: 28384 - DNA, 22 bp, Homo sapiens
caccataaacaaggcagacttt

SEQ ID NO: 28385 - DNA, 17 bp, Homo sapiens
cacctgattttaagact

SEQ ID NO: 28386 - DNA, 19 bp, Homo sapiens
cacctgatttgaagaacaa

SEQ ID NO: 28387 - DNA, 23 bp, Homo sapiens
caccctggaatcagacagacttt

SEQ ID NO: 28388 - DNA, 17 bp, Homo sapiens
acctatttctcagactt

SEQ ID NO: 28389 - DNA, 18 bp, Homo sapiens
cacttatttacaaaacaa

SEQ ID NO: 28390 - DNA, 18 bp, Homo sapiens
tgttctacagcagacttt

SEQ ID NO: 28391 - DNA, 18 bp, Homo sapiens
cccaatgaaacagacttt

SEQ ID NO: 28392 - DNA, 26 bp, Homo sapiens
cacctgatctacaagacaaatacttt

SEQ ID NO: 28393 - DNA, 17 bp, Homo sapiens
tgatataaacagacttt

SEQ ID NO: 28394 - DNA, 22 bp, Homo sapiens
cacactttttgaaacagacttt

SEQ ID NO: 28395 - DNA, 22 bp, Homo sapiens
catctgatgagaagcagacttt

SEQ ID NO: 28396 - DNA, 20 bp, Homo sapiens
cctgatttgtacgggacttt

SEQ ID NO: 28397 - DNA, 21 bp, Homo sapiens
ctgatttacttggcaggcttt

SEQ ID NO: 28398 - DNA, 19 bp, Homo sapiens
acctgatttaaaagcacag

SEQ ID NO: 28399 - DNA, 22 bp, Homo sapiens
accaggattgaaaacagacttt

SEQ ID NO: 28400 - DNA, 17 bp, Homo sapiens
ctaataaaacagacttt

SEQ ID NO: 28401 - DNA, 23 bp, Homo sapiens
cacctgtgcattaaacaggcttt

SEQ ID NO: 28402 - DNA, 20 bp, Homo sapiens
tgatgtcaaaagcagacttt

SEQ ID NO: 28403 - DNA, 21 bp, Homo sapiens
tgatgtcacaaagcagacttt

SEQ ID NO: 28404 - DNA, 23 bp, Homo sapiens
caactgatcgctggacagacttt

SEQ ID NO: 28405 - DNA, 16 bp, Homo sapiens
cctgctcagcagactt

SEQ ID NO: 28406 - DNA, 18 bp, Homo sapiens
tgcttaaaaacagacttt

SEQ ID NO: 28407 - DNA, 16 bp, Homo sapiens
ccattcacaagacaga

SEQ ID NO: 28408 - DNA, 21 bp, Homo sapiens
ctgatttacacccaaggcttt

SEQ ID NO: 28409 - DNA, 18 bp, Homo sapiens
cctgatttataaaaacaa

SEQ ID NO: 28410 - DNA, 22 bp, Homo sapiens
cctaatttataaattaaacttt

SEQ ID NO: 28411 - DNA, 21 bp, Homo sapiens
acttacggataaacagacttt

SEQ ID NO: 28412 - DNA, 22 bp, Homo sapiens
caccgacaccagaacagacttt

SEQ ID NO: 28413 - DNA, 22 bp, Homo sapiens
acctgatttgcagtgacaacct

SEQ ID NO: 28414 - DNA, 23 bp, Homo sapiens
tgatccaggacaggacagacttt

SEQ ID NO: 28415 - DNA, 19 bp, Homo sapiens
ctgaatcaccacagacttt

SEQ ID NO: 28416 - DNA, 23 bp, Homo sapiens
acctttgcctcaaagcagacttt

SEQ ID NO: 28417 - DNA, 24 bp, Homo sapiens
acttgatttacaactgtaaacttt

SEQ ID NO: 28418 - DNA, 17 bp, Homo sapiens
cacttgattacagactt

SEQ ID NO: 28419 - DNA, 66 bp, Camelpox virus
ggcgtctaagatattcttccatcaacttattaacatttttgactagggaagatacattatgacgtc

SEQ ID NO: 28420 - DNA, 24 bp, Camelpox virus
tctaagatattcttccatcaactt

SEQ ID NO: 28421 - DNA, 17 bp, Homo sapiens
tctaaatattcttccat

SEQ ID NO: 28422 - DNA, 21 bp, Homo sapiens
tctcaattcttccattaactt

SEQ ID NO: 28423 - DNA, 16 bp, Homo sapiens
taagatattctgtcaa

SEQ ID NO: 28424 - DNA, 17 bp, Homo sapiens
caagatatttttcctca

SEQ ID NO: 28425 - DNA, 22 bp, Homo sapiens
taaaataattttccatcagctt

SEQ ID NO: 28426 - DNA, 16 bp, Homo sapiens
cctaagatatcatcaa

SEQ ID NO: 28427 - DNA, 16 bp, Homo sapiens
ctaaaattttccatca

SEQ ID NO: 28428 - DNA, 18 bp, Homo sapiens
tccaagactccattaact

SEQ ID NO: 28429 - DNA, 18 bp, Homo sapiens
tctagaatattcttcctc

SEQ ID NO: 28430 - DNA, 18 bp, Homo sapiens
ctaagatattcttaaact

SEQ ID NO: 28431 - DNA, 78 bp, Equine herpesvirus 2
ggcctggaggacgcgggccagcacgtgaaagtgaggtgcctctttgacgtccttcacgagctggccctcctgcgggcc

SEQ ID NO: 28432 - DNA, 24 bp, Equine herpesvirus 2
cacgagctggccctcctgcgggcc

SEQ ID NO: 28433 - DNA, 16 bp, Homo sapiens
cacgagctgcctctgg

SEQ ID NO: 28434 - DNA, 19 bp, Homo sapiens
cacgagctgactctggggc

SEQ ID NO: 28435 - DNA, 20 bp, Homo sapiens
caccagctggcccccagggc

SEQ ID NO: 28436 - DNA, 16 bp, Homo sapiens
gagctggctgcagggc

SEQ ID NO: 28437 - DNA, 19 bp, Homo sapiens
cgggcggcaggtgcgggcc

SEQ ID NO: 28438 - DNA, 19 bp, Homo sapiens
cgggctggccccgagagcc

SEQ ID NO: 28439 - DNA, 20 bp, Homo sapiens
gagctggccctacctggaag

SEQ ID NO: 28440 - DNA, 19 bp, Homo sapiens
cacgagctggctcctgaag

SEQ ID NO: 28441 - DNA, 22 bp, Homo sapiens
caaggataagccttcctgcggg

SEQ ID NO: 28442 - DNA, 21 bp, Homo sapiens
cgggctgggctgggccgggcc

SEQ ID NO: 28443 - DNA, 22 bp, Homo sapiens
gagctggccccggatgtgggcc

SEQ ID NO: 28444 - DNA, 15 bp, Homo sapiens
gagctggcctggggc

SEQ ID NO: 28445 - DNA, 18 bp, Homo sapiens
cacagctggctctcccac

SEQ ID NO: 28446 - DNA, 20 bp, Homo sapiens
cgagcggccccgggggggcc

SEQ ID NO: 28447 - DNA, 20 bp, Homo sapiens
accggctcttcctgcgggcc

SEQ ID NO: 28448 - DNA, 17 bp, Homo sapiens
cgggctggccccagggc

SEQ ID NO: 28449 - DNA, 17 bp, Homo sapiens
cgggccggcttcgcggg

SEQ ID NO: 28450 - DNA, 18 bp, Homo sapiens
gactggccctgcacggcc

SEQ ID NO: 28451 - DNA, 19 bp, Homo sapiens
cacggcctggccctcccgc

SEQ ID NO: 28452 - DNA, 17 bp, Homo sapiens
gctggccctgctgaggc

SEQ ID NO: 28453 - DNA, 16 bp, Homo sapiens
cgcagctggcctgggg

SEQ ID NO: 28454 - DNA, 18 bp, Homo sapiens
cgcagctggccctcgtgc

SEQ ID NO: 28455 - DNA, 16 bp, Homo sapiens
gagctggctctggggc

SEQ ID NO: 28456 - DNA, 19 bp, Homo sapiens
agctggcctttcctcagcc

SEQ ID NO: 28457 - DNA, 19 bp, Homo sapiens
gagctggcctgcagcgggc

SEQ ID NO: 28458 - DNA, 19 bp, Homo sapiens
gctggcccttcctgaagcc

SEQ ID NO: 28459 - DNA, 19 bp, Homo sapiens
cgggctgcgggctgcgggc

SEQ ID NO: 28460 - DNA, 20 bp, Homo sapiens
cacgagcttgtcttcctggg

SEQ ID NO: 28461 - DNA, 18 bp, Homo sapiens
cggggctggcccgcgggc

SEQ ID NO: 28462 - DNA, 22 bp, Homo sapiens
cggggctggccctctagaaggg

SEQ ID NO: 28463 - DNA, 16 bp, Homo sapiens
cacgaggtggcccggg

SEQ ID NO: 28464 - DNA, 20 bp, Homo sapiens
cacgagctgcccctcagggc

SEQ ID NO: 28465 - DNA, 20 bp, Homo sapiens
cgagctggccctctccagcc

SEQ ID NO: 28466 - DNA, 21 bp, Homo sapiens
cacaagctggcctttctggac

SEQ ID NO: 28467 - DNA, 19 bp, Homo sapiens
cacgagctggtttcctgac

SEQ ID NO: 28468 - DNA, 18 bp, Homo sapiens
agttggccctttggaacc

SEQ ID NO: 28469 - DNA, 15 bp, Homo sapiens
cacagctcctgcggg

SEQ ID NO: 28470 - DNA, 19 bp, Homo sapiens
cgacctggcccttccggcg

SEQ ID NO: 28471 - DNA, 21 bp, Homo sapiens
cgagctggtgcctgcctggcc

SEQ ID NO: 28472 - DNA, 20 bp, Homo sapiens
cgaagcccctcctgtgggcc

SEQ ID NO: 28473 - DNA, 16 bp, Homo sapiens
gagctggcttcggggc

SEQ ID NO: 28474 - DNA, 21 bp, Homo sapiens
gagctggtcctgcaacagggc

SEQ ID NO: 28475 - DNA, 18 bp, Homo sapiens
gctgcgtctcctgcgggc

SEQ ID NO: 28476 - DNA, 19 bp, Homo sapiens
gacctgtttctcctgcggg

SEQ ID NO: 28477 - DNA, 16 bp, Homo sapiens
gagctggctcctgggc

SEQ ID NO: 28478 - DNA, 19 bp, Homo sapiens
cgggcggcggacgcgggcc

SEQ ID NO: 28479 - DNA, 17 bp, Homo sapiens
cggcgctggcccgcggg

SEQ ID NO: 28480 - DNA, 18 bp, Homo sapiens
cacgggctgctcaagggc

SEQ ID NO: 28481 - DNA, 16 bp, Homo sapiens
cacgggctgccacggg

SEQ ID NO: 28482 - DNA, 16 bp, Homo sapiens
gagctggccctggggc

SEQ ID NO: 28483 - DNA, 21 bp, Homo sapiens
acggcctggcccctagctggg

SEQ ID NO: 28484 - DNA, 19 bp, Homo sapiens
gagcctggggctgcgggcc

SEQ ID NO: 28485 - DNA, 21 bp, Homo sapiens
gagctggccctcacaggggcc

SEQ ID NO: 28486 - DNA, 18 bp, Homo sapiens
gagatggccctcaacgcc

SEQ ID NO: 28487 - DNA, 20 bp, Homo sapiens
cgaattgaagctctgtgggc

SEQ ID NO: 28488 - DNA, 20 bp, Homo sapiens
gagtggactctcttgtgggc

SEQ ID NO: 28489 - DNA, 22 bp, Homo sapiens
gctgcccagcctcctgcgggcc

SEQ ID NO: 28490 - DNA, 18 bp, Homo sapiens
gacctggccctttcagcc

SEQ ID NO: 28491 - DNA, 20 bp, Homo sapiens
gagctggccctccccctgcc

SEQ ID NO: 28492 - DNA, 18 bp, Homo sapiens
gagctggctgccctgggc

SEQ ID NO: 28493 - DNA, 20 bp, Homo sapiens
gagctggccctggacaggcc

SEQ ID NO: 28494 - DNA, 17 bp, Homo sapiens
cggctggcccgcaaggg

SEQ ID NO: 28495 - DNA, 19 bp, Homo sapiens
cacgggctggccgtcccgc

SEQ ID NO: 28496 - DNA, 23 bp, Homo sapiens
acgagcgggtcttggtgcgggcc

SEQ ID NO: 28497 - DNA, 20 bp, Homo sapiens
cacgggcaggttctgctggg

SEQ ID NO: 28498 - DNA, 17 bp, Homo sapiens
cgtagctggcctgtggg

SEQ ID NO: 28499 - DNA, 18 bp, Homo sapiens
cgagctgaccttgcgggc

SEQ ID NO: 28500 - DNA, 18 bp, Homo sapiens
cgatctggcccttctcgc

SEQ ID NO: 28501 - DNA, 64 bp, Equine herpesvirus 2
ggccacctgctttcaccccttctacttcaagggcttcacctccaaccacctgagctcggtggcc

SEQ ID NO: 28502 - DNA, 24 bp, Equine herpesvirus 2
gggcttcacctccaaccacctgag

SEQ ID NO: 28503 - DNA, 17 bp, Homo sapiens
gggctccagtcacctga

SEQ ID NO: 28504 - DNA, 24 bp, Homo sapiens
gggctgtggccggagtcacctgag

SEQ ID NO: 28505 - DNA, 24 bp, Homo sapiens
gggcctcagccccagctgcctgag

SEQ ID NO: 28506 - DNA, 19 bp, Homo sapiens
ggacttcactgccgcctga

SEQ ID NO: 28507 - DNA, 23 bp, Homo sapiens
gggtctcgggtggaccacctgag

SEQ ID NO: 28508 - DNA, 22 bp, Homo sapiens
aggcttcatccctttacctgag

SEQ ID NO: 28509 - DNA, 19 bp, Homo sapiens
gggttttacctccagccca

SEQ ID NO: 28510 - DNA, 21 bp, Homo sapiens
ggacttcactatccatttgag

SEQ ID NO: 28511 - DNA, 18 bp, Homo sapiens
ggatttcatctccaacca

SEQ ID NO: 28512 - DNA, 20 bp, Homo sapiens
ggcttcactgggcatctgag

SEQ ID NO: 28513 - DNA, 22 bp, Homo sapiens
gggcatcacaggtccacctgag

SEQ ID NO: 28514 - DNA, 20 bp, Homo sapiens
gggctccatttcattacctg

SEQ ID NO: 28515 - DNA, 22 bp, Homo sapiens
ggcctcaccccaactgcctgag

SEQ ID NO: 28516 - DNA, 20 bp, Homo sapiens
gggcttcacttctgccccac

SEQ ID NO: 28517 - DNA, 18 bp, Homo sapiens
gggcttcaccttcaatca

SEQ ID NO: 28518 - DNA, 18 bp, Homo sapiens
gggcttcaccttgaccac

SEQ ID NO: 28519 - DNA, 21 bp, Homo sapiens
gggctccacaccagctgcctg

SEQ ID NO: 28520 - DNA, 21 bp, Homo sapiens
gctccagtttggccacctgag

SEQ ID NO: 28521 - DNA, 19 bp, Homo sapiens
gggctccagtaaccacctg

SEQ ID NO: 28522 - DNA, 72 bp, Equine herpesvirus 2
ggcggaggatggggcgacggggttctttaacattctcagggacaggcacgtggccacctttaacctgctgcc

SEQ ID NO: 28523 - DNA, 24 bp, Equine herpesvirus 2
cacgtggccacctttaacctgctg

SEQ ID NO: 28524 - DNA, 22 bp, Homo sapiens
atgtgctcacagggacctgctg

SEQ ID NO: 28525 - DNA, 19 bp, Homo sapiens
tggcctttttgacctgctg

SEQ ID NO: 28526 - DNA, 21 bp, Homo sapiens
gcaaccatctttaacctgctg

SEQ ID NO: 28527 - DNA, 21 bp, Homo sapiens
cacgtggccgccattcccctg

SEQ ID NO: 28528 - DNA, 21 bp, Homo sapiens
acgtggccactgcctctgctg

SEQ ID NO: 28529 - DNA, 19 bp, Homo sapiens
cacgtggtagtttaacctg

SEQ ID NO: 28530 - DNA, 19 bp, Homo sapiens
gtggccactggacttgctg

SEQ ID NO: 28531 - DNA, 23 bp, Homo sapiens
tgatggcctcttttaacctgctg

SEQ ID NO: 28532 - DNA, 22 bp, Homo sapiens
acgtggccaccttcccaggctg

SEQ ID NO: 28533 - DNA, 21 bp, Homo sapiens
cacgtggccggtaggctgctg

SEQ ID NO: 28534 - DNA, 22 bp, Homo sapiens
cacctggccaccccagttgctg

SEQ ID NO: 28535 - DNA, 19 bp, Homo sapiens
gtggccaccaacactgctg

SEQ ID NO: 28536 - DNA, 22 bp, Homo sapiens
cgcggggctggtcaacctgctg

SEQ ID NO: 28537 - DNA, 16 bp, Homo sapiens
cacgtggccccactgc

SEQ ID NO: 28538 - DNA, 19 bp, Homo sapiens
tggccaccgcaccctgctg

SEQ ID NO: 28539 - DNA, 22 bp, Homo sapiens
gtggctgctcggagacctgctg

SEQ ID NO: 28540 - DNA, 18 bp, Homo sapiens
gccacctttaatctgctg

SEQ ID NO: 28541 - DNA, 18 bp, Homo sapiens
cacatggccactcctgct

SEQ ID NO: 28542 - DNA, 82 bp, Variola virus
atgttttttatctctttcagtatgtgaatagataggtattttatctctattcatcatcgaatttaagagatccgataaacat

SEQ ID NO: 28543 - DNA, 76 bp, Camelpox virus
tgggattttacttaatataatattatttcccgtaataaattttattagaaatgccaaatctataagaaaagtccta

SEQ ID NO: 28544 - DNA, 24 bp, Camelpox virus
ttagaaatgccaaatctataagaa

SEQ ID NO: 28545 - DNA, 21 bp, Homo sapiens
ttaaaaatgccaagataagaa

SEQ ID NO: 28546 - DNA, 21 bp, Homo sapiens
ttagaaatgttaacctttaag

SEQ ID NO: 28547 - DNA, 18 bp, Homo sapiens
ttaaaaatatctataaga

SEQ ID NO: 28548 - DNA, 19 bp, Homo sapiens
ttaggacctatctataaga

SEQ ID NO: 28549 - DNA, 20 bp, Homo sapiens
agaaatgctgggtccacaga

SEQ ID NO: 28550 - DNA, 26 bp, Homo sapiens
ctagaaatgcttagctcttatgagaa

SEQ ID NO: 28551 - DNA, 19 bp, Homo sapiens
gaaatgccaagttctgaga

SEQ ID NO: 28552 - DNA, 22 bp, Homo sapiens
ttagaaagtttttctataagaa

SEQ ID NO: 28553 - DNA, 18 bp, Homo sapiens
ctagaaatgctaaacact

SEQ ID NO: 28554 - DNA, 22 bp, Homo sapiens
ttagaaatgcaggatctcccag

SEQ ID NO: 28555 - DNA, 20 bp, Homo sapiens
ttagaaatgcagatccccag

SEQ ID NO: 28556 - DNA, 19 bp, Homo sapiens
ttagaaatgccaacatcta

SEQ ID NO: 28557 - DNA, 20 bp, Homo sapiens
tagaagtgccaaatttataa

SEQ ID NO: 28558 - DNA, 21 bp, Homo sapiens
aaagtgccaaacaccaaagaa

SEQ ID NO: 28559 - DNA, 19 bp, Homo sapiens
gaaatgccaaacaggcaag

SEQ ID NO: 28560 - DNA, 21 bp, Homo sapiens
tcagaaatgtagatataagaa

SEQ ID NO: 28561 - DNA, 19 bp, Homo sapiens
ttagcaatgccaagtacct

SEQ ID NO: 28562 - DNA, 20 bp, Homo sapiens
gaaatgccattcccatgaga

SEQ ID NO: 28563 - DNA, 77 bp, Human papillomavirus type 52
tgtgtatgtattaataaagtactgtatttactaaactatttatagtagtcttatgttatgttatggttgcacccaca

SEQ ID NO: 28564 - DNA, 19 bp, Human papillomavirus type 52
tgttatggttgcacccaca

SEQ ID NO: 28565 - DNA, 17 bp, Homo sapiens
tgttggcgcgcacccac

SEQ ID NO: 28566 - DNA, 17 bp, Homo sapiens
tgctccgcgcacccaca

SEQ ID NO: 28567 - DNA, 19 bp, Homo sapiens
tgtatgccgggcacccaca

SEQ ID NO: 28568 - DNA, 17 bp, Homo sapiens
tgtcacaggtgtccaca

SEQ ID NO: 28569 - DNA, 19 bp, Homo sapiens
tgttaatgtcacacccaca

SEQ ID NO: 28570 - DNA, 16 bp, Homo sapiens
tgtcacggccgcccac

SEQ ID NO: 28571 - DNA, 16 bp, Homo sapiens
tgttcatggcacccac

SEQ ID NO: 28572 - DNA, 16 bp, Homo sapiens
tgtcatggcacctaca

SEQ ID NO: 28573 - DNA, 19 bp, Homo sapiens
tgtcatggccacctccaca

SEQ ID NO: 28574 - DNA, 17 bp, Homo sapiens
tgctacagttgcctaca

SEQ ID NO: 28575 - DNA, 17 bp, Homo sapiens
tgtcatggtcatccgca

SEQ ID NO: 28576 - DNA, 19 bp, Homo sapiens
tgctatggtcttccttaca

SEQ ID NO: 28577 - DNA, 75 bp, Cowpox virus
cgggttttttatctctttcagtatgtgaatagataggtattttatctctattcatcatcgaatttaagagatccg

SEQ ID NO: 28578 - DNA, 18 bp, Cowpox virus
tcgaatttaagagatccg

SEQ ID NO: 28579 - DNA, 18 bp, Homo sapiens
cgagtctcaagagatccg

SEQ ID NO: 28580 - DNA, 18 bp, Homo sapiens
ccgggttcaagagattcg

SEQ ID NO: 28581 - DNA, 16 bp, Homo sapiens
ccgaacctcagatccg

SEQ ID NO: 28582 - DNA, 75 bp, Human papillomavirus type 59
gagtatttagggttaagttacctgatcccaataaatttggccttccagataacacagtatatgatcctaactctc

SEQ ID NO: 28583 - DNA, 24 bp, Human papillomavirus type 59
taacacagtatatgatcctaactc

SEQ ID NO: 28584 - DNA, 16 bp, Homo sapiens
acgcagtgtcctaact

SEQ ID NO: 28585 - DNA, 17 bp, Homo sapiens
cacagcacattttaact

SEQ ID NO: 28586 - DNA, 19 bp, Homo sapiens
acacagtatagtctcacaa

SEQ ID NO: 28587 - DNA, 19 bp, Homo sapiens
taacacagagcccctgact

SEQ ID NO: 28588 - DNA, 19 bp, Homo sapiens
taacatagtatatatacct

SEQ ID NO: 28589 - DNA, 20 bp, Homo sapiens
cagtggcgtgatcctagctc

SEQ ID NO: 28590 - DNA, 16 bp, Homo sapiens
taacacaggacctaac

SEQ ID NO: 28591 - DNA, 19 bp, Homo sapiens
taacacagtatttgatact

SEQ ID NO: 28592 - DNA, 20 bp, Homo sapiens
cagtggcatgatcctggctc

SEQ ID NO: 28593 - DNA, 17 bp, Homo sapiens
acacagtatattgaact

SEQ ID NO: 28594 - DNA, 20 bp, Homo sapiens
acacagtagaaatctggctc

SEQ ID NO: 28595 - DNA, 19 bp, Homo sapiens
cagtagcctagtcctaact

SEQ ID NO: 28596 - DNA, 15 bp, Homo sapiens
taacacagtatctac

SEQ ID NO: 28597 - DNA, 20 bp, Homo sapiens
cagtggcacgatcctagctc

SEQ ID NO: 28598 - DNA, 22 bp, Homo sapiens
acacagtcacaggattttaact

SEQ ID NO: 28599 - DNA, 20 bp, Homo sapiens
cagtggcctgatcctagctc

SEQ ID NO: 28600 - DNA, 20 bp, Homo sapiens
cagtgacacgatcttggctc

SEQ ID NO: 28601 - DNA, 23 bp, Homo sapiens
cacagtatataggcctctagctc

SEQ ID NO: 28602 - DNA, 19 bp, Homo sapiens
taacacagtatttgaaact

SEQ ID NO: 28603 - DNA, 21 bp, Homo sapiens
taacaacagctggtcctaact

SEQ ID NO: 28604 - DNA, 20 bp, Homo sapiens
acagtatataattttagctc

SEQ ID NO: 28605 - DNA, 20 bp, Homo sapiens
taacacagctgaacatattc

SEQ ID NO: 28606 - DNA, 18 bp, Homo sapiens
acacagtaattcctaact

SEQ ID NO: 28607 - DNA, 21 bp, Homo sapiens
agtatgacttgatcctagctc

SEQ ID NO: 28608 - DNA, 18 bp, Homo sapiens
cacagaagattctaactc

SEQ ID NO: 28609 - DNA, 97 bp, Monkeypox virus
attttaggaactatgttcatggtatcctggcgaatattaaaactatcaatgatatgattatcgttttcatcttttatcaccatatagtttctaagat

SEQ ID NO: 28610 - DNA, 24 bp, Monkeypox virus
ttcatggtatcctggcgaatatta

SEQ ID NO: 28611 - DNA, 25 bp, Homo sapiens
catggtatctttactgggaatatta

SEQ ID NO: 28612 - DNA, 21 bp, Homo sapiens
tggtattggctttgaatatta

SEQ ID NO: 28613 - DNA, 24 bp, Homo sapiens
ttcatggcgtagtctctggatatt

SEQ ID NO: 28614 - DNA, 21 bp, Homo sapiens
ttcatggtttggcaaagtatt

SEQ ID NO: 28615 - DNA, 62 bp, Human papillomavirus type 59
tgtatgtgtgcatgttgtatgttttgtattgtttgcctgtttgtatgttgtgtatatgtaca

SEQ ID NO: 28616 - DNA, 24 bp, Human papillomavirus type 59
tgtgtgcatgttgtatgttttgta

SEQ ID NO: 28617 - DNA, 18 bp, Homo sapiens
tgtgtgcatgtgtgcagt

SEQ ID NO: 28618 - DNA, 25 bp, Homo sapiens
tgtgtgcatgtgtgtaggagcctgt

SEQ ID NO: 28619 - DNA, 18 bp, Homo sapiens
tgtgtgcatgtgtgtgtt

SEQ ID NO: 28620 - DNA, 19 bp, Homo sapiens
tgagtgcatgctgttttgt

SEQ ID NO: 28621 - DNA, 19 bp, Homo sapiens
tgtgtgtgtgtgtgtctgt

SEQ ID NO: 28622 - DNA, 19 bp, Homo sapiens
tgtgtggcatttgttttgt

SEQ ID NO: 28623 - DNA, 19 bp, Homo sapiens
tgtgtgcatgtgtgagtgt

SEQ ID NO: 28624 - DNA, 23 bp, Homo sapiens
tgtgtgcatgtgtgtgcatttgt

SEQ ID NO: 28625 - DNA, 19 bp, Homo sapiens
tgtgtgcatttgtgtatgt

SEQ ID NO: 28626 - DNA, 19 bp, Homo sapiens
tgtgtgtgtgtttgttttg

SEQ ID NO: 28627 - DNA, 23 bp, Homo sapiens
tgtgtgtatgttatgtatatgta

SEQ ID NO: 28628 - DNA, 23 bp, Homo sapiens
tgtgtgcatgtttgtgtgtgtgt

SEQ ID NO: 28629 - DNA, 18 bp, Homo sapiens
tgtgtttgtttgttttgt

SEQ ID NO: 28630 - DNA, 17 bp, Homo sapiens
tgtgtgcatgtgtgtgt

SEQ ID NO: 28631 - DNA, 17 bp, Homo sapiens
tgtgtgtgtgtgtatat

SEQ ID NO: 28632 - DNA, 19 bp, Homo sapiens
tgtgtgcgtgtgtgcgtgt

SEQ ID NO: 28633 - DNA, 23 bp, Homo sapiens
tgtgtgcatgtttgtgtgcgtgt

SEQ ID NO: 28634 - DNA, 18 bp, Homo sapiens
tgtgtgcgtgtgtgtatg

SEQ ID NO: 28635 - DNA, 17 bp, Homo sapiens
tgtgtgtatgtgtgtgt

SEQ ID NO: 28636 - DNA, 23 bp, Homo sapiens
tgtgtgtgtgtgtgtctgcgtgt

SEQ ID NO: 28637 - DNA, 19 bp, Homo sapiens
tgtgtgtgtgtgtgtgtct

SEQ ID NO: 28638 - DNA, 19 bp, Homo sapiens
tgtgtgtgtgtgtgtatgt

SEQ ID NO: 28639 - DNA, 19 bp, Homo sapiens
tgtgtgtgtgtatgtgtgt

SEQ ID NO: 28640 - DNA, 18 bp, Homo sapiens
tgtgtgtgtgttgtgtat

SEQ ID NO: 28641 - DNA, 24 bp, Homo sapiens
tgtgtgtgtgttgtctcatcagta

SEQ ID NO: 28642 - DNA, 22 bp, Homo sapiens
tgtgtgcgtgtgtataaaaagt

SEQ ID NO: 28643 - DNA, 21 bp, Homo sapiens
tgtgggcatgtttttgtttgt

SEQ ID NO: 28644 - DNA, 19 bp, Homo sapiens
tgtgtgtatgtttgtgtgt

SEQ ID NO: 28645 - DNA, 18 bp, Homo sapiens
tgtgtgtgtgtgtgtata

SEQ ID NO: 28646 - DNA, 18 bp, Homo sapiens
tgtgtgtatgtgtgtgtt

SEQ ID NO: 28647 - DNA, 20 bp, Homo sapiens
tgtgtgcatgtgtgtgcatg

SEQ ID NO: 28648 - DNA, 17 bp, Homo sapiens
tgtgtgcatgtgtatgt

SEQ ID NO: 28649 - DNA, 23 bp, Homo sapiens
tgtgtgcatgtgtgcaagcatgt

SEQ ID NO: 28650 - DNA, 21 bp, Homo sapiens
tgtgtgtgtgtgtgtgttttg

SEQ ID NO: 28651 - DNA, 21 bp, Homo sapiens
tgtgtgtatgtctgtgcacgt

SEQ ID NO: 28652 - DNA, 17 bp, Homo sapiens
tgtgtgtgtgtgtatgc

SEQ ID NO: 28653 - DNA, 21 bp, Homo sapiens
tgtgtgtgtgtgtgtgtttta

SEQ ID NO: 28654 - DNA, 19 bp, Homo sapiens
tgtgtgcttgtgtgtgtgt

SEQ ID NO: 28655 - DNA, 19 bp, Homo sapiens
tgtgtgtgtgtgtgttttg

SEQ ID NO: 28656 - DNA, 20 bp, Homo sapiens
tgtgtgtgtgtgtgtccagt

SEQ ID NO: 28657 - DNA, 17 bp, Homo sapiens
tgtgtgtatgtgtatgt

SEQ ID NO: 28658 - DNA, 23 bp, Homo sapiens
tgtgtgtgtgtgtgtgtcctgta

SEQ ID NO: 28659 - DNA, 21 bp, Homo sapiens
tgtgtgtatgcttgtcagtgt

SEQ ID NO: 28660 - DNA, 22 bp, Homo sapiens
tgtgtgcatgctgtgtgcatgt

SEQ ID NO: 28661 - DNA, 18 bp, Homo sapiens
tgtgtgtgtgtgtgtgtc

SEQ ID NO: 28662 - DNA, 21 bp, Homo sapiens
tgtgtgtgtgtgtgtctctgt

SEQ ID NO: 28663 - DNA, 20 bp, Homo sapiens
tgtgtgcatgtatgtgtatg

SEQ ID NO: 28664 - DNA, 19 bp, Homo sapiens
tgtgtgtgtgtgtatatgt

SEQ ID NO: 28665 - DNA, 21 bp, Homo sapiens
tgtgtgcatgtgtgtgcctgt

SEQ ID NO: 28666 - DNA, 21 bp, Homo sapiens
tgtgtgtatgtgtatatatgt

SEQ ID NO: 28667 - DNA, 20 bp, Homo sapiens
gtgtgtgtgtatattttgta

SEQ ID NO: 28668 - DNA, 23 bp, Homo sapiens
tgtgtgtgtgtctgtgcaactgt

SEQ ID NO: 28669 - DNA, 17 bp, Homo sapiens
tgtgtgcacgcctttgt

SEQ ID NO: 28670 - DNA, 21 bp, Homo sapiens
tgtgtgtgtgtgtgtgtccta

SEQ ID NO: 28671 - DNA, 19 bp, Homo sapiens
tgtgtgtgtgtggtgtgtt

SEQ ID NO: 28672 - DNA, 20 bp, Homo sapiens
tgtgtgtgtgtgtgtggtgt

SEQ ID NO: 28673 - DNA, 16 bp, Homo sapiens
tgtgtgcgtgttttgt

SEQ ID NO: 28674 - DNA, 19 bp, Homo sapiens
tgtgtgtatgtatgtatat

SEQ ID NO: 28675 - DNA, 21 bp, Homo sapiens
tgtgtgtgtgtgtatctatgt

SEQ ID NO: 28676 - DNA, 65 bp, Human papillomavirus type 59
atgtgtggttgcacccaatgagtaaggtactgtccctttattgtttctttgtccttattacacat

SEQ ID NO: 28677 - DNA, 21 bp, Human papillomavirus type 59
ttctttgtccttattacacat

SEQ ID NO: 28678 - DNA, 17 bp, Homo sapiens
tttgaccccttacacat

SEQ ID NO: 28679 - DNA, 19 bp, Homo sapiens
ctctttgtcaagtaataca

SEQ ID NO: 28680 - DNA, 17 bp, Homo sapiens
tctttaatattacacat

SEQ ID NO: 28681 - DNA, 16 bp, Homo sapiens
ttccttgtccttaaca

SEQ ID NO: 28682 - DNA, 16 bp, Homo sapiens
ttctttttcccacaca

SEQ ID NO: 28683 - DNA, 18 bp, Homo sapiens
tctttgttcattacacat

SEQ ID NO: 28684 - DNA, 19 bp, Homo sapiens
ttctgtgtcccctacacat

SEQ ID NO: 28685 - DNA, 17 bp, Homo sapiens
ttcttgtccttagcaca

SEQ ID NO: 28686 - DNA, 21 bp, Homo sapiens
ttccttgtcctgatgccacat

SEQ ID NO: 28687 - DNA, 19 bp, Homo sapiens
ttctttatcttatccacat

SEQ ID NO: 28688 - DNA, 23 bp, Homo sapiens
ttctttattccccaactacacat

SEQ ID NO: 28689 - DNA, 18 bp, Homo sapiens
ttcttgtcccatcaacat

SEQ ID NO: 28690 - DNA, 16 bp, Homo sapiens
tcctttgtctactaca

SEQ ID NO: 28691 - DNA, 22 bp, Homo sapiens
ttcttttgtcctctacacacac

SEQ ID NO: 28692 - DNA, 18 bp, Homo sapiens
ttctttgtccataaaaca

SEQ ID NO: 28693 - DNA, 20 bp, Homo sapiens
ttctttgcataattacacat

SEQ ID NO: 28694 - DNA, 17 bp, Homo sapiens
ttctttgtcacactaca

SEQ ID NO: 28695 - DNA, 17 bp, Homo sapiens
ttctttgtcttagaaca

SEQ ID NO: 28696 - DNA, 18 bp, Homo sapiens
ttctctgttcctttacac

SEQ ID NO: 28697 - DNA, 16 bp, Homo sapiens
ttctttgtctctacac

SEQ ID NO: 28698 - DNA, 16 bp, Homo sapiens
ttcttgtcctcaaaca

SEQ ID NO: 28699 - DNA, 18 bp, Homo sapiens
ttccttgtgtatacacat

SEQ ID NO: 28700 - DNA, 18 bp, Homo sapiens
tcttttaacattacacat

SEQ ID NO: 28701 - DNA, 18 bp, Homo sapiens
ttctttgccattgcacat

SEQ ID NO: 28702 - DNA, 20 bp, Homo sapiens
ttctttgccctatagcacat

SEQ ID NO: 28703 - DNA, 16 bp, Homo sapiens
ttcattgtcctctaca

SEQ ID NO: 28704 - DNA, 20 bp, Homo sapiens
ttctttgcccagaggcacat

SEQ ID NO: 28705 - DNA, 20 bp, Homo sapiens
ttctttatccttaaagccat

SEQ ID NO: 28706 - DNA, 15 bp, Homo sapiens
tctgtccttcaccat

SEQ ID NO: 28707 - DNA, 19 bp, Homo sapiens
ctttgtaacctttacacat

SEQ ID NO: 28708 - DNA, 22 bp, Homo sapiens
ttctttgtccttcccctctaca

SEQ ID NO: 28709 - DNA, 17 bp, Homo sapiens
tttgcttcatcacacac

SEQ ID NO: 28710 - DNA, 17 bp, Homo sapiens
ctctttgccattataca

SEQ ID NO: 28711 - DNA, 17 bp, Homo sapiens
ttctttgtctcccaaca

SEQ ID NO: 28712 - DNA, 19 bp, Homo sapiens
ttctttgttttcacagcac

SEQ ID NO: 28713 - DNA, 22 bp, Homo sapiens
ttctttattctccctgacacat

SEQ ID NO: 28714 - DNA, 78 bp, Ectromelia virus
gatacgaatatgtctttgttaaaaacagttattttctgaatatttctagtttgtaattttaacatatgatattcgttc

SEQ ID NO: 28715 - DNA, 24 bp, Ectromelia virus
tctttgttaaaaacagttattttc

SEQ ID NO: 28716 - DNA, 18 bp, Homo sapiens
tcattgttaaaagcagct

SEQ ID NO: 28717 - DNA, 24 bp, Homo sapiens
tccttgtcttctccggttattttc

SEQ ID NO: 28718 - DNA, 19 bp, Homo sapiens
tctttgttacagctgtttt

SEQ ID NO: 28719 - DNA, 22 bp, Homo sapiens
tcttttcttcacagttattttc

SEQ ID NO: 28720 - DNA, 26 bp, Homo sapiens
tctttgtttaaaaggttagttatttt

SEQ ID NO: 28721 - DNA, 18 bp, Homo sapiens
tctttgttggtaacagtc

SEQ ID NO: 28722 - DNA, 20 bp, Homo sapiens
cttggggcacagttattttc

SEQ ID NO: 28723 - DNA, 24 bp, Homo sapiens
tctttgctaaaaatgtgacatttt

SEQ ID NO: 28724 - DNA, 68 bp, Human herpesvirus 6
gaccccaaccgcggtacccactgatctttatctttatgaagaaaaacaggaactgcggttgccccgtt

SEQ ID NO: 28725 - DNA, 21 bp, Human herpesvirus 6
aggaactgcggttgccccgtt

SEQ ID NO: 28726 - DNA, 19 bp, Homo sapiens
aggaactgaggaccttgtt

SEQ ID NO: 28727 - DNA, 18 bp, Homo sapiens
ggaatgaactgccctgtt

SEQ ID NO: 28728 - DNA, 22 bp, Homo sapiens
agaaactgctgaatgccttgtt

SEQ ID NO: 28729 - DNA, 19 bp, Homo sapiens
aggaactggggggcacgtt

SEQ ID NO: 28730 - DNA, 20 bp, Homo sapiens
aggcactgtgaagccccgtt

SEQ ID NO: 28731 - DNA, 21 bp, Homo sapiens
aggaactgcaggttttgcgtt

SEQ ID NO: 28732 - DNA, 17 bp, Homo sapiens
aggagtactgccccgtt

SEQ ID NO: 28733 - DNA, 25 bp, Homo sapiens
aggagctgcccgtgcctgccctgtt

SEQ ID NO: 28734 - DNA, 18 bp, Homo sapiens
ggggcccagtgctccgtt

SEQ ID NO: 28735 - DNA, 18 bp, Homo sapiens
gaactggcttgctccgtt

SEQ ID NO: 28736 - DNA, 22 bp, Homo sapiens
agggactgcagcaaggatcgtt

SEQ ID NO: 28737 - DNA, 19 bp, Homo sapiens
aggaactgcctctcccgtt

SEQ ID NO: 28738 - DNA, 16 bp, Homo sapiens
gggactgggccccgtt

SEQ ID NO: 28739 - DNA, 16 bp, Homo sapiens
aggaactactacctgt

SEQ ID NO: 28740 - DNA, 19 bp, Homo sapiens
ggggcctggctgccctgtt

SEQ ID NO: 28741 - DNA, 16 bp, Homo sapiens
aggaatgcaaccctgt

SEQ ID NO: 28742 - DNA, 17 bp, Homo sapiens
ggagtgggtgccccgtt

SEQ ID NO: 28743 - DNA, 20 bp, Homo sapiens
agaacctaaactgccctgtt

SEQ ID NO: 28744 - DNA, 24 bp, Homo sapiens
aggaactgtgatctttttctcgtt

SEQ ID NO: 28745 - DNA, 18 bp, Homo sapiens
ggaatcagctgccttgtt

SEQ ID NO: 28746 - DNA, 19 bp, Homo sapiens
aggacttcacggccccgtt

SEQ ID NO: 28747 - DNA, 18 bp, Homo sapiens
aggaactgctgcagtgtt

SEQ ID NO: 28748 - DNA, 21 bp, Homo sapiens
aggacgcttgagggccccgtt

SEQ ID NO: 28749 - DNA, 21 bp, Homo sapiens
aggtactgcaaaagctttgtt

SEQ ID NO: 28750 - DNA, 21 bp, Homo sapiens
aggggttccagttgccctgtt

SEQ ID NO: 28751 - DNA, 22 bp, Homo sapiens
aggaactgattttattcctgtt

SEQ ID NO: 28752 - DNA, 19 bp, Homo sapiens
aggcccgagttgccctgtt

SEQ ID NO: 28753 - DNA, 17 bp, Homo sapiens
ggagctgcggttccccg

SEQ ID NO: 28754 - DNA, 18 bp, Homo sapiens
ggggctgggggccccgtt

SEQ ID NO: 28755 - DNA, 15 bp, Homo sapiens
agaactcagccccgt

SEQ ID NO: 28756 - DNA, 21 bp, Homo sapiens
ggaactgcgtactcacctgtt

SEQ ID NO: 28757 - DNA, 18 bp, Homo sapiens
agaaactgtgtctccgct

SEQ ID NO: 28758 - DNA, 66 bp, Rat cytomegalovirus
cggctacatcgaagaaggaatacgagctaagtatacagagcgtgtgggaaaggagcgacgtggtcg

SEQ ID NO: 28759 - DNA, 24 bp, Rat cytomegalovirus
tcgaagaaggaatacgagctaagt

SEQ ID NO: 28760 - DNA, 17 bp, Homo sapiens
agaaggaatagtgcaag

SEQ ID NO: 28761 - DNA, 20 bp, Homo sapiens
gaggaagggactcactgagt

SEQ ID NO: 28762 - DNA, 21 bp, Homo sapiens
gaagaaggaaggtggctgagt

SEQ ID NO: 28763 - DNA, 22 bp, Homo sapiens
tctgggaaggaatgtgagagct

SEQ ID NO: 28764 - DNA, 72 bp, Yaba-like disease virus
ttacttttttaaacttgttaattttaagtgacaatgtaagtattgttatccacaaaacaactaattgagtaa

SEQ ID NO: 28765 - DNA, 24 bp, Yaba-like disease virus
aacttgttaattttaagtgacaat

SEQ ID NO: 28766 - DNA, 18 bp, Homo sapiens
aacttgttaattttaagt

SEQ ID NO: 28767 - DNA, 19 bp, Homo sapiens
ttattaattttatgacaat

SEQ ID NO: 28768 - DNA, 19 bp, Homo sapiens
aacttgttatattttgtga

SEQ ID NO: 28769 - DNA, 19 bp, Homo sapiens
cttgttaagaacagtgaca

SEQ ID NO: 28770 - DNA, 20 bp, Homo sapiens
aacttgttcacaaaaagtga

SEQ ID NO: 28771 - DNA, 17 bp, Homo sapiens
cttaggttttaagtgac

SEQ ID NO: 28772 - DNA, 18 bp, Homo sapiens
cttgttaattttaactaa

SEQ ID NO: 28773 - DNA, 18 bp, Homo sapiens
acttgttaatcttgtcac

SEQ ID NO: 28774 - DNA, 18 bp, Homo sapiens
ctgttaattttaagagga

SEQ ID NO: 28775 - DNA, 20 bp, Homo sapiens
aacttgttagtctgcaagta

SEQ ID NO: 28776 - DNA, 65 bp, Human papillomavirus type 51
tttggcatattttatcttactaattgcatagttggcaggtcaaatactatgtttttagtgccaag

SEQ ID NO: 28777 - DNA, 21 bp, Human papillomavirus type 51
tactatgtttttagtgccaag

SEQ ID NO: 28778 - DNA, 21 bp, Homo sapiens
tactgattcccaagtgccaag

SEQ ID NO: 28779 - DNA, 19 bp, Homo sapiens
ctgcatctttggtgccaag

SEQ ID NO: 28780 - DNA, 18 bp, Homo sapiens
tacatgttacgtgccaag

SEQ ID NO: 28781 - DNA, 16 bp, Homo sapiens
tactcccttagtgcca

SEQ ID NO: 28782 - DNA, 19 bp, Homo sapiens
tactagtttttgcttacca

SEQ ID NO: 28783 - DNA, 18 bp, Homo sapiens
tactgatgtcctgccaag

SEQ ID NO: 28784 - DNA, 18 bp, Homo sapiens
ctggaccctagtgccaag

SEQ ID NO: 28785 - DNA, 20 bp, Homo sapiens
cactatgtttttaaaacaag

SEQ ID NO: 28786 - DNA, 16 bp, Homo sapiens
tactatgttcctccaa

SEQ ID NO: 28787 - DNA, 18 bp, Homo sapiens
tactatgtttctagctca

SEQ ID NO: 28788 - DNA, 17 bp, Homo sapiens
tacatgtttttctacca

SEQ ID NO: 28789 - DNA, 20 bp, Homo sapiens
tacttgttgactgtgccaag

SEQ ID NO: 28790 - DNA, 17 bp, Homo sapiens
ccaggcatagtgccaag

SEQ ID NO: 28791 - DNA, 18 bp, Homo sapiens
tactatgtccaggccaag

SEQ ID NO: 28792 - DNA, 18 bp, Homo sapiens
taccatgagacagtgcca

SEQ ID NO: 28793 - DNA, 20 bp, Homo sapiens
cactgtgctcccaggtgcca

SEQ ID NO: 28794 - DNA, 19 bp, Homo sapiens
ctgtattctgtgtgccaag

SEQ ID NO: 28795 - DNA, 19 bp, Homo sapiens
tgtctttcttgatgccaag

SEQ ID NO: 28796 - DNA, 19 bp, Homo sapiens
tactctgtcctctgccaag

SEQ ID NO: 28797 - DNA, 20 bp, Homo sapiens
tatgtgtgcgcagtgccaag

SEQ ID NO: 28798 - DNA, 17 bp, Homo sapiens
tatgtttttggcccaag

SEQ ID NO: 28799 - DNA, 17 bp, Homo sapiens
tacagtgccctgtgcca

SEQ ID NO: 28800 - DNA, 21 bp, Homo sapiens
tacataaattttagtgccaag

SEQ ID NO: 28801 - DNA, 18 bp, Homo sapiens
ctaatctttagtgccaag

SEQ ID NO: 28802 - DNA, 19 bp, Homo sapiens
tacttgagatccagtgcca

SEQ ID NO: 28803 - DNA, 18 bp, Homo sapiens
tgctattccagtgccaag

SEQ ID NO: 28804 - DNA, 80 bp, Camelpox virus
tttctaagatatgggattttacttaatataatattatttcccgtaataaattttattagaaatgccaaatctataagaaa

SEQ ID NO: 28805 - DNA, 24 bp, Camelpox virus
tctaagatatgggattttacttaa

SEQ ID NO: 28806 - DNA, 20 bp, Homo sapiens
agatatagcgctttttactt

SEQ ID NO: 28807 - DNA, 18 bp, Homo sapiens
tctggatgtgggatttca

SEQ ID NO: 28808 - DNA, 29 bp, Homo sapiens
taaaatacatttctgggattttatttaat

SEQ ID NO: 28809 - DNA, 24 bp, Homo sapiens
tctaggatttggttcaaaacttaa

SEQ ID NO: 28810 - DNA, 24 bp, Homo sapiens
tctaagatattgggtgacaactta

SEQ ID NO: 28811 - DNA, 23 bp, Homo sapiens
tctgagatatgaggaaagctctt

SEQ ID NO: 28812 - DNA, 20 bp, Homo sapiens
tctgggatatgggggtctca

SEQ ID NO: 28813 - DNA, 18 bp, Homo sapiens
agatatggcattacttaa

SEQ ID NO: 28814 - DNA, 19 bp, Homo sapiens
tctaggactgattttactt

SEQ ID NO: 28815 - DNA, 19 bp, Homo sapiens
tctgagataatctcactta

SEQ ID NO: 28816 - DNA, 17 bp, Homo sapiens
tctaagacatttcactt

SEQ ID NO: 28817 - DNA, 21 bp, Homo sapiens
cttagagatgggttttactta

SEQ ID NO: 28818 - DNA, 20 bp, Homo sapiens
ctgagaatggttttacttaa

SEQ ID NO: 28819 - DNA, 79 bp, Human papillomavirus type 51
acagaggtaatggcttatttacacacaatggatcctaccattcttgaacagtggaattttggattaacattacctccgt

SEQ ID NO: 28820 - DNA, 24 bp, Human papillomavirus type 51
aatggatcctaccattcttgaaca

SEQ ID NO: 28821 - DNA, 19 bp, Homo sapiens
ggaaagccattcttggaca

SEQ ID NO: 28822 - DNA, 17 bp, Homo sapiens
atggatccagctcttga

SEQ ID NO: 28823 - DNA, 18 bp, Homo sapiens
tggattaaacttcttgaa

SEQ ID NO: 28824 - DNA, 25 bp, Homo sapiens
aatggatcttacacacccatgaaca

SEQ ID NO: 28825 - DNA, 17 bp, Homo sapiens
gacttactattcttgaa

SEQ ID NO: 28826 - DNA, 17 bp, Homo sapiens
aatggatcctgtctgaa

SEQ ID NO: 28827 - DNA, 18 bp, Homo sapiens
agagggtaccattcttga

SEQ ID NO: 28828 - DNA, 19 bp, Homo sapiens
tggatcctggcccccaaga

SEQ ID NO: 28829 - DNA, 23 bp, Homo sapiens
aatggatcctgcaaggcagaaca

SEQ ID NO: 28830 - DNA, 21 bp, Homo sapiens
aatagattttgttcttgaaca

SEQ ID NO: 28831 - DNA, 18 bp, Homo sapiens
aatggaccctactgctga

SEQ ID NO: 28832 - DNA, 18 bp, Homo sapiens
tggatcctaccgttcacg

SEQ ID NO: 28833 - DNA, 16 bp, Homo sapiens
atggatccttcatgaa

SEQ ID NO: 28834 - DNA, 63 bp, Equine herpesvirus 4
tggctaatgtccagtctatgtggaactaaaaaccccgcatccctagaagaagtttatgagcca

SEQ ID NO: 28835 - DNA, 24 bp, Equine herpesvirus 4
catccctagaagaagtttatgagc

SEQ ID NO: 28836 - DNA, 18 bp, Homo sapiens
catctctagaaaagtcca

SEQ ID NO: 28837 - DNA, 22 bp, Homo sapiens
tccccagagggagctcgggagc

SEQ ID NO: 28838 - DNA, 22 bp, Homo sapiens
catccccagaggagaccaggag

SEQ ID NO: 28839 - DNA, 17 bp, Homo sapiens
tccttagaagaaaagag

SEQ ID NO: 28840 - DNA, 18 bp, Homo sapiens
catctccagaagaggtcc

SEQ ID NO: 28841 - DNA, 18 bp, Homo sapiens
catccctaggtgaaggag

SEQ ID NO: 28842 - DNA, 19 bp, Homo sapiens
cccctagaaggggcaagag

SEQ ID NO: 28843 - DNA, 20 bp, Homo sapiens
catcccagaagagggtggag

SEQ ID NO: 28844 - DNA, 20 bp, Homo sapiens
catccctaaagaagcagaag

SEQ ID NO: 28845 - DNA, 18 bp, Homo sapiens
catccttagaagaagatt

SEQ ID NO: 28846 - DNA, 20 bp, Homo sapiens
ccttttgaagggtttatgag

SEQ ID NO: 28847 - DNA, 22 bp, Homo sapiens
catccccaggggaggacacagc

SEQ ID NO: 28848 - DNA, 22 bp, Homo sapiens
catccctaggggaggacacagc

SEQ ID NO: 28849 - DNA, 19 bp, Homo sapiens
cctaagagaattttatgag

SEQ ID NO: 28850 - DNA, 16 bp, Homo sapiens
catcccagaagtgtga

SEQ ID NO: 28851 - DNA, 23 bp, Homo sapiens
cactcctgggagtaacctatgag

SEQ ID NO: 28852 - DNA, 17 bp, Homo sapiens
tccaagaagtttgtgag

SEQ ID NO: 28853 - DNA, 19 bp, Homo sapiens
catcccctggaaggagatg

SEQ ID NO: 28854 - DNA, 19 bp, Homo sapiens
cattcctaaagaagtgtag

SEQ ID NO: 28855 - DNA, 16 bp, Homo sapiens
cctacaagaaattgag

SEQ ID NO: 28856 - DNA, 22 bp, Homo sapiens
ctattttcaggggtttatgagc

SEQ ID NO: 28857 - DNA, 15 bp, Homo sapiens
atcccagagcttatg

SEQ ID NO: 28858 - DNA, 21 bp, Homo sapiens
tctcagaagaaaaggcagagc

SEQ ID NO: 28859 - DNA, 22 bp, Homo sapiens
atccctagaagtgtgtattatg

SEQ ID NO: 28860 - DNA, 21 bp, Homo sapiens
catccccaggagtcagtgggc

SEQ ID NO: 28861 - DNA, 21 bp, Homo sapiens
cattcctagaaggagctgagc

SEQ ID NO: 28862 - DNA, 18 bp, Homo sapiens
atccctagagcgtatgag

SEQ ID NO: 28863 - DNA, 18 bp, Homo sapiens
atcccttgaagggatgag

SEQ ID NO: 28864 - DNA, 81 bp, Saimiriine herpesvirus 2
ttgtttttccatgaattaattaaattctacaattgttttcgcagcaattaaatacaaaaaattatttcaatggctcaataa

SEQ ID NO: 28865 - DNA, 24 bp, Saimiriine herpesvirus 2
tccatgaattaattaaattctaca

SEQ ID NO: 28866 - DNA, 22 bp, Homo sapiens
atgaattaattagtgttctaca

SEQ ID NO: 28867 - DNA, 18 bp, Homo sapiens
atgaacacaaattctaca

SEQ ID NO: 28868 - DNA, 19 bp, Homo sapiens
catgattaattaaatctct

SEQ ID NO: 28869 - DNA, 21 bp, Homo sapiens
tccatgaattaataaagactc

SEQ ID NO: 28870 - DNA, 18 bp, Homo sapiens
catgaattaattacattc

SEQ ID NO: 28871 - DNA, 20 bp, Homo sapiens
tccatgaatggattaatcca

SEQ ID NO: 28872 - DNA, 16 bp, Homo sapiens
tccaggaataattcta

SEQ ID NO: 28873 - DNA, 23 bp, Homo sapiens
cccatggcaatgtaaattctaca

SEQ ID NO: 28874 - DNA, 22 bp, Homo sapiens
catgtgagcactagattctaca

SEQ ID NO: 28875 - DNA, 21 bp, Homo sapiens
cctgaattttaattaaattct

SEQ ID NO: 28876 - DNA, 19 bp, Homo sapiens
tccatgaataatagcctct

SEQ ID NO: 28877 - DNA, 19 bp, Homo sapiens
catgaattaataaattaca

SEQ ID NO: 28878 - DNA, 90 bp, Human papillomavirus type 84
ggtgttgtgccccctccctccacaagtttagatgatacctataggtacttgcagtctcgcgccattacttgccaaaagggggccgccgcc

SEQ ID NO: 28879 - DNA, 24 bp, Human papillomavirus type 84
cacaagtttagatgatacctatag

SEQ ID NO: 28880 - DNA, 17 bp, Homo sapiens
agtttagatgcttatag

SEQ ID NO: 28881 - DNA, 19 bp, Homo sapiens
cacaagttgatggcctgta

SEQ ID NO: 28882 - DNA, 23 bp, Homo sapiens
cacaagcttggagatttttatag

SEQ ID NO: 28883 - DNA, 20 bp, Homo sapiens
acaagtttaggttgtactac

SEQ ID NO: 28884 - DNA, 18 bp, Homo sapiens
cacagagatgatacttat

SEQ ID NO: 28885 - DNA, 64 bp, Bovine enterovirus
ctgagagatggggctcgcagtcacccccgtggtaacacggttgcttgcccgcgtgtgctctcgg

SEQ ID NO: 28886 - DNA, 24 bp, Bovine enterovirus
tcgcagtcacccccgtggtaacac

SEQ ID NO: 28887 - DNA, 18 bp, Homo sapiens
gcagtcacctccaggaca

SEQ ID NO: 28888 - DNA, 20 bp, Homo sapiens
tccagtcacctgagctggca

SEQ ID NO: 28889 - DNA, 28 bp, Homo sapiens
ccgcagtcgcctctgctgcgtgttacca

SEQ ID NO: 28890 - DNA, 20 bp, Homo sapiens
acagtcacttttttgaacac

SEQ ID NO: 28891 - DNA, 19 bp, Homo sapiens
tcccagtcacctcctgggt

SEQ ID NO: 28892 - DNA, 17 bp, Homo sapiens
gcatcaccccagagaca

SEQ ID NO: 28893 - DNA, 22 bp, Homo sapiens
tcgcagccgccccttcccagca

SEQ ID NO: 28894 - DNA, 19 bp, Homo sapiens
tcgcagccgcgcggtgaca

SEQ ID NO: 28895 - DNA, 19 bp, Homo sapiens
tcgcagtcactgcctcggc

SEQ ID NO: 28896 - DNA, 22 bp, Homo sapiens
tcgcagtcacacgaaagtggca

SEQ ID NO: 28897 - DNA, 18 bp, Homo sapiens
tccagtcaccctcgccat

SEQ ID NO: 28898 - DNA, 22 bp, Homo sapiens
tcgcagccatttccccgaacgc

SEQ ID NO: 28899 - DNA, 19 bp, Homo sapiens
ccacaactcctgtggtgac

SEQ ID NO: 28900 - DNA, 22 bp, Homo sapiens
tcgcagtccccctgggcagaca

SEQ ID NO: 28901 - DNA, 18 bp, Homo sapiens
gcagtcaccccacaggca

SEQ ID NO: 28902 - DNA, 16 bp, Homo sapiens
gtcaccatagtaacac

SEQ ID NO: 28903 - DNA, 19 bp, Homo sapiens
tcgcaatcacccccaaaca

SEQ ID NO: 28904 - DNA, 21 bp, Homo sapiens
tcgcggccacccccgcccggc

SEQ ID NO: 28905 - DNA, 18 bp, Homo sapiens
gcagtgacctccatggta

SEQ ID NO: 28906 - DNA, 19 bp, Homo sapiens
gcagtcacccttccaggca

SEQ ID NO: 28907 - DNA, 17 bp, Homo sapiens
gcagtcacctctgaaca

SEQ ID NO: 28908 - DNA, 15 bp, Homo sapiens
gcagccaccccagca

SEQ ID NO: 28909 - DNA, 21 bp, Homo sapiens
tcgcagtcagcttcggtccca

SEQ ID NO: 28910 - DNA, 24 bp, Homo sapiens
tcccagtcacccttggagaggaac

SEQ ID NO: 28911 - DNA, 19 bp, Homo sapiens
tcgcagtcagtcacctgat

SEQ ID NO: 28912 - DNA, 17 bp, Homo sapiens
tcgcagccgccctcggc

SEQ ID NO: 28913 - DNA, 23 bp, Homo sapiens
tccagtcacccagagggtgacac

SEQ ID NO: 28914 - DNA, 18 bp, Homo sapiens
cgcggtcatcccacaaca

SEQ ID NO: 28915 - DNA, 23 bp, Homo sapiens
tcacggtcacctcctcatctgca

SEQ ID NO: 28916 - DNA, 19 bp, Homo sapiens
gcggtcaccacagtaacac

SEQ ID NO: 28917 - DNA, 71 bp, Bovine enterovirus
tgagttcgcccgcttgccattgaatattgccttgtattaccttatagcatttcaaaaagccacagatctca

SEQ ID NO: 28918 - DNA, 18 bp, Bovine enterovirus
aaaaagccacagatctca

SEQ ID NO: 28919 - DNA, 19 bp, Homo sapiens
aaaaagcctgccagactca

SEQ ID NO: 28920 - DNA, 17 bp, Homo sapiens
aaaaagccatgaactca

SEQ ID NO: 28921 - DNA, 18 bp, Homo sapiens
aaaaagccatgaatttca

SEQ ID NO: 28922 - DNA, 17 bp, Homo sapiens
aaaaagccacctcccca

SEQ ID NO: 28923 - DNA, 18 bp, Homo sapiens
aaaaaaccactattctca

SEQ ID NO: 28924 - DNA, 17 bp, Homo sapiens
aaaaacccacagaatca

SEQ ID NO: 28925 - DNA, 18 bp, Homo sapiens
aaaagccaatgattctca

SEQ ID NO: 28926 - DNA, 17 bp, Homo sapiens
aaaaaacacagatctca

SEQ ID NO: 28927 - DNA, 20 bp, Homo sapiens
aaaagccagtcaccagatct

SEQ ID NO: 28928 - DNA, 17 bp, Homo sapiens
aaaaaaccacaatctca

SEQ ID NO: 28929 - DNA, 18 bp, Homo sapiens
ggaagaccacaaagctca

SEQ ID NO: 28930 - DNA, 17 bp, Homo sapiens
aaaaaacctcattctca

SEQ ID NO: 28931 - DNA, 17 bp, Homo sapiens
aaaaacccactacctca

SEQ ID NO: 28932 - DNA, 17 bp, Homo sapiens
ggaaagccacagaatca

SEQ ID NO: 28933 - DNA, 16 bp, Homo sapiens
aaaaacccacaaccca

SEQ ID NO: 28934 - DNA, 21 bp, Homo sapiens
aaaaagccacacaatatctca

SEQ ID NO: 28935 - DNA, 19 bp, Homo sapiens
aaaagccacaataatctca

SEQ ID NO: 28936 - DNA, 16 bp, Homo sapiens
aaaaaaccagatctca

SEQ ID NO: 28937 - DNA, 17 bp, Homo sapiens
aaaaagccacagcctca

SEQ ID NO: 28938 - DNA, 15 bp, Homo sapiens
aaaaaaccaccctca

SEQ ID NO: 28939 - DNA, 18 bp, Homo sapiens
aaaaaaccccacatctca

SEQ ID NO: 28940 - DNA, 17 bp, Homo sapiens
aaaaagcccagacttca

SEQ ID NO: 28941 - DNA, 20 bp, Homo sapiens
aaaaagcccagtacatctca

SEQ ID NO: 28942 - DNA, 18 bp, Homo sapiens
tgaaacaacaagatctca

SEQ ID NO: 28943 - DNA, 19 bp, Homo sapiens
aaaaaaccaagagttctca

SEQ ID NO: 28944 - DNA, 18 bp, Homo sapiens
aaaaagccccagatttca

SEQ ID NO: 28945 - DNA, 18 bp, Homo sapiens
aaaaagccaaaaccctca

SEQ ID NO: 28946 - DNA, 18 bp, Homo sapiens
aaaaaaccacaaatttca

SEQ ID NO: 28947 - DNA, 18 bp, Homo sapiens
aaaaaattacagatctca

SEQ ID NO: 28948 - DNA, 21 bp, Homo sapiens
aaaaagcccaggcgctgtctc

SEQ ID NO: 28949 - DNA, 18 bp, Homo sapiens
aaaaaccacaagacttca

SEQ ID NO: 28950 - DNA, 17 bp, Homo sapiens
aaaaaacccaaccctca

SEQ ID NO: 28951 - DNA, 19 bp, Homo sapiens
aaaaaacctaacaatctca

SEQ ID NO: 28952 - DNA, 17 bp, Homo sapiens
aaaaatcccagctctca

SEQ ID NO: 28953 - DNA, 16 bp, Homo sapiens
aaaaaacaagatctca

SEQ ID NO: 28954 - DNA, 17 bp, Homo sapiens
aaaaagcccagagttca

SEQ ID NO: 28955 - DNA, 104 bp, Human papillomavirus type 84
ggcatttttttaacaggcagggtactatgggtgaggaggtgcctcagtctttttaccttaaggggacctcctcccgggcaacccttagcagttctgtgtatgcc

SEQ ID NO: 28956 - DNA, 24 bp, Human papillomavirus type 84
ctcccgggcaacccttagcagttc

SEQ ID NO: 28957 - DNA, 18 bp, Homo sapiens
ctcccgggccagtcagtt

SEQ ID NO: 28958 - DNA, 23 bp, Homo sapiens
tcctgggcccaagcttagcagtt

SEQ ID NO: 28959 - DNA, 24 bp, Homo sapiens
ctcccaggtagtttttcaacagtt

SEQ ID NO: 28960 - DNA, 17 bp, Homo sapiens
tcctggggtcagcagtt

SEQ ID NO: 28961 - DNA, 19 bp, Homo sapiens
ctcccgggcggatcaggtt

SEQ ID NO: 28962 - DNA, 18 bp, Homo sapiens
ctcccgggaactcaggtt

SEQ ID NO: 28963 - DNA, 19 bp, Homo sapiens
ctcccgggaggccccagtt

SEQ ID NO: 28964 - DNA, 20 bp, Homo sapiens
ctcccgggcgcccttcggtt

SEQ ID NO: 28965 - DNA, 23 bp, Homo sapiens
tcccgggaatgggaaagcagttc

SEQ ID NO: 28966 - DNA, 20 bp, Homo sapiens
ctcctgggcaacctgcagct

SEQ ID NO: 28967 - DNA, 22 bp, Homo sapiens
tctcaggcaacagtagcagttc

SEQ ID NO: 28968 - DNA, 21 bp, Homo sapiens
ctcccgggccatctggagttc

SEQ ID NO: 28969 - DNA, 23 bp, Homo sapiens
ctcctggccagtccaaagtgttc

SEQ ID NO: 28970 - DNA, 23 bp, Homo sapiens
ctcctgagcagccccctctgttc

SEQ ID NO: 28971 - DNA, 21 bp, Homo sapiens
ctccttggacccttggtagtt

SEQ ID NO: 28972 - DNA, 16 bp, Homo sapiens
ggacatttagcagttc

SEQ ID NO: 28973 - DNA, 18 bp, Homo sapiens
ctcccgggcagcacttgc

SEQ ID NO: 28974 - DNA, 68 bp, Equine herpesvirus 4
gctgctgcggcggcgagggctgctgcggcggcgagggctgctgcggcggcgagggctgctgcggcggc

SEQ ID NO: 28975 - DNA, 24 bp, Equine herpesvirus 4
ctgcggcggcgagggctgctgcgg

SEQ ID NO: 28976 - DNA, 20 bp, Homo sapiens
gcggcggcgaggccgggcgg

SEQ ID NO: 28977 - DNA, 18 bp, Homo sapiens
cagcggcggtggctttgg

SEQ ID NO: 28978 - DNA, 16 bp, Homo sapiens
gcggcggcggggcgcg

SEQ ID NO: 28979 - DNA, 19 bp, Homo sapiens
ctgcggcggcgagaacgcg

SEQ ID NO: 28980 - DNA, 16 bp, Homo sapiens
ctgcggcggtaggggc

SEQ ID NO: 28981 - DNA, 16 bp, Homo sapiens
tgcggcagtggctgtg

SEQ ID NO: 28982 - DNA, 25 bp, Homo sapiens
ctgcggcggcggaagctggctgcgg

SEQ ID NO: 28983 - DNA, 19 bp, Homo sapiens
ccgcggcggcggggatgcg

SEQ ID NO: 28984 - DNA, 20 bp, Homo sapiens
gcggcggccacttgttgcgg

SEQ ID NO: 28985 - DNA, 21 bp, Homo sapiens
cggtggcggcggcggctgcgg

SEQ ID NO: 28986 - DNA, 21 bp, Homo sapiens
ctgcggcggcagccgctgcgg

SEQ ID NO: 28987 - DNA, 21 bp, Homo sapiens
ctgcggcggcggcgacggcgg

SEQ ID NO: 28988 - DNA, 21 bp, Homo sapiens
ctgcggcggtgcagggagctg

SEQ ID NO: 28989 - DNA, 19 bp, Homo sapiens
gcggcggcggggcaggcgg

SEQ ID NO: 28990 - DNA, 16 bp, Homo sapiens
ctgcggcgggcgctgc

SEQ ID NO: 28991 - DNA, 16 bp, Homo sapiens
gcggcggcggggggcg

SEQ ID NO: 28992 - DNA, 18 bp, Homo sapiens
ctgtggtgacgagggctg

SEQ ID NO: 28993 - DNA, 21 bp, Homo sapiens
ccgcggcggcgaggagagcgg

SEQ ID NO: 28994 - DNA, 16 bp, Homo sapiens
ctgcggcggcggcggc

SEQ ID NO: 28995 - DNA, 18 bp, Homo sapiens
ctgggcggcgagggctgc

SEQ ID NO: 28996 - DNA, 16 bp, Homo sapiens
ctgcgggcgctgctgc

SEQ ID NO: 28997 - DNA, 19 bp, Homo sapiens
ggcgatggggctgctgtgg

SEQ ID NO: 28998 - DNA, 16 bp, Homo sapiens
ctgcggcggcgggcgc

SEQ ID NO: 28999 - DNA, 21 bp, Homo sapiens
ctgcggcggcggcgcgggcgg

SEQ ID NO: 29000 - DNA, 23 bp, Homo sapiens
cggcggcggcggcccagctgcgg

SEQ ID NO: 29001 - DNA, 22 bp, Homo sapiens
gcggcggcgagggaggcagcgg

SEQ ID NO: 29002 - DNA, 19 bp, Homo sapiens
gcggcggcgggggccccgg

SEQ ID NO: 29003 - DNA, 19 bp, Homo sapiens
ctgcggcggcggcggggcg

SEQ ID NO: 29004 - DNA, 19 bp, Homo sapiens
gcggcggcgaggggccctg

SEQ ID NO: 29005 - DNA, 18 bp, Homo sapiens
ggcgagcagctactgcgg

SEQ ID NO: 29006 - DNA, 21 bp, Homo sapiens
ctgcgcggcggcggcctgcgg

SEQ ID NO: 29007 - DNA, 22 bp, Homo sapiens
ctgggtggcgggcggcgtgcgg

SEQ ID NO: 29008 - DNA, 16 bp, Homo sapiens
ctgcggcggcggatgc

SEQ ID NO: 29009 - DNA, 20 bp, Homo sapiens
ggtggctgttgctgctgcgg

SEQ ID NO: 29010 - DNA, 22 bp, Homo sapiens
ctgcggccgcgggggcccgtgg

SEQ ID NO: 29011 - DNA, 16 bp, Homo sapiens
cggcggcggggatgtg

SEQ ID NO: 29012 - DNA, 23 bp, Homo sapiens
ctgcggcgggcgggctcctgcgg

SEQ ID NO: 29013 - DNA, 22 bp, Homo sapiens
ggcggcggcggccgggctgcgg

SEQ ID NO: 29014 - DNA, 19 bp, Homo sapiens
ctggggcggcggctgctgc

SEQ ID NO: 29015 - DNA, 22 bp, Homo sapiens
ccgcaccagggggctgctgtgg

SEQ ID NO: 29016 - DNA, 16 bp, Homo sapiens
ggtggcggctgctgcg

SEQ ID NO: 29017 - DNA, 16 bp, Homo sapiens
cgcggcggcgggggcg

SEQ ID NO: 29018 - DNA, 18 bp, Homo sapiens
ctccggcggcgggggtcg

SEQ ID NO: 29019 - DNA, 17 bp, Homo sapiens
gcggtggcgaggcggcg

SEQ ID NO: 29020 - DNA, 17 bp, Homo sapiens
ctgggcggcgggggctg

SEQ ID NO: 29021 - DNA, 24 bp, Homo sapiens
ctggggtggcgggggtgaactagg

SEQ ID NO: 29022 - DNA, 20 bp, Homo sapiens
ctgctgcggcggggggtgtg

SEQ ID NO: 29023 - DNA, 16 bp, Homo sapiens
cggcggcggcggctgc

SEQ ID NO: 29024 - DNA, 21 bp, Homo sapiens
cggcggcggcggcgactgcgg

SEQ ID NO: 29025 - DNA, 16 bp, Homo sapiens
ctgcggcggggggtgc

SEQ ID NO: 29026 - DNA, 24 bp, Homo sapiens
ctgcggcggcgggagcccgggcgg

SEQ ID NO: 29027 - DNA, 23 bp, Homo sapiens
ctgctggcggtggggggagtcgg

SEQ ID NO: 29028 - DNA, 19 bp, Homo sapiens
gcggcggcgaggagcgcgg

SEQ ID NO: 29029 - DNA, 22 bp, Homo sapiens
gcggcggctgctgctgctgcgg

SEQ ID NO: 29030 - DNA, 16 bp, Homo sapiens
ctgctgcggcggctgc

SEQ ID NO: 29031 - DNA, 21 bp, Homo sapiens
ctgcggcggcggcggcggcgg

SEQ ID NO: 29032 - DNA, 21 bp, Homo sapiens
ccgcggcggcgagggcgaacg

SEQ ID NO: 29033 - DNA, 21 bp, Homo sapiens
ctgtggcggcgggtactgtgg

SEQ ID NO: 29034 - DNA, 21 bp, Homo sapiens
ctgcggcgggagggaaggcgg

SEQ ID NO: 29035 - DNA, 17 bp, Homo sapiens
ggggctgggctgctgcg

SEQ ID NO: 29036 - DNA, 21 bp, Homo sapiens
cggcggcggcggcggctgcgg

SEQ ID NO: 29037 - DNA, 17 bp, Homo sapiens
cgcggcggcggggagcg

SEQ ID NO: 29038 - DNA, 21 bp, Homo sapiens
ccgcggcggctgctgctgcgg

SEQ ID NO: 29039 - DNA, 24 bp, Homo sapiens
ctgcggtgccaggagctgctgtgg

SEQ ID NO: 29040 - DNA, 26 bp, Homo sapiens
tgcggcaggtggggtgcttcttgcgg

SEQ ID NO: 29041 - DNA, 19 bp, Homo sapiens
ctgcggcggcggcggagcg

SEQ ID NO: 29042 - DNA, 16 bp, Homo sapiens
ctgtggcggaggctgc

SEQ ID NO: 29043 - DNA, 16 bp, Homo sapiens
ctgcggcggaggctgc

SEQ ID NO: 29044 - DNA, 22 bp, Homo sapiens
ctgcggcggcggcgtgctgcgg

SEQ ID NO: 29045 - DNA, 19 bp, Homo sapiens
ctgtggggcgagggctgtg

SEQ ID NO: 29046 - DNA, 22 bp, Homo sapiens
ctgcggcgcgtgagggcagcgg

SEQ ID NO: 29047 - DNA, 19 bp, Homo sapiens
cgtggcgctgctgctgtgg

SEQ ID NO: 29048 - DNA, 22 bp, Homo sapiens
ctgtgtgcatgggctgctgtgg

SEQ ID NO: 29049 - DNA, 20 bp, Homo sapiens
ctccggcggcggggtcggtg

SEQ ID NO: 29050 - DNA, 71 bp, Human adenovirus C
ccctcttcggcatcaaggaaggtgattggtttataggtgtaggccacgtgaccgggtgttcctgaaggggg

SEQ ID NO: 29051 - DNA, 23 bp, Human adenovirus C
tgaccgggtgttcctgaaggggg

SEQ ID NO: 29052 - DNA, 20 bp, Homo sapiens
tgaccgggtgtcctttctgg

SEQ ID NO: 29053 - DNA, 20 bp, Homo sapiens
tgcctctgttctgaaggggg

SEQ ID NO: 29054 - DNA, 21 bp, Homo sapiens
cgggtgttcctgaagcagggg

SEQ ID NO: 29055 - DNA, 21 bp, Homo sapiens
ccgggtgtggggtgaaggggg

SEQ ID NO: 29056 - DNA, 22 bp, Homo sapiens
tgatgggtgttagggccggggg

SEQ ID NO: 29057 - DNA, 18 bp, Homo sapiens
tgattgggtttcctgggg

SEQ ID NO: 29058 - DNA, 21 bp, Homo sapiens
gagtgtttctcttgaaggggg

SEQ ID NO: 29059 - DNA, 20 bp, Homo sapiens
tgagtgggtgcccaaggggg

SEQ ID NO: 29060 - DNA, 19 bp, Homo sapiens
gaccgggctctgggggggg

SEQ ID NO: 29061 - DNA, 20 bp, Homo sapiens
cgggtgttggtgccaggggg

SEQ ID NO: 29062 - DNA, 19 bp, Homo sapiens
tgccgggtgttcctcaggg

SEQ ID NO: 29063 - DNA, 85 bp, Human adenovirus E
aaggcgggcatgacctcggcactcaggttgtcagtttctagaaacgaggaggatttgatattgacggtgccggcggagatgcctt

SEQ ID NO: 29064 - DNA, 24 bp, Human adenovirus E
gggcatgacctcggcactcaggtt

SEQ ID NO: 29065 - DNA, 19 bp, Homo sapiens
gggcatgaggcatttaggt

SEQ ID NO: 29066 - DNA, 18 bp, Homo sapiens
gggcatgagcttggtggt

SEQ ID NO: 29067 - DNA, 21 bp, Homo sapiens
aggcattctggcactcaggtt

SEQ ID NO: 29068 - DNA, 22 bp, Homo sapiens
aggcatgactcttacttaggtt

SEQ ID NO: 29069 - DNA, 66 bp, Murid herpesvirus 4
taattgaggttcccggcaaatgttggatagataggtaacttctcacatttgcctggaccttttttg

SEQ ID NO: 29070 - DNA, 24 bp, Murid herpesvirus 4
tcacatttgcctggaccttttttg

SEQ ID NO: 29071 - DNA, 18 bp, Homo sapiens
tttgggaaaccttttttg

SEQ ID NO: 29072 - DNA, 24 bp, Homo sapiens
tcacatttctttggagcatttttg

SEQ ID NO: 29073 - DNA, 17 bp, Homo sapiens
atttgccttggtttttg

SEQ ID NO: 29074 - DNA, 18 bp, Homo sapiens
catatttgcctggactct

SEQ ID NO: 29075 - DNA, 16 bp, Homo sapiens
tttgtggccttttttg

SEQ ID NO: 29076 - DNA, 19 bp, Homo sapiens
acatttgcaacactttttt

SEQ ID NO: 29077 - DNA, 22 bp, Homo sapiens
tcacatttgcttggattactct

SEQ ID NO: 29078 - DNA, 21 bp, Homo sapiens
cacatttgggggccttttttg

SEQ ID NO: 29079 - DNA, 26 bp, Homo sapiens
tcacatttgtcttttaagtttttttg

SEQ ID NO: 29080 - DNA, 76 bp, Human adenovirus E
ttgaagtcgatattgtcgcagcccccctgctcccagagctggaagtccgtgcgcttcttgtaggcggggttgggca

SEQ ID NO: 29081 - DNA, 24 bp, Human adenovirus E
tccgtgcgcttcttgtaggcgggg

SEQ ID NO: 29082 - DNA, 20 bp, Homo sapiens
atgtgctccccagggtgggg

SEQ ID NO: 29083 - DNA, 22 bp, Homo sapiens
tctttgtgcttcttgtatttgg

SEQ ID NO: 29084 - DNA, 19 bp, Homo sapiens
gtggcgtttaaaggcgggg

SEQ ID NO: 29085 - DNA, 20 bp, Homo sapiens
tcctgtgcttcttgcgaggg

SEQ ID NO: 29086 - DNA, 17 bp, Homo sapiens
tctgtgtttcttgtagg

SEQ ID NO: 29087 - DNA, 75 bp, Human adenovirus E
taggtggggtagcagcgccccccgcggatgctggcgcgcacgtagtcatacagctcgtgcgagggggcgaggagc

SEQ ID NO: 29088 - DNA, 24 bp, Human adenovirus E
tagcagcgccccccgcggatgctg

SEQ ID NO: 29089 - DNA, 21 bp, Homo sapiens
gcagtgtcctggcagatgctg

SEQ ID NO: 29090 - DNA, 19 bp, Homo sapiens
gcgggccagctggatgctg

SEQ ID NO: 29091 - DNA, 23 bp, Homo sapiens
tagtaagtgccccataaatgctg

SEQ ID NO: 29092 - DNA, 19 bp, Homo sapiens
gcgccgccgctggatgctg

SEQ ID NO: 29093 - DNA, 21 bp, Homo sapiens
tagcagcagcctctcaggctg

SEQ ID NO: 29094 - DNA, 19 bp, Homo sapiens
gcggcgccccccggcactg

SEQ ID NO: 29095 - DNA, 18 bp, Homo sapiens
cagcagcgtctcccgcgg

SEQ ID NO: 29096 - DNA, 19 bp, Homo sapiens
tagcagcgtctccagagcc

SEQ ID NO: 29097 - DNA, 20 bp, Homo sapiens
gcagcaaggcgtggatgctg

SEQ ID NO: 29098 - DNA, 20 bp, Homo sapiens
gcggcgccccctggcggctg

SEQ ID NO: 29099 - DNA, 17 bp, Homo sapiens
cagcagccgcggatgct

SEQ ID NO: 29100 - DNA, 18 bp, Homo sapiens
tagcagttcctggatgct

SEQ ID NO: 29101 - DNA, 21 bp, Homo sapiens
tagcagatgcttcccgggctg

SEQ ID NO: 29102 - DNA, 17 bp, Homo sapiens
gcagcacctcccaagct

SEQ ID NO: 29103 - DNA, 18 bp, Homo sapiens
gcagcgccctctggcact

SEQ ID NO: 29104 - DNA, 20 bp, Homo sapiens
gcctgtccctgcggatgctg

SEQ ID NO: 29105 - DNA, 19 bp, Homo sapiens
tagcagtgccccccggtag

SEQ ID NO: 29106 - DNA, 22 bp, Homo sapiens
caggatcccctcgcggatgctg

SEQ ID NO: 29107 - DNA, 19 bp, Homo sapiens
cagcagcgcttgcgagatg

SEQ ID NO: 29108 - DNA, 130 bp, Murid herpesvirus 4
cgtgagagtctgtaacaccgcttcacccagaagagactggctaaggaagcagcttgagaggggaagtgcctaaacccttcccgaaagctgaaagtctcttctgctagtcaagcgtggtgcagacctcatg

SEQ ID NO: 29109 - DNA, 24 bp, Murid herpesvirus 4
cgaaagctgaaagtctcttctgct

SEQ ID NO: 29110 - DNA, 21 bp, Homo sapiens
agctgaacaaagtcttctgct

SEQ ID NO: 29111 - DNA, 18 bp, Homo sapiens
gctgaaagtctctctgct

SEQ ID NO: 29112 - DNA, 20 bp, Homo sapiens
gaaagctgggagtcctcctg

SEQ ID NO: 29113 - DNA, 15 bp, Homo sapiens
aaactgaagttctgc

SEQ ID NO: 29114 - DNA, 20 bp, Homo sapiens
gaaggctggagtcctctgct

SEQ ID NO: 29115 - DNA, 21 bp, Homo sapiens
gaaagtgaatatccttttgct

SEQ ID NO: 29116 - DNA, 23 bp, Homo sapiens
gaaagcagaaacgaggctctgct

SEQ ID NO: 29117 - DNA, 17 bp, Homo sapiens
gaaagtgtctcttctgc

SEQ ID NO: 29118 - DNA, 17 bp, Homo sapiens
cggcagcctctcttctg

SEQ ID NO: 29119 - DNA, 19 bp, Homo sapiens
gctgggggtgtcctctgct

SEQ ID NO: 29120 - DNA, 19 bp, Homo sapiens
agccgctgtttcttctgct

SEQ ID NO: 29121 - DNA, 17 bp, Homo sapiens
gaacagctgttcttctg

SEQ ID NO: 29122 - DNA, 17 bp, Homo sapiens
gaaagctgtaagtctgc

SEQ ID NO: 29123 - DNA, 21 bp, Homo sapiens
cgagggctgcaaatctctgct

SEQ ID NO: 29124 - DNA, 17 bp, Homo sapiens
gagagctgaaaatttgc

SEQ ID NO: 29125 - DNA, 20 bp, Homo sapiens
gacagctgaaagcaaacctg

SEQ ID NO: 29126 - DNA, 21 bp, Homo sapiens
cgtgagctggaaggggctgct

SEQ ID NO: 29127 - DNA, 21 bp, Homo sapiens
gaaagctggagtgggtctgct

SEQ ID NO: 29128 - DNA, 25 bp, Homo sapiens
cgaaagctggaatcttgtatctgct

SEQ ID NO: 29129 - DNA, 18 bp, Homo sapiens
agctggaagtctccagct

SEQ ID NO: 29130 - DNA, 20 bp, Homo sapiens
gaaagctggaagtcatagct

SEQ ID NO: 29131 - DNA, 21 bp, Homo sapiens
aaagctgaaggtttctgtgct

SEQ ID NO: 29132 - DNA, 18 bp, Homo sapiens
aagctaaagttcaccctg

SEQ ID NO: 29133 - DNA, 18 bp, Homo sapiens
gaaactgaaagtcgccgc

SEQ ID NO: 29134 - DNA, 21 bp, Homo sapiens
gaagctgaaggtgaggctgct

SEQ ID NO: 29135 - DNA, 17 bp, Homo sapiens
cggaagcgaaagtctct

SEQ ID NO: 29136 - DNA, 21 bp, Homo sapiens
gagactggaggttcctctgct

SEQ ID NO: 29137 - DNA, 21 bp, Homo sapiens
gagagctgaaagaccactgct

SEQ ID NO: 29138 - DNA, 17 bp, Homo sapiens
gctgtaattcttctgct

SEQ ID NO: 29139 - DNA, 22 bp, Homo sapiens
cggaagctaaaaggaaactgct

SEQ ID NO: 29140 - DNA, 21 bp, Homo sapiens
gaaggctgaaaaacatttgct

SEQ ID NO: 29141 - DNA, 19 bp, Homo sapiens
cgaaacttgaggcctctgc

SEQ ID NO: 29142 - DNA, 19 bp, Homo sapiens
cgagggctggcagtctccc

SEQ ID NO: 29143 - DNA, 21 bp, Homo sapiens
gaaagatgaggtcaatctgct

SEQ ID NO: 29144 - DNA, 20 bp, Homo sapiens
gaaagcagaaagtctcttct

SEQ ID NO: 29145 - DNA, 20 bp, Homo sapiens
gaaagctgaaaatctcccct

SEQ ID NO: 29146 - DNA, 18 bp, Homo sapiens
cgaaggctgaaagctcct

SEQ ID NO: 29147 - DNA, 20 bp, Homo sapiens
gagagcagaattcttctgct

SEQ ID NO: 29148 - DNA, 22 bp, Homo sapiens
gagagctacgcaatcttctgct

SEQ ID NO: 29149 - DNA, 25 bp, Homo sapiens
cggagctggaagtccctggcctgct

SEQ ID NO: 29150 - DNA, 20 bp, Homo sapiens
aagccgagagtctcttcacc

SEQ ID NO: 29151 - DNA, 93 bp, Yaba-like disease virus
ggtttttttatcccttggaattatgttaaaaataggtgttttttctttaaacataagagaatttataatatcagataaagggattaaaaaatc

SEQ ID NO: 29152 - DNA, 24 bp, Yaba-like disease virus
tatgttaaaaataggtgttttttc

SEQ ID NO: 29153 - DNA, 17 bp, Homo sapiens
tatgttaaagatgtttc

SEQ ID NO: 29154 - DNA, 21 bp, Homo sapiens
tgttttgaaaatagatgtttc

SEQ ID NO: 29155 - DNA, 19 bp, Homo sapiens
tgttaaaaatgggtgtttt

SEQ ID NO: 29156 - DNA, 23 bp, Homo sapiens
tatttaaaatagtagtgtttttt

SEQ ID NO: 29157 - DNA, 24 bp, Homo sapiens
tatgtatagatatacgtgtttttt

SEQ ID NO: 29158 - DNA, 18 bp, Homo sapiens
tatgttaaagatgctttt

SEQ ID NO: 29159 - DNA, 23 bp, Homo sapiens
tatgcttggaaatagggcgtttc

SEQ ID NO: 29160 - DNA, 22 bp, Homo sapiens
catgttaaaaatatgctttttc

SEQ ID NO: 29161 - DNA, 18 bp, Homo sapiens
atgttaaaagtgcctttt

SEQ ID NO: 29162 - DNA, 22 bp, Homo sapiens
atgttaaaaatatttatttttt

SEQ ID NO: 29163 - DNA, 61 bp, Yaba-like disease virus
gcacttatttcatgaatttcatttttagaactcattaaaatagtatttgaaaaataagtgt

SEQ ID NO: 29164 - DNA, 24 bp, Yaba-like disease virus
ttcatgaatttcatttttagaact

SEQ ID NO: 29165 - DNA, 21 bp, Homo sapiens
ttcaagaatttcatcaaaact

SEQ ID NO: 29166 - DNA, 24 bp, Homo sapiens
ttcatgaatattcattcctacact

SEQ ID NO: 29167 - DNA, 21 bp, Homo sapiens
ttcatgaatttccatttttag

SEQ ID NO: 29168 - DNA, 19 bp, Homo sapiens
atgaatttcataaaggact

SEQ ID NO: 29169 - DNA, 17 bp, Homo sapiens
ttctgaatttcattttc

SEQ ID NO: 29170 - DNA, 18 bp, Homo sapiens
ttcatgaaattcattttt

SEQ ID NO: 29171 - DNA, 18 bp, Homo sapiens
ttcatgaatttacatttt

SEQ ID NO: 29172 - DNA, 19 bp, Homo sapiens
ttcatgtatttcatcaaag

SEQ ID NO: 29173 - DNA, 22 bp, Homo sapiens
tgaatttcatttctctttagaa

SEQ ID NO: 29174 - DNA, 24 bp, Homo sapiens
ttcatgaatttcctaggtttagaa

SEQ ID NO: 29175 - DNA, 76 bp, Gallid herpesvirus 2
gcccacagatcgcaccttcaaccgataagagtctctagatgacaaatcgacagttagttggaaagtgttcgggggc

SEQ ID NO: 29176 - DNA, 18 bp, Gallid herpesvirus 2
tggaaagtgttcgggggc

SEQ ID NO: 29177 - DNA, 18 bp, Homo sapiens
cggagggcagctgggggc

SEQ ID NO: 29178 - DNA, 16 bp, Homo sapiens
tggaagccccaggggc

SEQ ID NO: 29179 - DNA, 15 bp, Homo sapiens
tggaagctcaggggc

SEQ ID NO: 29180 - DNA, 17 bp, Homo sapiens
tgggtgccccagggggc

SEQ ID NO: 29181 - DNA, 17 bp, Homo sapiens
tagaaggacccaggggc

SEQ ID NO: 29182 - DNA, 17 bp, Homo sapiens
tggaaaatgaaaaaggc

SEQ ID NO: 29183 - DNA, 17 bp, Homo sapiens
tggtgagtgtcgagggc

SEQ ID NO: 29184 - DNA, 18 bp, Homo sapiens
tggggtgcccgatggggc

SEQ ID NO: 29185 - DNA, 16 bp, Homo sapiens
cggaagtcccaagggc

SEQ ID NO: 29186 - DNA, 19 bp, Homo sapiens
cggagagtgatcccggggg

SEQ ID NO: 29187 - DNA, 19 bp, Homo sapiens
tggagattgttcaaagggc

SEQ ID NO: 29188 - DNA, 16 bp, Homo sapiens
tggagaggccaaaggc

SEQ ID NO: 29189 - DNA, 16 bp, Homo sapiens
tggaaaggccaggggc

SEQ ID NO: 29190 - DNA, 19 bp, Homo sapiens
tggaaagtggtaactcggg

SEQ ID NO: 29191 - DNA, 15 bp, Homo sapiens
tggaaaatgagaggc

SEQ ID NO: 29192 - DNA, 17 bp, Homo sapiens
tggaaggctccaagggc

SEQ ID NO: 29193 - DNA, 20 bp, Homo sapiens
tggaaaggtccagaaggggc

SEQ ID NO: 29194 - DNA, 22 bp, Homo sapiens
tggaaagtttgtcctcgggggc

SEQ ID NO: 29195 - DNA, 16 bp, Homo sapiens
cgggagccccaggggc

SEQ ID NO: 29196 - DNA, 15 bp, Homo sapiens
tggaaggccgggggc

SEQ ID NO: 29197 - DNA, 17 bp, Homo sapiens
tggaaggcgcggcgggc

SEQ ID NO: 29198 - DNA, 16 bp, Homo sapiens
tggaaagtttctaagc

SEQ ID NO: 29199 - DNA, 16 bp, Homo sapiens
cggaagtgttagaggc

SEQ ID NO: 29200 - DNA, 16 bp, Homo sapiens
tgggagtcccgagggc

SEQ ID NO: 29201 - DNA, 18 bp, Homo sapiens
ggaaagtcatcgaggggc

SEQ ID NO: 29202 - DNA, 16 bp, Homo sapiens
tgggaaggtcgagggc

SEQ ID NO: 29203 - DNA, 19 bp, Homo sapiens
tgaaaagtggacgctgggc

SEQ ID NO: 29204 - DNA, 17 bp, Homo sapiens
tgggaaatgtcaagggc

SEQ ID NO: 29205 - DNA, 17 bp, Homo sapiens
tggaaaactgagggggc

SEQ ID NO: 29206 - DNA, 17 bp, Homo sapiens
tggaaatgtcctcaggc

SEQ ID NO: 29207 - DNA, 17 bp, Homo sapiens
tggaggcccgaaggggc

SEQ ID NO: 29208 - DNA, 22 bp, Homo sapiens
tggaaagtggtggaggcggggg

SEQ ID NO: 29209 - DNA, 18 bp, Homo sapiens
tggagatgtgccaggggc

SEQ ID NO: 29210 - DNA, 17 bp, Homo sapiens
tggaaagtttcggtggc

SEQ ID NO: 29211 - DNA, 18 bp, Homo sapiens
tggagatgtcccgagggc

SEQ ID NO: 29212 - DNA, 17 bp, Homo sapiens
tggaaagttcaaagggc

SEQ ID NO: 29213 - DNA, 18 bp, Homo sapiens
tggaaggagtggagaggc

SEQ ID NO: 29214 - DNA, 20 bp, Homo sapiens
tggaaagtggtgtaaggggc

SEQ ID NO: 29215 - DNA, 17 bp, Homo sapiens
tggaagttccaaagggc

SEQ ID NO: 29216 - DNA, 18 bp, Homo sapiens
tggaagctcgaaaggggc

SEQ ID NO: 29217 - DNA, 18 bp, Homo sapiens
ggagcaggcgtcgggggc

SEQ ID NO: 29218 - DNA, 18 bp, Homo sapiens
tgaaaagtgttccagggc

SEQ ID NO: 29219 - DNA, 16 bp, Homo sapiens
tggaaagttcatgggc

SEQ ID NO: 29220 - DNA, 18 bp, Homo sapiens
tggaaaatggcaaggggc

SEQ ID NO: 29221 - DNA, 17 bp, Homo sapiens
tgggagtgatcaggggc

SEQ ID NO: 29222 - DNA, 17 bp, Homo sapiens
tggagggtttcgagggc

SEQ ID NO: 29223 - DNA, 16 bp, Homo sapiens
tggaagggccaggggc

SEQ ID NO: 29224 - DNA, 15 bp, Homo sapiens
tggaaagtgagaggc

SEQ ID NO: 29225 - DNA, 17 bp, Homo sapiens
tgggatgtccaaagggc

SEQ ID NO: 29226 - DNA, 17 bp, Homo sapiens
tggagggtgccaagggc

SEQ ID NO: 29227 - DNA, 20 bp, Homo sapiens
tggagagattcagaaggggc

SEQ ID NO: 29228 - DNA, 16 bp, Homo sapiens
cgggtgtctcgggggc

SEQ ID NO: 29229 - DNA, 18 bp, Homo sapiens
tggggagtgctcgacagc

SEQ ID NO: 29230 - DNA, 15 bp, Homo sapiens
tggaagtccgggggc

SEQ ID NO: 29231 - DNA, 18 bp, Homo sapiens
tgggtgcccaaggggggc

SEQ ID NO: 29232 - DNA, 17 bp, Homo sapiens
tggaaagtgggggaggc

SEQ ID NO: 29233 - DNA, 15 bp, Homo sapiens
tgaaaagtggggggc

SEQ ID NO: 29234 - DNA, 20 bp, Homo sapiens
ggggagctgggctcgggggc

SEQ ID NO: 29235 - DNA, 16 bp, Homo sapiens
tgggtgtgccgggggc

SEQ ID NO: 29236 - DNA, 17 bp, Homo sapiens
tggggaattccaagggc

SEQ ID NO: 29237 - DNA, 16 bp, Homo sapiens
tgggtgcccagggggc

SEQ ID NO: 29238 - DNA, 18 bp, Homo sapiens
ggagagtgttcacagggc

SEQ ID NO: 29239 - DNA, 16 bp, Homo sapiens
tggaagcccgaggggc

SEQ ID NO: 29240 - DNA, 16 bp, Homo sapiens
tgggaggcccaggggc

SEQ ID NO: 29241 - DNA, 20 bp, Homo sapiens
tgtaaagtgctgggaggggg

SEQ ID NO: 29242 - DNA, 17 bp, Homo sapiens
tggaaggtccctggggc

SEQ ID NO: 29243 - DNA, 16 bp, Homo sapiens
cggggcgtccgggggc

SEQ ID NO: 29244 - DNA, 18 bp, Homo sapiens
gaaagtgtcctttggggg

SEQ ID NO: 29245 - DNA, 19 bp, Homo sapiens
ggaaagtgttcggcagggc

SEQ ID NO: 29246 - DNA, 18 bp, Homo sapiens
tggaatgttcagccgggc

SEQ ID NO: 29247 - DNA, 17 bp, Homo sapiens
tggagcgttcacagggc

SEQ ID NO: 29248 - DNA, 17 bp, Homo sapiens
tggcaagtgccgggggc

SEQ ID NO: 29249 - DNA, 15 bp, Homo sapiens
tgggcgctcgggggc

SEQ ID NO: 29250 - DNA, 18 bp, Homo sapiens
tgggagttcccgaggggc

SEQ ID NO: 29251 - DNA, 16 bp, Homo sapiens
tggaaagtaagggggc

SEQ ID NO: 29252 - DNA, 19 bp, Homo sapiens
tggcaggtcccaggggggc

SEQ ID NO: 29253 - DNA, 16 bp, Homo sapiens
tgaaaagtgcagtggc

SEQ ID NO: 29254 - DNA, 17 bp, Homo sapiens
tggggagctccaggggc

SEQ ID NO: 29255 - DNA, 18 bp, Homo sapiens
tggaagagctcaaggggg

SEQ ID NO: 29256 - DNA, 18 bp, Homo sapiens
tggaaatgtttggtaggc

SEQ ID NO: 29257 - DNA, 15 bp, Homo sapiens
tggaaagcaaggggc

SEQ ID NO: 29258 - DNA, 17 bp, Homo sapiens
tggaaagcggcaaaggc

SEQ ID NO: 29259 - DNA, 18 bp, Homo sapiens
ggaaagtggcagaagggc

SEQ ID NO: 29260 - DNA, 17 bp, Homo sapiens
tgggatgtcccgggggc

SEQ ID NO: 29261 - DNA, 16 bp, Homo sapiens
tgggagtctcaggggc

SEQ ID NO: 29262 - DNA, 15 bp, Homo sapiens
tagaaagcagggggc

SEQ ID NO: 29263 - DNA, 17 bp, Homo sapiens
tgggagtgtccgagggc

SEQ ID NO: 29264 - DNA, 17 bp, Homo sapiens
tggcgaggctcgggggc

SEQ ID NO: 29265 - DNA, 16 bp, Homo sapiens
tggaaagtggaagggc

SEQ ID NO: 29266 - DNA, 18 bp, Homo sapiens
tgcaaagtgctggagggc

SEQ ID NO: 29267 - DNA, 18 bp, Homo sapiens
tggaaaatgcctatgggc

SEQ ID NO: 29268 - DNA, 19 bp, Homo sapiens
tagaaacgctcccgggggc

SEQ ID NO: 29269 - DNA, 15 bp, Homo sapiens
tggaaagcagggggc

SEQ ID NO: 29270 - DNA, 16 bp, Homo sapiens
tggaggccccgggggc

SEQ ID NO: 29271 - DNA, 15 bp, Homo sapiens
tggaaggccaggggc

SEQ ID NO: 29272 - DNA, 18 bp, Homo sapiens
ggaagcggtgccgggggc

SEQ ID NO: 29273 - DNA, 19 bp, Homo sapiens
tgcaaagtgtccacagggc

SEQ ID NO: 29274 - DNA, 15 bp, Homo sapiens
tgggcgtccgggggc

SEQ ID NO: 29275 - DNA, 18 bp, Homo sapiens
tgaaaagtacaaaggggc

SEQ ID NO: 29276 - DNA, 19 bp, Homo sapiens
tgtgaagtgccctgggggc

SEQ ID NO: 29277 - DNA, 20 bp, Homo sapiens
tggaaagctgccagtggggc

SEQ ID NO: 29278 - DNA, 17 bp, Homo sapiens
tgggtggtctcaggggc

SEQ ID NO: 29279 - DNA, 18 bp, Homo sapiens
tgaaaagtgtaaaagggg

SEQ ID NO: 29280 - DNA, 17 bp, Homo sapiens
tggaatgtccaaggggc

SEQ ID NO: 29281 - DNA, 18 bp, Homo sapiens
tgtgaaggtccgaggggc

SEQ ID NO: 29282 - DNA, 19 bp, Homo sapiens
tgggtggttcaagaggggc

SEQ ID NO: 29283 - DNA, 17 bp, Homo sapiens
tggaaggttccaaaggc

SEQ ID NO: 29284 - DNA, 18 bp, Homo sapiens
tggaaaatggcgaggggc

SEQ ID NO: 29285 - DNA, 61 bp, Gallid herpesvirus 2
tcattgagtttagtggcaaacgacaaacagacaaaaattgtagatgccgccagctagttga

SEQ ID NO: 29286 - DNA, 21 bp, Gallid herpesvirus 2
tagatgccgccagctagttga

SEQ ID NO: 29287 - DNA, 19 bp, Homo sapiens
tagatgccatcattcttga

SEQ ID NO: 29288 - DNA, 20 bp, Homo sapiens
tagatgcccttaagccctga

SEQ ID NO: 29289 - DNA, 16 bp, Homo sapiens
taaatggagctagttg

SEQ ID NO: 29290 - DNA, 20 bp, Homo sapiens
gatgccgctgtacctcttga

SEQ ID NO: 29291 - DNA, 18 bp, Homo sapiens
tagataccagctgtgttg

SEQ ID NO: 29292 - DNA, 18 bp, Homo sapiens
tagatgccgtcaggctag

SEQ ID NO: 29293 - DNA, 17 bp, Homo sapiens
gatcagaagctagttga

SEQ ID NO: 29294 - DNA, 18 bp, Homo sapiens
tagatgccaggccggttg

SEQ ID NO: 29295 - DNA, 19 bp, Homo sapiens
gatgccaaactctagttga

SEQ ID NO: 29296 - DNA, 18 bp, Homo sapiens
agatgtttcagctagttg

SEQ ID NO: 29297 - DNA, 21 bp, Homo sapiens
tagatacaggccagttggttg

SEQ ID NO: 29298 - DNA, 15 bp, Homo sapiens
tagatgccgcagttg

SEQ ID NO: 29299 - DNA, 20 bp, Homo sapiens
tagatgcaacatgctagttg

SEQ ID NO: 29300 - DNA, 25 bp, Homo sapiens
cagatgccgctgtggtcaactagct

SEQ ID NO: 29301 - DNA, 16 bp, Homo sapiens
tagatgcctgctagtc

SEQ ID NO: 29302 - DNA, 19 bp, Homo sapiens
tagatgccaccacggctga

SEQ ID NO: 29303 - DNA, 25 bp, Homo sapiens
cagatgccgctttggtcaactagct

SEQ ID NO: 29304 - DNA, 19 bp, Homo sapiens
agatgccgccaggtatgtg

SEQ ID NO: 29305 - DNA, 93 bp, Gallid herpesvirus 2
gtcggggcactttttccttccctcgggggttacaactaaattcgtcagtacgatacagtgaactccggggggaaggagaaaaaccgctccggc

SEQ ID NO: 29306 - DNA, 24 bp, Gallid herpesvirus 2
gggggttacaactaaattcgtcag

SEQ ID NO: 29307 - DNA, 17 bp, Homo sapiens
ggggttacagctgttca

SEQ ID NO: 29308 - DNA, 20 bp, Homo sapiens
gggggtctgcagctggtcca

SEQ ID NO: 29309 - DNA, 19 bp, Homo sapiens
gggggttataataaaattc

SEQ ID NO: 29310 - DNA, 79 bp, Ectromelia virus
atgtcgtttaaatatctgatgttgttcgctgctatgataatcggatcattcgccgataacgttaccgtcgaaacggcat

SEQ ID NO: 29311 - DNA, 24 bp, Ectromelia virus
tctgatgttgttcgctgctatgat

SEQ ID NO: 29312 - DNA, 19 bp, Homo sapiens
tctatgttgttcctcatga

SEQ ID NO: 29313 - DNA, 23 bp, Homo sapiens
tcttatgttgtttcagttatgat

SEQ ID NO: 29314 - DNA, 20 bp, Homo sapiens
tgatgctgcagtgagctatg

SEQ ID NO: 29315 - DNA, 16 bp, Homo sapiens
gatgtgtttgctatga

SEQ ID NO: 29316 - DNA, 22 bp, Homo sapiens
tctgatatcccactgctgtgat

SEQ ID NO: 29317 - DNA, 19 bp, Homo sapiens
tgatgccgaagttgctatg

SEQ ID NO: 29318 - DNA, 17 bp, Homo sapiens
tggtgctgttctcatga

SEQ ID NO: 29319 - DNA, 22 bp, Homo sapiens
tgaggttgcagtgagctatgat

SEQ ID NO: 29320 - DNA, 18 bp, Homo sapiens
tgatgttgttcctcctgc

SEQ ID NO: 29321 - DNA, 21 bp, Homo sapiens
tctgatgttgtttgcttccat

SEQ ID NO: 29322 - DNA, 60 bp, Ectromelia virus
tttttatgagtatttttacaaaaatgcataaagtgtatgtcgtatgtatatttataaaaa

SEQ ID NO: 29323 - DNA, 24 bp, Ectromelia virus
tgagtatttttacaaaaatgcata

SEQ ID NO: 29324 - DNA, 18 bp, Homo sapiens
tgagtatttttatacaaa

SEQ ID NO: 29325 - DNA, 18 bp, Homo sapiens
tgggtatctttacaacac

SEQ ID NO: 29326 - DNA, 22 bp, Homo sapiens
tgagtattacagaagatgcata

SEQ ID NO: 29327 - DNA, 24 bp, Homo sapiens
tgagtattttcaacgtggtgcata

SEQ ID NO: 29328 - DNA, 22 bp, Homo sapiens
tgagtaatgaaggaaaatgcat

SEQ ID NO: 29329 - DNA, 21 bp, Homo sapiens
tgagtatatttacaatacata

SEQ ID NO: 29330 - DNA, 20 bp, Homo sapiens
tgagcatttttacaaaaata

SEQ ID NO: 29331 - DNA, 17 bp, Homo sapiens
tgagtatttatatgcac

SEQ ID NO: 29332 - DNA, 22 bp, Homo sapiens
tgagcattttacataatgcata

SEQ ID NO: 29333 - DNA, 19 bp, Homo sapiens
taagtatttttacaccctg

SEQ ID NO: 29334 - DNA, 21 bp, Homo sapiens
tggataaaacaaaaatgcata

SEQ ID NO: 29335 - DNA, 22 bp, Homo sapiens
gagtatttctgttaaatgcata

SEQ ID NO: 29336 - DNA, 131 bp, Human herpesvirus 6
agatatatactttcaagtgtttggtgtgacattcaaagtctaatggttgaaaatgtttttcataaatggtagctattatgtgaatgttaagcaaaaacagattaaatatacctgaaagaaaaatattttgt

SEQ ID NO: 29337 - DNA, 24 bp, Human herpesvirus 6
tattatgtgaatgttaagcaaaaa

SEQ ID NO: 29338 - DNA, 20 bp, Homo sapiens
tattatgtaattaacaagca

SEQ ID NO: 29339 - DNA, 18 bp, Homo sapiens
tattgtgtcaatgttaag

SEQ ID NO: 29340 - DNA, 20 bp, Homo sapiens
tgtgtgttgaaaagcaaaaa

SEQ ID NO: 29341 - DNA, 18 bp, Homo sapiens
tattatttgaattaagca

SEQ ID NO: 29342 - DNA, 21 bp, Homo sapiens
tatttgtaaaataagcaaaaa

SEQ ID NO: 29343 - DNA, 24 bp, Homo sapiens
tattctaaaactgttaagcaaaaa

SEQ ID NO: 29344 - DNA, 21 bp, Homo sapiens
tattatgtagatggcaatgca

SEQ ID NO: 29345 - DNA, 19 bp, Homo sapiens
tattgatgtgaaagcaaaa

SEQ ID NO: 29346 - DNA, 18 bp, Homo sapiens
cattatgtgacagcaaaa

SEQ ID NO: 29347 - DNA, 17 bp, Homo sapiens
tattattgaatgttaaa

SEQ ID NO: 29348 - DNA, 25 bp, Homo sapiens
cattacatggggtgttaggcaaaaa

SEQ ID NO: 29349 - DNA, 21 bp, Homo sapiens
tactatgtgatgtggcaaaaa

SEQ ID NO: 29350 - DNA, 19 bp, Homo sapiens
tattatgtaggatgccaaa

SEQ ID NO: 29351 - DNA, 20 bp, Homo sapiens
ttatgtgagttttatcgcaa

SEQ ID NO: 29352 - DNA, 18 bp, Homo sapiens
attatgttttaagcaaaa

SEQ ID NO: 29353 - DNA, 20 bp, Homo sapiens
tatgtgtgtgtctgagcaaa

SEQ ID NO: 29354 - DNA, 24 bp, Homo sapiens
tactatgtggattatatcagcaaa

SEQ ID NO: 29355 - DNA, 21 bp, Homo sapiens
tattatgtgataaaggcaaaa

SEQ ID NO: 29356 - DNA, 19 bp, Homo sapiens
tatgtgatcttgagcaaaa

SEQ ID NO: 29357 - DNA, 106 bp, Human herpesvirus 6
ctggtttagtttggggaagtgaaagtaaaaatctgaatacttgacatctgtataaggtttttcaagaatacaattgtttatagtatcacgtctctaagaaagctgg

SEQ ID NO: 29358 - DNA, 23 bp, Human herpesvirus 6
tatcacgtctctaagaaagctgg

SEQ ID NO: 29359 - DNA, 20 bp, Homo sapiens
tatcacatttccacggctgg

SEQ ID NO: 29360 - DNA, 24 bp, Homo sapiens
tatcacctttttaaaaactgctgg

SEQ ID NO: 29361 - DNA, 22 bp, Homo sapiens
tcctgtctctaagcatctctgg

SEQ ID NO: 29362 - DNA, 19 bp, Homo sapiens
cgctaaccaggaaagctgg

SEQ ID NO: 29363 - DNA, 20 bp, Homo sapiens
tatcgcgtctccaaggtctg

SEQ ID NO: 29364 - DNA, 19 bp, Homo sapiens
taccacgtctctaaggcca

SEQ ID NO: 29365 - DNA, 23 bp, Homo sapiens
tcagcgttctctaagggagctgg

SEQ ID NO: 29366 - DNA, 23 bp, Homo sapiens
tcacgtctccccaggagggctgg

SEQ ID NO: 29367 - DNA, 103 bp, Human herpesvirus 6
tttagtttggggaagtgaaagtaaaaatctgaatacttgacatctgtataaggtttttcaagaatacaattgtttatagtatcacgtctctaagaaagctgga

SEQ ID NO: 29368 - DNA, 24 bp, Human herpesvirus 6
tatcacgtctctaagaaagctgga

SEQ ID NO: 29369 - DNA, 17 bp, Homo sapiens
tcaggtgagaaagctgg

SEQ ID NO: 29370 - DNA, 22 bp, Homo sapiens
atctgacatgagggaagctgga

SEQ ID NO: 29371 - DNA, 20 bp, Homo sapiens
cgctaaccaggaaagctgga

SEQ ID NO: 29372 - DNA, 19 bp, Homo sapiens
ccacgttggggaagctgga

SEQ ID NO: 29373 - DNA, 24 bp, Homo sapiens
tatcttgtctctaagagctccaga

SEQ ID NO: 29374 - DNA, 66 bp, Ectromelia virus
tctaatggtagttttgataggagattgtcatcagttgatacattgtttattatctcatctattaga

SEQ ID NO: 29375 - DNA, 24 bp, Ectromelia virus
tacattgtttattatctcatctat

SEQ ID NO: 29376 - DNA, 19 bp, Homo sapiens
tgttagctttctcatctat

SEQ ID NO: 29377 - DNA, 17 bp, Homo sapiens
cacattgctggtctcat

SEQ ID NO: 29378 - DNA, 23 bp, Homo sapiens
tacatttttaaaatgtcatctat

SEQ ID NO: 29379 - DNA, 22 bp, Homo sapiens
tacattgtttatatttttctat

SEQ ID NO: 29380 - DNA, 22 bp, Homo sapiens
tgattgtttcacgatcatctat

SEQ ID NO: 29381 - DNA, 20 bp, Homo sapiens
acgttgtcagtctcatctat

SEQ ID NO: 29382 - DNA, 22 bp, Homo sapiens
tacattatttattattagtcat

SEQ ID NO: 29383 - DNA, 18 bp, Homo sapiens
acaccaattatctcatct

SEQ ID NO: 29384 - DNA, 21 bp, Homo sapiens
tgtgtactgtgtctcatctat

SEQ ID NO: 29385 - DNA, 18 bp, Homo sapiens
tacatagtttattatttc

SEQ ID NO: 29386 - DNA, 19 bp, Homo sapiens
acattgttcaccttcatct

SEQ ID NO: 29387 - DNA, 83 bp, Gallid herpesvirus 2
actgtcatgaaccgtatgcgatcacattgacacggtttaaaatacatacgtgtgtatcgtggtcgtctactgtttgtggtggt

SEQ ID NO: 29388 - DNA, 24 bp, Gallid herpesvirus 2
tgtcatgaaccgtatgcgatcaca

SEQ ID NO: 29389 - DNA, 19 bp, Homo sapiens
tgtcatgagcgtttctcac

SEQ ID NO: 29390 - DNA, 17 bp, Homo sapiens
tgtcatgaattgagacc

SEQ ID NO: 29391 - DNA, 19 bp, Homo sapiens
tgttatataaatgcgatca

SEQ ID NO: 29392 - DNA, 18 bp, Homo sapiens
tgttatgaaccatgcaac

SEQ ID NO: 29393 - DNA, 17 bp, Homo sapiens
tgtcatgaccgtgtgcg

SEQ ID NO: 29394 - DNA, 18 bp, Homo sapiens
tgtcatgagcctggtata

SEQ ID NO: 29395 - DNA, 63 bp, Gallid herpesvirus 2
gatcaaggccctccgtataatgtaaatgttccaaaggtttgcataatacggagggttctgatc

SEQ ID NO: 29396 - DNA, 20 bp, Gallid herpesvirus 2
taatacggagggttctgatc

SEQ ID NO: 29397 - DNA, 15 bp, Homo sapiens
atacagagtctgatc

SEQ ID NO: 29398 - DNA, 18 bp, Homo sapiens
taatacggagtagcagat

SEQ ID NO: 29399 - DNA, 21 bp, Homo sapiens
atacagaggttccagttgatc

SEQ ID NO: 29400 - DNA, 20 bp, Homo sapiens
taatacagagatgccttgat

SEQ ID NO: 29401 - DNA, 18 bp, Homo sapiens
taatgcagggggccactg

SEQ ID NO: 29402 - DNA, 19 bp, Homo sapiens
taacatggccattctgatc

SEQ ID NO: 29403 - DNA, 73 bp, Gallid herpesvirus 2
ttttctccttccccccggagttcactgtatcgtactgacgaatttagttgtaacccccgagggaaggaaaaag

SEQ ID NO: 29404 - DNA, 24 bp, Gallid herpesvirus 2
ccccggagttcactgtatcgtact

SEQ ID NO: 29405 - DNA, 20 bp, Homo sapiens
ccgcggagttcgctgtcggc

SEQ ID NO: 29406 - DNA, 19 bp, Homo sapiens
cccatttcactgtatcgta

SEQ ID NO: 29407 - DNA, 20 bp, Homo sapiens
ccccggagttccccaggtat

SEQ ID NO: 29408 - DNA, 23 bp, Homo sapiens
ccccggagtccactgtggatact

SEQ ID NO: 29409 - DNA, 20 bp, Homo sapiens
ggattcactgtttctgtgct

SEQ ID NO: 29410 - DNA, 20 bp, Homo sapiens
ggtggttcattgaccacact

SEQ ID NO: 29411 - DNA, 22 bp, Homo sapiens
cccggagtccgacagccgtgct

SEQ ID NO: 29412 - DNA, 89 bp, Paramecium bursaria Chlorella virus 1
ggttttacttcttttagagattctttattagttatttcccagttatcaattataacgtcgtaatctctagtagtatactctataaaacc

SEQ ID NO: 29413 - DNA, 24 bp, Paramecium bursaria Chlorella virus 1
tctttattagttatttcccagtta

SEQ ID NO: 29414 - DNA, 19 bp, Homo sapiens
tctttttagtcatccagtt

SEQ ID NO: 29415 - DNA, 16 bp, Homo sapiens
tctttattagtgcagt

SEQ ID NO: 29416 - DNA, 21 bp, Homo sapiens
ttatatagttattttccagtt

SEQ ID NO: 29417 - DNA, 24 bp, Homo sapiens
tcttcatttccgtcttcccagtta

SEQ ID NO: 29418 - DNA, 19 bp, Homo sapiens
tccttattgagtcccagtt

SEQ ID NO: 29419 - DNA, 21 bp, Homo sapiens
tctttatcggtatcttcagtt

SEQ ID NO: 29420 - DNA, 26 bp, Homo sapiens
tctttattagtttttcagcacagtta

SEQ ID NO: 29421 - DNA, 22 bp, Homo sapiens
tctatattttatttcccagtta

SEQ ID NO: 29422 - DNA, 19 bp, Homo sapiens
tctttggtagtcaccagtt

SEQ ID NO: 29423 - DNA, 22 bp, Homo sapiens
ctcagaaagttgtttctcagtt

SEQ ID NO: 29424 - DNA, 21 bp, Homo sapiens
tccttatcccttttcccagtt

SEQ ID NO: 29425 - DNA, 78 bp, Rat cytomegalovirus
ccgcggcctccccaaggtccgggccacgaccgagaacgcgctcttcgccgtcgcccggaagacctgcgaggccctcgg

SEQ ID NO: 29426 - DNA, 24 bp, Rat cytomegalovirus
ttcgccgtcgcccggaagacctgc

SEQ ID NO: 29427 - DNA, 22 bp, Homo sapiens
ttcatggaacctggaagacctg

SEQ ID NO: 29428 - DNA, 24 bp, Homo sapiens
tccgctgtcgcccagcaggtttgc

SEQ ID NO: 29429 - DNA, 26 bp, Homo sapiens
ctcgccgttgcacggccgaggcctgc

SEQ ID NO: 29430 - DNA, 23 bp, Homo sapiens
ttcgtttcgcctctcagacctgc

SEQ ID NO: 29431 - DNA, 19 bp, Homo sapiens
gcctcgcccgacaccctgc

SEQ ID NO: 29432 - DNA, 22 bp, Homo sapiens
tcgcagggtctggaagacctgc

SEQ ID NO: 29433 - DNA, 21 bp, Homo sapiens
ttcgccgtctcccatccttgc

SEQ ID NO: 29434 - DNA, 24 bp, Homo sapiens
ctcgccgtcgtctgggcgctctgc

SEQ ID NO: 29435 - DNA, 106 bp, Rat cytomegalovirus
gcggcccccgtcgcgatggaggcggaggcggaggcggaggacggcggcgggggattcgccgtcgccctcgccgacgatccgctctcccgtctcctcggggggctgt

SEQ ID NO: 29436 - DNA, 24 bp, Rat cytomegalovirus
aggcggaggcggaggacggcggcg

SEQ ID NO: 29437 - DNA, 24 bp, Homo sapiens
ggcggcggcgggcaccgggcggcg

SEQ ID NO: 29438 - DNA, 22 bp, Homo sapiens
aggcggcgggcggcgggcggcg

SEQ ID NO: 29439 - DNA, 22 bp, Homo sapiens
gcggagctcggggacggcggcg

SEQ ID NO: 29440 - DNA, 19 bp, Homo sapiens
aggcggcgtcggcggcggc

SEQ ID NO: 29441 - DNA, 18 bp, Homo sapiens
agcggggctggcggcggc

SEQ ID NO: 29442 - DNA, 19 bp, Homo sapiens
agcggccgagggcggtggc

SEQ ID NO: 29443 - DNA, 24 bp, Homo sapiens
aggcgagggcgggggtggcggcgc

SEQ ID NO: 29444 - DNA, 19 bp, Homo sapiens
aggcgggcggcggagatgg

SEQ ID NO: 29445 - DNA, 18 bp, Homo sapiens
ggcggggcaggcggcggc

SEQ ID NO: 29446 - DNA, 22 bp, Homo sapiens
ggtggagataccggcggcggcg

SEQ ID NO: 29447 - DNA, 16 bp, Homo sapiens
gcggagaggcggcggc

SEQ ID NO: 29448 - DNA, 20 bp, Homo sapiens
aggcggaggccggggaggcg

SEQ ID NO: 29449 - DNA, 23 bp, Homo sapiens
ggcggaggcgcaggggccgggcg

SEQ ID NO: 29450 - DNA, 19 bp, Homo sapiens
aggcaggggaagctggcgg

SEQ ID NO: 29451 - DNA, 20 bp, Homo sapiens
ggtggaggcgggagatggcg

SEQ ID NO: 29452 - DNA, 15 bp, Homo sapiens
ggcgggcggcggcgg

SEQ ID NO: 29453 - DNA, 18 bp, Homo sapiens
ggcggcggcggcggcggc

SEQ ID NO: 29454 - DNA, 22 bp, Homo sapiens
aggcggagcggggcgctcggcg

SEQ ID NO: 29455 - DNA, 19 bp, Homo sapiens
aggtgaggcggagcggggc

SEQ ID NO: 29456 - DNA, 20 bp, Homo sapiens
aggtgggagtggaggtgggg

SEQ ID NO: 29457 - DNA, 19 bp, Homo sapiens
agggggggcagtggcggcg

SEQ ID NO: 29458 - DNA, 19 bp, Homo sapiens
aggcggtggcagcggcggc

SEQ ID NO: 29459 - DNA, 19 bp, Homo sapiens
agccggaggaggcggcggc

SEQ ID NO: 29460 - DNA, 19 bp, Homo sapiens
aggcggcggcggcggcggc

SEQ ID NO: 29461 - DNA, 19 bp, Homo sapiens
aggccgcgagggcggcggc

SEQ ID NO: 29462 - DNA, 20 bp, Homo sapiens
gggtgaggcggagaccacgg

SEQ ID NO: 29463 - DNA, 19 bp, Homo sapiens
ggctggaggcggagcgcgg

SEQ ID NO: 29464 - DNA, 23 bp, Homo sapiens
ggctgggggcagcagcggcggcg

SEQ ID NO: 29465 - DNA, 17 bp, Homo sapiens
gcggtgcggcggcggcg

SEQ ID NO: 29466 - DNA, 22 bp, Homo sapiens
aggcggaggcgggcggatcaca

SEQ ID NO: 29467 - DNA, 20 bp, Homo sapiens
ggcagaggtgggtcgtggcg

SEQ ID NO: 29468 - DNA, 18 bp, Homo sapiens
ggtggcggtggcggcggc

SEQ ID NO: 29469 - DNA, 21 bp, Homo sapiens
ggggcgcagagggtggcggcg

SEQ ID NO: 29470 - DNA, 24 bp, Homo sapiens
ggcggagcggagggcgcggtggcg

SEQ ID NO: 29471 - DNA, 19 bp, Homo sapiens
ggcgggggcggcggcggcg

SEQ ID NO: 29472 - DNA, 22 bp, Homo sapiens
ggcggcggcgggggcggcggcg

SEQ ID NO: 29473 - DNA, 22 bp, Homo sapiens
ggcgacgctgggggcggcggcg

SEQ ID NO: 29474 - DNA, 22 bp, Homo sapiens
aggcagaggcggcgcggtggcg

SEQ ID NO: 29475 - DNA, 21 bp, Homo sapiens
ggcgggcgggaggcggcggcg

SEQ ID NO: 29476 - DNA, 19 bp, Homo sapiens
aggcggcggcggcgcggcg

SEQ ID NO: 29477 - DNA, 18 bp, Homo sapiens
aggcggaggcctggcggc

SEQ ID NO: 29478 - DNA, 21 bp, Homo sapiens
ggccgggagacgacggcggcg

SEQ ID NO: 29479 - DNA, 19 bp, Homo sapiens
ggcgggggcagcgaggcgg

SEQ ID NO: 29480 - DNA, 19 bp, Homo sapiens
ggaggaggcggagggagcg

SEQ ID NO: 29481 - DNA, 22 bp, Homo sapiens
ggctggggcggagggccccacg

SEQ ID NO: 29482 - DNA, 19 bp, Homo sapiens
ggctggaggcggcggcggc

SEQ ID NO: 29483 - DNA, 19 bp, Homo sapiens
aggcggggctggaggagcg

SEQ ID NO: 29484 - DNA, 21 bp, Homo sapiens
aggcggaggcaggaggctgcg

SEQ ID NO: 29485 - DNA, 23 bp, Homo sapiens
aagcggcgacggggacggcggcg

SEQ ID NO: 29486 - DNA, 23 bp, Homo sapiens
aggcgggggcggcagctgcggcg

SEQ ID NO: 29487 - DNA, 25 bp, Homo sapiens
aggcgcgggcggaggaggcccggcg

SEQ ID NO: 29488 - DNA, 19 bp, Homo sapiens
aggcgcggcggtggcggcg

SEQ ID NO: 29489 - DNA, 24 bp, Homo sapiens
ggccgggcagtgggggcggcggcg

SEQ ID NO: 29490 - DNA, 22 bp, Homo sapiens
agtgggggcggcggcggtggcg

SEQ ID NO: 29491 - DNA, 18 bp, Homo sapiens
ggcggcagcggcggcggc

SEQ ID NO: 29492 - DNA, 19 bp, Homo sapiens
aggcgaggcgggggcagcg

SEQ ID NO: 29493 - DNA, 20 bp, Homo sapiens
ggcggcgggcggcagcggcg

SEQ ID NO: 29494 - DNA, 18 bp, Homo sapiens
aggcggcggcggcggcgg

SEQ ID NO: 29495 - DNA, 21 bp, Homo sapiens
aggcaggggtggggaggggcg

SEQ ID NO: 29496 - DNA, 19 bp, Homo sapiens
ggcggaggcggcggcggcg

SEQ ID NO: 29497 - DNA, 20 bp, Homo sapiens
ggagggggcggaggaggagg

SEQ ID NO: 29498 - DNA, 20 bp, Homo sapiens
aggtggaggcaggaggatcg

SEQ ID NO: 29499 - DNA, 27 bp, Homo sapiens
aggcagagggaggcgaggacggcggcg

SEQ ID NO: 29500 - DNA, 19 bp, Homo sapiens
ggcggaggcggcggtggcg

SEQ ID NO: 29501 - DNA, 19 bp, Homo sapiens
aggcagaggcggcagcggc

SEQ ID NO: 29502 - DNA, 24 bp, Homo sapiens
ggcggaggcggggccgcgccggcg

SEQ ID NO: 29503 - DNA, 17 bp, Homo sapiens
ggcggcggcggggacgg

SEQ ID NO: 29504 - DNA, 22 bp, Homo sapiens
ggcggcggcagcagcggcggcg

SEQ ID NO: 29505 - DNA, 15 bp, Homo sapiens
aggggaggcgggcgg

SEQ ID NO: 29506 - DNA, 22 bp, Homo sapiens
ggtggggcgcggtccggcggcg

SEQ ID NO: 29507 - DNA, 21 bp, Homo sapiens
aggtgggggtggggtgagggg

SEQ ID NO: 29508 - DNA, 26 bp, Homo sapiens
ggcgggggtaagagtgggcggtggcg

SEQ ID NO: 29509 - DNA, 22 bp, Homo sapiens
aggcggaggtggagacggagcg

SEQ ID NO: 29510 - DNA, 17 bp, Homo sapiens
ggtggcggcggcgcggc

SEQ ID NO: 29511 - DNA, 18 bp, Homo sapiens
ggcggggcggaggtcgcg

SEQ ID NO: 29512 - DNA, 18 bp, Homo sapiens
aggcggcgggtggggggc

SEQ ID NO: 29513 - DNA, 17 bp, Homo sapiens
ggccggggtggagggcg

SEQ ID NO: 29514 - DNA, 21 bp, Homo sapiens
agcggaggcgctgcggcggcg

SEQ ID NO: 29515 - DNA, 19 bp, Homo sapiens
ggtcgggggtggggggcgg

SEQ ID NO: 29516 - DNA, 19 bp, Homo sapiens
aggccgaggcggaggacag

SEQ ID NO: 29517 - DNA, 18 bp, Homo sapiens
ggcggaggtggcggcggc

SEQ ID NO: 29518 - DNA, 22 bp, Homo sapiens
gggggagccccgggcggcggcg

SEQ ID NO: 29519 - DNA, 19 bp, Homo sapiens
ggcggaagcggggcgggcg

SEQ ID NO: 29520 - DNA, 18 bp, Homo sapiens
aggcgggggcggagggcg

SEQ ID NO: 29521 - DNA, 20 bp, Homo sapiens
aggcggggtgccgggcggcg

SEQ ID NO: 29522 - DNA, 17 bp, Homo sapiens
agggggggtggggggcg

SEQ ID NO: 29523 - DNA, 20 bp, Homo sapiens
aggcgggggcgggcatggcg

SEQ ID NO: 29524 - DNA, 20 bp, Homo sapiens
ggtggggcggaggtagggcg

SEQ ID NO: 29525 - DNA, 27 bp, Homo sapiens
aggcggagggggaggggacaggtggcg

SEQ ID NO: 29526 - DNA, 21 bp, Homo sapiens
aggtgggcggtggcagcggcg

SEQ ID NO: 29527 - DNA, 21 bp, Homo sapiens
aggttggggctacgacggcgg

SEQ ID NO: 29528 - DNA, 17 bp, Homo sapiens
ggcggaggcggggggcg

SEQ ID NO: 29529 - DNA, 16 bp, Homo sapiens
agcggagcggcggcgg

SEQ ID NO: 29530 - DNA, 22 bp, Homo sapiens
aggtgagggcgagacggcggcg

SEQ ID NO: 29531 - DNA, 22 bp, Homo sapiens
ggcggaggcggctcgagcggcg

SEQ ID NO: 29532 - DNA, 24 bp, Homo sapiens
agctggaggggccgggcggcggcg

SEQ ID NO: 29533 - DNA, 18 bp, Homo sapiens
ggaggaggcggagggccg

SEQ ID NO: 29534 - DNA, 21 bp, Homo sapiens
ggcggcggcggggcggcggcg

SEQ ID NO: 29535 - DNA, 18 bp, Homo sapiens
ggcggaggggcgcgcggc

SEQ ID NO: 29536 - DNA, 17 bp, Homo sapiens
ggcggggcggaggggcg

SEQ ID NO: 29537 - DNA, 21 bp, Homo sapiens
aggcggaggggaggcctcgcg

SEQ ID NO: 29538 - DNA, 19 bp, Homo sapiens
aggaggaggcggccgcggc

SEQ ID NO: 29539 - DNA, 16 bp, Homo sapiens
ggcggagggggagggg

SEQ ID NO: 29540 - DNA, 23 bp, Homo sapiens
aggaggaggcggcggcggcggcg

SEQ ID NO: 29541 - DNA, 18 bp, Homo sapiens
ggaggaggaggcggcggc

SEQ ID NO: 29542 - DNA, 18 bp, Homo sapiens
ggtggaggcggtgggggg

SEQ ID NO: 29543 - DNA, 18 bp, Homo sapiens
aggcgggggaggggcggc

SEQ ID NO: 29544 - DNA, 19 bp, Homo sapiens
ggcggaggcggaggccagc

SEQ ID NO: 29545 - DNA, 22 bp, Homo sapiens
aggaggaggcgggggagaggcg

SEQ ID NO: 29546 - DNA, 18 bp, Homo sapiens
ggcgggggcggagggggg

SEQ ID NO: 29547 - DNA, 17 bp, Homo sapiens
ggggaggcggaagctgg

SEQ ID NO: 29548 - DNA, 18 bp, Homo sapiens
agggcgggggctggcggc

SEQ ID NO: 29549 - DNA, 24 bp, Homo sapiens
aggcgccggcagggacggtggcgc

SEQ ID NO: 29550 - DNA, 19 bp, Homo sapiens
agccgggggcggaggagac

SEQ ID NO: 29551 - DNA, 18 bp, Homo sapiens
ggggggaggagcggcggc

SEQ ID NO: 29552 - DNA, 20 bp, Homo sapiens
ggcggcggcggaggtcggcg

SEQ ID NO: 29553 - DNA, 22 bp, Homo sapiens
aggcggaggcggcggtgcagcg

SEQ ID NO: 29554 - DNA, 19 bp, Homo sapiens
ggcggaggcggctgcggcg

SEQ ID NO: 29555 - DNA, 25 bp, Homo sapiens
ggcggcggcggggctgagcgcggcg

SEQ ID NO: 29556 - DNA, 22 bp, Homo sapiens
aggcggctccggggcggcggcg

SEQ ID NO: 29557 - DNA, 21 bp, Homo sapiens
ggcgcgggccgggcggcggcg

SEQ ID NO: 29558 - DNA, 23 bp, Homo sapiens
agggggaggcgggggcgacggcg

SEQ ID NO: 29559 - DNA, 16 bp, Homo sapiens
ggcgggggcagagggc

SEQ ID NO: 29560 - DNA, 24 bp, Homo sapiens
aggcgggcagcgggggcggcggcg

SEQ ID NO: 29561 - DNA, 21 bp, Homo sapiens
aggcaggggtggagggcggcg

SEQ ID NO: 29562 - DNA, 17 bp, Homo sapiens
ggcggggtggggggcaa

SEQ ID NO: 29563 - DNA, 18 bp, Homo sapiens
ggcggggcggggacacgg

SEQ ID NO: 29564 - DNA, 22 bp, Homo sapiens
ggccgaggctgaggcggcggcg

SEQ ID NO: 29565 - DNA, 19 bp, Homo sapiens
aggctgaggcggcggcggc

SEQ ID NO: 29566 - DNA, 23 bp, Homo sapiens
ggggaggcggacggccggcggcg

SEQ ID NO: 29567 - DNA, 18 bp, Homo sapiens
ggcggcggcggctgcggc

SEQ ID NO: 29568 - DNA, 18 bp, Homo sapiens
ggcggcgggcggacggcg

SEQ ID NO: 29569 - DNA, 22 bp, Homo sapiens
ggggagctcgggggcggcggcg

SEQ ID NO: 29570 - DNA, 24 bp, Homo sapiens
agcggggcgctccgggcggcggcg

SEQ ID NO: 29571 - DNA, 18 bp, Homo sapiens
aggcggcggcggagggcg

SEQ ID NO: 29572 - DNA, 23 bp, Homo sapiens
ggtggcgggtccctgcggcggcg

SEQ ID NO: 29573 - DNA, 23 bp, Homo sapiens
ggcggggcagagagatggcggcg

SEQ ID NO: 29574 - DNA, 22 bp, Homo sapiens
ggtgggggaggaggcagcggcg

SEQ ID NO: 29575 - DNA, 21 bp, Homo sapiens
ggatggcggtggggacggcgg

SEQ ID NO: 29576 - DNA, 17 bp, Homo sapiens
ggcgcggcggcggcggc

SEQ ID NO: 29577 - DNA, 19 bp, Homo sapiens
aggcgggcgcggcggcggc

SEQ ID NO: 29578 - DNA, 19 bp, Homo sapiens
ggggggcccgggcggcggc

SEQ ID NO: 29579 - DNA, 23 bp, Homo sapiens
aggcggcggcggcggcagcggcg

SEQ ID NO: 29580 - DNA, 21 bp, Homo sapiens
ggcggggccggggcgcgggcg

SEQ ID NO: 29581 - DNA, 18 bp, Homo sapiens
ggcgcgggcggaggggcg

SEQ ID NO: 29582 - DNA, 18 bp, Homo sapiens
ggccgagagggcggcggc

SEQ ID NO: 29583 - DNA, 21 bp, Homo sapiens
aggccggcgtgggcggcggcg

SEQ ID NO: 29584 - DNA, 18 bp, Homo sapiens
aggcgcggtggtggcggc

SEQ ID NO: 29585 - DNA, 17 bp, Homo sapiens
aggcggaggcgcggtgg

SEQ ID NO: 29586 - DNA, 18 bp, Homo sapiens
agccggggcggcggcggc

SEQ ID NO: 29587 - DNA, 17 bp, Homo sapiens
ggcgggcgggcggcggc

SEQ ID NO: 29588 - DNA, 23 bp, Homo sapiens
aggcgagggatccggcggcggcg

SEQ ID NO: 29589 - DNA, 18 bp, Homo sapiens
ggcgggcgccgcggcggc

SEQ ID NO: 29590 - DNA, 26 bp, Homo sapiens
ggcggcggcggagcgggcggcggcgc

SEQ ID NO: 29591 - DNA, 19 bp, Homo sapiens
ggagcgggcgggcggcggc

SEQ ID NO: 29592 - DNA, 19 bp, Homo sapiens
aggcgaaggcggcggcggc

SEQ ID NO: 29593 - DNA, 18 bp, Homo sapiens
ggcggtggcggcggcggc

SEQ ID NO: 29594 - DNA, 23 bp, Homo sapiens
aggcgaaggcgaaggcggcggcg

SEQ ID NO: 29595 - DNA, 21 bp, Homo sapiens
aggcggagcgcacgggcggcg

SEQ ID NO: 29596 - DNA, 17 bp, Homo sapiens
ggcgggcggatggcggc

SEQ ID NO: 29597 - DNA, 23 bp, Homo sapiens
ggcggatggcggcggcacggcgg

SEQ ID NO: 29598 - DNA, 19 bp, Homo sapiens
ggcggaggggggagaggcg

SEQ ID NO: 29599 - DNA, 19 bp, Homo sapiens
ggcggcggcggcggtggcg

SEQ ID NO: 29600 - DNA, 21 bp, Homo sapiens
gggtgcgctcgggcggcggcg

SEQ ID NO: 29601 - DNA, 20 bp, Homo sapiens
aggcggtggccgtggcggcg

SEQ ID NO: 29602 - DNA, 21 bp, Homo sapiens
ggctgcctgagggcggcggcg

SEQ ID NO: 29603 - DNA, 19 bp, Homo sapiens
agctggaggcggaggcgcg

SEQ ID NO: 29604 - DNA, 21 bp, Homo sapiens
aggcggaggcgggtggatcac

SEQ ID NO: 29605 - DNA, 18 bp, Homo sapiens
ggcggaggcgacggcggc

SEQ ID NO: 29606 - DNA, 24 bp, Homo sapiens
ggcgccgggcggggggcggcggcg

SEQ ID NO: 29607 - DNA, 21 bp, Homo sapiens
ggcggagtgcgggcggtggcg

SEQ ID NO: 29608 - DNA, 16 bp, Homo sapiens
ggcggggcggagggcg

SEQ ID NO: 29609 - DNA, 20 bp, Homo sapiens
ggcgcgggcggtcagcggcg

SEQ ID NO: 29610 - DNA, 19 bp, Homo sapiens
agctggaggcggaggagac

SEQ ID NO: 29611 - DNA, 22 bp, Homo sapiens
ggcggaggcggcggcggcggcg

SEQ ID NO: 29612 - DNA, 21 bp, Homo sapiens
aggtgggcggaggcggcggcg

SEQ ID NO: 29613 - DNA, 21 bp, Homo sapiens
cagggctggggggcggcggcg

SEQ ID NO: 29614 - DNA, 18 bp, Homo sapiens
ggtggcggcggcggcggc

SEQ ID NO: 29615 - DNA, 20 bp, Homo sapiens
aggcggcagcggcggtggcg

SEQ ID NO: 29616 - DNA, 23 bp, Homo sapiens
aggcggcgggcgggacaccggcg

SEQ ID NO: 29617 - DNA, 17 bp, Homo sapiens
ggcggggcggagggcag

SEQ ID NO: 29618 - DNA, 19 bp, Homo sapiens
ggcgggggtggcggcggcg

SEQ ID NO: 29619 - DNA, 20 bp, Homo sapiens
agtcgggggtgggggagagg

SEQ ID NO: 29620 - DNA, 18 bp, Homo sapiens
ggcgcacggggcggcggc

SEQ ID NO: 29621 - DNA, 24 bp, Homo sapiens
ggcgggggcggcagggcggcggcg

SEQ ID NO: 29622 - DNA, 19 bp, Homo sapiens
cagggtcgggggacggcgg

SEQ ID NO: 29623 - DNA, 22 bp, Homo sapiens
agcggaggcggaggccaaggcg

SEQ ID NO: 29624 - DNA, 19 bp, Homo sapiens
ggcgggggcggctgcggcg

SEQ ID NO: 29625 - DNA, 19 bp, Homo sapiens
ggtggaggcgggggagcaa

SEQ ID NO: 29626 - DNA, 20 bp, Homo sapiens
ggctgaggcgggcggcggcg

SEQ ID NO: 29627 - DNA, 16 bp, Homo sapiens
aggcgggcggcggcgg

SEQ ID NO: 29628 - DNA, 25 bp, Homo sapiens
ggtcggggcggaggggtcccaggcg

SEQ ID NO: 29629 - DNA, 20 bp, Homo sapiens
aggcgggggtaggggagcgg

SEQ ID NO: 29630 - DNA, 22 bp, Homo sapiens
ggcagctgagggggcggcggcg

SEQ ID NO: 29631 - DNA, 16 bp, Homo sapiens
agcgcgggggcggcgg

SEQ ID NO: 29632 - DNA, 17 bp, Homo sapiens
ggggcaaggacggcggc

SEQ ID NO: 29633 - DNA, 18 bp, Homo sapiens
ggcggaagtggggtggcg

SEQ ID NO: 29634 - DNA, 18 bp, Homo sapiens
ggcggcgacgacggcggc

SEQ ID NO: 29635 - DNA, 19 bp, Homo sapiens
aggctggagtggcggcggc

SEQ ID NO: 29636 - DNA, 23 bp, Homo sapiens
aggaggaggcggaggaagaggcg

SEQ ID NO: 29637 - DNA, 19 bp, Homo sapiens
aggcggcggtggcggcggc

SEQ ID NO: 29638 - DNA, 19 bp, Homo sapiens
aggcggagcggagctgggg

SEQ ID NO: 29639 - DNA, 21 bp, Homo sapiens
ggcgaaggtggaggtcctgcg

SEQ ID NO: 29640 - DNA, 19 bp, Homo sapiens
aggcgaaggctgcggcggc

SEQ ID NO: 29641 - DNA, 23 bp, Homo sapiens
ggggaggcgtggaagcggcggcg

SEQ ID NO: 29642 - DNA, 21 bp, Homo sapiens
ggcggaggccggaggcacgcg

SEQ ID NO: 29643 - DNA, 16 bp, Homo sapiens
ggcgaggcggagggcg

SEQ ID NO: 29644 - DNA, 19 bp, Homo sapiens
ggcgggaggcggggctcgg

SEQ ID NO: 29645 - DNA, 18 bp, Homo sapiens
aggcggttgggcggcggc

SEQ ID NO: 29646 - DNA, 23 bp, Homo sapiens
ggtgggggcggagggcggcggcg

SEQ ID NO: 29647 - DNA, 19 bp, Homo sapiens
aagcggaggatgcggcggc

SEQ ID NO: 29648 - DNA, 23 bp, Homo sapiens
aggcggaggtgggtggatcacaa

SEQ ID NO: 29649 - DNA, 23 bp, Homo sapiens
aggaggaggcggtggcggcggcg

SEQ ID NO: 29650 - DNA, 18 bp, Homo sapiens
ggaggaggaggcggtggc

SEQ ID NO: 29651 - DNA, 21 bp, Homo sapiens
aggaggaggcggcgagcggcg

SEQ ID NO: 29652 - DNA, 21 bp, Homo sapiens
aggtggaggcgggcggatcac

SEQ ID NO: 29653 - DNA, 22 bp, Homo sapiens
aggcagaggcggagaggtggcg

SEQ ID NO: 29654 - DNA, 29 bp, Homo sapiens
ggcggaggcgtggggaccaagagcggcgc

SEQ ID NO: 29655 - DNA, 19 bp, Homo sapiens
aggcggcggcagcggcggc

SEQ ID NO: 29656 - DNA, 21 bp, Homo sapiens
aggcggggctctcggtggcgg

SEQ ID NO: 29657 - DNA, 18 bp, Homo sapiens
ggcggagggcggggggcg

SEQ ID NO: 29658 - DNA, 23 bp, Homo sapiens
ggttgggggcgggggccggggcg

SEQ ID NO: 29659 - DNA, 21 bp, Homo sapiens
ggccggggccaggcggcggcg

SEQ ID NO: 29660 - DNA, 22 bp, Homo sapiens
ggagggggcggcggcggcggcg

SEQ ID NO: 29661 - DNA, 16 bp, Homo sapiens
agggagggggcggcgg

SEQ ID NO: 29662 - DNA, 22 bp, Homo sapiens
aggtggaggcgggcggatcacg

SEQ ID NO: 29663 - DNA, 19 bp, Homo sapiens
ggggggaggaggcggcggc

SEQ ID NO: 29664 - DNA, 18 bp, Homo sapiens
ggaggaggcggcggcggc

SEQ ID NO: 29665 - DNA, 20 bp, Homo sapiens
agcggagccgggcggcggcg

SEQ ID NO: 29666 - DNA, 20 bp, Homo sapiens
aggcaggggtggaggaggcg

SEQ ID NO: 29667 - DNA, 18 bp, Homo sapiens
aggcaggggtggaggagg

SEQ ID NO: 29668 - DNA, 19 bp, Homo sapiens
ggtggaggggaggcagggg

SEQ ID NO: 29669 - DNA, 21 bp, Homo sapiens
aggaggaggcgggggacacag

SEQ ID NO: 29670 - DNA, 22 bp, Homo sapiens
ggcggcggctgctgcggcggcg

SEQ ID NO: 29671 - DNA, 21 bp, Homo sapiens
gcggggatctgggcggcggcg

SEQ ID NO: 29672 - DNA, 20 bp, Homo sapiens
ggaggaggaaggcggcggcg

SEQ ID NO: 29673 - DNA, 23 bp, Homo sapiens
aggtggcggcgacagcggcggcg

SEQ ID NO: 29674 - DNA, 22 bp, Homo sapiens
ggcggaggtggaagtagggcgg

SEQ ID NO: 29675 - DNA, 19 bp, Homo sapiens
ggtggaggcggtggcggcg

SEQ ID NO: 29676 - DNA, 22 bp, Homo sapiens
ggcgcgggtccgggcggcggcg

SEQ ID NO: 29677 - DNA, 22 bp, Homo sapiens
ggcgcgggcggcgcgggcggcg

SEQ ID NO: 29678 - DNA, 18 bp, Homo sapiens
ggcggcgcgggcggcggc

SEQ ID NO: 29679 - DNA, 17 bp, Homo sapiens
ggggaggtgggggacag

SEQ ID NO: 29680 - DNA, 23 bp, Homo sapiens
ggctgggattctgggcggcggcg

SEQ ID NO: 29681 - DNA, 17 bp, Homo sapiens
ggcgcggtggcggcggc

SEQ ID NO: 29682 - DNA, 20 bp, Homo sapiens
ggctggttcgggcggcggcg

SEQ ID NO: 29683 - DNA, 21 bp, Homo sapiens
aggaggaggcggggtgaggcg

SEQ ID NO: 29684 - DNA, 23 bp, Homo sapiens
ggcggacgcagcgggcggcggcg

SEQ ID NO: 29685 - DNA, 21 bp, Homo sapiens
aggcagggggtggggcaggcg

SEQ ID NO: 29686 - DNA, 18 bp, Homo sapiens
agatggaggcggcggcgg

SEQ ID NO: 29687 - DNA, 18 bp, Homo sapiens
aggcggcggcggtggtgg

SEQ ID NO: 29688 - DNA, 25 bp, Homo sapiens
ggtggaggcggcggctgtggcggcg

SEQ ID NO: 29689 - DNA, 20 bp, Homo sapiens
aggcgggggtgggggcacag

SEQ ID NO: 29690 - DNA, 20 bp, Homo sapiens
ggcgaggagcgacggcggcg

SEQ ID NO: 29691 - DNA, 16 bp, Homo sapiens
ggcggagcggcggcgg

SEQ ID NO: 29692 - DNA, 22 bp, Homo sapiens
ggagggggtcaccgcggcggcg

SEQ ID NO: 29693 - DNA, 18 bp, Homo sapiens
ggcggagcggcggtggcg

SEQ ID NO: 29694 - DNA, 26 bp, Homo sapiens
aggcggcggcgacacaggcggtggcg

SEQ ID NO: 29695 - DNA, 19 bp, Homo sapiens
aggcggcggtggtcgtggc

SEQ ID NO: 29696 - DNA, 20 bp, Homo sapiens
aggcggaggcggaggaaggc

SEQ ID NO: 29697 - DNA, 18 bp, Homo sapiens
aggggaggcggccggcgg

SEQ ID NO: 29698 - DNA, 17 bp, Homo sapiens
ggcgggcggcggagagg

SEQ ID NO: 29699 - DNA, 23 bp, Homo sapiens
aggcgggtgccggggcggcggcg

SEQ ID NO: 29700 - DNA, 19 bp, Homo sapiens
aggaggaggcggcggcggc

SEQ ID NO: 29701 - DNA, 20 bp, Homo sapiens
gacgggggcggccggcggcg

SEQ ID NO: 29702 - DNA, 21 bp, Homo sapiens
ggcggcggcggggcccgggcg

SEQ ID NO: 29703 - DNA, 23 bp, Homo sapiens
ggccggggttcctggcggcggcg

SEQ ID NO: 29704 - DNA, 23 bp, Homo sapiens
agctggaggcgcaggcggcggcg

SEQ ID NO: 29705 - DNA, 16 bp, Homo sapiens
aggcggcggcgggcgg

SEQ ID NO: 29706 - DNA, 20 bp, Homo sapiens
aggcggcggcggcggtggcg

SEQ ID NO: 29707 - DNA, 19 bp, Homo sapiens
ggcggaggcggcagcggcg

SEQ ID NO: 29708 - DNA, 21 bp, Homo sapiens
acggcggcgggggcggtggcg

SEQ ID NO: 29709 - DNA, 19 bp, Homo sapiens
ggcgggggcggtggcggcg

SEQ ID NO: 29710 - DNA, 17 bp, Homo sapiens
aggagggggcggggggc

SEQ ID NO: 29711 - DNA, 19 bp, Homo sapiens
ggtgggggctggaggtgcg

SEQ ID NO: 29712 - DNA, 22 bp, Homo sapiens
acgtgggctgcgggcggcggcg

SEQ ID NO: 29713 - DNA, 17 bp, Homo sapiens
ggtggacgcggcggcgg

SEQ ID NO: 29714 - DNA, 20 bp, Homo sapiens
gcgcgcggggggcggcggcg

SEQ ID NO: 29715 - DNA, 22 bp, Homo sapiens
aggtgggggcggaggaactccg

SEQ ID NO: 29716 - DNA, 21 bp, Homo sapiens
aggcggggcgggggacaccag

SEQ ID NO: 29717 - DNA, 17 bp, Homo sapiens
ggcggagcggcggcggc

SEQ ID NO: 29718 - DNA, 19 bp, Homo sapiens
ggcgggcgcgcaggcggcg

SEQ ID NO: 29719 - DNA, 17 bp, Homo sapiens
ggccggggcggagggcg

SEQ ID NO: 29720 - DNA, 19 bp, Homo sapiens
aggcggaggcggcggctgc

SEQ ID NO: 29721 - DNA, 19 bp, Homo sapiens
ggcggaggcggaggcggcg

SEQ ID NO: 29722 - DNA, 22 bp, Homo sapiens
gacgggctcctgggcggcggcg

SEQ ID NO: 29723 - DNA, 17 bp, Homo sapiens
ggcggtgaggcggcggc

SEQ ID NO: 29724 - DNA, 16 bp, Homo sapiens
aggcggaggggggcgg

SEQ ID NO: 29725 - DNA, 23 bp, Homo sapiens
aggcggaggcggcggcctcggcg

SEQ ID NO: 29726 - DNA, 18 bp, Homo sapiens
ggtggggcggagggtcag

SEQ ID NO: 29727 - DNA, 17 bp, Homo sapiens
ggcgggcgagcggcggc

SEQ ID NO: 29728 - DNA, 19 bp, Homo sapiens
aggcagcgagggcggcggc

SEQ ID NO: 29729 - DNA, 19 bp, Homo sapiens
ggcggaagcggcgaggcgg

SEQ ID NO: 29730 - DNA, 17 bp, Homo sapiens
aggcgggggggagggcg

SEQ ID NO: 29731 - DNA, 22 bp, Homo sapiens
ggcgcgctgtcgggcggcggcg

SEQ ID NO: 29732 - DNA, 23 bp, Homo sapiens
ggtggcgggtccccgcggcggcg

SEQ ID NO: 29733 - DNA, 19 bp, Homo sapiens
aggcggaggcgcgggccgc

SEQ ID NO: 29734 - DNA, 23 bp, Homo sapiens
aggcgggggcgggcggatcacaa

SEQ ID NO: 29735 - DNA, 17 bp, Homo sapiens
ggcggcggcggcggcgg

SEQ ID NO: 29736 - DNA, 19 bp, Homo sapiens
cgggcggggggcggcggcg

SEQ ID NO: 29737 - DNA, 23 bp, Homo sapiens
agtggctgcagggggcggcggcg

SEQ ID NO: 29738 - DNA, 22 bp, Homo sapiens
agcggaggcggtggtggtggcg

SEQ ID NO: 29739 - DNA, 23 bp, Homo sapiens
aggaggaggcggcagcggcggcg

SEQ ID NO: 29740 - DNA, 19 bp, Homo sapiens
agccgggggggtggcggcg

SEQ ID NO: 29741 - DNA, 23 bp, Homo sapiens
aggtggaggcggaggtggaatcg

SEQ ID NO: 29742 - DNA, 19 bp, Homo sapiens
aggcgcaggcggagaggcg

SEQ ID NO: 29743 - DNA, 18 bp, Homo sapiens
gcggaggcagcggcggcg

SEQ ID NO: 29744 - DNA, 22 bp, Homo sapiens
ggctgggcggggggcggcggcg

SEQ ID NO: 29745 - DNA, 21 bp, Homo sapiens
gggtgaggcggtgtggcggcg

SEQ ID NO: 29746 - DNA, 20 bp, Homo sapiens
gacggggcagggcggcggcg

SEQ ID NO: 29747 - DNA, 23 bp, Homo sapiens
ggcggaggcgggagtggaggtgg

SEQ ID NO: 29748 - DNA, 20 bp, Homo sapiens
ggtggaggcggaggcggtgg

SEQ ID NO: 29749 - DNA, 21 bp, Homo sapiens
aggcggaggcggtggtggtgg

SEQ ID NO: 29750 - DNA, 15 bp, Homo sapiens
ggcgcggggcggcgg

SEQ ID NO: 29751 - DNA, 16 bp, Homo sapiens
ggcgcggggcggcggc

SEQ ID NO: 29752 - DNA, 20 bp, Homo sapiens
aggcggaggtgaagctgagg

SEQ ID NO: 29753 - DNA, 19 bp, Homo sapiens
agcggaggcggaggacgcg

SEQ ID NO: 29754 - DNA, 18 bp, Homo sapiens
aggtggaggcggagacag

SEQ ID NO: 29755 - DNA, 21 bp, Homo sapiens
ggggtggaggaagcggcggcg

SEQ ID NO: 29756 - DNA, 18 bp, Homo sapiens
aggcgggggtagggggcg

SEQ ID NO: 29757 - DNA, 17 bp, Homo sapiens
ggctggggcggacggcg

SEQ ID NO: 29758 - DNA, 22 bp, Homo sapiens
ggtggaggcggcggctgtggcg

SEQ ID NO: 29759 - DNA, 27 bp, Homo sapiens
aggcggcggcgaccacagacggcggcg

SEQ ID NO: 29760 - DNA, 20 bp, Homo sapiens
aggggaggcggaggccagcg

SEQ ID NO: 29761 - DNA, 17 bp, Homo sapiens
ggggaggcgggggccgg

SEQ ID NO: 29762 - DNA, 18 bp, Homo sapiens
ggcgaggcggggcggggc

SEQ ID NO: 29763 - DNA, 23 bp, Homo sapiens
aggcggaggcggcaaaaccggcg

SEQ ID NO: 29764 - DNA, 17 bp, Homo sapiens
aggcgaggcgggcgcgg

SEQ ID NO: 29765 - DNA, 19 bp, Homo sapiens
agccggggcggtggcggcg

SEQ ID NO: 29766 - DNA, 20 bp, Homo sapiens
ggcgaagaaggacggcggcg

SEQ ID NO: 29767 - DNA, 18 bp, Homo sapiens
aggggaggcgggctggcg

SEQ ID NO: 29768 - DNA, 21 bp, Homo sapiens
agctgggacgggacggcggcg

SEQ ID NO: 29769 - DNA, 22 bp, Homo sapiens
ggcggtggtgggggcggcggcg

SEQ ID NO: 29770 - DNA, 19 bp, Homo sapiens
ggtgggggcggcggcggcg

SEQ ID NO: 29771 - DNA, 99 bp, Human papillomavirus type 45
ccctggcagttgtgtgtattccccttctcccagtggctctattattacttctgattctcaattatttaataagccatattggttacataaggcccaggg

SEQ ID NO: 29772 - DNA, 24 bp, Human papillomavirus type 45
tgtgtgtattccccttctcccagt

SEQ ID NO: 29773 - DNA, 17 bp, Homo sapiens
tgtgtgtattttcttct

SEQ ID NO: 29774 - DNA, 17 bp, Homo sapiens
tgcaccccttctcttag

SEQ ID NO: 29775 - DNA, 23 bp, Homo sapiens
tctgtgcttctctttctcccagt

SEQ ID NO: 29776 - DNA, 20 bp, Homo sapiens
tatgtgtattctctatgcca

SEQ ID NO: 29777 - DNA, 20 bp, Homo sapiens
tgaggttctcttctcccagt

SEQ ID NO: 29778 - DNA, 18 bp, Homo sapiens
tgtgtgtattttttccca

SEQ ID NO: 29779 - DNA, 17 bp, Homo sapiens
gtactccctttttcccg

SEQ ID NO: 29780 - DNA, 18 bp, Homo sapiens
tatgtgtatgtttcccag

SEQ ID NO: 29781 - DNA, 18 bp, Homo sapiens
tgtgtgcaattcttccag

SEQ ID NO: 29782 - DNA, 19 bp, Homo sapiens
tgtgtatattcttttttct

SEQ ID NO: 29783 - DNA, 21 bp, Homo sapiens
tgtggtgggtcttctcccagt

SEQ ID NO: 29784 - DNA, 22 bp, Homo sapiens
tgtgttcccctcacatcctggt

SEQ ID NO: 29785 - DNA, 130 bp, Human papillomavirus type 45
acgtatacgtagtaagaaataatatgttagcacatatatgtatgtttgtatgtatggttttgtatgttgtatgtatgtatgtatttgtgtgatatattactgtattttgtttgtttgcgtgcgtgtatgt

SEQ ID NO: 29786 - DNA, 24 bp, Human papillomavirus type 45
tacgtagtaagaaataatatgtta

SEQ ID NO: 29787 - DNA, 17 bp, Homo sapiens
tacgtaggagaaataat

SEQ ID NO: 29788 - DNA, 17 bp, Homo sapiens
tagtaagaataaatgtt

SEQ ID NO: 29789 - DNA, 21 bp, Homo sapiens
tacgtagtatggaagtaatat

SEQ ID NO: 29790 - DNA, 65 bp, Human papillomavirus type 45
cctaaaggaaaaattttcctccgatttggatcaatatccccttggtcgaaagtttttagttcagg

SEQ ID NO: 29791 - DNA, 20 bp, Human papillomavirus type 45
tcgaaagtttttagttcagg

SEQ ID NO: 29792 - DNA, 18 bp, Homo sapiens
gaaactttttaattaagg

SEQ ID NO: 29793 - DNA, 17 bp, Homo sapiens
gaaagtttacaattagg

SEQ ID NO: 29794 - DNA, 18 bp, Homo sapiens
gaaagtttctgttaaagg

SEQ ID NO: 29795 - DNA, 19 bp, Homo sapiens
gaaagtttctaactacagg

SEQ ID NO: 29796 - DNA, 16 bp, Homo sapiens
gaagctttctttcagg

SEQ ID NO: 29797 - DNA, 17 bp, Homo sapiens
gaggttttcagcccggg

SEQ ID NO: 29798 - DNA, 18 bp, Homo sapiens
tccaaagtttagagcagg

SEQ ID NO: 29799 - DNA, 17 bp, Homo sapiens
ccgaaagtttagacagg

SEQ ID NO: 29800 - DNA, 18 bp, Homo sapiens
gaagcctcctggttcagg

SEQ ID NO: 29801 - DNA, 15 bp, Homo sapiens
aaaagccagttcagg

SEQ ID NO: 29802 - DNA, 18 bp, Homo sapiens
cgaaagtttagaaacagg

SEQ ID NO: 29803 - DNA, 17 bp, Homo sapiens
aaaagtttccagccagg

SEQ ID NO: 29804 - DNA, 16 bp, Homo sapiens
gagagttttcagcagg

SEQ ID NO: 29805 - DNA, 18 bp, Homo sapiens
gaaagttttaaattaagg

SEQ ID NO: 29806 - DNA, 17 bp, Homo sapiens
gaaggattcagctcagg

SEQ ID NO: 29807 - DNA, 15 bp, Homo sapiens
tcaaaagttttccag

SEQ ID NO: 29808 - DNA, 19 bp, Homo sapiens
tcgaggatttagttccagg

SEQ ID NO: 29809 - DNA, 19 bp, Homo sapiens
tcaagggtttctcctcagg

SEQ ID NO: 29810 - DNA, 17 bp, Homo sapiens
tcaaagtatagttcagg

SEQ ID NO: 29811 - DNA, 20 bp, Homo sapiens
tcaaaagttttaatagcagg

SEQ ID NO: 29812 - DNA, 20 bp, Homo sapiens
tcaaaaacaattggttcagg

SEQ ID NO: 29813 - DNA, 17 bp, Homo sapiens
cgaaagtttccttcagg

SEQ ID NO: 29814 - DNA, 18 bp, Homo sapiens
gaaagctaaaagttcagg

SEQ ID NO: 29815 - DNA, 16 bp, Homo sapiens
gaaagtttaatacagg

SEQ ID NO: 29816 - DNA, 22 bp, Homo sapiens
tccaaagtttcctgttttcagg

SEQ ID NO: 29817 - DNA, 15 bp, Homo sapiens
tcgaaaattcttcag

SEQ ID NO: 29818 - DNA, 16 bp, Homo sapiens
gaaagtcttgttcagg

SEQ ID NO: 29819 - DNA, 18 bp, Homo sapiens
tctgaagttttcctcagg

SEQ ID NO: 29820 - DNA, 16 bp, Homo sapiens
gaaagtctgtagcagg

SEQ ID NO: 29821 - DNA, 21 bp, Homo sapiens
gaaagttcaggagggttcagg

SEQ ID NO: 29822 - DNA, 19 bp, Homo sapiens
gaaattttttcaactcagg

SEQ ID NO: 29823 - DNA, 61 bp, Human papillomavirus type 45
gagttgtcagcactgatgattatgtgtctcgcacaagcatattttatcatgcaggcagttc

SEQ ID NO: 29824 - DNA, 24 bp, Human papillomavirus type 45
tgtcagcactgatgattatgtgtc

SEQ ID NO: 29825 - DNA, 19 bp, Homo sapiens
tgtcagcactggtggtcat

SEQ ID NO: 29826 - DNA, 21 bp, Homo sapiens
tgtcagtggtgatgatcacgt

SEQ ID NO: 29827 - DNA, 20 bp, Homo sapiens
tcagcagaacaattgtgtgt

SEQ ID NO: 29828 - DNA, 20 bp, Homo sapiens
tgttaacaccatttatgtgt

SEQ ID NO: 29829 - DNA, 22 bp, Homo sapiens
tgttagcattgatgatctttgt

SEQ ID NO: 29830 - DNA, 22 bp, Homo sapiens
tgtcgacactgatggcacgtgt

SEQ ID NO: 29831 - DNA, 21 bp, Homo sapiens
tgtcggggctgctcatgtgtc

SEQ ID NO: 29832 - DNA, 15 bp, Homo sapiens
tgcagcactgatgtg

SEQ ID NO: 29833 - DNA, 15 bp, Homo sapiens
gcactgactatgtgt

SEQ ID NO: 29834 - DNA, 67 bp, Rabbit fibroma virus
acggtaactcgtatatttttacgtacaataaagcgatttgtaaaaataaaaactttacgtaatccgt

SEQ ID NO: 29835 - DNA, 24 bp, Rabbit fibroma virus
actcgtatatttttacgtacaata

SEQ ID NO: 29836 - DNA, 20 bp, Homo sapiens
gtatattctcccgtgcaata

SEQ ID NO: 29837 - DNA, 25 bp, Homo sapiens
actcatatatagaaaatgtgcaata

SEQ ID NO: 29838 - DNA, 19 bp, Homo sapiens
tatttccacaggtacaata

SEQ ID NO: 29839 - DNA, 19 bp, Homo sapiens
acttttatatttttacata

SEQ ID NO: 29840 - DNA, 19 bp, Homo sapiens
catatatcttttatgtaca

SEQ ID NO: 29841 - DNA, 18 bp, Homo sapiens
gtatgttcaacatacaat

SEQ ID NO: 29842 - DNA, 20 bp, Homo sapiens
cgtgtatcctatgtacaata

SEQ ID NO: 29843 - DNA, 24 bp, Homo sapiens
actcgttattttcactttgcaata

SEQ ID NO: 29844 - DNA, 63 bp, Rabbit fibroma virus
gacgtacttgtctatcttaaacacgataccgtagccacccgtggagatatgataaaagtcgtc

SEQ ID NO: 29845 - DNA, 19 bp, Rabbit fibroma virus
agatatgataaaagtcgtc

SEQ ID NO: 29846 - DNA, 18 bp, Homo sapiens
agatacatccaaagtcgt

SEQ ID NO: 29847 - DNA, 19 bp, Homo sapiens
agatatgactacagctgtc

SEQ ID NO: 29848 - DNA, 18 bp, Homo sapiens
agatatgacatccaagtc

SEQ ID NO: 29849 - DNA, 17 bp, Homo sapiens
aatatgataaatgtgtc

SEQ ID NO: 29850 - DNA, 18 bp, Homo sapiens
agaataaataaagtcgtc

SEQ ID NO: 29851 - DNA, 18 bp, Homo sapiens
aaatagacaaaagtcgtc

SEQ ID NO: 29852 - DNA, 17 bp, Homo sapiens
gatgtgataaaagggtc

SEQ ID NO: 29853 - DNA, 18 bp, Homo sapiens
gacattgataaaagttgt

SEQ ID NO: 29854 - DNA, 18 bp, Homo sapiens
gatgtcgactaagtcgtc

SEQ ID NO: 29855 - DNA, 17 bp, Homo sapiens
agatatgaaaagtacgt

SEQ ID NO: 29856 - DNA, 18 bp, Homo sapiens
aaatatgataaaagaagc

SEQ ID NO: 29857 - DNA, 18 bp, Homo sapiens
gatataataacagcagtc

SEQ ID NO: 29858 - DNA, 80 bp, African swine fever virus
ggatgatatcacgcatttctaaaataatatagggttctaatcttttggaatctttcataactagatcggtggtaatattc

SEQ ID NO: 29859 - DNA, 24 bp, African swine fever virus
tatcacgcatttctaaaataatat

SEQ ID NO: 29860 - DNA, 17 bp, Homo sapiens
acacactaaaataatat

SEQ ID NO: 29861 - DNA, 18 bp, Homo sapiens
cgcattttaaaataatat

SEQ ID NO: 29862 - DNA, 19 bp, Homo sapiens
tcacattctaaaataatat

SEQ ID NO: 29863 - DNA, 21 bp, Homo sapiens
acaccgtatctaaaataatat

SEQ ID NO: 29864 - DNA, 80 bp, Human papillomavirus type 56
agttatatttaaagggtagcaatggtagagaaccccctccgagttctgtatatgttgctacgcctagtgggtctatgatt

SEQ ID NO: 29865 - DNA, 24 bp, Human papillomavirus type 56
tatgttgctacgcctagtgggtct

SEQ ID NO: 29866 - DNA, 17 bp, Homo sapiens
atgttgctgtgccagtc

SEQ ID NO: 29867 - DNA, 24 bp, Homo sapiens
tgctgtgtggtgtctggtgggtct

SEQ ID NO: 29868 - DNA, 19 bp, Homo sapiens
tatgttgctacagtatggt

SEQ ID NO: 29869 - DNA, 21 bp, Homo sapiens
tatgttgctatttcccttagt

SEQ ID NO: 29870 - DNA, 20 bp, Homo sapiens
tgttgttggcctgtgggtct

SEQ ID NO: 29871 - DNA, 19 bp, Homo sapiens
accaatgcctggtgggtct

SEQ ID NO: 29872 - DNA, 20 bp, Homo sapiens
tgttgctaagcagtgggtct

SEQ ID NO: 29873 - DNA, 20 bp, Homo sapiens
tgttctacgcctgcacgtct

SEQ ID NO: 29874 - DNA, 60 bp, Human papillomavirus type 56
tgttactgtagtagatactactagaagtactaacatgactattagtactgctacagaaca

SEQ ID NO: 29875 - DNA, 19 bp, Human papillomavirus type 56
ttagtactgctacagaaca

SEQ ID NO: 29876 - DNA, 19 bp, Homo sapiens
tcagaataactacagaaca

SEQ ID NO: 29877 - DNA, 19 bp, Homo sapiens
ttaataaaaacacagaaca

SEQ ID NO: 29878 - DNA, 19 bp, Homo sapiens
ttagtaattgtacaaaaca

SEQ ID NO: 29879 - DNA, 17 bp, Homo sapiens
ttagcactgataaaaca

SEQ ID NO: 29880 - DNA, 21 bp, Homo sapiens
ttagtacctcttatcacagaa

SEQ ID NO: 29881 - DNA, 18 bp, Homo sapiens
tagtcacagcacagaaca

SEQ ID NO: 29882 - DNA, 16 bp, Homo sapiens
tcaacactgcagaaca

SEQ ID NO: 29883 - DNA, 22 bp, Homo sapiens
ttagttctcacaaaacagaaca

SEQ ID NO: 29884 - DNA, 17 bp, Homo sapiens
tcagtctttacagaaca

SEQ ID NO: 29885 - DNA, 18 bp, Homo sapiens
tcagtattatacagaaca

SEQ ID NO: 29886 - DNA, 17 bp, Homo sapiens
tagcaccatatagaaca

SEQ ID NO: 29887 - DNA, 21 bp, Homo sapiens
ttagtactaattaacggaaca

SEQ ID NO: 29888 - DNA, 18 bp, Homo sapiens
tcagtactgccactaaca

SEQ ID NO: 29889 - DNA, 16 bp, Homo sapiens
ttaatactgcagaaca

SEQ ID NO: 29890 - DNA, 17 bp, Homo sapiens
tcagttaacacagaaca

SEQ ID NO: 29891 - DNA, 18 bp, Homo sapiens
gtacaaacgctacagaac

SEQ ID NO: 29892 - DNA, 18 bp, Homo sapiens
ctagtgctgccacccaca

SEQ ID NO: 29893 - DNA, 17 bp, Homo sapiens
ttaatacctgacagaac

SEQ ID NO: 29894 - DNA, 18 bp, Homo sapiens
tcagtactgccataaaca

SEQ ID NO: 29895 - DNA, 17 bp, Homo sapiens
tcagtactgagaaaaca

SEQ ID NO: 29896 - DNA, 19 bp, Homo sapiens
ttagcatcacaacagaaca

SEQ ID NO: 29897 - DNA, 77 bp, Human papillomavirus type 56
caaaattactttgtctgcagaggttatggcatatttacataatatgaatgctaacctactggaggactggaatattg

SEQ ID NO: 29898 - DNA, 24 bp, Human papillomavirus type 56
tactttgtctgcagaggttatggc

SEQ ID NO: 29899 - DNA, 20 bp, Homo sapiens
ctttatttgcaaaagagtgg

SEQ ID NO: 29900 - DNA, 19 bp, Homo sapiens
ccttgtctgcagagttctg

SEQ ID NO: 29901 - DNA, 20 bp, Homo sapiens
tactttgtccgcaggcaggc

SEQ ID NO: 29902 - DNA, 23 bp, Homo sapiens
tactttgtttcagaggggaaggc

SEQ ID NO: 29903 - DNA, 17 bp, Homo sapiens
ctttgtctgcaaggaag

SEQ ID NO: 29904 - DNA, 20 bp, Homo sapiens
ctttgtctcagaatgcaggc

SEQ ID NO: 29905 - DNA, 19 bp, Homo sapiens
tttgtctgcagcagctggc

SEQ ID NO: 29906 - DNA, 19 bp, Homo sapiens
ctttgtctgtaggcactgg

SEQ ID NO: 29907 - DNA, 19 bp, Homo sapiens
tttatctgtgaagggtggc

SEQ ID NO: 29908 - DNA, 22 bp, Homo sapiens
tactttgtttgctgatacaagg

SEQ ID NO: 29909 - DNA, 18 bp, Homo sapiens
tttgtctggaggtttagg

SEQ ID NO: 29910 - DNA, 18 bp, Homo sapiens
tttgtctgggagaggagg

SEQ ID NO: 29911 - DNA, 16 bp, Homo sapiens
tttgtctgcaaggtgg

SEQ ID NO: 29912 - DNA, 19 bp, Homo sapiens
tttggttgcaaagatgtgg

SEQ ID NO: 29913 - DNA, 18 bp, Homo sapiens
ctttgtctgcagtctggc

SEQ ID NO: 29914 - DNA, 20 bp, Homo sapiens
ccttgtctgtggggtggggc

SEQ ID NO: 29915 - DNA, 19 bp, Homo sapiens
tactttgttgcagtaatgg

SEQ ID NO: 29916 - DNA, 18 bp, Homo sapiens
ctttgtctgcggagaggt

SEQ ID NO: 29917 - DNA, 119 bp, Human papillomavirus type 56
gacatgatagacacaggatttggcgctatggactttaaggtgttgcaggaatctaaggctgaggtacctttagacattgtacaatccacctgtaaatatcctgactatttaaaaatgtc

SEQ ID NO: 29918 - DNA, 24 bp, Human papillomavirus type 56
aggtgttgcaggaatctaaggctg

SEQ ID NO: 29919 - DNA, 19 bp, Homo sapiens
aggtgttgaggggtgggct

SEQ ID NO: 29920 - DNA, 22 bp, Homo sapiens
agatgctgagagtctggggctg

SEQ ID NO: 29921 - DNA, 17 bp, Homo sapiens
ggtttgtgggcaaggct

SEQ ID NO: 29922 - DNA, 22 bp, Homo sapiens
ggtgttgcgggagctgaggctg

SEQ ID NO: 29923 - DNA, 19 bp, Homo sapiens
aggcagcaggaatttaggg

SEQ ID NO: 29924 - DNA, 131 bp, Human papillomavirus type 18
gcctgcttcacctggcagctgtgtgtattctccctctccaagtggctctattgttacctctgactcccagttgtttaataaaccatattggttacataaggcacagggtcataacaatggtgtttgctggc

SEQ ID NO: 29925 - DNA, 24 bp, Human papillomavirus type 18
cacagggtcataacaatggtgttt

SEQ ID NO: 29926 - DNA, 20 bp, Homo sapiens
cagagggttgtgacaatggt

SEQ ID NO: 29927 - DNA, 21 bp, Homo sapiens
catggtcatatgccagtgttt

SEQ ID NO: 29928 - DNA, 18 bp, Homo sapiens
cacagggttaagattagt

SEQ ID NO: 29929 - DNA, 20 bp, Homo sapiens
cacaggatcataacagtgat

SEQ ID NO: 29930 - DNA, 20 bp, Homo sapiens
cacagggtcaggcggtggtg

SEQ ID NO: 29931 - DNA, 19 bp, Homo sapiens
cagggtcaaaataatgctt

SEQ ID NO: 29932 - DNA, 16 bp, Homo sapiens
caaggtcataggtgtt

SEQ ID NO: 29933 - DNA, 20 bp, Homo sapiens
cacagggtcataccaataac

SEQ ID NO: 29934 - DNA, 20 bp, Homo sapiens
acaccttaacagtggtgttt

SEQ ID NO: 29935 - DNA, 25 bp, Homo sapiens
cacagggtcttagctcagactgttt

SEQ ID NO: 29936 - DNA, 18 bp, Homo sapiens
acaggagtcgtaatgtct

SEQ ID NO: 29937 - DNA, 19 bp, Homo sapiens
cacagggtcagatggcctt

SEQ ID NO: 29938 - DNA, 21 bp, Homo sapiens
gggtcataatgtattatgttt

SEQ ID NO: 29939 - DNA, 16 bp, Homo sapiens
cacaggtcatggcatt

SEQ ID NO: 29940 - DNA, 26 bp, Homo sapiens
cacagggctcatgggtgcaggtgttt

SEQ ID NO: 29941 - DNA, 18 bp, Homo sapiens
gtgcacacgatggtgttt

SEQ ID NO: 29942 - DNA, 16 bp, Homo sapiens
cacagggtcatggtgt

SEQ ID NO: 29943 - DNA, 19 bp, Homo sapiens
cacagggtcagagcagtgc

SEQ ID NO: 29944 - DNA, 61 bp, Meleagrid herpesvirus 1
cgtgactcggtgctggcgcgtctcttccgggtcctttctgatcgcgccgggtccgtgtgcg

SEQ ID NO: 29945 - DNA, 23 bp, Meleagrid herpesvirus 1
tgatcgcgccgggtccgtgtgcg

SEQ ID NO: 29946 - DNA, 21 bp, Homo sapiens
tgatgtgcgtgtgcgtgtgcg

SEQ ID NO: 29947 - DNA, 21 bp, Homo sapiens
tgaccgcgccgggtggatgcg

SEQ ID NO: 29948 - DNA, 18 bp, Homo sapiens
tgatcacgtgtgtgtgtg

SEQ ID NO: 29949 - DNA, 28 bp, Homo sapiens
tgatggtgccgggtctccagcgcacacg

SEQ ID NO: 29950 - DNA, 69 bp, Meleagrid herpesvirus 1
cgtttcgcttcgactctgccggtccgctggtgccgacgatcgccgggaccggcactttcgcggcggacg

SEQ ID NO: 29951 - DNA, 24 bp, Meleagrid herpesvirus 1
tcgcttcgactctgccggtccgct

SEQ ID NO: 29952 - DNA, 20 bp, Homo sapiens
tcgtcttgactctgccagcc

SEQ ID NO: 29953 - DNA, 18 bp, Homo sapiens
gctctctgccggtttgct

SEQ ID NO: 29954 - DNA, 67 bp, Human papillomavirus type 18
gtgtacgtgccaggaagtaatatgtgtgtgtgtatatatatatacatctattgttgtgtttgtatgt

SEQ ID NO: 29955 - DNA, 24 bp, Human papillomavirus type 18
aggaagtaatatgtgtgtgtgtat

SEQ ID NO: 29956 - DNA, 21 bp, Homo sapiens
ggagagaatgtgtgtgtgtgt

SEQ ID NO: 29957 - DNA, 23 bp, Homo sapiens
ggaggcgagtggtgtgtgtgtgt

SEQ ID NO: 29958 - DNA, 22 bp, Homo sapiens
aggaattgatatgtgtgtgtgt

SEQ ID NO: 29959 - DNA, 21 bp, Homo sapiens
agaaggtttgtgtgtgtgtgt

SEQ ID NO: 29960 - DNA, 19 bp, Homo sapiens
agtgagtgtgtgtgtgtgt

SEQ ID NO: 29961 - DNA, 21 bp, Homo sapiens
agaaagagtgtgtgtgtgtgt

SEQ ID NO: 29962 - DNA, 17 bp, Homo sapiens
agcatgtgtgtgtgtgt

SEQ ID NO: 29963 - DNA, 20 bp, Homo sapiens
gtgtgtatgtgtgtgtgtat

SEQ ID NO: 29964 - DNA, 18 bp, Homo sapiens
gtgtgtatgtgtgtgtgt

SEQ ID NO: 29965 - DNA, 20 bp, Homo sapiens
agaaaaatgtgtgtgtgtgt

SEQ ID NO: 29966 - DNA, 24 bp, Homo sapiens
agaagagtgtgtatgtgtgtgtgt

SEQ ID NO: 29967 - DNA, 24 bp, Homo sapiens
aggaagggatttttgtgtgtgtgt

SEQ ID NO: 29968 - DNA, 20 bp, Homo sapiens
aggaattagtgtgtgtttgc

SEQ ID NO: 29969 - DNA, 22 bp, Homo sapiens
ggcgcgcctggtgtgtgtgtgt

SEQ ID NO: 29970 - DNA, 19 bp, Homo sapiens
gggaggggtgtgtgtgtgt

SEQ ID NO: 29971 - DNA, 19 bp, Homo sapiens
agcatatccgtgtgtgtgt

SEQ ID NO: 29972 - DNA, 18 bp, Homo sapiens
aagtgtatgtgtgtgtgt

SEQ ID NO: 29973 - DNA, 21 bp, Homo sapiens
agggtgagtttgtgtgtgtgt

SEQ ID NO: 29974 - DNA, 25 bp, Homo sapiens
gaaagcaggatgtatgtgtgtgtgt

SEQ ID NO: 29975 - DNA, 20 bp, Homo sapiens
gaagttttgtgtgtgtgtgt

SEQ ID NO: 29976 - DNA, 19 bp, Homo sapiens
aagttttgtgtgtgtgtgt

SEQ ID NO: 29977 - DNA, 20 bp, Homo sapiens
gtacatatatgtgtgtgtgt

SEQ ID NO: 29978 - DNA, 18 bp, Homo sapiens
ggaggcagctgtgtgtgt

SEQ ID NO: 29979 - DNA, 19 bp, Homo sapiens
agggtgaatgtgtgtgtgt

SEQ ID NO: 29980 - DNA, 21 bp, Homo sapiens
ggaggcagtgtgtgtgtgtgt

SEQ ID NO: 29981 - DNA, 19 bp, Homo sapiens
aagtttcgtgtgtgtgtgt

SEQ ID NO: 29982 - DNA, 20 bp, Homo sapiens
agcaaaaactgtgtgtgtgt

SEQ ID NO: 29983 - DNA, 18 bp, Homo sapiens
aagtttgtgtgtgtgtgt

SEQ ID NO: 29984 - DNA, 17 bp, Homo sapiens
ggtgtgtgtgtgtgtgt

SEQ ID NO: 29985 - DNA, 22 bp, Homo sapiens
aggacggtgtgtgtgtgtgtgt

SEQ ID NO: 29986 - DNA, 22 bp, Homo sapiens
aagtatgtatgtgtgtgtgtat

SEQ ID NO: 29987 - DNA, 18 bp, Homo sapiens
gtgtgcatgtgtgtgtgt

SEQ ID NO: 29988 - DNA, 20 bp, Homo sapiens
ggctgtgtgtgtgtgtgtat

SEQ ID NO: 29989 - DNA, 18 bp, Homo sapiens
ggatgtgtgtgtgtgtgt

SEQ ID NO: 29990 - DNA, 22 bp, Homo sapiens
agatatacatatgtgtgtgtgt

SEQ ID NO: 29991 - DNA, 19 bp, Homo sapiens
agcaggggtgtgtgtgtgt

SEQ ID NO: 29992 - DNA, 18 bp, Homo sapiens
gggtgtgtgtgtgtgtgt

SEQ ID NO: 29993 - DNA, 19 bp, Homo sapiens
agagtgtgtgtgtgtgtgt

SEQ ID NO: 29994 - DNA, 22 bp, Homo sapiens
agaaaaacatatgtgtgtgtgt

SEQ ID NO: 29995 - DNA, 23 bp, Homo sapiens
ggtgcgtgtgtatgtgtgtgtgt

SEQ ID NO: 29996 - DNA, 26 bp, Homo sapiens
aggtgtatatgtatgtgtgtgtgtat

SEQ ID NO: 29997 - DNA, 20 bp, Homo sapiens
agcaatatttgtgtgtgtgt

SEQ ID NO: 29998 - DNA, 16 bp, Homo sapiens
aggaagtgtgtgtggt

SEQ ID NO: 29999 - DNA, 19 bp, Homo sapiens
agggtctctgtgtgtgtgt

SEQ ID NO: 30000 - DNA, 22 bp, Homo sapiens
gtatatgtatgtgtgtgtgtat

SEQ ID NO: 30001 - DNA, 20 bp, Homo sapiens
gagagcctgtgtgtgtgtgt

SEQ ID NO: 30002 - DNA, 20 bp, Homo sapiens
gggggtgtgtgtgtgtgtgt

SEQ ID NO: 30003 - DNA, 18 bp, Homo sapiens
gggggtgtgtgtgtgtgt

SEQ ID NO: 30004 - DNA, 22 bp, Homo sapiens
gtctgtctatgtgtgtgtgtat

SEQ ID NO: 30005 - DNA, 19 bp, Homo sapiens
agggtgtatgtgtgtgtgt

SEQ ID NO: 30006 - DNA, 20 bp, Homo sapiens
gaaattgtgtgtgtgtgtgt

SEQ ID NO: 30007 - DNA, 20 bp, Homo sapiens
agaagggcgtgtgtgtgtgt

SEQ ID NO: 30008 - DNA, 20 bp, Homo sapiens
aggaagccatgcgtgtgtgt

SEQ ID NO: 30009 - DNA, 18 bp, Homo sapiens
ggctgtgtgtgtgtgtgt

SEQ ID NO: 30010 - DNA, 20 bp, Homo sapiens
ggacgtgcgtgtgtgtgtgt

SEQ ID NO: 30011 - DNA, 21 bp, Homo sapiens
aggggcgtgagatgtgtgtgt

SEQ ID NO: 30012 - DNA, 20 bp, Homo sapiens
ggacacaggtgtgtgtgtgt

SEQ ID NO: 30013 - DNA, 18 bp, Homo sapiens
gcgtgcatgtgtgtgtgt

SEQ ID NO: 30014 - DNA, 24 bp, Homo sapiens
gggagatggggtatgtgtgtgtgt

SEQ ID NO: 30015 - DNA, 21 bp, Homo sapiens
aggaaaaatttgtgtgtgtgt

SEQ ID NO: 30016 - DNA, 19 bp, Homo sapiens
agtagacacctgtgtgtgt

SEQ ID NO: 30017 - DNA, 18 bp, Homo sapiens
gggggcagtgtgtgtgta

SEQ ID NO: 30018 - DNA, 20 bp, Homo sapiens
aggggcgtgtgtgtgtgtgt

SEQ ID NO: 30019 - DNA, 19 bp, Homo sapiens
aggaaatacgtgtgtgtat

SEQ ID NO: 30020 - DNA, 19 bp, Homo sapiens
agaaagtgtgtgtgtgtgt

SEQ ID NO: 30021 - DNA, 19 bp, Homo sapiens
ggcacatttgtgtgtgtgt

SEQ ID NO: 30022 - DNA, 21 bp, Homo sapiens
agcaagaatgtgtgtgtgtgt

SEQ ID NO: 30023 - DNA, 22 bp, Homo sapiens
gggagtgtgcacgtgtgtgtgt

SEQ ID NO: 30024 - DNA, 19 bp, Homo sapiens
agaagtaatgtggtttgta

SEQ ID NO: 30025 - DNA, 19 bp, Homo sapiens
aggaaatatgtgtgtgtgt

SEQ ID NO: 30026 - DNA, 21 bp, Homo sapiens
ggtttgtgtatgtgtgtgtgt

SEQ ID NO: 30027 - DNA, 21 bp, Homo sapiens
aggagcatgtcgtgtgtgtgt

SEQ ID NO: 30028 - DNA, 18 bp, Homo sapiens
gagagtgtgtgtgtgtgt

SEQ ID NO: 30029 - DNA, 22 bp, Homo sapiens
aggagtatgtgcgtgtgtgtat

SEQ ID NO: 30030 - DNA, 16 bp, Homo sapiens
agaagcatgtgtgtgt

SEQ ID NO: 30031 - DNA, 18 bp, Homo sapiens
aggtaggtgtgtgtgtgt

SEQ ID NO: 30032 - DNA, 20 bp, Homo sapiens
gagtatgcgagtgtgtgtgt

SEQ ID NO: 30033 - DNA, 26 bp, Homo sapiens
aggtgatatgactaatgtgtgtgtgt

SEQ ID NO: 30034 - DNA, 19 bp, Homo sapiens
gactaatgtgtgtgtgtgt

SEQ ID NO: 30035 - DNA, 20 bp, Homo sapiens
agggggttgtgtgtgtgtat

SEQ ID NO: 30036 - DNA, 18 bp, Homo sapiens
aggggtgtgtgtgtgtgt

SEQ ID NO: 30037 - DNA, 22 bp, Homo sapiens
agcagtgattttgtgtgtgtgt

SEQ ID NO: 30038 - DNA, 21 bp, Homo sapiens
agggagtgtatgtgagtgtgt

SEQ ID NO: 30039 - DNA, 20 bp, Homo sapiens
gactgcatgtgtgtgtgtat

SEQ ID NO: 30040 - DNA, 19 bp, Homo sapiens
gtatatagtgtgtgtgtgt

SEQ ID NO: 30041 - DNA, 21 bp, Homo sapiens
aggagacagccgtgtgtgtgt

SEQ ID NO: 30042 - DNA, 20 bp, Homo sapiens
gtctctgtgtgtgtgtgtat

SEQ ID NO: 30043 - DNA, 20 bp, Homo sapiens
agaagcgtgtgtgtgtgtgt

SEQ ID NO: 30044 - DNA, 18 bp, Homo sapiens
gggagggtgtgtgtgtgt

SEQ ID NO: 30045 - DNA, 19 bp, Homo sapiens
gagccctctgtgtgtgtgt

SEQ ID NO: 30046 - DNA, 18 bp, Homo sapiens
gaaagtgtgtgtgtgtgt

SEQ ID NO: 30047 - DNA, 24 bp, Homo sapiens
aggtagaattgcatgtgtgtgtgt

SEQ ID NO: 30048 - DNA, 17 bp, Homo sapiens
gtgtatgtgtgtgtgta

SEQ ID NO: 30049 - DNA, 21 bp, Homo sapiens
agagagagattgtgtgtgtgt

SEQ ID NO: 30050 - DNA, 20 bp, Homo sapiens
aggagtgagtgtgtgtgtgt

SEQ ID NO: 30051 - DNA, 18 bp, Homo sapiens
ggtcgtgtgtgtgtgtgt

SEQ ID NO: 30052 - DNA, 21 bp, Homo sapiens
agagagactctgtgtgtgtgt

SEQ ID NO: 30053 - DNA, 19 bp, Homo sapiens
ggcaggtgtgtgtgtgtgt

SEQ ID NO: 30054 - DNA, 18 bp, Homo sapiens
gtatgtatgtgtgtgtgt

SEQ ID NO: 30055 - DNA, 20 bp, Homo sapiens
gtatatatatgtgtgtgtgt

SEQ ID NO: 30056 - DNA, 17 bp, Homo sapiens
gtatatgtgtgtgtgta

SEQ ID NO: 30057 - DNA, 18 bp, Homo sapiens
agaggtgtgtgtgtgtgt

SEQ ID NO: 30058 - DNA, 18 bp, Homo sapiens
agcttgtgtgtgtgtgta

SEQ ID NO: 30059 - DNA, 21 bp, Homo sapiens
gaaaggtgtgtgtgtgtgtgt

SEQ ID NO: 30060 - DNA, 22 bp, Homo sapiens
aagaaattatgtgtgtgtgtat

SEQ ID NO: 30061 - DNA, 18 bp, Homo sapiens
gggagagtgtgtgtgtgt

SEQ ID NO: 30062 - DNA, 20 bp, Homo sapiens
gaaagggtgtgtgtgtgtgt

SEQ ID NO: 30063 - DNA, 18 bp, Homo sapiens
gggggtttgtgtgtgtgt

SEQ ID NO: 30064 - DNA, 23 bp, Homo sapiens
ggcgtgtatatatgtgtgtgtgt

SEQ ID NO: 30065 - DNA, 17 bp, Homo sapiens
agagtgtgtgtgtgtgt

SEQ ID NO: 30066 - DNA, 20 bp, Homo sapiens
gggtgtgtatgtgtgtgtgt

SEQ ID NO: 30067 - DNA, 21 bp, Homo sapiens
ggggtaggggtgtgtgtgtgt

SEQ ID NO: 30068 - DNA, 24 bp, Homo sapiens
gaaaactgtgatatgtgtgtgtgt

SEQ ID NO: 30069 - DNA, 24 bp, Homo sapiens
agctatatatatgtgtgtgtgtat

SEQ ID NO: 30070 - DNA, 23 bp, Homo sapiens
aggaagggaactcttgtgtgtat

SEQ ID NO: 30071 - DNA, 22 bp, Homo sapiens
ggatgagtctgtgtgtgtgtgt

SEQ ID NO: 30072 - DNA, 18 bp, Homo sapiens
gaagctctgtgtgtgtgt

SEQ ID NO: 30073 - DNA, 17 bp, Homo sapiens
aagctctgtgtgtgtgt

SEQ ID NO: 30074 - DNA, 22 bp, Homo sapiens
aggagtgcgagtgtgtgtgtgt

SEQ ID NO: 30075 - DNA, 22 bp, Homo sapiens
agggtgtgatgtgtgtgcatgt

SEQ ID NO: 30076 - DNA, 18 bp, Homo sapiens
gcaagtgtgtgtgtgtgt

SEQ ID NO: 30077 - DNA, 17 bp, Homo sapiens
aggaagggtgtgtgtgt

SEQ ID NO: 30078 - DNA, 22 bp, Homo sapiens
ggattgcagtgcgtgtgtgtgt

SEQ ID NO: 30079 - DNA, 18 bp, Homo sapiens
gtatatatgtgtgtgtgt

SEQ ID NO: 30080 - DNA, 18 bp, Homo sapiens
gggtctgtgtgtgtgtgt

SEQ ID NO: 30081 - DNA, 22 bp, Homo sapiens
ggagggtaagggctgtgtgtgt

SEQ ID NO: 30082 - DNA, 21 bp, Homo sapiens
agggagtgtgtgtgtgtgtgt

SEQ ID NO: 30083 - DNA, 19 bp, Homo sapiens
agggagtgtgtgtgtgtgt

SEQ ID NO: 30084 - DNA, 15 bp, Homo sapiens
aggaagtgtgtgtgt

SEQ ID NO: 30085 - DNA, 21 bp, Homo sapiens
agggtgtgtgagtgtgtgtgt

SEQ ID NO: 30086 - DNA, 17 bp, Homo sapiens
agaagatgtgtgtgtgt

SEQ ID NO: 30087 - DNA, 19 bp, Homo sapiens
gaagagtgtgtgtgtgtgt

SEQ ID NO: 30088 - DNA, 18 bp, Homo sapiens
gggagtgattgtgtgtgt

SEQ ID NO: 30089 - DNA, 18 bp, Homo sapiens
gagcaggtgtgtgtgtgt

SEQ ID NO: 30090 - DNA, 20 bp, Homo sapiens
ggggcattgtgtgtgtgtgt

SEQ ID NO: 30091 - DNA, 18 bp, Homo sapiens
aagtaggtgtgtgtgtgt

SEQ ID NO: 30092 - DNA, 20 bp, Homo sapiens
aggaagtaaatgaattgtgt

SEQ ID NO: 30093 - DNA, 20 bp, Homo sapiens
agcagtgcttgtgtgtgtgt

SEQ ID NO: 30094 - DNA, 19 bp, Homo sapiens
ggggtgtgtgtgtgtgtat

SEQ ID NO: 30095 - DNA, 20 bp, Homo sapiens
gtatctatgtgtgtgtgtat

SEQ ID NO: 30096 - DNA, 20 bp, Homo sapiens
gtatgtatgtgtgtgtgtat

SEQ ID NO: 30097 - DNA, 22 bp, Homo sapiens
gtatatatatgtgtgtgtgtat

SEQ ID NO: 30098 - DNA, 18 bp, Homo sapiens
gagagtatgtgtgtgtgt

SEQ ID NO: 30099 - DNA, 20 bp, Homo sapiens
agtaatatgtgtgtgtgtat

SEQ ID NO: 30100 - DNA, 21 bp, Homo sapiens
ggaagggatgtgtgtctgtgt

SEQ ID NO: 30101 - DNA, 26 bp, Homo sapiens
ggaatgtgatgtgcacctctgtgtgt

SEQ ID NO: 30102 - DNA, 21 bp, Homo sapiens
agtgagtgagtgtgtgtgtgt

SEQ ID NO: 30103 - DNA, 23 bp, Homo sapiens
ggaaattagtggtgtgtgtgtgt

SEQ ID NO: 30104 - DNA, 69 bp, Gallid herpesvirus 3
agtgcgtgcttcagacccgcggacccgggcaacttgtacccggccccgagcgtctctgtgcaacgcact

SEQ ID NO: 30105 - DNA, 24 bp, Gallid herpesvirus 3
gccccgagcgtctctgtgcaacgc

SEQ ID NO: 30106 - DNA, 19 bp, Homo sapiens
gccccgagttccggcagcg

SEQ ID NO: 30107 - DNA, 18 bp, Homo sapiens
ccggagcgtctccggtgc

SEQ ID NO: 30108 - DNA, 24 bp, Homo sapiens
gcacccacacaagtttctgtgcaa

SEQ ID NO: 30109 - DNA, 20 bp, Homo sapiens
gccccgagctctggaagtgc

SEQ ID NO: 30110 - DNA, 19 bp, Homo sapiens
cccgggctctgcgcggcgc

SEQ ID NO: 30111 - DNA, 20 bp, Homo sapiens
gccccgagtgtccgcagcgc

SEQ ID NO: 30112 - DNA, 24 bp, Homo sapiens
gcctgagcgtctctgtcactcggc

SEQ ID NO: 30113 - DNA, 24 bp, Homo sapiens
gcccattcatgctctgtgcaatgc

SEQ ID NO: 30114 - DNA, 21 bp, Homo sapiens
gccccgagtgcctttcatatg

SEQ ID NO: 30115 - DNA, 18 bp, Homo sapiens
agaatttctgtgcaacgc

SEQ ID NO: 30116 - DNA, 18 bp, Homo sapiens
gcctcagcgtctctgcgc

SEQ ID NO: 30117 - DNA, 18 bp, Homo sapiens
gccccagtgtctccgcgc

SEQ ID NO: 30118 - DNA, 22 bp, Homo sapiens
gcctggggcgtctctgcctagc

SEQ ID NO: 30119 - DNA, 19 bp, Homo sapiens
gccctgagtgttctgatgc

SEQ ID NO: 30120 - DNA, 19 bp, Homo sapiens
gccccgggggtgcgcaacg

SEQ ID NO: 30121 - DNA, 22 bp, Homo sapiens
cccgggcgcctcctcgcagcgc

SEQ ID NO: 30122 - DNA, 17 bp, Homo sapiens
cccgggcgcctccggca

SEQ ID NO: 30123 - DNA, 22 bp, Homo sapiens
gcccttgagtgccgtgcaatgc

SEQ ID NO: 30124 - DNA, 23 bp, Homo sapiens
gcctttgctagtctgtgcagcgc

SEQ ID NO: 30125 - DNA, 20 bp, Homo sapiens
gcctcggcgtccctcggcgc

SEQ ID NO: 30126 - DNA, 18 bp, Homo sapiens
gcctccggcggtgcaacg

SEQ ID NO: 30127 - DNA, 21 bp, Homo sapiens
gccttcgggcgcctgtggtgc

SEQ ID NO: 30128 - DNA, 18 bp, Homo sapiens
gctccagcgtctctctgc

SEQ ID NO: 30129 - DNA, 24 bp, Homo sapiens
gctctgtagcgttctgcgcaatgc

SEQ ID NO: 30130 - DNA, 21 bp, Homo sapiens
gcctcctcctctgtgcagtgc

SEQ ID NO: 30131 - DNA, 19 bp, Homo sapiens
gccccgaacgattgcaacg

SEQ ID NO: 30132 - DNA, 19 bp, Homo sapiens
gctccgggcatctctgagc

SEQ ID NO: 30133 - DNA, 18 bp, Homo sapiens
gcccccagagtgtgcaag

SEQ ID NO: 30134 - DNA, 16 bp, Homo sapiens
ccccggcgtctgatgc

SEQ ID NO: 30135 - DNA, 18 bp, Homo sapiens
gccccatgcatctgtgtg

SEQ ID NO: 30136 - DNA, 21 bp, Homo sapiens
ccccgagcgccacgtgcagcg

SEQ ID NO: 30137 - DNA, 20 bp, Homo sapiens
cccgagcgccgtcgcagcgc

SEQ ID NO: 30138 - DNA, 18 bp, Homo sapiens
gccccgagggtccggcgc

SEQ ID NO: 30139 - DNA, 17 bp, Homo sapiens
ccccgggcgtccccggc

SEQ ID NO: 30140 - DNA, 20 bp, Homo sapiens
gccccgagcctcggcagcgc

SEQ ID NO: 30141 - DNA, 18 bp, Homo sapiens
gccccgggcctctctgcg

SEQ ID NO: 30142 - DNA, 23 bp, Homo sapiens
gcaccgagcgtccgggggcgacg

SEQ ID NO: 30143 - DNA, 62 bp, Lumpy skin disease virus
taatataatcctaattcatcttttttatcgtataaaaattctatagcataggttttatattg

SEQ ID NO: 30144 - DNA, 19 bp, Lumpy skin disease virus
tagcataggttttatattg

SEQ ID NO: 30145 - DNA, 18 bp, Homo sapiens
gcatagacctcagtattg

SEQ ID NO: 30146 - DNA, 16 bp, Homo sapiens
cagcataggaatattg

SEQ ID NO: 30147 - DNA, 19 bp, Homo sapiens
cagcactggttttatgttg

SEQ ID NO: 30148 - DNA, 87 bp, Lumpy skin disease virus
tgttgatataaactatcacataaactaaagtcattaataaaaattttttctgccaatgattcactaaacaaatagtttatattttta

SEQ ID NO: 30149 - DNA, 24 bp, Lumpy skin disease virus
tgatataaactatcacataaacta

SEQ ID NO: 30150 - DNA, 19 bp, Homo sapiens
tggtataaactgttcacat

SEQ ID NO: 30151 - DNA, 18 bp, Homo sapiens
atataaactagacaaact

SEQ ID NO: 30152 - DNA, 24 bp, Homo sapiens
tgatatgatcatatccataaacta

SEQ ID NO: 30153 - DNA, 69 bp, Molluscum contagiosum virus
cgcgaactacgagcgcacagcaagcttgacgacgtggcggacagcttccacatggcactcgagtacgcg

SEQ ID NO: 30154 - DNA, 19 bp, Molluscum contagiosum virus
catggcactcgagtacgcg

SEQ ID NO: 30155 - DNA, 16 bp, Homo sapiens
catgtcactcaaggcg

SEQ ID NO: 30156 - DNA, 17 bp, Homo sapiens
catgacacagacacacg

SEQ ID NO: 30157 - DNA, 17 bp, Homo sapiens
catggcactgcacagcg

SEQ ID NO: 30158 - DNA, 17 bp, Homo sapiens
atgggctaaaatacgcg

SEQ ID NO: 30159 - DNA, 22 bp, Homo sapiens
catggcacgtggccacaccgcg

SEQ ID NO: 30160 - DNA, 79 bp, Meleagrid herpesvirus 1
caatgtatgacgaatactgcgttcaagggttttgtttttattgtgctcactgctgcagaagatattgttaagagcattg

SEQ ID NO: 30161 - DNA, 24 bp, Meleagrid herpesvirus 1
tatgacgaatactgcgttcaaggg

SEQ ID NO: 30162 - DNA, 17 bp, Homo sapiens
gaatactgcaggaaggg

SEQ ID NO: 30163 - DNA, 20 bp, Homo sapiens
tatgacgaatgttcgtaaag

SEQ ID NO: 30164 - DNA, 22 bp, Homo sapiens
tatgacgaggcggcgtttaggg

SEQ ID NO: 30165 - DNA, 21 bp, Homo sapiens
tatgacaatacatattaaggg

SEQ ID NO: 30166 - DNA, 20 bp, Homo sapiens
tggcaaataccagacaaggg

SEQ ID NO: 30167 - DNA, 22 bp, Homo sapiens
tatgataaatgttgtccaaggg

SEQ ID NO: 30168 - DNA, 77 bp, Meleagrid herpesvirus 1
ctggctttattcaggcccagagaccatttggattttgcgttatgcttactcgtggcctttttggaaaatagagttgg

SEQ ID NO: 30169 - DNA, 24 bp, Meleagrid herpesvirus 1
ctttattcaggcccagagaccatt

SEQ ID NO: 30170 - DNA, 17 bp, Homo sapiens
tttattcagcccagacc

SEQ ID NO: 30171 - DNA, 18 bp, Homo sapiens
ttcagcccagaggtcatt

SEQ ID NO: 30172 - DNA, 20 bp, Homo sapiens
ctttattccaagggccagag

SEQ ID NO: 30173 - DNA, 24 bp, Homo sapiens
ttcattcaggttatgcagaccatt

SEQ ID NO: 30174 - DNA, 19 bp, Homo sapiens
tttgttcaggcctgaagcc

SEQ ID NO: 30175 - DNA, 80 bp, Meleagrid herpesvirus 1
tgaatgggacatggagtatgtgtgcaaatgtgataagagctatatatctccaggatgtaccatcgactatgtcgcaagca

SEQ ID NO: 30176 - DNA, 24 bp, Meleagrid herpesvirus 1
tctccaggatgtaccatcgactat

SEQ ID NO: 30177 - DNA, 24 bp, Homo sapiens
tctccagggatgtacaggggctat

SEQ ID NO: 30178 - DNA, 20 bp, Homo sapiens
caagatgttttattgactat

SEQ ID NO: 30179 - DNA, 24 bp, Homo sapiens
tctccaggaagtactgcaggaact

SEQ ID NO: 30180 - DNA, 21 bp, Homo sapiens
tccaggatgtgcatagctact

SEQ ID NO: 30181 - DNA, 23 bp, Homo sapiens
tctccaggattgtccatcgctat

SEQ ID NO: 30182 - DNA, 99 bp, Human papillomavirus type 6
accccaagcggctctttggtgtcctctgaggcacaattgtttaataagccatattggctacaaaaagcccagggacataacaatggtatttgttggggt

SEQ ID NO: 30183 - DNA, 24 bp, Human papillomavirus type 6
tctttggtgtcctctgaggcacaa

SEQ ID NO: 30184 - DNA, 23 bp, Homo sapiens
tctttggtgatttcttccaatga

SEQ ID NO: 30185 - DNA, 20 bp, Homo sapiens
tctttgatgttcttctttca

SEQ ID NO: 30186 - DNA, 15 bp, Homo sapiens
tctttggcactgagg

SEQ ID NO: 30187 - DNA, 16 bp, Homo sapiens
tctctggtgtctggca

SEQ ID NO: 30188 - DNA, 17 bp, Homo sapiens
tcgtttggtgttccgca

SEQ ID NO: 30189 - DNA, 25 bp, Homo sapiens
tctttggtcttctctggtccctgca

SEQ ID NO: 30190 - DNA, 16 bp, Homo sapiens
tctgtggtgtaggcac

SEQ ID NO: 30191 - DNA, 22 bp, Homo sapiens
tctttggttgttttctttttca

SEQ ID NO: 30192 - DNA, 21 bp, Homo sapiens
tctctggtgttctcaggcaca

SEQ ID NO: 30193 - DNA, 21 bp, Homo sapiens
tctctggtgttctggggcaca

SEQ ID NO: 30194 - DNA, 17 bp, Homo sapiens
tctttggtgtctcatgg

SEQ ID NO: 30195 - DNA, 17 bp, Homo sapiens
tctttgtgttttctaag

SEQ ID NO: 30196 - DNA, 20 bp, Homo sapiens
tctttggctgttttcctctg

SEQ ID NO: 30197 - DNA, 18 bp, Homo sapiens
tctttggtgttctaaaca

SEQ ID NO: 30198 - DNA, 18 bp, Homo sapiens
cttttgctctgaggcaca

SEQ ID NO: 30199 - DNA, 19 bp, Homo sapiens
tttggtgttttcgaatgca

SEQ ID NO: 30200 - DNA, 20 bp, Homo sapiens
tctttggtgccttcctaaca

SEQ ID NO: 30201 - DNA, 18 bp, Homo sapiens
tctttggtttctttggac

SEQ ID NO: 30202 - DNA, 18 bp, Homo sapiens
tctttggtgccctcatag

SEQ ID NO: 30203 - DNA, 20 bp, Homo sapiens
ctttggtgttttctctgcgg

SEQ ID NO: 30204 - DNA, 26 bp, Homo sapiens
tctctggtgttcttttatatccacaa

SEQ ID NO: 30205 - DNA, 21 bp, Homo sapiens
tctttggttctgggaagtgca

SEQ ID NO: 30206 - DNA, 18 bp, Homo sapiens
tctttggtgttccttggc

SEQ ID NO: 30207 - DNA, 21 bp, Homo sapiens
tctttggcttatggggcacaa

SEQ ID NO: 30208 - DNA, 20 bp, Homo sapiens
tctttggtggtcttcccaca

SEQ ID NO: 30209 - DNA, 20 bp, Homo sapiens
tctttggtgtcctagtacaa

SEQ ID NO: 30210 - DNA, 21 bp, Homo sapiens
ctcttaactctctgaggcgca

SEQ ID NO: 30211 - DNA, 18 bp, Homo sapiens
tctttgatgtccttttga

SEQ ID NO: 30212 - DNA, 19 bp, Homo sapiens
tctctgaagttttgaggca

SEQ ID NO: 30213 - DNA, 21 bp, Homo sapiens
tctggaatcctctggggcaca

SEQ ID NO: 30214 - DNA, 19 bp, Homo sapiens
tctttggtattttcagtga

SEQ ID NO: 30215 - DNA, 21 bp, Homo sapiens
tccttggtgtttgaagaggca

SEQ ID NO: 30216 - DNA, 16 bp, Homo sapiens
tttagctctgaggcac

SEQ ID NO: 30217 - DNA, 15 bp, Homo sapiens
cctttggtgtaggcc

SEQ ID NO: 30218 - DNA, 20 bp, Homo sapiens
tctgctgcctttctgaggca

SEQ ID NO: 30219 - DNA, 16 bp, Homo sapiens
tctggtgggaggcaca

SEQ ID NO: 30220 - DNA, 17 bp, Homo sapiens
tctttgtgtcctctgaa

SEQ ID NO: 30221 - DNA, 21 bp, Homo sapiens
tctttggtggctaaagcacaa

SEQ ID NO: 30222 - DNA, 27 bp, Homo sapiens
tccttggtgttcaaggagtgaggtaca

SEQ ID NO: 30223 - DNA, 19 bp, Homo sapiens
tctttggtggctaaagcac

SEQ ID NO: 30224 - DNA, 18 bp, Homo sapiens
ctttggtgttacctggca

SEQ ID NO: 30225 - DNA, 20 bp, Homo sapiens
tctttggcgttttcttgtca

SEQ ID NO: 30226 - DNA, 18 bp, Homo sapiens
tctttggtgtttgctgag

SEQ ID NO: 30227 - DNA, 18 bp, Homo sapiens
tctttggtgtcctgtggg

SEQ ID NO: 30228 - DNA, 19 bp, Homo sapiens
tctttgatgttgaataagg

SEQ ID NO: 30229 - DNA, 19 bp, Homo sapiens
tctctgatgtcttttgagg

SEQ ID NO: 30230 - DNA, 114 bp, Human papillomavirus type 6
atatatgtgtatatgtactgttatatatatgtgtgtatgtactgttatgtatatgtgtttatgtactgttatatgtgtgtatatatgtgtatgtgtgtatatgtatatgtatgt

SEQ ID NO: 30231 - DNA, 24 bp, Human papillomavirus type 6
tatgtgtatatgtactgttatata

SEQ ID NO: 30232 - DNA, 18 bp, Homo sapiens
tatgtgcatatgtattgt

SEQ ID NO: 30233 - DNA, 20 bp, Homo sapiens
tatgtgtatgtacatatata

SEQ ID NO: 30234 - DNA, 17 bp, Homo sapiens
tatgtgtgtatgtgtgt

SEQ ID NO: 30235 - DNA, 18 bp, Homo sapiens
atgtgtatgtgtctctgt

SEQ ID NO: 30236 - DNA, 21 bp, Homo sapiens
tgtatatatgtacactcacat

SEQ ID NO: 30237 - DNA, 17 bp, Homo sapiens
tatatgtgtatgtatgt

SEQ ID NO: 30238 - DNA, 19 bp, Homo sapiens
tgtgtgcatgtatttatat

SEQ ID NO: 30239 - DNA, 17 bp, Homo sapiens
tatgtgtgtatgcgtgt

SEQ ID NO: 30240 - DNA, 16 bp, Homo sapiens
tatgtgtgtgtctgct

SEQ ID NO: 30241 - DNA, 17 bp, Homo sapiens
tatgtatatatgtgtgt

SEQ ID NO: 30242 - DNA, 17 bp, Homo sapiens
tatatgtatatggatgt

SEQ ID NO: 30243 - DNA, 17 bp, Homo sapiens
tatatgtatatgtgtgt

SEQ ID NO: 30244 - DNA, 17 bp, Homo sapiens
tatgtatgtatgtatgt

SEQ ID NO: 30245 - DNA, 21 bp, Homo sapiens
tatgtgtaatatgtatacata

SEQ ID NO: 30246 - DNA, 17 bp, Homo sapiens
tatgtgtgtgtgactgt

SEQ ID NO: 30247 - DNA, 20 bp, Homo sapiens
tatgtgtgtgtgtgttacat

SEQ ID NO: 30248 - DNA, 23 bp, Homo sapiens
tatgtatatatatactttatata

SEQ ID NO: 30249 - DNA, 20 bp, Homo sapiens
tatgtgtatatgtatcagtt

SEQ ID NO: 30250 - DNA, 19 bp, Homo sapiens
tatgtgtatgtgtacatgt

SEQ ID NO: 30251 - DNA, 17 bp, Homo sapiens
tatgtgtatgtgtgtgt

SEQ ID NO: 30252 - DNA, 18 bp, Homo sapiens
gtgtatatatacttatat

SEQ ID NO: 30253 - DNA, 20 bp, Homo sapiens
tgctacagtgctgttatata

SEQ ID NO: 30254 - DNA, 22 bp, Homo sapiens
tatgtatatatatatttatata

SEQ ID NO: 30255 - DNA, 21 bp, Homo sapiens
tatgtatgtatgtatattata

SEQ ID NO: 30256 - DNA, 20 bp, Homo sapiens
tgtgtatatctatatctata

SEQ ID NO: 30257 - DNA, 22 bp, Homo sapiens
tgtgtatatatactcacatata

SEQ ID NO: 30258 - DNA, 17 bp, Homo sapiens
tatgtgtgcatgcatgt

SEQ ID NO: 30259 - DNA, 19 bp, Homo sapiens
tatggtatatgtgctgtca

SEQ ID NO: 30260 - DNA, 22 bp, Homo sapiens
tatgtctatgtatatttatata

SEQ ID NO: 30261 - DNA, 19 bp, Homo sapiens
tatgtgtatgtgaatctat

SEQ ID NO: 30262 - DNA, 19 bp, Homo sapiens
tatgtgtaaatgtgttcac

SEQ ID NO: 30263 - DNA, 19 bp, Homo sapiens
tgtgtgtatgtctgtgcac

SEQ ID NO: 30264 - DNA, 22 bp, Homo sapiens
tatgtgtatatatatccatata

SEQ ID NO: 30265 - DNA, 21 bp, Homo sapiens
tgtatatatgtatattacata

SEQ ID NO: 30266 - DNA, 22 bp, Homo sapiens
tgtatatatatacacacatata

SEQ ID NO: 30267 - DNA, 17 bp, Homo sapiens
catgtgtatatgtgtgt

SEQ ID NO: 30268 - DNA, 28 bp, Homo sapiens
tatgtgtatatgtgtacacttgttatat

SEQ ID NO: 30269 - DNA, 24 bp, Homo sapiens
tatatgtatgtgtatacccttata

SEQ ID NO: 30270 - DNA, 20 bp, Homo sapiens
tgtatatatgtacatatata

SEQ ID NO: 30271 - DNA, 23 bp, Homo sapiens
tatatgtatacataagttgtata

SEQ ID NO: 30272 - DNA, 17 bp, Homo sapiens
tatgtgatatgtatagt

SEQ ID NO: 30273 - DNA, 20 bp, Homo sapiens
tatgtatatgcgtttatata

SEQ ID NO: 30274 - DNA, 18 bp, Homo sapiens
tatgtgtatatgtgtgtt

SEQ ID NO: 30275 - DNA, 17 bp, Homo sapiens
tatttgtatatgtatgt

SEQ ID NO: 30276 - DNA, 22 bp, Homo sapiens
tgtatatatatacatctatata

SEQ ID NO: 30277 - DNA, 18 bp, Homo sapiens
tatgtgtatatataatat

SEQ ID NO: 30278 - DNA, 21 bp, Homo sapiens
catgtgtgtatgtacttacat

SEQ ID NO: 30279 - DNA, 19 bp, Homo sapiens
tatgtgtatgtatgcatgt

SEQ ID NO: 30280 - DNA, 22 bp, Homo sapiens
tatgtgtatatatatatttata

SEQ ID NO: 30281 - DNA, 22 bp, Homo sapiens
tatatgtatatgtatacatata

SEQ ID NO: 30282 - DNA, 21 bp, Homo sapiens
tatgtgtgtgtataattatat

SEQ ID NO: 30283 - DNA, 22 bp, Homo sapiens
tatatgtatatatatttatata

SEQ ID NO: 30284 - DNA, 17 bp, Homo sapiens
tgtgtatatattatata

SEQ ID NO: 30285 - DNA, 17 bp, Homo sapiens
tatgtgtatatgtctgt

SEQ ID NO: 30286 - DNA, 17 bp, Homo sapiens
tatgtatatgtgtatgt

SEQ ID NO: 30287 - DNA, 17 bp, Homo sapiens
tgtatatatgtatacat

SEQ ID NO: 30288 - DNA, 21 bp, Homo sapiens
tatgtgtgtatatactacata

SEQ ID NO: 30289 - DNA, 19 bp, Homo sapiens
tatgtgcatgtgtatacat

SEQ ID NO: 30290 - DNA, 22 bp, Homo sapiens
tacgtgtgtatgtgtctttata

SEQ ID NO: 30291 - DNA, 22 bp, Homo sapiens
tgtgtatatgcataaacatata

SEQ ID NO: 30292 - DNA, 17 bp, Homo sapiens
tgtatatatgcatatat

SEQ ID NO: 30293 - DNA, 17 bp, Homo sapiens
tatgtgtgtatgtatgt

SEQ ID NO: 30294 - DNA, 24 bp, Homo sapiens
tatggtatatgtattttctatata

SEQ ID NO: 30295 - DNA, 20 bp, Homo sapiens
tgtgttatatgtattatata

SEQ ID NO: 30296 - DNA, 20 bp, Homo sapiens
tgtatatatgtatacatata

SEQ ID NO: 30297 - DNA, 20 bp, Homo sapiens
tgtgttatgcttgttatata

SEQ ID NO: 30298 - DNA, 17 bp, Homo sapiens
gtgatatattgttatat

SEQ ID NO: 30299 - DNA, 18 bp, Homo sapiens
gtgcagcactgttatata

SEQ ID NO: 30300 - DNA, 73 bp, Human papillomavirus type 6
ctatttacatatgtggcactacatgtaaatatccagattatttacaaatggctgcagacccatatggtgatag

SEQ ID NO: 30301 - DNA, 24 bp, Human papillomavirus type 6
tggcactacatgtaaatatccaga

SEQ ID NO: 30302 - DNA, 23 bp, Homo sapiens
gcactacatatagagtgtccaga

SEQ ID NO: 30303 - DNA, 20 bp, Homo sapiens
tggcactagtaatgatccag

SEQ ID NO: 30304 - DNA, 17 bp, Homo sapiens
tggcctgtatgtaaata

SEQ ID NO: 30305 - DNA, 20 bp, Homo sapiens
tggtaccacatgtccaccag

SEQ ID NO: 30306 - DNA, 17 bp, Homo sapiens
tgggttacatgtaaaca

SEQ ID NO: 30307 - DNA, 22 bp, Homo sapiens
tggtgctagtcagttatccaga

SEQ ID NO: 30308 - DNA, 19 bp, Homo sapiens
tggtactcgtggcatccag

SEQ ID NO: 30309 - DNA, 20 bp, Homo sapiens
tggccacttaaaatatccag

SEQ ID NO: 30310 - DNA, 19 bp, Homo sapiens
tggcatcatccatatccag

SEQ ID NO: 30311 - DNA, 20 bp, Homo sapiens
gcactatagagtatatccag

SEQ ID NO: 30312 - DNA, 23 bp, Homo sapiens
tggcacatatagtttcatctaga

SEQ ID NO: 30313 - DNA, 18 bp, Homo sapiens
tggcactacaagtaaaca

SEQ ID NO: 30314 - DNA, 21 bp, Homo sapiens
ggcactgtggggatatccaga

SEQ ID NO: 30315 - DNA, 18 bp, Homo sapiens
tggcacacatgtaagcag

SEQ ID NO: 30316 - DNA, 22 bp, Homo sapiens
tggtataaaagcaatatccaga

SEQ ID NO: 30317 - DNA, 23 bp, Homo sapiens
tgtactacatgtggaacagtcag

SEQ ID NO: 30318 - DNA, 62 bp, Rabbit fibroma virus
caaaatggtgtttgaaaaataggtgtacaacacgtcaccgtttatcaggtacgccgagtttg

SEQ ID NO: 30319 - DNA, 24 bp, Rabbit fibroma virus
caccgtttatcaggtacgccgagt

SEQ ID NO: 30320 - DNA, 17 bp, Homo sapiens
gttttcaggtaccgaat

SEQ ID NO: 30321 - DNA, 20 bp, Homo sapiens
gtctcgcaggtgcgccgagt

SEQ ID NO: 30322 - DNA, 24 bp, Homo sapiens
caccgtttacaggctggcttgagt

SEQ ID NO: 30323 - DNA, 62 bp, Rabbit fibroma virus
tgtcgtctttatccttcaggaccatgtaattcttcaagtatggtacctttaacaagacgaca

SEQ ID NO: 30324 - DNA, 19 bp, Rabbit fibroma virus
tacctttaacaagacgaca

SEQ ID NO: 30325 - DNA, 19 bp, Homo sapiens
cacctttaacactatgaca

SEQ ID NO: 30326 - DNA, 18 bp, Homo sapiens
cacctttaatcagactga

SEQ ID NO: 30327 - DNA, 16 bp, Homo sapiens
acctaaacagacgaca

SEQ ID NO: 30328 - DNA, 16 bp, Homo sapiens
tacctttacagagaca

SEQ ID NO: 30329 - DNA, 20 bp, Homo sapiens
taccttcaacctgcacggca

SEQ ID NO: 30330 - DNA, 18 bp, Homo sapiens
tacctttaaaaaagagac

SEQ ID NO: 30331 - DNA, 18 bp, Homo sapiens
tacctttaactccagaca

SEQ ID NO: 30332 - DNA, 16 bp, Homo sapiens
taccaacaagacgaca

SEQ ID NO: 30333 - DNA, 18 bp, Homo sapiens
tacccttaatagaggaca

SEQ ID NO: 30334 - DNA, 21 bp, Homo sapiens
cacctttaatgagagttgaca

SEQ ID NO: 30335 - DNA, 65 bp, Rabbit fibroma virus
gaaacgcgagatcgatcagaaacgttctagaattagtctgtaatatgtcgatatctccatatttc

SEQ ID NO: 30336 - DNA, 24 bp, Rabbit fibroma virus
ttagtctgtaatatgtcgatatct

SEQ ID NO: 30337 - DNA, 19 bp, Homo sapiens
ttaatctgtaatattaatc

SEQ ID NO: 30338 - DNA, 23 bp, Homo sapiens
ttagtctggagtgtcagtgatat

SEQ ID NO: 30339 - DNA, 16 bp, Homo sapiens
gtctgtaatatatatc

SEQ ID NO: 30340 - DNA, 18 bp, Homo sapiens
agtctgtaatataaatat

SEQ ID NO: 30341 - DNA, 20 bp, Homo sapiens
ttagtctgtgaaaatttatc

SEQ ID NO: 30342 - DNA, 18 bp, Homo sapiens
tcagtctgtgataatgtc

SEQ ID NO: 30343 - DNA, 19 bp, Homo sapiens
gtatgtaatatgtcggtat

SEQ ID NO: 30344 - DNA, 60 bp, Myxoma virus
gacgcaaatactcctccattaacgcgtttacgttacttaccagaggggacacgttgtgtc

SEQ ID NO: 30345 - DNA, 21 bp, Myxoma virus
ccagaggggacacgttgtgtc

SEQ ID NO: 30346 - DNA, 24 bp, Homo sapiens
cagagggatgtgtgacacaacgtg

SEQ ID NO: 30347 - DNA, 20 bp, Homo sapiens
ccagagggcacgcccgcctc

SEQ ID NO: 30348 - DNA, 18 bp, Homo sapiens
gaggggacgtggcttgtc

SEQ ID NO: 30349 - DNA, 17 bp, Homo sapiens
gaggggacactccggtc

SEQ ID NO: 30350 - DNA, 17 bp, Homo sapiens
cagaagggatgtcctgc

SEQ ID NO: 30351 - DNA, 19 bp, Homo sapiens
cagagggagatgccccgtc

SEQ ID NO: 30352 - DNA, 15 bp, Homo sapiens
ccagagagggtgtgt

SEQ ID NO: 30353 - DNA, 16 bp, Homo sapiens
cagagggggcgttggc

SEQ ID NO: 30354 - DNA, 25 bp, Homo sapiens
ccagaggggctgttgacacaacgtg

SEQ ID NO: 30355 - DNA, 18 bp, Homo sapiens
ccggagggaacatcagtc

SEQ ID NO: 30356 - DNA, 20 bp, Homo sapiens
tgagaggggatacgaaggtc

SEQ ID NO: 30357 - DNA, 24 bp, Homo sapiens
ccagaggaggcatgggaaaggtgt

SEQ ID NO: 30358 - DNA, 18 bp, Homo sapiens
cagatcaagtgttgtgtc

SEQ ID NO: 30359 - DNA, 20 bp, Homo sapiens
ccagagagggcgggcttgtc

SEQ ID NO: 30360 - DNA, 19 bp, Homo sapiens
tgagaggggatgactttgt

SEQ ID NO: 30361 - DNA, 21 bp, Homo sapiens
ccagaggggagcccaccagtc

SEQ ID NO: 30362 - DNA, 24 bp, Homo sapiens
cagagggacatgcgacacaacgtg

SEQ ID NO: 30363 - DNA, 20 bp, Homo sapiens
ccagaggggtgttgcttgtc

SEQ ID NO: 30364 - DNA, 25 bp, Homo sapiens
ccagagggacagtcgacacaacgtg

SEQ ID NO: 30365 - DNA, 24 bp, Homo sapiens
cagagggggttttgacacaacgtg

SEQ ID NO: 30366 - DNA, 19 bp, Homo sapiens
caaaggggacgcttctgtc

SEQ ID NO: 30367 - DNA, 18 bp, Homo sapiens
ccaaggggacccagtgtc

SEQ ID NO: 30368 - DNA, 15 bp, Homo sapiens
ccagggggaccgtgt

SEQ ID NO: 30369 - DNA, 18 bp, Homo sapiens
gaggggacaccccccatc

SEQ ID NO: 30370 - DNA, 24 bp, Homo sapiens
cagaggggctgtcgacacaacgtg

SEQ ID NO: 30371 - DNA, 18 bp, Homo sapiens
ccggagggggcgccgcgc

SEQ ID NO: 30372 - DNA, 18 bp, Homo sapiens
gagggggtacactgtgtc

SEQ ID NO: 30373 - DNA, 20 bp, Homo sapiens
ccagagggtacagtaacgtc

SEQ ID NO: 30374 - DNA, 21 bp, Homo sapiens
ccagaggggagctgaagagtc

SEQ ID NO: 30375 - DNA, 19 bp, Homo sapiens
ccagaggggcaggcttgtc

SEQ ID NO: 30376 - DNA, 17 bp, Homo sapiens
ccagaggggccgccctg

SEQ ID NO: 30377 - DNA, 17 bp, Homo sapiens
ccagggggaacacctgc

SEQ ID NO: 30378 - DNA, 25 bp, Homo sapiens
ccaggggggtactcgacacaacgtg

SEQ ID NO: 30379 - DNA, 25 bp, Homo sapiens
ccagaggggaacttgacacaacgtg

SEQ ID NO: 30380 - DNA, 22 bp, Homo sapiens
cagagaggaaaacgtgttgtgt

SEQ ID NO: 30381 - DNA, 18 bp, Homo sapiens
cacgggggacacagcatc

SEQ ID NO: 30382 - DNA, 22 bp, Homo sapiens
ccagaggagggcagtgccatgt

SEQ ID NO: 30383 - DNA, 18 bp, Homo sapiens
ccagtggccagttgtgtc

SEQ ID NO: 30384 - DNA, 24 bp, Homo sapiens
cagagggggtggcgacacaacgtg

SEQ ID NO: 30385 - DNA, 25 bp, Homo sapiens
ccagagggatgctcgacacaacgtg

SEQ ID NO: 30386 - DNA, 18 bp, Homo sapiens
gaggggatgggctatgtc

SEQ ID NO: 30387 - DNA, 16 bp, Homo sapiens
ccagaggagacgctgt

SEQ ID NO: 30388 - DNA, 25 bp, Homo sapiens
ccagagggggtttcgacacaacgtg

SEQ ID NO: 30389 - DNA, 18 bp, Homo sapiens
ccaggggagacatacatt

SEQ ID NO: 30390 - DNA, 16 bp, Homo sapiens
cagagggggtggtgcc

SEQ ID NO: 30391 - DNA, 19 bp, Homo sapiens
ccagaggagggcacgccac

SEQ ID NO: 30392 - DNA, 20 bp, Homo sapiens
ccagagggacacctggggtc

SEQ ID NO: 30393 - DNA, 17 bp, Homo sapiens
ccagagaggagacgtgt

SEQ ID NO: 30394 - DNA, 25 bp, Homo sapiens
ccagagggggccttgacacaacgtg

SEQ ID NO: 30395 - DNA, 18 bp, Homo sapiens
ccagaggggagcagttgt

SEQ ID NO: 30396 - DNA, 21 bp, Homo sapiens
ccaggggagacatcacacatc

SEQ ID NO: 30397 - DNA, 19 bp, Homo sapiens
cagagggacacagcaggtc

SEQ ID NO: 30398 - DNA, 22 bp, Homo sapiens
ccagaggggaggagggcgtgtc

SEQ ID NO: 30399 - DNA, 25 bp, Homo sapiens
ccagaggggaattcgacacaacgtg

SEQ ID NO: 30400 - DNA, 20 bp, Homo sapiens
ccagaggggcggcagcagtc

SEQ ID NO: 30401 - DNA, 17 bp, Homo sapiens
ccagaggggaattatat

SEQ ID NO: 30402 - DNA, 15 bp, Homo sapiens
ccagagaggacgtgt

SEQ ID NO: 30403 - DNA, 25 bp, Homo sapiens
ccagaggggttgtcgacacaacgtg

SEQ ID NO: 30404 - DNA, 19 bp, Homo sapiens
cacaggggacaccggtgtc

SEQ ID NO: 30405 - DNA, 24 bp, Homo sapiens
cagagggacagttgacacaacgtg

SEQ ID NO: 30406 - DNA, 20 bp, Homo sapiens
caggggggacacacccaatc

SEQ ID NO: 30407 - DNA, 20 bp, Homo sapiens
ccagaggggaatcgccgatc

SEQ ID NO: 30408 - DNA, 16 bp, Homo sapiens
ccagaagggacactgt

SEQ ID NO: 30409 - DNA, 16 bp, Homo sapiens
agaggggaccgtgggt

SEQ ID NO: 30410 - DNA, 15 bp, Homo sapiens
cagagggggttgtgt

SEQ ID NO: 30411 - DNA, 21 bp, Homo sapiens
cagagggggcaggctagtgtc

SEQ ID NO: 30412 - DNA, 16 bp, Homo sapiens
ccagaggggaccatgt

SEQ ID NO: 30413 - DNA, 25 bp, Homo sapiens
ccaaggggggtgttgacacaacgtg

SEQ ID NO: 30414 - DNA, 25 bp, Homo sapiens
ccagagggggcctcgacacaacgtg

SEQ ID NO: 30415 - DNA, 25 bp, Homo sapiens
ccagaggggtatgtgacacaacgtg

SEQ ID NO: 30416 - DNA, 20 bp, Homo sapiens
gaggggacccaagctgtgtc

SEQ ID NO: 30417 - DNA, 21 bp, Homo sapiens
cagaggggggtgccgactgtc

SEQ ID NO: 30418 - DNA, 23 bp, Homo sapiens
ccagagggcatagagcttgtgtc

SEQ ID NO: 30419 - DNA, 18 bp, Homo sapiens
ccagggggcgcgccgcgc

SEQ ID NO: 30420 - DNA, 21 bp, Homo sapiens
ccagagggcacaagatgtgtc

SEQ ID NO: 30421 - DNA, 20 bp, Homo sapiens
cagagagggttggtggtgtc

SEQ ID NO: 30422 - DNA, 17 bp, Homo sapiens
gaggggacagccttgtc

SEQ ID NO: 30423 - DNA, 25 bp, Homo sapiens
ccagagggagtgttgacacaacgtg

SEQ ID NO: 30424 - DNA, 15 bp, Homo sapiens
ccagagggactgtgt

SEQ ID NO: 30425 - DNA, 20 bp, Homo sapiens
ccgcgggggacaccagccgt

SEQ ID NO: 30426 - DNA, 18 bp, Homo sapiens
ccagagggggtggctggc

SEQ ID NO: 30427 - DNA, 18 bp, Homo sapiens
cagaggggagcaggtgtc

SEQ ID NO: 30428 - DNA, 16 bp, Homo sapiens
ccagaggggctcgtgt

SEQ ID NO: 30429 - DNA, 19 bp, Homo sapiens
ccagaaggtgacttgtgtc

SEQ ID NO: 30430 - DNA, 22 bp, Homo sapiens
ccagaggggacagcctagctgt

SEQ ID NO: 30431 - DNA, 22 bp, Homo sapiens
ccagtggggactggtacgtgtc

SEQ ID NO: 30432 - DNA, 18 bp, Homo sapiens
ccaggggggtgccgtgtc

SEQ ID NO: 30433 - DNA, 18 bp, Homo sapiens
cagaggggactgtgtgtc

SEQ ID NO: 30434 - DNA, 15 bp, Homo sapiens
ccaggggggctgtat

SEQ ID NO: 30435 - DNA, 18 bp, Homo sapiens
ccacaggggacaggtggt

SEQ ID NO: 30436 - DNA, 19 bp, Homo sapiens
ccaggcggggcgctgcgtc

SEQ ID NO: 30437 - DNA, 18 bp, Homo sapiens
ccagagggcacacacagt

SEQ ID NO: 30438 - DNA, 15 bp, Homo sapiens
ccaggagggctgtgt

SEQ ID NO: 30439 - DNA, 25 bp, Homo sapiens
ccagagggggcttcgacacaacgtg

SEQ ID NO: 30440 - DNA, 17 bp, Homo sapiens
ccagagagggcactgcc

SEQ ID NO: 30441 - DNA, 19 bp, Homo sapiens
cagagaggacagaagctgt

SEQ ID NO: 30442 - DNA, 17 bp, Homo sapiens
ccagagggggccgcccc

SEQ ID NO: 30443 - DNA, 21 bp, Homo sapiens
ccagaggggagcagctgtgtc

SEQ ID NO: 30444 - DNA, 21 bp, Homo sapiens
ccacaggggacagctgctgtc

SEQ ID NO: 30445 - DNA, 20 bp, Homo sapiens
ccggaggggacaagcggcgt

SEQ ID NO: 30446 - DNA, 16 bp, Homo sapiens
ccagagggacacgggt

SEQ ID NO: 30447 - DNA, 16 bp, Homo sapiens
ccagaggaggctctgt

SEQ ID NO: 30448 - DNA, 15 bp, Homo sapiens
cagagaggatgtgcc

SEQ ID NO: 30449 - DNA, 16 bp, Homo sapiens
gaggggacgcggtgtc

SEQ ID NO: 30450 - DNA, 16 bp, Homo sapiens
aaagggggtgtatgtc

SEQ ID NO: 30451 - DNA, 24 bp, Homo sapiens
cagaggggtagtcgacacaacgtg

SEQ ID NO: 30452 - DNA, 16 bp, Homo sapiens
cccaggggagttgtgt

SEQ ID NO: 30453 - DNA, 23 bp, Homo sapiens
ccagagggagcaccggccctgtc

SEQ ID NO: 30454 - DNA, 16 bp, Homo sapiens
ccagagagggcgtgtg

SEQ ID NO: 30455 - DNA, 18 bp, Homo sapiens
gagggaacgccatgagtc

SEQ ID NO: 30456 - DNA, 17 bp, Homo sapiens
gaggggcacactgtgtc

SEQ ID NO: 30457 - DNA, 15 bp, Homo sapiens
ccagagggggccgtg

SEQ ID NO: 30458 - DNA, 23 bp, Homo sapiens
ccagagaggacaaatacagtgtc

SEQ ID NO: 30459 - DNA, 20 bp, Homo sapiens
ccagaggagataccctggtc

SEQ ID NO: 30460 - DNA, 22 bp, Homo sapiens
ccaagaggacaagtgttgtgtc

SEQ ID NO: 30461 - DNA, 25 bp, Homo sapiens
ccagagggtgtgtcgacacaacgtg

SEQ ID NO: 30462 - DNA, 25 bp, Homo sapiens
ccagaggggctgtcgacacaacgtg

SEQ ID NO: 30463 - DNA, 19 bp, Homo sapiens
cagaggggactcacctatc

SEQ ID NO: 30464 - DNA, 21 bp, Homo sapiens
ccagagggcgcacctggtgtc

SEQ ID NO: 30465 - DNA, 25 bp, Homo sapiens
ccagagggggctttgacacaacgtg

SEQ ID NO: 30466 - DNA, 19 bp, Homo sapiens
ccgaggggaccgggtgtgt

SEQ ID NO: 30467 - DNA, 19 bp, Homo sapiens
cctgaggggactgctgtgt

SEQ ID NO: 30468 - DNA, 17 bp, Homo sapiens
cagaaggggacgatgtc

SEQ ID NO: 30469 - DNA, 16 bp, Homo sapiens
ccagagggcgtggtgt

SEQ ID NO: 30470 - DNA, 17 bp, Homo sapiens
cagaggggtgtgtgtgt

SEQ ID NO: 30471 - DNA, 18 bp, Homo sapiens
ccagcagggggcgctggt

SEQ ID NO: 30472 - DNA, 24 bp, Homo sapiens
cagaggggggctcgacacaacgtg

SEQ ID NO: 30473 - DNA, 18 bp, Homo sapiens
cagaggaggtcacagtgt

SEQ ID NO: 30474 - DNA, 17 bp, Homo sapiens
cagaggggagccaggtc

SEQ ID NO: 30475 - DNA, 20 bp, Homo sapiens
cagagggggtttcactgtgt

SEQ ID NO: 30476 - DNA, 16 bp, Homo sapiens
agaggggagcactgtc

SEQ ID NO: 30477 - DNA, 18 bp, Homo sapiens
ccagaggggaggcccagc

SEQ ID NO: 30478 - DNA, 19 bp, Homo sapiens
ccagaggaggtacggcatc

SEQ ID NO: 30479 - DNA, 19 bp, Homo sapiens
cagggggcacaccactgtc

SEQ ID NO: 30480 - DNA, 19 bp, Homo sapiens
aaggaccctgcgttgtgtc

SEQ ID NO: 30481 - DNA, 18 bp, Homo sapiens
ccagaggtgggtcatgtc

SEQ ID NO: 30482 - DNA, 19 bp, Homo sapiens
caaaggggacgcgactggt

SEQ ID NO: 30483 - DNA, 24 bp, Homo sapiens
cagaggggaactcgacacaacgtg

SEQ ID NO: 30484 - DNA, 19 bp, Homo sapiens
caaaggggacgaaggtgtc

SEQ ID NO: 30485 - DNA, 16 bp, Homo sapiens
ccagaggggcagcagt

SEQ ID NO: 30486 - DNA, 18 bp, Homo sapiens
ccagaaggggcacagggt

SEQ ID NO: 30487 - DNA, 15 bp, Homo sapiens
ccagggaggctgtgt

SEQ ID NO: 30488 - DNA, 18 bp, Homo sapiens
gaggggatgggctgtgtc

SEQ ID NO: 30489 - DNA, 16 bp, Homo sapiens
ccaggggagacactgt

SEQ ID NO: 30490 - DNA, 15 bp, Homo sapiens
ccagaggggaactgt

SEQ ID NO: 30491 - DNA, 20 bp, Homo sapiens
ccagaggcggtgaccgcgtc

SEQ ID NO: 30492 - DNA, 24 bp, Homo sapiens
cagaggggtggtcgacacaacgtg

SEQ ID NO: 30493 - DNA, 16 bp, Homo sapiens
gaagggaccaggtgtc

SEQ ID NO: 30494 - DNA, 101 bp, Myxoma virus
gtgtactagacgggaacatgtccggtcctttgagcgtcaagacacccaaaacgtctgtatacgtggatacgaggatcgtttgcagttctatgatggtatac

SEQ ID NO: 30495 - DNA, 24 bp, Myxoma virus
tacgtggatacgaggatcgtttgc

SEQ ID NO: 30496 - DNA, 18 bp, Homo sapiens
gtggatactgaggaaggc

SEQ ID NO: 30497 - DNA, 23 bp, Homo sapiens
tacgtggacacagtctcgtttgc

SEQ ID NO: 30498 - DNA, 86 bp, Myxoma virus
acgctattattttttgtatgttcctgtgttgtaatttcaacatatgatattcggacaacgacgggggcctacccaagtaattgtgt

SEQ ID NO: 30499 - DNA, 24 bp, Myxoma virus
tattattttttgtatgttcctgtg

SEQ ID NO: 30500 - DNA, 25 bp, Homo sapiens
tattatttttttgtttgggtctgtg

SEQ ID NO: 30501 - DNA, 20 bp, Homo sapiens
ttttttgtttgtttttcctg

SEQ ID NO: 30502 - DNA, 15 bp, Homo sapiens
tattttttttcctgt

SEQ ID NO: 30503 - DNA, 60 bp, Tupaia herpesvirus
gccgatccgttcgtagtggtaatccccgatcaaccgaccgaggccgacgcggacgaaggc

SEQ ID NO: 30504 - DNA, 22 bp, Tupaia herpesvirus
cgaggccgacgcggacgaaggc

SEQ ID NO: 30505 - DNA, 25 bp, Homo sapiens
cgaggccgaggccagccctgaaggc

SEQ ID NO: 30506 - DNA, 21 bp, Homo sapiens
cgaggcgggcggatcatgagg

SEQ ID NO: 30507 - DNA, 19 bp, Homo sapiens
cgggctgaagaacgaaggc

SEQ ID NO: 30508 - DNA, 22 bp, Homo sapiens
cgaggccgtgcattggcggagg

SEQ ID NO: 30509 - DNA, 21 bp, Homo sapiens
gaggccgaaggcggcgaaggc

SEQ ID NO: 30510 - DNA, 15 bp, Homo sapiens
ggcccggacgaaggc

SEQ ID NO: 30511 - DNA, 21 bp, Homo sapiens
cgaggcaggcggatcacgagg

SEQ ID NO: 30512 - DNA, 20 bp, Homo sapiens
cgaggccagcggaacaaggc

SEQ ID NO: 30513 - DNA, 20 bp, Homo sapiens
cgaggccgggccgcgagggc

SEQ ID NO: 30514 - DNA, 17 bp, Homo sapiens
cgaagccggtgcggcga

SEQ ID NO: 30515 - DNA, 22 bp, Homo sapiens
cgaggccgttgctcgcgggggc

SEQ ID NO: 30516 - DNA, 21 bp, Homo sapiens
cggggcgacgcggccccgggc

SEQ ID NO: 30517 - DNA, 17 bp, Homo sapiens
ccaggccgacagggagg

SEQ ID NO: 30518 - DNA, 19 bp, Homo sapiens
cgaggccgccgccgggggc

SEQ ID NO: 30519 - DNA, 19 bp, Homo sapiens
gacgcgcgcggacgggggc

SEQ ID NO: 30520 - DNA, 22 bp, Homo sapiens
cggggcgggcgcggatcggggc

SEQ ID NO: 30521 - DNA, 19 bp, Homo sapiens
ggctcgacgcggcccgggc

SEQ ID NO: 30522 - DNA, 16 bp, Homo sapiens
cgaggccggcgggaaa

SEQ ID NO: 30523 - DNA, 21 bp, Homo sapiens
cgaggtgggcggatcacgagg

SEQ ID NO: 30524 - DNA, 15 bp, Homo sapiens
cgggccgacaggagg

SEQ ID NO: 30525 - DNA, 19 bp, Homo sapiens
cgaggccgcgccgcgaggc

SEQ ID NO: 30526 - DNA, 22 bp, Homo sapiens
cgaggccgcaggcttcggaggc

SEQ ID NO: 30527 - DNA, 19 bp, Homo sapiens
cgaggccggctacctgggc

SEQ ID NO: 30528 - DNA, 20 bp, Homo sapiens
cgagagtcgggggcgagggc

SEQ ID NO: 30529 - DNA, 17 bp, Homo sapiens
cgaggccggagcaaagg

SEQ ID NO: 30530 - DNA, 20 bp, Homo sapiens
cgggccaggaggacgaaggc

SEQ ID NO: 30531 - DNA, 17 bp, Homo sapiens
gagcgccgggcgagggc

SEQ ID NO: 30532 - DNA, 21 bp, Homo sapiens
cgaggcgggcggatcacgagg

SEQ ID NO: 30533 - DNA, 19 bp, Homo sapiens
cgaggccggcgccccgggc

SEQ ID NO: 30534 - DNA, 17 bp, Homo sapiens
cgaggccacgggcgggg

SEQ ID NO: 30535 - DNA, 20 bp, Homo sapiens
gaggccgactgtggaggggc

SEQ ID NO: 30536 - DNA, 21 bp, Homo sapiens
cgaggcaggcggatcacaagg

SEQ ID NO: 30537 - DNA, 22 bp, Homo sapiens
caaggccggtggatcaagaggc

SEQ ID NO: 30538 - DNA, 20 bp, Homo sapiens
cgaggcgggcggatcacagg

SEQ ID NO: 30539 - DNA, 20 bp, Homo sapiens
cgaggccggggctcagaggc

SEQ ID NO: 30540 - DNA, 18 bp, Homo sapiens
gaggccgagggacggggg

SEQ ID NO: 30541 - DNA, 19 bp, Homo sapiens
cgaggccgtcatcgagggc

SEQ ID NO: 30542 - DNA, 15 bp, Homo sapiens
aggccgggacgaagg

SEQ ID NO: 30543 - DNA, 24 bp, Homo sapiens
cgaggctggcgtctggtggaaggc

SEQ ID NO: 30544 - DNA, 21 bp, Homo sapiens
cgaggtgggcggatcacaagg

SEQ ID NO: 30545 - DNA, 16 bp, Homo sapiens
cgaagccggcgcgggg

SEQ ID NO: 30546 - DNA, 23 bp, Homo sapiens
caaggccgaccctcagtgagggc

SEQ ID NO: 30547 - DNA, 17 bp, Homo sapiens
cgaggccgtgggcgagg

SEQ ID NO: 30548 - DNA, 21 bp, Homo sapiens
gaggccgagtggctcacgggc

SEQ ID NO: 30549 - DNA, 17 bp, Homo sapiens
cggggccgacgcgaaga

SEQ ID NO: 30550 - DNA, 21 bp, Homo sapiens
cgaggtcggcggatcacgagg

SEQ ID NO: 30551 - DNA, 21 bp, Homo sapiens
cgaggcgggcggatcacaagg

SEQ ID NO: 30552 - DNA, 20 bp, Homo sapiens
gaggtcagtgaggacgaagg

SEQ ID NO: 30553 - DNA, 21 bp, Homo sapiens
cggggccgacacggaggaggc

SEQ ID NO: 30554 - DNA, 19 bp, Homo sapiens
cgaagccgcccatggaggc

SEQ ID NO: 30555 - DNA, 17 bp, Homo sapiens
gaggccaacggagaggg

SEQ ID NO: 30556 - DNA, 21 bp, Homo sapiens
cgggccgacgcgggagaaggc

SEQ ID NO: 30557 - DNA, 17 bp, Homo sapiens
cggggcggacgcggaag

SEQ ID NO: 30558 - DNA, 16 bp, Homo sapiens
gaggccgaggcggagg

SEQ ID NO: 30559 - DNA, 18 bp, Homo sapiens
gaggccgaccacccaggc

SEQ ID NO: 30560 - DNA, 19 bp, Homo sapiens
cgaggctgctggtcagggc

SEQ ID NO: 30561 - DNA, 21 bp, Homo sapiens
cgaggcgggtggatcacaagg

SEQ ID NO: 30562 - DNA, 21 bp, Homo sapiens
cgaggccagacagctggaggc

SEQ ID NO: 30563 - DNA, 29 bp, Homo sapiens
cgaggccgggaggcgcgcgggcggaggcg

SEQ ID NO: 30564 - DNA, 17 bp, Homo sapiens
cgaggccggggcggagg

SEQ ID NO: 30565 - DNA, 17 bp, Homo sapiens
cggggcggacgcggagg

SEQ ID NO: 30566 - DNA, 20 bp, Homo sapiens
gaggccgagttaggaaaggc

SEQ ID NO: 30567 - DNA, 19 bp, Homo sapiens
cgaggccgcgcggaccggc

SEQ ID NO: 30568 - DNA, 19 bp, Homo sapiens
cgaggccgcgtggaacagc

SEQ ID NO: 30569 - DNA, 20 bp, Homo sapiens
cggggccgacagctccgggc

SEQ ID NO: 30570 - DNA, 17 bp, Homo sapiens
cgaggccgaggggaagg

SEQ ID NO: 30571 - DNA, 17 bp, Homo sapiens
gaggccaaaggtgaagg

SEQ ID NO: 30572 - DNA, 17 bp, Homo sapiens
cgggccgacgggggagg

SEQ ID NO: 30573 - DNA, 22 bp, Homo sapiens
gagaccgagagaccatgaaggc

SEQ ID NO: 30574 - DNA, 17 bp, Homo sapiens
cgaggccggcgggcggg

SEQ ID NO: 30575 - DNA, 21 bp, Homo sapiens
cgaggccatgcagcatgaggc

SEQ ID NO: 30576 - DNA, 22 bp, Homo sapiens
cggggccgacgcagagcggggc

SEQ ID NO: 30577 - DNA, 19 bp, Homo sapiens
cgaggccggcggcggttgc

SEQ ID NO: 30578 - DNA, 17 bp, Homo sapiens
cgaggccgaggcgaggg

SEQ ID NO: 30579 - DNA, 16 bp, Homo sapiens
cgaggccgcgcccggg

SEQ ID NO: 30580 - DNA, 16 bp, Homo sapiens
cgagcccgacgcaggg

SEQ ID NO: 30581 - DNA, 21 bp, Homo sapiens
cgaggtaggcggatcacgagg

SEQ ID NO: 30582 - DNA, 16 bp, Homo sapiens
gaggccgaagtgaagg

SEQ ID NO: 30583 - DNA, 19 bp, Homo sapiens
cgaggccaggcagggaggc

SEQ ID NO: 30584 - DNA, 20 bp, Homo sapiens
cgaggccaccaccagggggc

SEQ ID NO: 30585 - DNA, 23 bp, Homo sapiens
cgaggcgggcggatcacgagggc

SEQ ID NO: 30586 - DNA, 21 bp, Homo sapiens
cgaggcaggcggatcatgagg

SEQ ID NO: 30587 - DNA, 20 bp, Homo sapiens
cgaggccgcgcgagcggggg

SEQ ID NO: 30588 - DNA, 17 bp, Homo sapiens
cgaggcgggcggcaagg

SEQ ID NO: 30589 - DNA, 22 bp, Homo sapiens
gaggccgagcagcgcggaaggc

SEQ ID NO: 30590 - DNA, 17 bp, Homo sapiens
cgaggccgagcttgagg

SEQ ID NO: 30591 - DNA, 21 bp, Homo sapiens
caaggccggtgacagcaaggc

SEQ ID NO: 30592 - DNA, 19 bp, Homo sapiens
cgaggccgaggccttgagg

SEQ ID NO: 30593 - DNA, 20 bp, Homo sapiens
cgaggccaggaacctgaagg

SEQ ID NO: 30594 - DNA, 20 bp, Homo sapiens
cgaggccatgcaggagaggc

SEQ ID NO: 30595 - DNA, 17 bp, Homo sapiens
cgaggcagacgagaagg

SEQ ID NO: 30596 - DNA, 19 bp, Homo sapiens
cgaggccggcggactgggg

SEQ ID NO: 30597 - DNA, 20 bp, Homo sapiens
cgaggacgacaaaggaaggc

SEQ ID NO: 30598 - DNA, 19 bp, Homo sapiens
aggccgactggacgaaggc

SEQ ID NO: 30599 - DNA, 22 bp, Homo sapiens
cgaggtgacagcaggtgagggc

SEQ ID NO: 30600 - DNA, 19 bp, Homo sapiens
cgaggccggctgggagagc

SEQ ID NO: 30601 - DNA, 22 bp, Homo sapiens
cgaggccgccgcgtccccgggc

SEQ ID NO: 30602 - DNA, 19 bp, Homo sapiens
cgaggccgacgggcggggc

SEQ ID NO: 30603 - DNA, 15 bp, Homo sapiens
gaggccgacgggagg

SEQ ID NO: 30604 - DNA, 16 bp, Homo sapiens
gaggccgaggccgagg

SEQ ID NO: 30605 - DNA, 24 bp, Homo sapiens
ccaggccgaccacaaagcgggggc

SEQ ID NO: 30606 - DNA, 21 bp, Homo sapiens
cggggcctggggggacgaagg

SEQ ID NO: 30607 - DNA, 68 bp, Lumpy skin disease virus
ttatgtttgcaacctgtgaaaagtcaaaatcatttaaacaagcttttataggttcattaaaaatataa

SEQ ID NO: 30608 - DNA, 24 bp, Lumpy skin disease virus
ttttataggttcattaaaaatata

SEQ ID NO: 30609 - DNA, 20 bp, Homo sapiens
tcatctttcattaaaaatat

SEQ ID NO: 30610 - DNA, 24 bp, Homo sapiens
tcttatagatccattagaaatata

SEQ ID NO: 30611 - DNA, 19 bp, Homo sapiens
tttcataggtttcatgaaa

SEQ ID NO: 30612 - DNA, 21 bp, Homo sapiens
ttttatagattcagaaatata

SEQ ID NO: 30613 - DNA, 130 bp, Tupaia herpesvirus
tcgcgcatcgagcggagatagcggaccctctccgacgcctgccagtgcagattgcacaccgcgagcgcctcggtgtgccgctcggccttggccaggtcgttcggtgagaggtgcgccggttcgaagcgga

SEQ ID NO: 30614 - DNA, 24 bp, Tupaia herpesvirus
tagcggaccctctccgacgcctgc

SEQ ID NO: 30615 - DNA, 21 bp, Homo sapiens
gctggaccctctcacacctgc

SEQ ID NO: 30616 - DNA, 20 bp, Homo sapiens
ggtgtgccctctccaggctg

SEQ ID NO: 30617 - DNA, 25 bp, Homo sapiens
tagcgaactcttttccctgaacctg

SEQ ID NO: 30618 - DNA, 19 bp, Homo sapiens
gcgcaccctctccacccgc

SEQ ID NO: 30619 - DNA, 20 bp, Homo sapiens
gggtcctctccacgtactgc

SEQ ID NO: 30620 - DNA, 18 bp, Homo sapiens
cggatggccgacgcctgc

SEQ ID NO: 30621 - DNA, 26 bp, Homo sapiens
tagcggactctctctgtcttctctgc

SEQ ID NO: 30622 - DNA, 15 bp, Homo sapiens
gcggaccctctgccc

SEQ ID NO: 30623 - DNA, 75 bp, Tupaia herpesvirus
tcgagccgatcagctgcagctcgcacgagacgtcaaagtattcggtctggcagcggcgcacgagatcggccccga

SEQ ID NO: 30624 - DNA, 24 bp, Tupaia herpesvirus
tggcagcggcgcacgagatcggcc

SEQ ID NO: 30625 - DNA, 19 bp, Homo sapiens
gcggcggtgtagaccggcc

SEQ ID NO: 30626 - DNA, 19 bp, Homo sapiens
tggcagcggcggcggcggc

SEQ ID NO: 30627 - DNA, 20 bp, Homo sapiens
tggcagcggcacacgaaatc

SEQ ID NO: 30628 - DNA, 23 bp, Homo sapiens
tggcagcggtggctcacatggcc

SEQ ID NO: 30629 - DNA, 21 bp, Homo sapiens
tggcagcggcggcggtgagcc

SEQ ID NO: 30630 - DNA, 16 bp, Homo sapiens
gcagcggcgcgcgggc

SEQ ID NO: 30631 - DNA, 18 bp, Homo sapiens
tggcagcggcggctcggc

SEQ ID NO: 30632 - DNA, 20 bp, Homo sapiens
tggcagcggctggagtttgg

SEQ ID NO: 30633 - DNA, 19 bp, Homo sapiens
tggcagcggcggcgggggc

SEQ ID NO: 30634 - DNA, 20 bp, Homo sapiens
ggcagcggtgcgccccggcc

SEQ ID NO: 30635 - DNA, 19 bp, Homo sapiens
tggcagcggtgcagcgggc

SEQ ID NO: 30636 - DNA, 22 bp, Homo sapiens
tggcggcgccgcgcgcccggcc

SEQ ID NO: 30637 - DNA, 22 bp, Homo sapiens
tggtggcggcgcatgcgcggcc

SEQ ID NO: 30638 - DNA, 19 bp, Homo sapiens
gcagcggcgcgatctcggc

SEQ ID NO: 30639 - DNA, 19 bp, Homo sapiens
tggcggcggtggcgacggc

SEQ ID NO: 30640 - DNA, 18 bp, Homo sapiens
tggcagcggcttgcgggc

SEQ ID NO: 30641 - DNA, 20 bp, Homo sapiens
gcagcggcgccctttcggcc

SEQ ID NO: 30642 - DNA, 18 bp, Homo sapiens
tggcagcgcgcaggcggc

SEQ ID NO: 30643 - DNA, 22 bp, Homo sapiens
tggcggcggcgcgtacctggcc

SEQ ID NO: 30644 - DNA, 17 bp, Homo sapiens
ggcagcggcgcgcaggc

SEQ ID NO: 30645 - DNA, 21 bp, Homo sapiens
ggcggcggcgcgcgcgaggcc

SEQ ID NO: 30646 - DNA, 18 bp, Homo sapiens
gcagcggcgcaccgaggc

SEQ ID NO: 30647 - DNA, 20 bp, Homo sapiens
tgtagcggcgcaatcttggc

SEQ ID NO: 30648 - DNA, 18 bp, Homo sapiens
tggcagcggcgggcaggc

SEQ ID NO: 30649 - DNA, 20 bp, Homo sapiens
tggcagcgggggcagttggc

SEQ ID NO: 30650 - DNA, 87 bp, Tupaia herpesvirus
gttcgtcgttccgtgtccagggggagcgtcccagccggcgacgttttgacgagctgttgctttccctgacgaaccttctgcacgaat

SEQ ID NO: 30651 - DNA, 24 bp, Tupaia herpesvirus
tgttgctttccctgacgaaccttc

SEQ ID NO: 30652 - DNA, 20 bp, Homo sapiens
tgctgcttttcctggtcctt

SEQ ID NO: 30653 - DNA, 21 bp, Homo sapiens
ttgctttctctggaaaccttc

SEQ ID NO: 30654 - DNA, 21 bp, Homo sapiens
tgttgtttccttccactcttc

SEQ ID NO: 30655 - DNA, 24 bp, Homo sapiens
tgtgctttcctcacagaggtcttc

SEQ ID NO: 30656 - DNA, 18 bp, Homo sapiens
ttgctttcctcctgcctt

SEQ ID NO: 30657 - DNA, 25 bp, Homo sapiens
tgttgctttctcctgatgcccattc

SEQ ID NO: 30658 - DNA, 16 bp, Homo sapiens
tgtcgctttcttgcaa

SEQ ID NO: 30659 - DNA, 20 bp, Homo sapiens
ttgctttctgctaaaacctt

SEQ ID NO: 30660 - DNA, 21 bp, Homo sapiens
tgttgcctttttgagatactt

SEQ ID NO: 30661 - DNA, 18 bp, Homo sapiens
tgtgctttcccgagtctt

SEQ ID NO: 30662 - DNA, 23 bp, Homo sapiens
tgttcttttctttctaaaccttc

SEQ ID NO: 30663 - DNA, 20 bp, Homo sapiens
ttgctttcctactggtcttc

SEQ ID NO: 30664 - DNA, 23 bp, Homo sapiens
tgttattttccctgttcactttc

SEQ ID NO: 30665 - DNA, 24 bp, Homo sapiens
tgttgcttttgttccttatgatga

SEQ ID NO: 30666 - DNA, 24 bp, Homo sapiens
tgttgcctttcctgaaatctcttc

SEQ ID NO: 30667 - DNA, 22 bp, Homo sapiens
tgttacttttcctattgtcttc

SEQ ID NO: 30668 - DNA, 19 bp, Homo sapiens
tgttactttctcctgtgaa

SEQ ID NO: 30669 - DNA, 20 bp, Homo sapiens
tgttgtattccctgatggaa

SEQ ID NO: 30670 - DNA, 19 bp, Homo sapiens
tgtgctttcctggggtctt

SEQ ID NO: 30671 - DNA, 25 bp, Homo sapiens
tgctgctttctctgactgcatcttc

SEQ ID NO: 30672 - DNA, 21 bp, Homo sapiens
tgttgctttttctcgttcttc

SEQ ID NO: 30673 - DNA, 21 bp, Homo sapiens
tgttgcttttctagatggaac

SEQ ID NO: 30674 - DNA, 95 bp, Tupaia herpesvirus
ccgtgtcctcgctttcttctctctccgcttccccgcgatccggtccttcgttcggtcggctttcacggggttagaaaaagagagcgtgcgcgcgg

SEQ ID NO: 30675 - DNA, 24 bp, Tupaia herpesvirus
cacggggttagaaaaagagagcgt

SEQ ID NO: 30676 - DNA, 17 bp, Homo sapiens
ggagttaggaggggcat

SEQ ID NO: 30677 - DNA, 21 bp, Homo sapiens
cgggctccgaaaggagagcgt

SEQ ID NO: 30678 - DNA, 18 bp, Homo sapiens
cacggggctggggagagc

SEQ ID NO: 30679 - DNA, 19 bp, Homo sapiens
cacggggtgggagaaggca

SEQ ID NO: 30680 - DNA, 17 bp, Homo sapiens
acggggctggacagagg

SEQ ID NO: 30681 - DNA, 22 bp, Homo sapiens
cgggagttccgagagagagcgt

SEQ ID NO: 30682 - DNA, 20 bp, Homo sapiens
cggcggtcccgggagagcgt

SEQ ID NO: 30683 - DNA, 18 bp, Homo sapiens
acgggagaaaagagagcg

SEQ ID NO: 30684 - DNA, 21 bp, Homo sapiens
ggggttaggagggagacccgt

SEQ ID NO: 30685 - DNA, 20 bp, Homo sapiens
gggaccagaaaagagagtgt

SEQ ID NO: 30686 - DNA, 21 bp, Homo sapiens
cgggagccgaggggagagcgt

SEQ ID NO: 30687 - DNA, 21 bp, Homo sapiens
cggggtgacaggagagagcgt

SEQ ID NO: 30688 - DNA, 19 bp, Homo sapiens
ggggttagagaagcctcgt

SEQ ID NO: 30689 - DNA, 21 bp, Homo sapiens
cagggccatggaggagggcgt

SEQ ID NO: 30690 - DNA, 19 bp, Homo sapiens
gggagagaagagagagcgt

SEQ ID NO: 30691 - DNA, 16 bp, Homo sapiens
cggaaagaggagagcg

SEQ ID NO: 30692 - DNA, 15 bp, Homo sapiens
ggggttagagaaagc

SEQ ID NO: 30693 - DNA, 17 bp, Homo sapiens
cactgggttagagaaag

SEQ ID NO: 30694 - DNA, 24 bp, Homo sapiens
cacagggttagggtgcctgagggt

SEQ ID NO: 30695 - DNA, 25 bp, Homo sapiens
cacggtgttagaaaagaaaaagtgt

SEQ ID NO: 30696 - DNA, 18 bp, Homo sapiens
cacggggcttagagagaa

SEQ ID NO: 30697 - DNA, 21 bp, Homo sapiens
gggatcaggggaggagagtgt

SEQ ID NO: 30698 - DNA, 24 bp, Homo sapiens
ggggatggaaagaaaatgaggcgt

SEQ ID NO: 30699 - DNA, 21 bp, Homo sapiens
cggggttattatggagagtgt

SEQ ID NO: 30700 - DNA, 18 bp, Homo sapiens
cacagggttggagaggca

SEQ ID NO: 30701 - DNA, 19 bp, Homo sapiens
ggagccaggaagagagtgt

SEQ ID NO: 30702 - DNA, 71 bp, Saimiriine herpesvirus 2
tttattatagtattttctaaaatttgtattaattatatatactaagattgttttagaaataaaaaaataaa

SEQ ID NO: 30703 - DNA, 24 bp, Saimiriine herpesvirus 2
tagtattttctaaaatttgtatta

SEQ ID NO: 30704 - DNA, 20 bp, Homo sapiens
tagtattttctaatggtatt

SEQ ID NO: 30705 - DNA, 20 bp, Homo sapiens
tagtattttccaaatcctgc

SEQ ID NO: 30706 - DNA, 19 bp, Homo sapiens
tagcattttctagctatgt

SEQ ID NO: 30707 - DNA, 21 bp, Homo sapiens
tagtattttctgcataactgt

SEQ ID NO: 30708 - DNA, 21 bp, Homo sapiens
tagtatttcctagaaagcact

SEQ ID NO: 30709 - DNA, 20 bp, Homo sapiens
tagtattttctgagctttgt

SEQ ID NO: 30710 - DNA, 17 bp, Homo sapiens
gtattttctaagctgta

SEQ ID NO: 30711 - DNA, 18 bp, Homo sapiens
atattttctaattcctgt

SEQ ID NO: 30712 - DNA, 18 bp, Homo sapiens
tagtatttttaaaatttg

SEQ ID NO: 30713 - DNA, 130 bp, Saimiriine herpesvirus 2
atcaagaaaaaagtttgtggttctcaggggattagttcacaagctgtctgaggttaagggtgtttctttggcactgacacagaagttgctataagaattgaagcttgctttacaaaaagttacttgtgat

SEQ ID NO: 30714 - DNA, 24 bp, Saimiriine herpesvirus 2
aagctgtctgaggttaagggtgtt

SEQ ID NO: 30715 - DNA, 23 bp, Homo sapiens
aagctgtcagaggtccctttgtt

SEQ ID NO: 30716 - DNA, 22 bp, Homo sapiens
aagctggttgcaagagggtgtt

SEQ ID NO: 30717 - DNA, 19 bp, Homo sapiens
gctgtctaggtcctttgtt

SEQ ID NO: 30718 - DNA, 18 bp, Homo sapiens
aagttgctgaggttgaat

SEQ ID NO: 30719 - DNA, 21 bp, Homo sapiens
aagctgctgaggttgtcaggt

SEQ ID NO: 30720 - DNA, 17 bp, Homo sapiens
gctgtctggggctaggc

SEQ ID NO: 30721 - DNA, 20 bp, Homo sapiens
agctgactgaggttgaaggt

SEQ ID NO: 30722 - DNA, 21 bp, Homo sapiens
aagctgtctatcttgggtgtt

SEQ ID NO: 30723 - DNA, 19 bp, Homo sapiens
agcttgtctggggttaggg

SEQ ID NO: 30724 - DNA, 18 bp, Homo sapiens
agtgtctggggttggagc

SEQ ID NO: 30725 - DNA, 21 bp, Homo sapiens
aagctgtctaccttgggtgtt

SEQ ID NO: 30726 - DNA, 18 bp, Homo sapiens
agctatctggggttctgt

SEQ ID NO: 30727 - DNA, 18 bp, Homo sapiens
agctgtctggggttagga

SEQ ID NO: 30728 - DNA, 60 bp, Tupaia herpesvirus
ctgggtagcgctaccgagggtgcgtgctcatctctaaccgcctctgtgcgtagtgtccag

SEQ ID NO: 30729 - DNA, 18 bp, Tupaia herpesvirus
tctgtgcgtagtgtccag

SEQ ID NO: 30730 - DNA, 18 bp, Homo sapiens
tctgtgcgctatgtacag

SEQ ID NO: 30731 - DNA, 16 bp, Homo sapiens
tctgtgcagtggccag

SEQ ID NO: 30732 - DNA, 16 bp, Homo sapiens
cctctgcagtgtccag

SEQ ID NO: 30733 - DNA, 15 bp, Homo sapiens
cctgtgcgcagccag

SEQ ID NO: 30734 - DNA, 18 bp, Homo sapiens
tctatgcccagtgtccag

SEQ ID NO: 30735 - DNA, 17 bp, Homo sapiens
tctgtgtccaagtccag

SEQ ID NO: 30736 - DNA, 17 bp, Homo sapiens
tctatgcacacgttcag

SEQ ID NO: 30737 - DNA, 18 bp, Homo sapiens
ctgtccatcagtgtccag

SEQ ID NO: 30738 - DNA, 18 bp, Homo sapiens
tctcggaccagtgtccag

SEQ ID NO: 30739 - DNA, 18 bp, Homo sapiens
ctgtgtgtgtgtgtccag

SEQ ID NO: 30740 - DNA, 17 bp, Homo sapiens
tctgtgtgtgtgtccag

SEQ ID NO: 30741 - DNA, 16 bp, Homo sapiens
tctgtagtaattccag

SEQ ID NO: 30742 - DNA, 20 bp, Homo sapiens
tctgtgcgtggtgctctcag

SEQ ID NO: 30743 - DNA, 18 bp, Homo sapiens
tctgttcacaacgtccag

SEQ ID NO: 30744 - DNA, 17 bp, Homo sapiens
tctgagcgaatatccag

SEQ ID NO: 30745 - DNA, 17 bp, Homo sapiens
tctgctgtgatgtccag

SEQ ID NO: 30746 - DNA, 16 bp, Homo sapiens
tctgatgagcgtccag

SEQ ID NO: 30747 - DNA, 18 bp, Homo sapiens
tctgtgcatggtatttcc

SEQ ID NO: 30748 - DNA, 16 bp, Homo sapiens
tcttggccatgtccag

SEQ ID NO: 30749 - DNA, 22 bp, Homo sapiens
tccgtgcatgagaggtgtccag

SEQ ID NO: 30750 - DNA, 18 bp, Homo sapiens
ctgtgtggctgcgtccag

SEQ ID NO: 30751 - DNA, 17 bp, Homo sapiens
tctatacatttgtccag

SEQ ID NO: 30752 - DNA, 16 bp, Homo sapiens
tctgtgcagataccag

SEQ ID NO: 30753 - DNA, 16 bp, Homo sapiens
tctgtagcatctccag

SEQ ID NO: 30754 - DNA, 18 bp, Homo sapiens
ctgtcagcaggtgtccag

SEQ ID NO: 30755 - DNA, 15 bp, Homo sapiens
tctggccacgtccag

SEQ ID NO: 30756 - DNA, 16 bp, Homo sapiens
tctggccaatgtccag

SEQ ID NO: 30757 - DNA, 15 bp, Homo sapiens
cctgtgcgaggccag

SEQ ID NO: 30758 - DNA, 16 bp, Homo sapiens
tctgtgtagaatccag

SEQ ID NO: 30759 - DNA, 19 bp, Homo sapiens
tctgtgcatatgtatgcag

SEQ ID NO: 30760 - DNA, 17 bp, Homo sapiens
tctggtagtacatccag

SEQ ID NO: 30761 - DNA, 20 bp, Homo sapiens
tgtgcgtaggttttgttcag

SEQ ID NO: 30762 - DNA, 18 bp, Homo sapiens
tctttgtcaggtgtccag

SEQ ID NO: 30763 - DNA, 17 bp, Homo sapiens
cctggcgcagtgtccag

SEQ ID NO: 30764 - DNA, 15 bp, Homo sapiens
tctgtgagtgtccag

SEQ ID NO: 30765 - DNA, 18 bp, Homo sapiens
tctgtggctgagttccag

SEQ ID NO: 30766 - DNA, 17 bp, Homo sapiens
tctgtgcataatcgcag

SEQ ID NO: 30767 - DNA, 18 bp, Homo sapiens
tctagtgcaggtgtccag

SEQ ID NO: 30768 - DNA, 17 bp, Homo sapiens
tccgtgtgtacatccag

SEQ ID NO: 30769 - DNA, 16 bp, Homo sapiens
tccgccatgtgtccag

SEQ ID NO: 30770 - DNA, 15 bp, Homo sapiens
tctgtggtagtacag

SEQ ID NO: 30771 - DNA, 18 bp, Homo sapiens
ctgtgcgcaggcgtccag

SEQ ID NO: 30772 - DNA, 18 bp, Homo sapiens
tcagtggtctgtgtccag

SEQ ID NO: 30773 - DNA, 18 bp, Homo sapiens
tctgggcgtagtatgcag

SEQ ID NO: 30774 - DNA, 16 bp, Homo sapiens
cctgtgcaccatccag

SEQ ID NO: 30775 - DNA, 18 bp, Homo sapiens
tctgggctcaacgtccag

SEQ ID NO: 30776 - DNA, 16 bp, Homo sapiens
tctgtggcacgtccag

SEQ ID NO: 30777 - DNA, 17 bp, Homo sapiens
cccggcgtggtgtccag

SEQ ID NO: 30778 - DNA, 18 bp, Homo sapiens
tccgagataggtgtccag

SEQ ID NO: 30779 - DNA, 16 bp, Homo sapiens
tctgtgatatatccag

SEQ ID NO: 30780 - DNA, 15 bp, Homo sapiens
tctggtagtatccag

SEQ ID NO: 30781 - DNA, 16 bp, Homo sapiens
tctatgcgtgtgacag

SEQ ID NO: 30782 - DNA, 17 bp, Homo sapiens
tctgtgtgttcatccag

SEQ ID NO: 30783 - DNA, 17 bp, Homo sapiens
tctgggcccacgtccag

SEQ ID NO: 30784 - DNA, 19 bp, Homo sapiens
tctgtgcattaagaaccag

SEQ ID NO: 30785 - DNA, 16 bp, Homo sapiens
tctgtgcatgtgccaa

SEQ ID NO: 30786 - DNA, 18 bp, Homo sapiens
tgtgcgtagactgaccag

SEQ ID NO: 30787 - DNA, 15 bp, Homo sapiens
tcttggtatgtccag

SEQ ID NO: 30788 - DNA, 16 bp, Homo sapiens
tctgcgcgggcgccag

SEQ ID NO: 30789 - DNA, 18 bp, Homo sapiens
ctggagcgtggtgtccag

SEQ ID NO: 30790 - DNA, 18 bp, Homo sapiens
tctgctgtctgtgtccag

SEQ ID NO: 30791 - DNA, 17 bp, Homo sapiens
tctgtgcgttacaccag

SEQ ID NO: 30792 - DNA, 17 bp, Homo sapiens
tcagtgcgtgtgcccag

SEQ ID NO: 30793 - DNA, 16 bp, Homo sapiens
cctgcccggtgtccag

SEQ ID NO: 30794 - DNA, 21 bp, Homo sapiens
tctatacaacatggtgtccag

SEQ ID NO: 30795 - DNA, 17 bp, Homo sapiens
tcagtgcaaatgtccag

SEQ ID NO: 30796 - DNA, 17 bp, Homo sapiens
tctgtgcccaggtccag

SEQ ID NO: 30797 - DNA, 15 bp, Homo sapiens
tccgtgcggccccag

SEQ ID NO: 30798 - DNA, 19 bp, Homo sapiens
tctgtacgtcccgcttcag

SEQ ID NO: 30799 - DNA, 17 bp, Homo sapiens
tccgaggcggtgtccag

SEQ ID NO: 30800 - DNA, 16 bp, Homo sapiens
tctgtgcgcgcctcag

SEQ ID NO: 30801 - DNA, 16 bp, Homo sapiens
tctctgcagcatccag

SEQ ID NO: 30802 - DNA, 16 bp, Homo sapiens
tctgtgcccagtccag

SEQ ID NO: 30803 - DNA, 18 bp, Homo sapiens
ctggaacgcagtgtccag

SEQ ID NO: 30804 - DNA, 16 bp, Homo sapiens
tctgtgcagcctccag

SEQ ID NO: 30805 - DNA, 18 bp, Homo sapiens
tcggtgcgccccgtccag

SEQ ID NO: 30806 - DNA, 16 bp, Homo sapiens
tctgtgcgctgaccag

SEQ ID NO: 30807 - DNA, 17 bp, Homo sapiens
tctgagcacccatccag

SEQ ID NO: 30808 - DNA, 16 bp, Homo sapiens
tcccactagtgtccag

SEQ ID NO: 30809 - DNA, 18 bp, Homo sapiens
cctctgggtagtgtccag

SEQ ID NO: 30810 - DNA, 19 bp, Homo sapiens
tctttgcgtagtggttcag

SEQ ID NO: 30811 - DNA, 20 bp, Homo sapiens
tctgggacccgggtgtccag

SEQ ID NO: 30812 - DNA, 16 bp, Homo sapiens
tctgtgcagtgtccag

SEQ ID NO: 30813 - DNA, 17 bp, Homo sapiens
tctgtccgtgtgcccag

SEQ ID NO: 30814 - DNA, 17 bp, Homo sapiens
tctgtgcagagccccag

SEQ ID NO: 30815 - DNA, 16 bp, Homo sapiens
tctgggcagcgtccag

SEQ ID NO: 30816 - DNA, 19 bp, Homo sapiens
cccagctggtggtgtccag

SEQ ID NO: 30817 - DNA, 16 bp, Homo sapiens
cctgtgcgggccccag

SEQ ID NO: 30818 - DNA, 16 bp, Homo sapiens
tctctatagtgtccag

SEQ ID NO: 30819 - DNA, 18 bp, Homo sapiens
tctgttagtggtgtccag

SEQ ID NO: 30820 - DNA, 18 bp, Homo sapiens
tctgtgcgcagtgagcag

SEQ ID NO: 30821 - DNA, 18 bp, Homo sapiens
tctgtgcaggtgagcgtc

SEQ ID NO: 30822 - DNA, 19 bp, Homo sapiens
tctgtgcgaccgtctccag

SEQ ID NO: 30823 - DNA, 16 bp, Homo sapiens
cctggctagtgtccag

SEQ ID NO: 30824 - DNA, 60 bp, Tupaia herpesvirus
ggccagccgatgggtgccggtttggcggccgcggtcgccgccgtccaccaacgggaggcc

SEQ ID NO: 30825 - DNA, 24 bp, Tupaia herpesvirus
agccgatgggtgccggtttggcgg

SEQ ID NO: 30826 - DNA, 18 bp, Homo sapiens
accggtgggtgccgaacg

SEQ ID NO: 30827 - DNA, 19 bp, Homo sapiens
gctgagggtgccggcgagg

SEQ ID NO: 30828 - DNA, 19 bp, Homo sapiens
caatgggtgttggcagcgg

SEQ ID NO: 30829 - DNA, 20 bp, Homo sapiens
gctggggtggggtttggcgg

SEQ ID NO: 30830 - DNA, 19 bp, Homo sapiens
tggtgtggaggtttggtgg

SEQ ID NO: 30831 - DNA, 18 bp, Homo sapiens
gccggtgggtgctgtctg

SEQ ID NO: 30832 - DNA, 20 bp, Homo sapiens
gccgatggtggggctggcgg

SEQ ID NO: 30833 - DNA, 18 bp, Homo sapiens
cgatgggtgtctgagtgg

SEQ ID NO: 30834 - DNA, 18 bp, Homo sapiens
agctgctgggctttggcg

SEQ ID NO: 30835 - DNA, 130 bp, Tupaia herpesvirus
aggagcggcgacgcgaagacgacggtgagtcgagcggtcggtcggtcggtcggtcacaacgcgcgtcgcggtcgtttgactgactgactgactgactgaccgaccgttcgccggctctcggcgccgcgtt

SEQ ID NO: 30836 - DNA, 17 bp, Tupaia herpesvirus
gctctcggcgccgcgtt

SEQ ID NO: 30837 - DNA, 19 bp, Homo sapiens
gctcccggcggaaactgtt

SEQ ID NO: 30838 - DNA, 19 bp, Homo sapiens
gctctcggcccgccccgtt

SEQ ID NO: 30839 - DNA, 18 bp, Homo sapiens
gccctcgggcatcgcgtt

SEQ ID NO: 30840 - DNA, 19 bp, Homo sapiens
gctctcggcctacctcgtt

SEQ ID NO: 30841 - DNA, 21 bp, Homo sapiens
tctcggcaccgtcttgcgtta

SEQ ID NO: 30842 - DNA, 62 bp, Human papillomavirus type 53
cccgctataggtgaacactggacaaagggtacggcctgtcgttccacacctactacagcggg

SEQ ID NO: 30843 - DNA, 24 bp, Human papillomavirus type 53
taggtgaacactggacaaagggta

SEQ ID NO: 30844 - DNA, 18 bp, Homo sapiens
taggtgaaaacaaggggt

SEQ ID NO: 30845 - DNA, 18 bp, Homo sapiens
ggtgttcaggcaaagggt

SEQ ID NO: 30846 - DNA, 21 bp, Homo sapiens
ggtgagacaaagagaagggta

SEQ ID NO: 30847 - DNA, 20 bp, Homo sapiens
ggtagggggagacaaagggt

SEQ ID NO: 30848 - DNA, 17 bp, Homo sapiens
gggaagatgcaaagggt

SEQ ID NO: 30849 - DNA, 20 bp, Homo sapiens
ggggaacaaaataaggggta

SEQ ID NO: 30850 - DNA, 20 bp, Homo sapiens
ggtgagcatctctcaggggt

SEQ ID NO: 30851 - DNA, 21 bp, Homo sapiens
taggtgaaggcagtaagggta

SEQ ID NO: 30852 - DNA, 24 bp, Homo sapiens
tagatgaggaaaagacagggggta

SEQ ID NO: 30853 - DNA, 19 bp, Homo sapiens
taggtgaacactgggaggt

SEQ ID NO: 30854 - DNA, 21 bp, Homo sapiens
taggtggtatttcaaagggta

SEQ ID NO: 30855 - DNA, 68 bp, Fowlpox virus
tagaatacggggatatagatgttttacaaacaaatgctagaacatttttgattaatatagcctttcta

SEQ ID NO: 30856 - DNA, 24 bp, Fowlpox virus
ctagaacatttttgattaatatag

SEQ ID NO: 30857 - DNA, 24 bp, Homo sapiens
ctagaaattttatcctcaatatag

SEQ ID NO: 30858 - DNA, 24 bp, Homo sapiens
ctagaacagttttggcatgcatag

SEQ ID NO: 30859 - DNA, 19 bp, Homo sapiens
ctagaacttctgtaatata

SEQ ID NO: 30860 - DNA, 20 bp, Homo sapiens
ctggaacatctttgattaac

SEQ ID NO: 30861 - DNA, 22 bp, Homo sapiens
taaaacattgccattaatatag

SEQ ID NO: 30862 - DNA, 21 bp, Homo sapiens
tagaatattttagattaatat

SEQ ID NO: 30863 - DNA, 67 bp, Fowlpox virus
ggcggtaacaaattcagagtacgctatacgtaataaaacgatgtacacgtacttttcaaataccgcc

SEQ ID NO: 30864 - DNA, 24 bp, Fowlpox virus
tacacgtacttttcaaataccgcc

SEQ ID NO: 30865 - DNA, 22 bp, Homo sapiens
gcacctgtttttcaaaacagcc

SEQ ID NO: 30866 - DNA, 23 bp, Homo sapiens
catgtacttctttaagaactcgc

SEQ ID NO: 30867 - DNA, 20 bp, Homo sapiens
actgagctttcaaatactgc

SEQ ID NO: 30868 - DNA, 23 bp, Homo sapiens
tacactgtaggagtaataccgcc

SEQ ID NO: 30869 - DNA, 22 bp, Homo sapiens
tacaggtacttttcaagtgacc

SEQ ID NO: 30870 - DNA, 96 bp, Human papillomavirus type 53
gtctgtgttgtatgactgtatgtatgtgtaatgtttgcatgttgttaataaatatgaatgagtgttacttttacgcgtggttgcataaactaaggc

SEQ ID NO: 30871 - DNA, 24 bp, Human papillomavirus type 53
tgactgtatgtatgtgtaatgttt

SEQ ID NO: 30872 - DNA, 18 bp, Homo sapiens
tgattggtatgtatgtgt

SEQ ID NO: 30873 - DNA, 24 bp, Homo sapiens
tgactgtatggcccagagatgttt

SEQ ID NO: 30874 - DNA, 18 bp, Homo sapiens
tgcttgtatgtgtatgtt

SEQ ID NO: 30875 - DNA, 23 bp, Homo sapiens
tgactgtaagtatcaacatgttt

SEQ ID NO: 30876 - DNA, 16 bp, Homo sapiens
tgttgtatgtgtatgt

SEQ ID NO: 30877 - DNA, 24 bp, Homo sapiens
tgactgatctcaagtgtaatgttt

SEQ ID NO: 30878 - DNA, 18 bp, Homo sapiens
tgcatgccatgtgtgtgt

SEQ ID NO: 30879 - DNA, 18 bp, Homo sapiens
tggctgtggtgtatgtgt

SEQ ID NO: 30880 - DNA, 18 bp, Homo sapiens
tgagtgtatgtgtgtgta

SEQ ID NO: 30881 - DNA, 20 bp, Homo sapiens
tgttgtgtgtgtgtaatgtt

SEQ ID NO: 30882 - DNA, 17 bp, Homo sapiens
tgttgtgtgtgtaatgt

SEQ ID NO: 30883 - DNA, 17 bp, Homo sapiens
tgatgtgtgtgtaatgt

SEQ ID NO: 30884 - DNA, 71 bp, Human papillomavirus type 53
caatttgcaaaacagtttttctgctgatttggatcagtttcctcttggcaggaagtttttaatgcaggttg

SEQ ID NO: 30885 - DNA, 24 bp, Human papillomavirus type 53
tggcaggaagtttttaatgcaggt

SEQ ID NO: 30886 - DNA, 19 bp, Homo sapiens
tgggggagaggatgcaggt

SEQ ID NO: 30887 - DNA, 17 bp, Homo sapiens
ggcgggaagcatgcagg

SEQ ID NO: 30888 - DNA, 23 bp, Homo sapiens
tggcaggagcaccctgtgcaggt

SEQ ID NO: 30889 - DNA, 23 bp, Homo sapiens
tggcagggaagctggatgcaggt

SEQ ID NO: 30890 - DNA, 21 bp, Homo sapiens
tggcaagaggtagatgtgggt

SEQ ID NO: 30891 - DNA, 18 bp, Homo sapiens
tggtgggaagttcacagg

SEQ ID NO: 30892 - DNA, 60 bp, Human herpesvirus 5
ggcttcgttgcgtatggccaccaccacgttaaagagagacggtggcaccagctcgaagcc

SEQ ID NO: 30893 - DNA, 18 bp, Human herpesvirus 5
tggcaccagctcgaagcc

SEQ ID NO: 30894 - DNA, 17 bp, Homo sapiens
tagcaccacccgaagcc

SEQ ID NO: 30895 - DNA, 16 bp, Homo sapiens
tggcccagcccaagcc

SEQ ID NO: 30896 - DNA, 15 bp, Homo sapiens
tggcccatcaaagcc

SEQ ID NO: 30897 - DNA, 19 bp, Homo sapiens
ggcaccagccagggaagcc

SEQ ID NO: 30898 - DNA, 16 bp, Homo sapiens
tggcacaacccgagcc

SEQ ID NO: 30899 - DNA, 20 bp, Homo sapiens
ggcaccagcgctccggggcc

SEQ ID NO: 30900 - DNA, 16 bp, Homo sapiens
tggcaccaccccagcc

SEQ ID NO: 30901 - DNA, 15 bp, Homo sapiens
tggacgcccaaagcc

SEQ ID NO: 30902 - DNA, 15 bp, Homo sapiens
tagcaccaaaaagcc

SEQ ID NO: 30903 - DNA, 18 bp, Homo sapiens
ggcaccagcccacaagcc

SEQ ID NO: 30904 - DNA, 17 bp, Homo sapiens
tggaaccacccaaagcc

SEQ ID NO: 30905 - DNA, 17 bp, Homo sapiens
tggcactacccaaagcc

SEQ ID NO: 30906 - DNA, 19 bp, Homo sapiens
tggcaccaccacccgggcc

SEQ ID NO: 30907 - DNA, 18 bp, Homo sapiens
tgccaccagcccccaagc

SEQ ID NO: 30908 - DNA, 16 bp, Homo sapiens
tgacgcccccaaagcc

SEQ ID NO: 30909 - DNA, 18 bp, Homo sapiens
tgacaccacatcaaaagc

SEQ ID NO: 30910 - DNA, 17 bp, Homo sapiens
tggaccagctcaaggcc

SEQ ID NO: 30911 - DNA, 18 bp, Homo sapiens
ggcaccagccaggacagc

SEQ ID NO: 30912 - DNA, 16 bp, Homo sapiens
tggcaccacaaacgcc

SEQ ID NO: 30913 - DNA, 18 bp, Homo sapiens
tggcaccactcacaggcc

SEQ ID NO: 30914 - DNA, 17 bp, Homo sapiens
tgacaccatcaggagcc

SEQ ID NO: 30915 - DNA, 16 bp, Homo sapiens
tggccaccccaaagcc

SEQ ID NO: 30916 - DNA, 20 bp, Homo sapiens
tggcccagaccagggaggcc

SEQ ID NO: 30917 - DNA, 17 bp, Homo sapiens
tgatgccactcaaagcc

SEQ ID NO: 30918 - DNA, 18 bp, Homo sapiens
tggcaccagcctcgagcc

SEQ ID NO: 30919 - DNA, 19 bp, Homo sapiens
tgacaccagctgggagggc

SEQ ID NO: 30920 - DNA, 16 bp, Homo sapiens
tgggacccccaaagcc

SEQ ID NO: 30921 - DNA, 18 bp, Homo sapiens
tggcccagctcgcaagcc

SEQ ID NO: 30922 - DNA, 21 bp, Homo sapiens
tggcaccaagactgaagggcc

SEQ ID NO: 30923 - DNA, 17 bp, Homo sapiens
tagcaccaacgtgagcc

SEQ ID NO: 30924 - DNA, 18 bp, Homo sapiens
tggtccagcccaaaggcc

SEQ ID NO: 30925 - DNA, 20 bp, Homo sapiens
ggcaccagcagagggaagcc

SEQ ID NO: 30926 - DNA, 17 bp, Homo sapiens
tggcagcagtcgaagcc

SEQ ID NO: 30927 - DNA, 17 bp, Homo sapiens
tagcaccaacccaggcc

SEQ ID NO: 30928 - DNA, 17 bp, Homo sapiens
tggaccagcccccagcc

SEQ ID NO: 30929 - DNA, 18 bp, Homo sapiens
tagcaccagcctgcagcc

SEQ ID NO: 30930 - DNA, 21 bp, Homo sapiens
tgacaccaggcacgagaggcc

SEQ ID NO: 30931 - DNA, 18 bp, Homo sapiens
tggcaccacacagcagcc

SEQ ID NO: 30932 - DNA, 20 bp, Homo sapiens
tagcaccagtcgccggagcc

SEQ ID NO: 30933 - DNA, 18 bp, Homo sapiens
tgacaccaaggcagagcc

SEQ ID NO: 30934 - DNA, 18 bp, Homo sapiens
tgacaccacccacaggcc

SEQ ID NO: 30935 - DNA, 20 bp, Homo sapiens
tggcaccaggactgatggcc

SEQ ID NO: 30936 - DNA, 21 bp, Homo sapiens
tggcaccagaccatcaaagcc

SEQ ID NO: 30937 - DNA, 16 bp, Homo sapiens
tggcccggccgaagcc

SEQ ID NO: 30938 - DNA, 16 bp, Homo sapiens
tagcaccaggaaggcc

SEQ ID NO: 30939 - DNA, 22 bp, Homo sapiens
tggcaccatgcctctaggagcc

SEQ ID NO: 30940 - DNA, 18 bp, Homo sapiens
tggcccagctcagggagc

SEQ ID NO: 30941 - DNA, 19 bp, Homo sapiens
tggcaccagcaggaaaagc

SEQ ID NO: 30942 - DNA, 18 bp, Homo sapiens
tgacaccacatcaaagcc

SEQ ID NO: 30943 - DNA, 19 bp, Homo sapiens
ggcaccagctggagcggcc

SEQ ID NO: 30944 - DNA, 19 bp, Homo sapiens
tgactgacagctcgaggcc

SEQ ID NO: 30945 - DNA, 17 bp, Homo sapiens
tgacaccacacccagcc

SEQ ID NO: 30946 - DNA, 17 bp, Homo sapiens
tggacgctcaaaaggcc

SEQ ID NO: 30947 - DNA, 15 bp, Homo sapiens
tggcaccacaaagcc

SEQ ID NO: 30948 - DNA, 18 bp, Homo sapiens
tggtgtcagctcgaaacc

SEQ ID NO: 30949 - DNA, 21 bp, Homo sapiens
tggcaccaggcacagcaggcc

SEQ ID NO: 30950 - DNA, 18 bp, Homo sapiens
ggcaccagcttggaggcc

SEQ ID NO: 30951 - DNA, 16 bp, Homo sapiens
tggcaccacgaaggcc

SEQ ID NO: 30952 - DNA, 19 bp, Homo sapiens
tggcaccaactgtgtagcc

SEQ ID NO: 30953 - DNA, 18 bp, Homo sapiens
tggccccagctcgagtgc

SEQ ID NO: 30954 - DNA, 19 bp, Homo sapiens
tgacaccaagcgagaagcc

SEQ ID NO: 30955 - DNA, 19 bp, Homo sapiens
tggccccagctcactgagc

SEQ ID NO: 30956 - DNA, 19 bp, Homo sapiens
tagcaccacacaccgggcc

SEQ ID NO: 30957 - DNA, 17 bp, Homo sapiens
tggccccgcccaaagcc

SEQ ID NO: 30958 - DNA, 18 bp, Homo sapiens
tggcaccattgctggagc

SEQ ID NO: 30959 - DNA, 21 bp, Homo sapiens
tagcaccagaaccgtggggcc

SEQ ID NO: 30960 - DNA, 17 bp, Homo sapiens
tggcactgcccaaagcc

SEQ ID NO: 30961 - DNA, 71 bp, Human papillomavirus type 30
ggcgacatggttgatattgggtttggtgccatggattttaaaacattacaggaatctaaatcagatgtgcc

SEQ ID NO: 30962 - DNA, 24 bp, Human papillomavirus type 30
tacaggaatctaaatcagatgtgc

SEQ ID NO: 30963 - DNA, 18 bp, Homo sapiens
cacaggatgtcagatgtg

SEQ ID NO: 30964 - DNA, 23 bp, Homo sapiens
tgaggaatctgagtatcatgtgc

SEQ ID NO: 30965 - DNA, 19 bp, Homo sapiens
tacaggagtactaagtatg

SEQ ID NO: 30966 - DNA, 20 bp, Homo sapiens
cagtctttagatcagatgtg

SEQ ID NO: 30967 - DNA, 20 bp, Homo sapiens
tacagcagtaaccagatgtg

SEQ ID NO: 30968 - DNA, 21 bp, Homo sapiens
tacagggacaggcagatgtgc

SEQ ID NO: 30969 - DNA, 17 bp, Homo sapiens
agaatctaaaacagtgc

SEQ ID NO: 30970 - DNA, 17 bp, Homo sapiens
agggtccacagatgtgc

SEQ ID NO: 30971 - DNA, 18 bp, Homo sapiens
agtgagtctaaatcaaat

SEQ ID NO: 30972 - DNA, 21 bp, Homo sapiens
tacagcaatctaaacattgtg

SEQ ID NO: 30973 - DNA, 21 bp, Homo sapiens
gggttcacaaaatcagatgtg

SEQ ID NO: 30974 - DNA, 18 bp, Homo sapiens
gaaatctgagagatgtgc

SEQ ID NO: 30975 - DNA, 18 bp, Homo sapiens
aagagcagatcagatgtg

SEQ ID NO: 30976 - DNA, 65 bp, Human papillomavirus type 9
gtgcttaagtgctatcgctttcgggaacgcaaaaaaaaaagaggcttagtaaaatattatagtac

SEQ ID NO: 30977 - DNA, 24 bp, Human papillomavirus type 9
taagtgctatcgctttcgggaacg

SEQ ID NO: 30978 - DNA, 18 bp, Homo sapiens
gctccgttttcgggagcg

SEQ ID NO: 30979 - DNA, 16 bp, Homo sapiens
taagtgctatgcagga

SEQ ID NO: 30980 - DNA, 85 bp, Human papillomavirus type 9
gagcacagacaacaattcattaggactatgaaattaccacctacagtagattggtctttaggaaatgttgatgatctgtaagctt

SEQ ID NO: 30981 - DNA, 24 bp, Human papillomavirus type 9
taggactatgaaattaccacctac

SEQ ID NO: 30982 - DNA, 16 bp, Homo sapiens
aggaaaattaccacct

SEQ ID NO: 30983 - DNA, 19 bp, Homo sapiens
ggactatgctcactatcta

SEQ ID NO: 30984 - DNA, 22 bp, Homo sapiens
aggatcaattaattaccatcta

SEQ ID NO: 30985 - DNA, 21 bp, Homo sapiens
taggacaatttcccaccacct

SEQ ID NO: 30986 - DNA, 22 bp, Homo sapiens
aggatctattaattaccatcta

SEQ ID NO: 30987 - DNA, 71 bp, Human papillomavirus type 30
gggcagaaagtttttaatgcaacttggggttcgtactaaaccttctactactactaaaaaacgctcggccc

SEQ ID NO: 30988 - DNA, 24 bp, Human papillomavirus type 30
aagtttttaatgcaacttggggtt

SEQ ID NO: 30989 - DNA, 18 bp, Homo sapiens
gtttcctggtttggggtt

SEQ ID NO: 30990 - DNA, 20 bp, Homo sapiens
gcttttggacatttggggtt

SEQ ID NO: 30991 - DNA, 18 bp, Homo sapiens
aagtttttaatcgggtgt

SEQ ID NO: 30992 - DNA, 24 bp, Homo sapiens
agacttctaatgtggtttggggtt

SEQ ID NO: 30993 - DNA, 23 bp, Homo sapiens
atttttaatgcacatacagggtt

SEQ ID NO: 30994 - DNA, 18 bp, Homo sapiens
aagtttttaattcattgg

SEQ ID NO: 30995 - DNA, 21 bp, Homo sapiens
agtttttagtggtttggggtt

SEQ ID NO: 30996 - DNA, 22 bp, Homo sapiens
aagtttttgatggcagcctcag

SEQ ID NO: 30997 - DNA, 18 bp, Homo sapiens
aagtttttagtgcatact

SEQ ID NO: 30998 - DNA, 20 bp, Homo sapiens
gttttttgttttttggggtt

SEQ ID NO: 30999 - DNA, 60 bp, Human papillomavirus type 30
tgctgttgggcataagtttttattgcaaacatctgcaacacaatgatttggcttgcagca

SEQ ID NO: 31000 - DNA, 24 bp, Human papillomavirus type 30
tgggcataagtttttattgcaaac

SEQ ID NO: 31001 - DNA, 21 bp, Homo sapiens
tgggtcgaatttgttgcaaac

SEQ ID NO: 31002 - DNA, 16 bp, Homo sapiens
tgagcataggttgcaa

SEQ ID NO: 31003 - DNA, 17 bp, Homo sapiens
tgggataggtttttatt

SEQ ID NO: 31004 - DNA, 19 bp, Homo sapiens
tggggatgtttattgcaaa

SEQ ID NO: 31005 - DNA, 21 bp, Homo sapiens
tgggtgttgcaaattgcaaac

SEQ ID NO: 31006 - DNA, 20 bp, Homo sapiens
gggcagatttttattgcaaa

SEQ ID NO: 31007 - DNA, 21 bp, Homo sapiens
gcatacagagtttttattgca

SEQ ID NO: 31008 - DNA, 24 bp, Homo sapiens
tgggcgaaagccacatttgcaaac

SEQ ID NO: 31009 - DNA, 71 bp, Human papillomavirus type 30
ccaacagatgcatatgtaaagcgcaccaatatattttatcatgcaggcagctcacgtttgcttgctgttgg

SEQ ID NO: 31010 - DNA, 24 bp, Human papillomavirus type 30
tgtaaagcgcaccaatatatttta

SEQ ID NO: 31011 - DNA, 19 bp, Homo sapiens
aacagtccaatatatttta

SEQ ID NO: 31012 - DNA, 87 bp, Human papillomavirus type 30
gtttctgtatgactgtatgtatgtgtaatgactgtatgtatgtaataaatatgaatgagtcttacttttacgtgtggttacataaac

SEQ ID NO: 31013 - DNA, 24 bp, Human papillomavirus type 30
tgaatgagtcttacttttacgtgt

SEQ ID NO: 31014 - DNA, 21 bp, Homo sapiens
tgaatgaatctttaaatgtgt

SEQ ID NO: 31015 - DNA, 18 bp, Homo sapiens
tgaatgagctaatatgtg

SEQ ID NO: 31016 - DNA, 24 bp, Homo sapiens
tgaatgagtttatttaacacatgt

SEQ ID NO: 31017 - DNA, 62 bp, Cryphonectria hypovirus 3
ctggggtaaacattttgggacaacctcctatggcatttagaggtttttgcccaatttcccag

SEQ ID NO: 31018 - DNA, 18 bp, Cryphonectria hypovirus 3
ttttgcccaatttcccag

SEQ ID NO: 31019 - DNA, 18 bp, Homo sapiens
ttctgcccgacaccccag

SEQ ID NO: 31020 - DNA, 17 bp, Homo sapiens
ttttgcttatttcccag

SEQ ID NO: 31021 - DNA, 16 bp, Homo sapiens
tcttggcctttcccag

SEQ ID NO: 31022 - DNA, 18 bp, Homo sapiens
ttctgcccaaagtctcag

SEQ ID NO: 31023 - DNA, 17 bp, Homo sapiens
ttttcccttctccccag

SEQ ID NO: 31024 - DNA, 18 bp, Homo sapiens
ttttgccatgtttcccag

SEQ ID NO: 31025 - DNA, 17 bp, Homo sapiens
tcttgaccttttcccag

SEQ ID NO: 31026 - DNA, 15 bp, Homo sapiens
ttctgcatttcccag

SEQ ID NO: 31027 - DNA, 18 bp, Homo sapiens
ttttggaccgtttcccag

SEQ ID NO: 31028 - DNA, 17 bp, Homo sapiens
ctttgcccgaataccag

SEQ ID NO: 31029 - DNA, 22 bp, Homo sapiens
ttttccccaaaaaaattcccag

SEQ ID NO: 31030 - DNA, 20 bp, Homo sapiens
ttctgcccatcttctctcag

SEQ ID NO: 31031 - DNA, 19 bp, Homo sapiens
tttgcccagatttcattcc

SEQ ID NO: 31032 - DNA, 18 bp, Homo sapiens
ttttccccggtttcccag

SEQ ID NO: 31033 - DNA, 16 bp, Homo sapiens
ctttgccctcttccag

SEQ ID NO: 31034 - DNA, 18 bp, Homo sapiens
ttttcccaagcccctcag

SEQ ID NO: 31035 - DNA, 18 bp, Homo sapiens
tcttgccctgtcacccag

SEQ ID NO: 31036 - DNA, 18 bp, Homo sapiens
tcttgctctatctcccag

SEQ ID NO: 31037 - DNA, 19 bp, Homo sapiens
ttctgcccggcttccccag

SEQ ID NO: 31038 - DNA, 19 bp, Homo sapiens
ttttacccacagaccccag

SEQ ID NO: 31039 - DNA, 18 bp, Homo sapiens
ctttgcccatcatcccag

SEQ ID NO: 31040 - DNA, 18 bp, Homo sapiens
tcttgccctttcgcccag

SEQ ID NO: 31041 - DNA, 15 bp, Homo sapiens
ttctgcccaccccag

SEQ ID NO: 31042 - DNA, 17 bp, Homo sapiens
ttctgccctcctcccag

SEQ ID NO: 31043 - DNA, 15 bp, Homo sapiens
tcttgaacttcccag

SEQ ID NO: 31044 - DNA, 17 bp, Homo sapiens
ctttgctcctttcccag

SEQ ID NO: 31045 - DNA, 15 bp, Homo sapiens
ttctgcccaacccag

SEQ ID NO: 31046 - DNA, 16 bp, Homo sapiens
ttttcccaagccccag

SEQ ID NO: 31047 - DNA, 18 bp, Homo sapiens
ttctgcccaatccaccag

SEQ ID NO: 31048 - DNA, 17 bp, Homo sapiens
ttttcccaactgtccag

SEQ ID NO: 31049 - DNA, 19 bp, Homo sapiens
ttttgccctgcctccccag

SEQ ID NO: 31050 - DNA, 18 bp, Homo sapiens
tcttgcccaaaaccttcc

SEQ ID NO: 31051 - DNA, 15 bp, Homo sapiens
ttttacatttcccag

SEQ ID NO: 31052 - DNA, 16 bp, Homo sapiens
ttttgcccaactgcag

SEQ ID NO: 31053 - DNA, 18 bp, Homo sapiens
ttttgccgtacttcccag

SEQ ID NO: 31054 - DNA, 18 bp, Homo sapiens
ttctgcccaacgcctccc

SEQ ID NO: 31055 - DNA, 16 bp, Homo sapiens
ttctgtcctctcccag

SEQ ID NO: 31056 - DNA, 16 bp, Homo sapiens
tcctgaaatttcccag

SEQ ID NO: 31057 - DNA, 16 bp, Homo sapiens
ttttgtccaatcccag

SEQ ID NO: 31058 - DNA, 17 bp, Homo sapiens
ttttgccaattccacag

SEQ ID NO: 31059 - DNA, 18 bp, Homo sapiens
ttttcccactcctcccag

SEQ ID NO: 31060 - DNA, 15 bp, Homo sapiens
ctttgcacctcccag

SEQ ID NO: 31061 - DNA, 18 bp, Homo sapiens
ttttgcccaagcgctccc

SEQ ID NO: 31062 - DNA, 18 bp, Homo sapiens
tcttgcccatttcctcag

SEQ ID NO: 31063 - DNA, 16 bp, Homo sapiens
ttttactatttcccag

SEQ ID NO: 31064 - DNA, 18 bp, Homo sapiens
ttttcccaaaatcctcag

SEQ ID NO: 31065 - DNA, 17 bp, Homo sapiens
ttttacacccttcccag

SEQ ID NO: 31066 - DNA, 18 bp, Homo sapiens
ttttccccaacttttcag

SEQ ID NO: 31067 - DNA, 19 bp, Homo sapiens
ttttcccaaataccaccag

SEQ ID NO: 31068 - DNA, 17 bp, Homo sapiens
tcttgcccgcctgccag

SEQ ID NO: 31069 - DNA, 16 bp, Homo sapiens
ttctgcctttccccag

SEQ ID NO: 31070 - DNA, 17 bp, Homo sapiens
ctttgcccttttcccag

SEQ ID NO: 31071 - DNA, 19 bp, Homo sapiens
ttctgcccatgttcctcag

SEQ ID NO: 31072 - DNA, 18 bp, Homo sapiens
tcttggacactttcccag

SEQ ID NO: 31073 - DNA, 15 bp, Homo sapiens
ttctgcctctcccag

SEQ ID NO: 31074 - DNA, 15 bp, Homo sapiens
ctttgcatctcccag

SEQ ID NO: 31075 - DNA, 18 bp, Homo sapiens
ctttgtccatctccccag

SEQ ID NO: 31076 - DNA, 17 bp, Homo sapiens
ttctgccccacccccag

SEQ ID NO: 31077 - DNA, 18 bp, Homo sapiens
ctttgcccaactaaccag

SEQ ID NO: 31078 - DNA, 16 bp, Homo sapiens
ttctgcccttcctcag

SEQ ID NO: 31079 - DNA, 19 bp, Homo sapiens
ttttcccagacctacccag

SEQ ID NO: 31080 - DNA, 20 bp, Homo sapiens
ttttgcccatattccttcag

SEQ ID NO: 31081 - DNA, 19 bp, Homo sapiens
ttttcccagtcactcccag

SEQ ID NO: 31082 - DNA, 16 bp, Homo sapiens
ttttgccctctctcag

SEQ ID NO: 31083 - DNA, 20 bp, Homo sapiens
ttctgcccaggtctttccag

SEQ ID NO: 31084 - DNA, 16 bp, Homo sapiens
ttttaccttttcccag

SEQ ID NO: 31085 - DNA, 17 bp, Homo sapiens
tcttgccctgctcccag

SEQ ID NO: 31086 - DNA, 18 bp, Homo sapiens
tcttgccctgtcgcccag

SEQ ID NO: 31087 - DNA, 18 bp, Homo sapiens
tcttgttccatttcccag

SEQ ID NO: 31088 - DNA, 18 bp, Homo sapiens
ttctgcccatcttcccag

SEQ ID NO: 31089 - DNA, 18 bp, Homo sapiens
ttcaacacagtttcccag

SEQ ID NO: 31090 - DNA, 19 bp, Homo sapiens
ttctgcccaagagccccag

SEQ ID NO: 31091 - DNA, 21 bp, Homo sapiens
ttttccccaagtcttttccag

SEQ ID NO: 31092 - DNA, 18 bp, Homo sapiens
ttttgccatgcttcccag

SEQ ID NO: 31093 - DNA, 16 bp, Homo sapiens
ttctgcccctctccag

SEQ ID NO: 31094 - DNA, 15 bp, Homo sapiens
ttttgcccttcccag

SEQ ID NO: 31095 - DNA, 16 bp, Homo sapiens
tcttgcccaaccacag

SEQ ID NO: 31096 - DNA, 16 bp, Homo sapiens
ttttccccctccccag

SEQ ID NO: 31097 - DNA, 17 bp, Homo sapiens
tcctgaaaatttcccag

SEQ ID NO: 31098 - DNA, 15 bp, Homo sapiens
ctttgcctttcccag

SEQ ID NO: 31099 - DNA, 15 bp, Homo sapiens
ttctccctttcccag

SEQ ID NO: 31100 - DNA, 18 bp, Homo sapiens
tcttgtcccctttcccag

SEQ ID NO: 31101 - DNA, 18 bp, Homo sapiens
ttttgcccagctttctca

SEQ ID NO: 31102 - DNA, 19 bp, Homo sapiens
tcttgccccgacctcccag

SEQ ID NO: 31103 - DNA, 16 bp, Homo sapiens
ttttcccagttcccag

SEQ ID NO: 31104 - DNA, 17 bp, Homo sapiens
ttttcccagcctcccag

SEQ ID NO: 31105 - DNA, 17 bp, Homo sapiens
ttctgccattctcccag

SEQ ID NO: 31106 - DNA, 16 bp, Homo sapiens
tcttgccctaatccag

SEQ ID NO: 31107 - DNA, 18 bp, Homo sapiens
tttgctcaagtctcccag

SEQ ID NO: 31108 - DNA, 16 bp, Homo sapiens
tcttgtccttccccag

SEQ ID NO: 31109 - DNA, 96 bp, Human herpesvirus 8
ttgggatcaacgcgcgtctggtactgggtgatatcttcgcatcaaaatggtcgctattcgcgagggacaccccagagtatcgggtgttttacccaa

SEQ ID NO: 31110 - DNA, 24 bp, Human herpesvirus 8
ttcgcgagggacaccccagagtat

SEQ ID NO: 31111 - DNA, 22 bp, Homo sapiens
ttcgtggggacaccttcagagt

SEQ ID NO: 31112 - DNA, 19 bp, Homo sapiens
tccgtgggggacacctagc

SEQ ID NO: 31113 - DNA, 61 bp, Human herpesvirus 8
caggtccaaagaggctaacgagacggcgtcccatcttctgttcggtctcccggattcactg

SEQ ID NO: 31114 - DNA, 24 bp, Human herpesvirus 8
agaggctaacgagacggcgtccca

SEQ ID NO: 31115 - DNA, 18 bp, Homo sapiens
agaggctagtgaggcccc

SEQ ID NO: 31116 - DNA, 24 bp, Homo sapiens
agaggctagtgtgggcgggtctca

SEQ ID NO: 31117 - DNA, 22 bp, Homo sapiens
agagctgcgcctgtggcgtccc

SEQ ID NO: 31118 - DNA, 19 bp, Homo sapiens
gaggcggaggcggcgtccc

SEQ ID NO: 31119 - DNA, 18 bp, Homo sapiens
aaaggctgatggcgtccc

SEQ ID NO: 31120 - DNA, 20 bp, Homo sapiens
agaggctactgaggcccccc

SEQ ID NO: 31121 - DNA, 20 bp, Homo sapiens
agaggctgacaagacatatc

SEQ ID NO: 31122 - DNA, 20 bp, Homo sapiens
gaggctggcagacagcggtc

SEQ ID NO: 31123 - DNA, 20 bp, Homo sapiens
agcggctggccgggcgtccc

SEQ ID NO: 31124 - DNA, 22 bp, Homo sapiens
agaggcagagggtggcgtccca

SEQ ID NO: 31125 - DNA, 19 bp, Homo sapiens
agaggctagtgacaacctc

SEQ ID NO: 31126 - DNA, 19 bp, Homo sapiens
agccacgggggcggcgtcc

SEQ ID NO: 31127 - DNA, 23 bp, Homo sapiens
agaggctacatgggacgcaggcc

SEQ ID NO: 31128 - DNA, 18 bp, Homo sapiens
agaggctaactgggcacc

SEQ ID NO: 31129 - DNA, 21 bp, Homo sapiens
aggggttgacaagacaggccc

SEQ ID NO: 31130 - DNA, 23 bp, Homo sapiens
agaggctagtggtgcggagggcg

SEQ ID NO: 31131 - DNA, 20 bp, Homo sapiens
gaggcaggtagcgcgtccca

SEQ ID NO: 31132 - DNA, 17 bp, Homo sapiens
ggctgaccagacatccc

SEQ ID NO: 31133 - DNA, 15 bp, Homo sapiens
gaggctaagaggtcc

SEQ ID NO: 31134 - DNA, 22 bp, Homo sapiens
agaggccaggcgcggtgtctca

SEQ ID NO: 31135 - DNA, 21 bp, Homo sapiens
aaggcagagggtggcgtccca

SEQ ID NO: 31136 - DNA, 21 bp, Homo sapiens
agaggctaatagatgtgccca

SEQ ID NO: 31137 - DNA, 16 bp, Homo sapiens
ggctaacggagagccc

SEQ ID NO: 31138 - DNA, 17 bp, Homo sapiens
agaggtaatgagacaac

SEQ ID NO: 31139 - DNA, 20 bp, Homo sapiens
agaggctaacggacttcccc

SEQ ID NO: 31140 - DNA, 21 bp, Homo sapiens
agaggccaatgagagcaccca

SEQ ID NO: 31141 - DNA, 23 bp, Homo sapiens
agaggctaaccaggcaggcctcc

SEQ ID NO: 31142 - DNA, 68 bp, Human herpesvirus 8
gttgacatgtggagccactggcgcgttgccgacaacggcgacgacaataacccgctccgccacgcagc

SEQ ID NO: 31143 - DNA, 24 bp, Human herpesvirus 8
acgacaataacccgctccgccacg

SEQ ID NO: 31144 - DNA, 19 bp, Homo sapiens
cggcaaggcccgctccacc

SEQ ID NO: 31145 - DNA, 22 bp, Homo sapiens
cgcgggaccgcgctccgctgcg

SEQ ID NO: 31146 - DNA, 19 bp, Homo sapiens
gacaataatccccagcacg

SEQ ID NO: 31147 - DNA, 22 bp, Homo sapiens
cggcaatttcagctccgccgcg

SEQ ID NO: 31148 - DNA, 103 bp, Human papillomavirus type 26
caacacacaagccaatatgtgctgctaacacacctatatacctgtaatcattattccttttatagtttatgtgtttgtgctttgcgtgtgtgtgtgtgtgttg

SEQ ID NO: 31149 - DNA, 24 bp, Human papillomavirus type 26
tttgtgctttgcgtgtgtgtgtgt

SEQ ID NO: 31150 - DNA, 18 bp, Homo sapiens
tgtgtgtgtgtgtgtgtg

SEQ ID NO: 31151 - DNA, 21 bp, Homo sapiens
tgtgcacacgtgtgtgtgtgt

SEQ ID NO: 31152 - DNA, 25 bp, Homo sapiens
tctgtgtgagtgtgtgtgtgtgtgt

SEQ ID NO: 31153 - DNA, 22 bp, Homo sapiens
ttgtaagagtgtgtgtgtgtgt

SEQ ID NO: 31154 - DNA, 19 bp, Homo sapiens
tatgtgcgtgtgtgtgtgt

SEQ ID NO: 31155 - DNA, 21 bp, Homo sapiens
tgtgcgtgtgtgtgtgtgtgt

SEQ ID NO: 31156 - DNA, 23 bp, Homo sapiens
tttgtgtgtgtgtgtgtgtgtgt

SEQ ID NO: 31157 - DNA, 21 bp, Homo sapiens
tgtgtgtgcgtgtgtgtgtgt

SEQ ID NO: 31158 - DNA, 22 bp, Homo sapiens
tgtgtttgtgtgtgtgtgtgta

SEQ ID NO: 31159 - DNA, 21 bp, Homo sapiens
tctgtgtgtatgtgtgtgtgt

SEQ ID NO: 31160 - DNA, 21 bp, Homo sapiens
tgtgtttgtgtgtgtgtgtgt

SEQ ID NO: 31161 - DNA, 21 bp, Homo sapiens
tgtgtatgtgtgtgtgtgtgt

SEQ ID NO: 31162 - DNA, 23 bp, Homo sapiens
tgtgagagtgtgtgtgtgtgtgt

SEQ ID NO: 31163 - DNA, 21 bp, Homo sapiens
tgtacgtgtgtgtgtgtgtgt

SEQ ID NO: 31164 - DNA, 23 bp, Homo sapiens
tgtgcatgtacgtgtgtgtgtgt

SEQ ID NO: 31165 - DNA, 19 bp, Homo sapiens
tgtgttttggggtgtgtgt

SEQ ID NO: 31166 - DNA, 18 bp, Homo sapiens
tatgtgtgtgtgtgtgtg

SEQ ID NO: 31167 - DNA, 26 bp, Homo sapiens
tgtgcatgtttgtgtgtgtgtgtgta

SEQ ID NO: 31168 - DNA, 23 bp, Homo sapiens
tgtgcattggcgtgtgtgtgtgt

SEQ ID NO: 31169 - DNA, 20 bp, Homo sapiens
tttgtgctctgtaagtgtgt

SEQ ID NO: 31170 - DNA, 19 bp, Homo sapiens
tgtgtctgtgtgtgtgtgt

SEQ ID NO: 31171 - DNA, 23 bp, Homo sapiens
tctgtgcacgcgtgtgtgtgtgt

SEQ ID NO: 31172 - DNA, 18 bp, Homo sapiens
ccgtgtgtgtgtgtgtgt

SEQ ID NO: 31173 - DNA, 18 bp, Homo sapiens
tgtttgtgtgtgtgtgtg

SEQ ID NO: 31174 - DNA, 21 bp, Homo sapiens
tgtgtgtgagtgtgtgtgtgt

SEQ ID NO: 31175 - DNA, 21 bp, Homo sapiens
tgtgagtgtgtgtgtgtgtgt

SEQ ID NO: 31176 - DNA, 20 bp, Homo sapiens
tttgcaaggtgtgtgtgtgt

SEQ ID NO: 31177 - DNA, 18 bp, Homo sapiens
tgtatgtgtgtgtgtgtg

SEQ ID NO: 31178 - DNA, 21 bp, Homo sapiens
tttgtgtgcatgtgtgtgtgt

SEQ ID NO: 31179 - DNA, 21 bp, Homo sapiens
tgtgtgtgcatgtgtgtgtgt

SEQ ID NO: 31180 - DNA, 25 bp, Homo sapiens
tgtgaagttttgtgtgtgtgtgtgt

SEQ ID NO: 31181 - DNA, 20 bp, Homo sapiens
tttgtttttctggtgtgtgt

SEQ ID NO: 31182 - DNA, 28 bp, Homo sapiens
tttgtatcatatatgtgtgtgtgtgtgt

SEQ ID NO: 31183 - DNA, 20 bp, Homo sapiens
gtgaatgtgtgtgtgtgtgt

SEQ ID NO: 31184 - DNA, 18 bp, Homo sapiens
ctctgtgtgtgtgtgtgt

SEQ ID NO: 31185 - DNA, 19 bp, Homo sapiens
tttgtgtttttgtctgtgt

SEQ ID NO: 31186 - DNA, 23 bp, Homo sapiens
tctgtgtatgtgtgtgtgtgtgt

SEQ ID NO: 31187 - DNA, 23 bp, Homo sapiens
tgtgtatatgtgtgtgtgtgtgt

SEQ ID NO: 31188 - DNA, 21 bp, Homo sapiens
tgaatttgtgtgtgtgtgtgt

SEQ ID NO: 31189 - DNA, 25 bp, Homo sapiens
tatgcaagtttgtgtgtgtgtgtgt

SEQ ID NO: 31190 - DNA, 25 bp, Homo sapiens
tgtgtctgcatttgtgtgtgtgtgt

SEQ ID NO: 31191 - DNA, 21 bp, Homo sapiens
tgtgtctgcgtgtgtgtgtgt

SEQ ID NO: 31192 - DNA, 21 bp, Homo sapiens
tgtgcgtgcgtgtgtgtgtgt

SEQ ID NO: 31193 - DNA, 22 bp, Homo sapiens
cttgtgatatgtgtgtgtgtgt

SEQ ID NO: 31194 - DNA, 21 bp, Homo sapiens
tgtgtgtgtatgtgtgtgtgt

SEQ ID NO: 31195 - DNA, 23 bp, Homo sapiens
tgtgtctctgtgtgtgtgtgtgt

SEQ ID NO: 31196 - DNA, 18 bp, Homo sapiens
tgtgtgcgtgtgtgtgtg

SEQ ID NO: 31197 - DNA, 23 bp, Homo sapiens
tttggttttgtgtgtgggtgtgt

SEQ ID NO: 31198 - DNA, 22 bp, Homo sapiens
tctgtagtgtgtgtgtgtgtgt

SEQ ID NO: 31199 - DNA, 19 bp, Homo sapiens
tgtgcacgtgtgtgtgtgt

SEQ ID NO: 31200 - DNA, 22 bp, Homo sapiens
tttgtgcattttttgtgtgtgt

SEQ ID NO: 31201 - DNA, 21 bp, Homo sapiens
tgtgcatgtgtgtgtgtgtgt

SEQ ID NO: 31202 - DNA, 21 bp, Homo sapiens
tgtggctgtgtgtgtgtgtgt

SEQ ID NO: 31203 - DNA, 21 bp, Homo sapiens
tgtgtatgcatgtgtgtgtgt

SEQ ID NO: 31204 - DNA, 21 bp, Homo sapiens
tgtgcgcgcgtgtgtgtgtgt

SEQ ID NO: 31205 - DNA, 18 bp, Homo sapiens
tgtgagtgtgtgtgtgtg

SEQ ID NO: 31206 - DNA, 23 bp, Homo sapiens
tctgtgggtgtgtgtgtgtgtgt

SEQ ID NO: 31207 - DNA, 21 bp, Homo sapiens
tgtgtgtgcatatgtgtgtgt

SEQ ID NO: 31208 - DNA, 25 bp, Homo sapiens
ctgttgttttgtgtgtgtgtgtgta

SEQ ID NO: 31209 - DNA, 22 bp, Homo sapiens
tgtgtaaaatgtgtgtgtgtgt

SEQ ID NO: 31210 - DNA, 19 bp, Homo sapiens
tttgtgtgcgtgtgtgtgt

SEQ ID NO: 31211 - DNA, 19 bp, Homo sapiens
tgctgggctgtgtgtgtgt

SEQ ID NO: 31212 - DNA, 19 bp, Homo sapiens
tatgtttgtgtgtgtgtgt

SEQ ID NO: 31213 - DNA, 19 bp, Homo sapiens
tctgtttttgtgtgtgtgt

SEQ ID NO: 31214 - DNA, 21 bp, Homo sapiens
tgtgtctgtgtgtgtgtgtgt

SEQ ID NO: 31215 - DNA, 21 bp, Homo sapiens
tgtctctgtgtgtgtgtgtgt

SEQ ID NO: 31216 - DNA, 19 bp, Homo sapiens
tgactgtgtgtgtgtgtgt

SEQ ID NO: 31217 - DNA, 21 bp, Homo sapiens
tgtgggggtgtgtgtgtgtgt

SEQ ID NO: 31218 - DNA, 23 bp, Homo sapiens
tgtgggggtgtgtgtgtgtgtgt

SEQ ID NO: 31219 - DNA, 21 bp, Homo sapiens
tgtgtgtacgtgtgtgtgtgt

SEQ ID NO: 31220 - DNA, 21 bp, Homo sapiens
tttgtgtgtgtatgtgtgtgt

SEQ ID NO: 31221 - DNA, 22 bp, Homo sapiens
ttgtgtgtgtgtgtgtgtgtgt

SEQ ID NO: 31222 - DNA, 22 bp, Homo sapiens
atgaaattgtgtgtgtgtgtgt

SEQ ID NO: 31223 - DNA, 23 bp, Homo sapiens
tgtggacgtgcgtgtgtgtgtgt

SEQ ID NO: 31224 - DNA, 19 bp, Homo sapiens
cttgtgctttgtgtgtggt

SEQ ID NO: 31225 - DNA, 26 bp, Homo sapiens
tgtgtctttattttgtgtgtgtgtgt

SEQ ID NO: 31226 - DNA, 21 bp, Homo sapiens
tgtgcgtgcatgtgtgtgtgt

SEQ ID NO: 31227 - DNA, 23 bp, Homo sapiens
tgtacagctgtgtgtgtgtgtgt

SEQ ID NO: 31228 - DNA, 21 bp, Homo sapiens
tgtgtaaatgtgtgtgtgtgt

SEQ ID NO: 31229 - DNA, 22 bp, Homo sapiens
cttgtattgtgtgtgtgtgtgt

SEQ ID NO: 31230 - DNA, 21 bp, Homo sapiens
tgtgtttgtgtatgtgtgtgt

SEQ ID NO: 31231 - DNA, 18 bp, Homo sapiens
ctttgtgtgtgtgtgtgt

SEQ ID NO: 31232 - DNA, 23 bp, Homo sapiens
tgtgtatgtgcgtgtgtgtgtgt

SEQ ID NO: 31233 - DNA, 23 bp, Homo sapiens
ttgcacactgtgtgtgtgtgtgt

SEQ ID NO: 31234 - DNA, 19 bp, Homo sapiens
tgtgtgcatgtgtgtgtgt

SEQ ID NO: 31235 - DNA, 22 bp, Homo sapiens
tgtgcttgtgtgtgtgtgtgta

SEQ ID NO: 31236 - DNA, 23 bp, Homo sapiens
tgtgcacgtgcgtgtgtgtgtgt

SEQ ID NO: 31237 - DNA, 17 bp, Homo sapiens
tttgtgtttgtgtgtgt

SEQ ID NO: 31238 - DNA, 22 bp, Homo sapiens
gcacatttgtgtgtgtgtgtgt

SEQ ID NO: 31239 - DNA, 24 bp, Homo sapiens
tttgtataaagtgtgtgtgtgtgt

SEQ ID NO: 31240 - DNA, 22 bp, Homo sapiens
tatgcagtgtgtgtgtgtgtgt

SEQ ID NO: 31241 - DNA, 25 bp, Homo sapiens
tctgtgtgtctgtgtgtgtgtgtgt

SEQ ID NO: 31242 - DNA, 22 bp, Homo sapiens
tttgtgctatctgagtgtgtgt

SEQ ID NO: 31243 - DNA, 18 bp, Homo sapiens
tgtgtgtttgtgtgtgtg

SEQ ID NO: 31244 - DNA, 21 bp, Homo sapiens
tttgtgtatgtgtgtgtgtgt

SEQ ID NO: 31245 - DNA, 21 bp, Homo sapiens
tgtgagagtgtgtgtgtgtgt

SEQ ID NO: 31246 - DNA, 22 bp, Homo sapiens
tatggagtgtgtgtgtgtgtgt

SEQ ID NO: 31247 - DNA, 24 bp, Homo sapiens
tctgtttttgtgtgtgtgtgtgta

SEQ ID NO: 31248 - DNA, 23 bp, Homo sapiens
tatgcgagtgtgtgtgtgtgtgt

SEQ ID NO: 31249 - DNA, 24 bp, Homo sapiens
tatgactaatgtgtgtgtgtgtgt

SEQ ID NO: 31250 - DNA, 20 bp, Homo sapiens
ctctaggggtgtgtgtgtgt

SEQ ID NO: 31251 - DNA, 22 bp, Homo sapiens
gtgattttgtgtgtgtgtgtgt

SEQ ID NO: 31252 - DNA, 21 bp, Homo sapiens
ttgttggtggtgtgtgtgtgt

SEQ ID NO: 31253 - DNA, 21 bp, Homo sapiens
tgtgtgtgtctgtgtgtgtgt

SEQ ID NO: 31254 - DNA, 24 bp, Homo sapiens
tgtatatagtgtgtgtgtgtgtgt

SEQ ID NO: 31255 - DNA, 21 bp, Homo sapiens
atatattgtgtgtgtgtgtgt

SEQ ID NO: 31256 - DNA, 19 bp, Homo sapiens
tgttctgtgtgtgtgtgtg

SEQ ID NO: 31257 - DNA, 21 bp, Homo sapiens
tatacttgtgtgtgtgtgtgt

SEQ ID NO: 31258 - DNA, 21 bp, Homo sapiens
tgtgtctctgtgtgtgtgtgt

SEQ ID NO: 31259 - DNA, 21 bp, Homo sapiens
tgtgcgaaagtgtgtgtgtgt

SEQ ID NO: 31260 - DNA, 19 bp, Homo sapiens
tttgtgctttgtttgatgt

SEQ ID NO: 31261 - DNA, 22 bp, Homo sapiens
tattttttgtgtgtgtgtgtgt

SEQ ID NO: 31262 - DNA, 23 bp, Homo sapiens
tctgtgtgtatgtgtgtgtgtgt

SEQ ID NO: 31263 - DNA, 18 bp, Homo sapiens
tatgtgagtgtgtgtgtg

SEQ ID NO: 31264 - DNA, 20 bp, Homo sapiens
tttgttgtgtgtgtgtgtgt

SEQ ID NO: 31265 - DNA, 23 bp, Homo sapiens
tgtgattttgtgtgtgtgtgtgt

SEQ ID NO: 31266 - DNA, 24 bp, Homo sapiens
tctccactttgtgtgtgtgtgtgt

SEQ ID NO: 31267 - DNA, 25 bp, Homo sapiens
tttgtgtgtgtggttgtgtgtgtgt

SEQ ID NO: 31268 - DNA, 24 bp, Homo sapiens
tgttagaggtgtgtgtgtgtgtgt

SEQ ID NO: 31269 - DNA, 24 bp, Homo sapiens
tctgttagaggtgtgtgtgtgtgt

SEQ ID NO: 31270 - DNA, 17 bp, Homo sapiens
tttgtttttgtgtgtgc

SEQ ID NO: 31271 - DNA, 22 bp, Homo sapiens
tgtgaggggtgtgtgtgtgtgt

SEQ ID NO: 31272 - DNA, 16 bp, Homo sapiens
tgtgtggtgtgtgtgt

SEQ ID NO: 31273 - DNA, 22 bp, Homo sapiens
tgtgatatgtgtgtgtgtgtgt

SEQ ID NO: 31274 - DNA, 22 bp, Homo sapiens
tctgtgtggcatgtgtgtgtgt

SEQ ID NO: 31275 - DNA, 21 bp, Homo sapiens
tgtgtttgtgtttgtgtgtgt

SEQ ID NO: 31276 - DNA, 21 bp, Homo sapiens
cttgtgcatgtgtgtgtgtgt

SEQ ID NO: 31277 - DNA, 21 bp, Homo sapiens
tgtgcacctgtgtgtgtgtgt

SEQ ID NO: 31278 - DNA, 21 bp, Homo sapiens
tatgaatgtgtgtgtgtgtgt

SEQ ID NO: 31279 - DNA, 20 bp, Homo sapiens
tgcagtgcgtgtgtgtgtgt

SEQ ID NO: 31280 - DNA, 23 bp, Homo sapiens
tgtatatatgtgtgtgtgtgtgt

SEQ ID NO: 31281 - DNA, 19 bp, Homo sapiens
tgcttgtgtgtgtgtgtgt

SEQ ID NO: 31282 - DNA, 19 bp, Homo sapiens
tgatcacgtgtgtgtgtgt

SEQ ID NO: 31283 - DNA, 19 bp, Homo sapiens
gttactgtgtgtgtgtgtg

SEQ ID NO: 31284 - DNA, 25 bp, Homo sapiens
cctaggctttgtgtgtgtgtgtgta

SEQ ID NO: 31285 - DNA, 22 bp, Homo sapiens
tataccgtgtgtgtgtgtgtgt

SEQ ID NO: 31286 - DNA, 18 bp, Homo sapiens
tgtgtgcatgtgtgtgtg

SEQ ID NO: 31287 - DNA, 23 bp, Homo sapiens
tgtgagtgtgcgtgtgtgtgtgt

SEQ ID NO: 31288 - DNA, 22 bp, Homo sapiens
tgtgtgttgtgtgtgtgtgtgt

SEQ ID NO: 31289 - DNA, 24 bp, Homo sapiens
tttatgaagggagtgtgtgtgtgt

SEQ ID NO: 31290 - DNA, 22 bp, Homo sapiens
tgaagtttgtgtgtgtgtgtgt

SEQ ID NO: 31291 - DNA, 23 bp, Homo sapiens
tctgcctctgtgtgtgtgtgtgt

SEQ ID NO: 31292 - DNA, 21 bp, Homo sapiens
tgtgggtgtgtgtgtgtgtgt

SEQ ID NO: 31293 - DNA, 23 bp, Homo sapiens
tgtgcgtgtgggtgtgtgtgtgt

SEQ ID NO: 31294 - DNA, 19 bp, Homo sapiens
tttgtgtttgtatgtgtgt

SEQ ID NO: 31295 - DNA, 23 bp, Homo sapiens
tgtgtaggtgtgtgtgtgtgtgt

SEQ ID NO: 31296 - DNA, 21 bp, Homo sapiens
tgtatatgtgtgtgtgtgtgt

SEQ ID NO: 31297 - DNA, 22 bp, Homo sapiens
ttgagcaggtgtgtgtgtgtgt

SEQ ID NO: 31298 - DNA, 19 bp, Homo sapiens
gtgcttgtgtgtgtgtgtg

SEQ ID NO: 31299 - DNA, 23 bp, Homo sapiens
cttgtgtgtgtgtgtgtgtgtgt

SEQ ID NO: 31300 - DNA, 21 bp, Homo sapiens
tatgggtgtgtgtgtgtgtgt

SEQ ID NO: 31301 - DNA, 25 bp, Homo sapiens
tgtgtatgtatgtgtgtgtgtgtgt

SEQ ID NO: 31302 - DNA, 25 bp, Homo sapiens
tgtgagagtatgtgtgtgtgtgtgt

SEQ ID NO: 31303 - DNA, 23 bp, Homo sapiens
tctgcgggtgtgtgtgtgtgtgt

SEQ ID NO: 31304 - DNA, 18 bp, Homo sapiens
cttgtctgtgtgtgtgtg

SEQ ID NO: 31305 - DNA, 23 bp, Homo sapiens
tttgtgtttgtgtgtgtgtgtgt

SEQ ID NO: 31306 - DNA, 23 bp, Homo sapiens
tgtgccagtgtgtgtgtgtgtgt

SEQ ID NO: 31307 - DNA, 21 bp, Homo sapiens
tgagattgtgtgtgtgtgtgt

SEQ ID NO: 31308 - DNA, 19 bp, Homo sapiens
gtggtgtgtgtgtgtgtgt

SEQ ID NO: 31309 - DNA, 114 bp, Equine herpesvirus 1
gcgggcgtggggacccggggagagaccaccaggcctcgccggttttctctctctccgttgggggggggatggtagggattggtgggtgaggtggttgtggtagtcattgtgagt

SEQ ID NO: 31310 - DNA, 24 bp, Equine herpesvirus 1
ggggatggtagggattggtgggtg

SEQ ID NO: 31311 - DNA, 16 bp, Homo sapiens
gggggtgagtgggggt

SEQ ID NO: 31312 - DNA, 22 bp, Homo sapiens
ggggactggtggggatggcggg

SEQ ID NO: 31313 - DNA, 18 bp, Homo sapiens
ggggagggtggggatgtg

SEQ ID NO: 31314 - DNA, 21 bp, Homo sapiens
ggggtggtgcgggggcaggtg

SEQ ID NO: 31315 - DNA, 18 bp, Homo sapiens
ggggtgtgggggttaatg

SEQ ID NO: 31316 - DNA, 18 bp, Homo sapiens
ggggtggggggattgggt

SEQ ID NO: 31317 - DNA, 22 bp, Homo sapiens
ggggtgctgggggagagtggtg

SEQ ID NO: 31318 - DNA, 24 bp, Homo sapiens
ggggataggtgggggaatgaggtg

SEQ ID NO: 31319 - DNA, 19 bp, Homo sapiens
ggggtggtaggaaggggtg

SEQ ID NO: 31320 - DNA, 20 bp, Homo sapiens
ggggtggtggggggcgggtg

SEQ ID NO: 31321 - DNA, 22 bp, Homo sapiens
ggggtgataggggagagaggtg

SEQ ID NO: 31322 - DNA, 16 bp, Homo sapiens
ggggatgggggggggg

SEQ ID NO: 31323 - DNA, 18 bp, Homo sapiens
ggggtggtggtggcaggt

SEQ ID NO: 31324 - DNA, 21 bp, Homo sapiens
ggggatggtaggaggtgggtg

SEQ ID NO: 31325 - DNA, 18 bp, Homo sapiens
ggggatggggggatggtg

SEQ ID NO: 31326 - DNA, 16 bp, Homo sapiens
ggggggtggggattga

SEQ ID NO: 31327 - DNA, 17 bp, Homo sapiens
ggggaggcttggtgggt

SEQ ID NO: 31328 - DNA, 21 bp, Homo sapiens
ggggctggtggggtgggggtg

SEQ ID NO: 31329 - DNA, 21 bp, Homo sapiens
gggggtgtagggggcagggtg

SEQ ID NO: 31330 - DNA, 17 bp, Homo sapiens
ggggtggtagggcttgg

SEQ ID NO: 31331 - DNA, 16 bp, Homo sapiens
ggggtggggggaggtg

SEQ ID NO: 31332 - DNA, 21 bp, Homo sapiens
ggggtggggtgggggtgggtg

SEQ ID NO: 31333 - DNA, 21 bp, Homo sapiens
ggggtggtgaggaagcgggtg

SEQ ID NO: 31334 - DNA, 19 bp, Homo sapiens
ggggatgggggggttgatg

SEQ ID NO: 31335 - DNA, 17 bp, Homo sapiens
ggggaggtggggaggtg

SEQ ID NO: 31336 - DNA, 21 bp, Homo sapiens
ggggtggtggggagttggatg

SEQ ID NO: 31337 - DNA, 18 bp, Homo sapiens
ggggtggtgggcaggggt

SEQ ID NO: 31338 - DNA, 19 bp, Homo sapiens
ggggatagtggggctgggt

SEQ ID NO: 31339 - DNA, 16 bp, Homo sapiens
ggggtgggggggtggg

SEQ ID NO: 31340 - DNA, 19 bp, Homo sapiens
ggggatgggagtggtgggt

SEQ ID NO: 31341 - DNA, 18 bp, Homo sapiens
ggggtggggggagcaggt

SEQ ID NO: 31342 - DNA, 19 bp, Homo sapiens
gggagtggtggggatgggt

SEQ ID NO: 31343 - DNA, 21 bp, Homo sapiens
ggggatggggggagcggggtg

SEQ ID NO: 31344 - DNA, 16 bp, Homo sapiens
ggggatggtggttggg

SEQ ID NO: 31345 - DNA, 18 bp, Homo sapiens
ggggtggggggttagggt

SEQ ID NO: 31346 - DNA, 22 bp, Homo sapiens
ggggatgggaggggatggggtg

SEQ ID NO: 31347 - DNA, 19 bp, Homo sapiens
ggggggggtggacgtgggt

SEQ ID NO: 31348 - DNA, 17 bp, Homo sapiens
ggggtggtagagagggt

SEQ ID NO: 31349 - DNA, 17 bp, Homo sapiens
ggggtggcagggggcgg

SEQ ID NO: 31350 - DNA, 19 bp, Homo sapiens
ggggatggtggtgatagtg

SEQ ID NO: 31351 - DNA, 18 bp, Homo sapiens
ggggatgatgaggtgggt

SEQ ID NO: 31352 - DNA, 23 bp, Homo sapiens
gggaatggtggggagtcagggtg

SEQ ID NO: 31353 - DNA, 18 bp, Homo sapiens
ggggatggtggtggaggt

SEQ ID NO: 31354 - DNA, 23 bp, Homo sapiens
ggggatggaaggttgtatgggtg

SEQ ID NO: 31355 - DNA, 18 bp, Homo sapiens
gggggtggggaggtgggt

SEQ ID NO: 31356 - DNA, 19 bp, Homo sapiens
ggcggtggtgatggtgggt

SEQ ID NO: 31357 - DNA, 131 bp, Cowpox virus
tggtctcataaaaaaagttttacaaaaatatttttattctctttctctcttcaatggtctcacaaaaatattaaacctctttctgatggagtcgtaaaaatatttttattctctttctgatgtctcaacta

SEQ ID NO: 31358 - DNA, 24 bp, Cowpox virus
tgatggagtcgtaaaaatattttt

SEQ ID NO: 31359 - DNA, 21 bp, Homo sapiens
tggagttctaaaaatattttt

SEQ ID NO: 31360 - DNA, 19 bp, Homo sapiens
tgtggcataaaaatatttt

SEQ ID NO: 31361 - DNA, 22 bp, Homo sapiens
tgctggatcataaaatattttt

SEQ ID NO: 31362 - DNA, 22 bp, Homo sapiens
tgaaggagctcaaaatattttt

SEQ ID NO: 31363 - DNA, 21 bp, Homo sapiens
tgggtcattagaaatattttt

SEQ ID NO: 31364 - DNA, 123 bp, Equine herpesvirus 1
ccgagcgggggagagcggtaggggaaacgccgcctgggatgagtgggaccgagtagtgtgtgataggcactagagggcgccagcgtacaggggagtgtacccaccaaaactccaacaccacgg

SEQ ID NO: 31365 - DNA, 24 bp, Equine herpesvirus 1
tacaggggagtgtacccaccaaaa

SEQ ID NO: 31366 - DNA, 19 bp, Homo sapiens
ggcagaagtgcccgccaaa

SEQ ID NO: 31367 - DNA, 23 bp, Homo sapiens
cagggagcgtgtgtgttcaccaa

SEQ ID NO: 31368 - DNA, 17 bp, Homo sapiens
tacagggagcgagccac

SEQ ID NO: 31369 - DNA, 17 bp, Homo sapiens
aaggaatacttaccaaa

SEQ ID NO: 31370 - DNA, 20 bp, Homo sapiens
cacagctcaggtacccgcca

SEQ ID NO: 31371 - DNA, 21 bp, Homo sapiens
taagggaacagtgcccaccaa

SEQ ID NO: 31372 - DNA, 24 bp, Homo sapiens
tacaggggtgaggtatcaccaaaa

SEQ ID NO: 31373 - DNA, 17 bp, Homo sapiens
aggggaatatcaccaaa

SEQ ID NO: 31374 - DNA, 17 bp, Homo sapiens
tacagtggagtgttcca

SEQ ID NO: 31375 - DNA, 18 bp, Homo sapiens
caggagagtaaagccacc

SEQ ID NO: 31376 - DNA, 18 bp, Homo sapiens
aggcagccagtacccacc

SEQ ID NO: 31377 - DNA, 23 bp, Homo sapiens
cagaggagaccacagcctgccaa

SEQ ID NO: 31378 - DNA, 18 bp, Homo sapiens
cagggcgaggcccaccaa

SEQ ID NO: 31379 - DNA, 22 bp, Homo sapiens
cacaggaaagtacttatcaaaa

SEQ ID NO: 31380 - DNA, 19 bp, Homo sapiens
ggggagtggtcaaccaaaa

SEQ ID NO: 31381 - DNA, 22 bp, Homo sapiens
cacaggggcactgccccaccaa

SEQ ID NO: 31382 - DNA, 18 bp, Homo sapiens
caggatgctgcccaccaa

SEQ ID NO: 31383 - DNA, 20 bp, Homo sapiens
caggggaggtatccacaaaa

SEQ ID NO: 31384 - DNA, 21 bp, Homo sapiens
aggattagatgcccaccaaaa

SEQ ID NO: 31385 - DNA, 21 bp, Homo sapiens
taagagaatctgtacctatca

SEQ ID NO: 31386 - DNA, 20 bp, Homo sapiens
gggcttcagtgtacccatca

SEQ ID NO: 31387 - DNA, 19 bp, Homo sapiens
acaggaaactgtccaccaa

SEQ ID NO: 31388 - DNA, 17 bp, Homo sapiens
tacagggagtgtttcca

SEQ ID NO: 31389 - DNA, 17 bp, Homo sapiens
tacagggggtcccacca

SEQ ID NO: 31390 - DNA, 21 bp, Homo sapiens
agggaaatatcactcatcaaa

SEQ ID NO: 31391 - DNA, 20 bp, Homo sapiens
gggatttttacccactaaaa

SEQ ID NO: 31392 - DNA, 17 bp, Homo sapiens
aagggagtgttcatcaa

SEQ ID NO: 31393 - DNA, 20 bp, Homo sapiens
ggggagtgaccacaaccaaa

SEQ ID NO: 31394 - DNA, 91 bp, Cowpox virus
tttttctttggtacaaaatttcacacaagtttttatacagacaaattcttgtccatatattttaaaacattgacttttgtactaagaaaaa

SEQ ID NO: 31395 - DNA, 24 bp, Cowpox virus
tctttggtacaaaatttcacacaa

SEQ ID NO: 31396 - DNA, 23 bp, Homo sapiens
tctttgtacaaaatattgtacaa

SEQ ID NO: 31397 - DNA, 18 bp, Homo sapiens
tctttggtacaaagctca

SEQ ID NO: 31398 - DNA, 18 bp, Homo sapiens
tctttggtataaaaatca

SEQ ID NO: 31399 - DNA, 18 bp, Homo sapiens
tctttgctagttcacaca

SEQ ID NO: 31400 - DNA, 22 bp, Homo sapiens
tttggcacaaagaaatatcaca

SEQ ID NO: 31401 - DNA, 20 bp, Homo sapiens
tctttggtggaaaacacgca

SEQ ID NO: 31402 - DNA, 18 bp, Homo sapiens
gtacaaaatctgcacgca

SEQ ID NO: 31403 - DNA, 18 bp, Homo sapiens
tttggtacaaatgccaca

SEQ ID NO: 31404 - DNA, 18 bp, Homo sapiens
tttggacagaatttcaca

SEQ ID NO: 31405 - DNA, 21 bp, Homo sapiens
tccttggtgcaatccagtaca

SEQ ID NO: 31406 - DNA, 18 bp, Homo sapiens
cttgaaagatttcacaca

SEQ ID NO: 31407 - DNA, 16 bp, Homo sapiens
tttggtacaaccaaca

SEQ ID NO: 31408 - DNA, 18 bp, Homo sapiens
tctttggtatgaaaatca

SEQ ID NO: 31409 - DNA, 18 bp, Homo sapiens
tctttggtagcaaaattt

SEQ ID NO: 31410 - DNA, 20 bp, Homo sapiens
ccttttttaaatttcacaca

SEQ ID NO: 31411 - DNA, 21 bp, Homo sapiens
tcttcggtacgaatctcacac

SEQ ID NO: 31412 - DNA, 20 bp, Homo sapiens
tttgctagtaaatttcacac

SEQ ID NO: 31413 - DNA, 19 bp, Homo sapiens
tttggtacaaaatgataca

SEQ ID NO: 31414 - DNA, 18 bp, Homo sapiens
tctttggttgtctacaca

SEQ ID NO: 31415 - DNA, 19 bp, Homo sapiens
tccttggcagttttacaca

SEQ ID NO: 31416 - DNA, 17 bp, Homo sapiens
tctttggtcatgtcaca

SEQ ID NO: 31417 - DNA, 22 bp, Homo sapiens
tctttgggttcctctcacacaa

SEQ ID NO: 31418 - DNA, 23 bp, Homo sapiens
tctatgctaggggtttcacacaa

SEQ ID NO: 31419 - DNA, 21 bp, Homo sapiens
tctttggtaaaaataaagaca

SEQ ID NO: 31420 - DNA, 22 bp, Homo sapiens
tctgatactaaaattttgcaca

SEQ ID NO: 31421 - DNA, 23 bp, Homo sapiens
tctttggtggacgtaattgcaca

SEQ ID NO: 31422 - DNA, 18 bp, Homo sapiens
tctgtggcacaagtttca

SEQ ID NO: 31423 - DNA, 19 bp, Homo sapiens
ctttggtactattcataca

SEQ ID NO: 31424 - DNA, 25 bp, Homo sapiens
tctttggtattagaactctacacaa

SEQ ID NO: 31425 - DNA, 21 bp, Homo sapiens
tctttggtaaaaaaaattgca

SEQ ID NO: 31426 - DNA, 20 bp, Homo sapiens
tttggtacgaaatcacacaa

SEQ ID NO: 31427 - DNA, 19 bp, Homo sapiens
tctttggtaaaggcaaaat

SEQ ID NO: 31428 - DNA, 20 bp, Homo sapiens
tctctggtacagagcagaca

SEQ ID NO: 31429 - DNA, 20 bp, Homo sapiens
ttcgacaaaatttcacacaa

SEQ ID NO: 31430 - DNA, 28 bp, Homo sapiens
tccttggtatgaaacatctttcacacaa

SEQ ID NO: 31431 - DNA, 18 bp, Homo sapiens
tctttagtatggaatctc

SEQ ID NO: 31432 - DNA, 82 bp, Cowpox virus
aaaatatttttattctctttctctcttcaatggtctcacaaaaatattaaacctctttctgatggagtcgtaaaaatatttt

SEQ ID NO: 31433 - DNA, 24 bp, Cowpox virus
aatatttttattctctttctctct

SEQ ID NO: 31434 - DNA, 16 bp, Homo sapiens
tatttttactctttcc

SEQ ID NO: 31435 - DNA, 24 bp, Homo sapiens
aatattttgtttgaatttctctct

SEQ ID NO: 31436 - DNA, 18 bp, Homo sapiens
ttcccactctctttttct

SEQ ID NO: 31437 - DNA, 20 bp, Homo sapiens
ggattttcaaccctctttct

SEQ ID NO: 31438 - DNA, 19 bp, Homo sapiens
atatttcttctttttctct

SEQ ID NO: 31439 - DNA, 24 bp, Homo sapiens
aatattttaattctcagactctct

SEQ ID NO: 31440 - DNA, 19 bp, Homo sapiens
attccttttctctttctct

SEQ ID NO: 31441 - DNA, 18 bp, Homo sapiens
ttctttcattttctctct

SEQ ID NO: 31442 - DNA, 15 bp, Homo sapiens
cttttactttctctc

SEQ ID NO: 31443 - DNA, 22 bp, Homo sapiens
tttttattttatttttctctct

SEQ ID NO: 31444 - DNA, 26 bp, Homo sapiens
atatttttttctcccgtggtctctct

SEQ ID NO: 31445 - DNA, 20 bp, Homo sapiens
ttttctttctttttctctct

SEQ ID NO: 31446 - DNA, 20 bp, Homo sapiens
tatttcatctctttctctct

SEQ ID NO: 31447 - DNA, 22 bp, Homo sapiens
aatattgttattctctacatct

SEQ ID NO: 31448 - DNA, 22 bp, Homo sapiens
acatatccatttctttctctct

SEQ ID NO: 31449 - DNA, 21 bp, Homo sapiens
aatatgtctatttttctctct

SEQ ID NO: 31450 - DNA, 21 bp, Homo sapiens
atatttttgttcccaatctct

SEQ ID NO: 31451 - DNA, 22 bp, Homo sapiens
atatttctttctctttctttct

SEQ ID NO: 31452 - DNA, 19 bp, Homo sapiens
aatattttctaattctctc

SEQ ID NO: 31453 - DNA, 24 bp, Homo sapiens
aatattttatttactgatctctct

SEQ ID NO: 31454 - DNA, 23 bp, Homo sapiens
tattttgtgccctttttctctct

SEQ ID NO: 31455 - DNA, 22 bp, Homo sapiens
atttttattagtagttctctct

SEQ ID NO: 31456 - DNA, 19 bp, Homo sapiens
tattttcttttctttctct

SEQ ID NO: 31457 - DNA, 18 bp, Homo sapiens
catttttgtcctctctct

SEQ ID NO: 31458 - DNA, 20 bp, Homo sapiens
tttttattctctgtaactct

SEQ ID NO: 31459 - DNA, 23 bp, Homo sapiens
tattttcagtcttgtttttctct

SEQ ID NO: 31460 - DNA, 21 bp, Homo sapiens
cattcctttctctttctttct

SEQ ID NO: 31461 - DNA, 124 bp, Human papillomavirus type 45
tgggaagtacaatatgggggcaatgtaattgattgtaatgactctatgtgcagtaccagtgacgacacggtatccgctactcagattgttagacagctacaacacgcctccacgtcgaccccca

SEQ ID NO: 31462 - DNA, 24 bp, Human papillomavirus type 45
tcagattgttagacagctacaaca

SEQ ID NO: 31463 - DNA, 18 bp, Homo sapiens
tcagattggaggctacaa

SEQ ID NO: 31464 - DNA, 21 bp, Homo sapiens
tcacattgtattgagctacaa

SEQ ID NO: 31465 - DNA, 18 bp, Homo sapiens
gaaggtcagacagctgca

SEQ ID NO: 31466 - DNA, 17 bp, Homo sapiens
ccggatcgccagcagct

SEQ ID NO: 31467 - DNA, 21 bp, Homo sapiens
tcagatggctcttagctacaa

SEQ ID NO: 31468 - DNA, 22 bp, Homo sapiens
cagccagtagacagctgcaaca

SEQ ID NO: 31469 - DNA, 23 bp, Homo sapiens
tcacattgtattgagctacaaca

SEQ ID NO: 31470 - DNA, 20 bp, Homo sapiens
tcacataaaaaatagctaca

SEQ ID NO: 31471 - DNA, 19 bp, Homo sapiens
agttgttagatagctatca

SEQ ID NO: 31472 - DNA, 19 bp, Homo sapiens
agattgtccggctgtaaca

SEQ ID NO: 31473 - DNA, 20 bp, Homo sapiens
tcagattgtgagattgcaca

SEQ ID NO: 31474 - DNA, 22 bp, Homo sapiens
tcaggctgtgagacagctgcaa

SEQ ID NO: 31475 - DNA, 19 bp, Homo sapiens
tcaggatgttagaagcagc

SEQ ID NO: 31476 - DNA, 22 bp, Homo sapiens
tcaaatcattatggctataaca

SEQ ID NO: 31477 - DNA, 18 bp, Homo sapiens
tcaagagttcagacagct

SEQ ID NO: 31478 - DNA, 17 bp, Homo sapiens
tcggattgtcacaccta

SEQ ID NO: 31479 - DNA, 124 bp, Cowpox virus
acctctttctgatggagtcgtaaaatattttattctctttctctcttcaatggtctcacaaaaatattaaacctctttctgatggagtcgtaaaatattttattctctttctctcttcaatggt

SEQ ID NO: 31480 - DNA, 24 bp, Cowpox virus
tattttattctctttctctcttca

SEQ ID NO: 31481 - DNA, 18 bp, Homo sapiens
cattttgttctcctcttc

SEQ ID NO: 31482 - DNA, 20 bp, Homo sapiens
tattctctgctctcttttca

SEQ ID NO: 31483 - DNA, 21 bp, Homo sapiens
ttctgttcttgctcctcttca

SEQ ID NO: 31484 - DNA, 22 bp, Homo sapiens
tattttcccccttttctttctt

SEQ ID NO: 31485 - DNA, 22 bp, Homo sapiens
tcttttcctttttttctcttca

SEQ ID NO: 31486 - DNA, 22 bp, Homo sapiens
ttttgttcagcttttctcttca

SEQ ID NO: 31487 - DNA, 25 bp, Homo sapiens
tattttttctcttcctcctttttca

SEQ ID NO: 31488 - DNA, 24 bp, Homo sapiens
tattttattttctcattttcttca

SEQ ID NO: 31489 - DNA, 24 bp, Homo sapiens
tattttattttttctttctctcct

SEQ ID NO: 31490 - DNA, 20 bp, Homo sapiens
ttttattttctctctttctt

SEQ ID NO: 31491 - DNA, 23 bp, Homo sapiens
tattttatgcttagaactcttca

SEQ ID NO: 31492 - DNA, 16 bp, Homo sapiens
ctttattttctctctt

SEQ ID NO: 31493 - DNA, 25 bp, Homo sapiens
attttattagtagcttttctcttca

SEQ ID NO: 31494 - DNA, 26 bp, Homo sapiens
tatttttttctcccgtggtctctctt

SEQ ID NO: 31495 - DNA, 21 bp, Homo sapiens
tacttttgtgacttctctctt

SEQ ID NO: 31496 - DNA, 18 bp, Homo sapiens
tttattttcccctcttca

SEQ ID NO: 31497 - DNA, 21 bp, Homo sapiens
tttatcctacttttttcttca

SEQ ID NO: 31498 - DNA, 23 bp, Homo sapiens
tttctttctttctttctctcttc

SEQ ID NO: 31499 - DNA, 22 bp, Homo sapiens
attttttcactttctcttttca

SEQ ID NO: 31500 - DNA, 20 bp, Homo sapiens
tccatttctttctctcttca

SEQ ID NO: 31501 - DNA, 21 bp, Homo sapiens
cattttattttctttttcttc

SEQ ID NO: 31502 - DNA, 18 bp, Homo sapiens
tattttatctttctcctt

SEQ ID NO: 31503 - DNA, 19 bp, Homo sapiens
ttttattctttttcatctt

SEQ ID NO: 31504 - DNA, 16 bp, Homo sapiens
tattttattttctctc

SEQ ID NO: 31505 - DNA, 20 bp, Homo sapiens
ttttatcctctttgctcctt

SEQ ID NO: 31506 - DNA, 20 bp, Homo sapiens
cttctttctctttctctctt

SEQ ID NO: 31507 - DNA, 18 bp, Homo sapiens
tattttattctctcattc

SEQ ID NO: 31508 - DNA, 22 bp, Homo sapiens
tattttcttttctttctctttc

SEQ ID NO: 31509 - DNA, 18 bp, Homo sapiens
tatttctgttctttctct

SEQ ID NO: 31510 - DNA, 22 bp, Homo sapiens
cttgactctctttcttttttca

SEQ ID NO: 31511 - DNA, 19 bp, Homo sapiens
tattttatttcctttctcc

SEQ ID NO: 31512 - DNA, 82 bp, Cowpox virus
ataaaaaagttttacaaaaatatttttattctctttctctcttcaatggtctcataaaaaagttttacaaaaatatttttat

SEQ ID NO: 31513 - DNA, 24 bp, Cowpox virus
tcataaaaaagttttacaaaaata

SEQ ID NO: 31514 - DNA, 23 bp, Homo sapiens
tcataaaagagctattttacaaa

SEQ ID NO: 31515 - DNA, 23 bp, Homo sapiens
tcatttcaaagttttataaaaat

SEQ ID NO: 31516 - DNA, 21 bp, Homo sapiens
taaaaaagacacacaaaaata

SEQ ID NO: 31517 - DNA, 22 bp, Homo sapiens
ataaaaaagccttataaaaata

SEQ ID NO: 31518 - DNA, 24 bp, Homo sapiens
tcataaagcaagtgaccaaaaata

SEQ ID NO: 31519 - DNA, 21 bp, Homo sapiens
aaaaagtcttgtacaaaaata

SEQ ID NO: 31520 - DNA, 23 bp, Homo sapiens
taaaaaagtaaaaaacaaaaata

SEQ ID NO: 31521 - DNA, 18 bp, Homo sapiens
tcataaaaatacaaaaat

SEQ ID NO: 31522 - DNA, 24 bp, Homo sapiens
tcatgaaacagttttaccaaaata

SEQ ID NO: 31523 - DNA, 24 bp, Homo sapiens
tcacaaatacattttacaaaaata

SEQ ID NO: 31524 - DNA, 21 bp, Homo sapiens
tcattaaacttttacaaaaat

SEQ ID NO: 31525 - DNA, 24 bp, Homo sapiens
ccataaaaagacccaccaaaaata

SEQ ID NO: 31526 - DNA, 18 bp, Homo sapiens
tcacaaaaaagtcacaaa

SEQ ID NO: 31527 - DNA, 81 bp, Cowpox virus
aaaatatttttattctctttctctcttcaatggtctcacaaaaatattaaacctctttctgatggagtcgtaaaatatttt

SEQ ID NO: 31528 - DNA, 109 bp, Human papillomavirus type 45
tacatatgcatgctttacacaccatacaataattactataatgtacagtacagtgtaacatacctgtgatgtgcatgttgttgtatttttgtatttttgtatttttgta

SEQ ID NO: 31529 - DNA, 24 bp, Human papillomavirus type 45
taatgtacagtacagtgtaacata

SEQ ID NO: 31530 - DNA, 19 bp, Homo sapiens
taatgtacagaacaggata

SEQ ID NO: 31531 - DNA, 20 bp, Homo sapiens
atgtacagtactgcagcata

SEQ ID NO: 31532 - DNA, 19 bp, Homo sapiens
taatgtacagatcaatgta

SEQ ID NO: 31533 - DNA, 20 bp, Homo sapiens
taatgtacactactgatata

SEQ ID NO: 31534 - DNA, 18 bp, Homo sapiens
taatgtacattacagtat

SEQ ID NO: 31535 - DNA, 22 bp, Homo sapiens
tacatgtgcagtgtacaacata

SEQ ID NO: 31536 - DNA, 23 bp, Homo sapiens
taatttacagtattgtcaaacat

SEQ ID NO: 31537 - DNA, 19 bp, Homo sapiens
taatgtacatgaaagcata

SEQ ID NO: 31538 - DNA, 23 bp, Homo sapiens
taatgtgcagtttatataacata

SEQ ID NO: 31539 - DNA, 18 bp, Homo sapiens
taatgtacatataatgta

SEQ ID NO: 31540 - DNA, 17 bp, Homo sapiens
gtgcaggagtgtaacat

SEQ ID NO: 31541 - DNA, 20 bp, Homo sapiens
atgtacagtaagaaaatata

SEQ ID NO: 31542 - DNA, 18 bp, Homo sapiens
aatgtacagtaccaatat

SEQ ID NO: 31543 - DNA, 18 bp, Homo sapiens
tgtacagtgagtgaacat

SEQ ID NO: 31544 - DNA, 23 bp, Homo sapiens
taatgtacagttttgaaagtgta

SEQ ID NO: 31545 - DNA, 18 bp, Homo sapiens
aatgtacagcagtgacat

SEQ ID NO: 31546 - DNA, 17 bp, Homo sapiens
tgtacagtacagtacat

SEQ ID NO: 31547 - DNA, 19 bp, Homo sapiens
caatgtacagtattttgca

SEQ ID NO: 31548 - DNA, 21 bp, Homo sapiens
atgtacagtactgacagtata

SEQ ID NO: 31549 - DNA, 22 bp, Homo sapiens
taatatacagtcaagatgatgt

SEQ ID NO: 31550 - DNA, 23 bp, Homo sapiens
taatttacagcatcagtaacata

SEQ ID NO: 31551 - DNA, 82 bp, Cowpox virus
aaaatatttttattctctttctcgcttcaatggtctcacaaaaatattaaacctctttctgatggagtcgtaaaaatatttt

SEQ ID NO: 31552 - DNA, 24 bp, Cowpox virus
aatatttttattctctttctcgct

SEQ ID NO: 31553 - DNA, 21 bp, Homo sapiens
aatattttctcttttcttgct

SEQ ID NO: 31554 - DNA, 19 bp, Homo sapiens
aatattttcatttccttct

SEQ ID NO: 31555 - DNA, 19 bp, Homo sapiens
ttttattcggtttcttgct

SEQ ID NO: 31556 - DNA, 21 bp, Homo sapiens
aatattgttattctctacatc

SEQ ID NO: 31557 - DNA, 20 bp, Homo sapiens
atattcctctttttctcgct

SEQ ID NO: 31558 - DNA, 24 bp, Homo sapiens
aacatttttatttttaactccgct

SEQ ID NO: 31559 - DNA, 95 bp, Ictalurid herpesvirus 1
tcccccgggaaacgtcctctcgatgatccggacgaggttcctagttctcaactaggtgacccagctccgcatcgagagtggcagctcccccggga

SEQ ID NO: 31560 - DNA, 24 bp, Ictalurid herpesvirus 1
tcgatgatccggacgaggttccta

SEQ ID NO: 31561 - DNA, 17 bp, Homo sapiens
tcatgatttggacgaga

SEQ ID NO: 31562 - DNA, 26 bp, Homo sapiens
gatgatcctggattttataggaacct

SEQ ID NO: 31563 - DNA, 20 bp, Homo sapiens
gatgattacttaaggttcct

SEQ ID NO: 31564 - DNA, 20 bp, Homo sapiens
tcggagatctggggtctcct

SEQ ID NO: 31565 - DNA, 123 bp, Equine herpesvirus 1
ccgtggtgttggagttttggtgggtacactcccctgtacgctggcgccctctagtgcctatcacacactactcggtcccactcatcccaggcggcgtttcccctaccgctctcccccgctcgg

SEQ ID NO: 31566 - DNA, 24 bp, Equine herpesvirus 1
tcggtcccactcatcccaggcggc

SEQ ID NO: 31567 - DNA, 20 bp, Homo sapiens
gtcatctcatcccaggtggc

SEQ ID NO: 31568 - DNA, 17 bp, Homo sapiens
tcggtcccgtccggacg

SEQ ID NO: 31569 - DNA, 19 bp, Homo sapiens
ggccccactcgcccgcggc

SEQ ID NO: 31570 - DNA, 27 bp, Homo sapiens
tcggtcccgcctcaagcaccgggtggc

SEQ ID NO: 31571 - DNA, 19 bp, Homo sapiens
tcggtcccacttctcccag

SEQ ID NO: 31572 - DNA, 25 bp, Homo sapiens
tcggtcccgtctcgagggccgcggc

SEQ ID NO: 31573 - DNA, 24 bp, Homo sapiens
tcggctcactcatcccccaaacgg

SEQ ID NO: 31574 - DNA, 17 bp, Homo sapiens
tcggttccatcatccca

SEQ ID NO: 31575 - DNA, 24 bp, Homo sapiens
tcggtcccattcatccgagggggc

SEQ ID NO: 31576 - DNA, 22 bp, Homo sapiens
tcggccccattcatctccctgg

SEQ ID NO: 31577 - DNA, 19 bp, Homo sapiens
cggtctcggacccaggcgg

SEQ ID NO: 31578 - DNA, 128 bp, Ictalurid herpesvirus 1
gaattattattattcttattattcttattccacgagagtatgagctcgtctgtaagagcctgaacgatgattattcttatttcacgagagtatgagctcgtctgtaagagcctgaacgatgattattc

SEQ ID NO: 31579 - DNA, 24 bp, Ictalurid herpesvirus 1
tgagctcgtctgtaagagcctgaa

SEQ ID NO: 31580 - DNA, 26 bp, Homo sapiens
tgagctcgtcctgcgtcttgagcttg

SEQ ID NO: 31581 - DNA, 18 bp, Homo sapiens
agctacttgggagcctga

SEQ ID NO: 31582 - DNA, 18 bp, Homo sapiens
tggctctcaaagagcctg

SEQ ID NO: 31583 - DNA, 19 bp, Homo sapiens
tgacttgtcaacagcctga

SEQ ID NO: 31584 - DNA, 18 bp, Homo sapiens
tcatctgtaagccacctg

SEQ ID NO: 31585 - DNA, 20 bp, Homo sapiens
tgagtccagtaagagcttga

SEQ ID NO: 31586 - DNA, 20 bp, Homo sapiens
gagcctaagtgagagtctga

SEQ ID NO: 31587 - DNA, 17 bp, Homo sapiens
tggctggtgagagcctg

SEQ ID NO: 31588 - DNA, 24 bp, Homo sapiens
tgagctatgtcatttcagcctgaa

SEQ ID NO: 31589 - DNA, 19 bp, Homo sapiens
tgagttcgcctgtggagag

SEQ ID NO: 31590 - DNA, 22 bp, Homo sapiens
tgagtcgtctgtgggtacgctg

SEQ ID NO: 31591 - DNA, 21 bp, Homo sapiens
tgagttcatctgtagaatgaa

SEQ ID NO: 31592 - DNA, 17 bp, Homo sapiens
tgggcttgctgtaagag

SEQ ID NO: 31593 - DNA, 24 bp, Homo sapiens
tgagctttttgtaactaacctgaa

SEQ ID NO: 31594 - DNA, 18 bp, Homo sapiens
tggactcgtctgctctga

SEQ ID NO: 31595 - DNA, 17 bp, Homo sapiens
tggctcgtctgtggctg

SEQ ID NO: 31596 - DNA, 19 bp, Homo sapiens
tgggctagtctgtaagtga

SEQ ID NO: 31597 - DNA, 23 bp, Homo sapiens
tggctcgggctggaggagcctga

SEQ ID NO: 31598 - DNA, 16 bp, Homo sapiens
tgagcccaggagcctg

SEQ ID NO: 31599 - DNA, 16 bp, Homo sapiens
gagctcagagagcctg

SEQ ID NO: 31600 - DNA, 20 bp, Homo sapiens
tgaggctcacaggagcctga

SEQ ID NO: 31601 - DNA, 20 bp, Homo sapiens
tgatcttctctgagagcctg

SEQ ID NO: 31602 - DNA, 19 bp, Homo sapiens
tggctcgtctgtaaggtcc

SEQ ID NO: 31603 - DNA, 106 bp, Bovine herpesvirus 1
gcgggctggtcatcggcattctggcgcaccggtgcgcgctcctccccttggtcttcccggcaaccccgcgcacggccgcgtgcggcgtgccgtgggacgagcccgc

SEQ ID NO: 31604 - DNA, 24 bp, Bovine herpesvirus 1
tctggcgcaccggtgcgcgctcct

SEQ ID NO: 31605 - DNA, 24 bp, Homo sapiens
tctggccacggcccgcgcgctcct

SEQ ID NO: 31606 - DNA, 21 bp, Homo sapiens
tctgcgctttggtgcgctcct

SEQ ID NO: 31607 - DNA, 17 bp, Homo sapiens
tctgcgcacctgcttct

SEQ ID NO: 31608 - DNA, 23 bp, Homo sapiens
tgtgcacacccctgtgcgcttct

SEQ ID NO: 31609 - DNA, 22 bp, Homo sapiens
ctggcgtgggctacgcgctcct

SEQ ID NO: 31610 - DNA, 25 bp, Homo sapiens
ctggcgcgctccaccctgcgctcct

SEQ ID NO: 31611 - DNA, 129 bp, Ictalurid herpesvirus 1
atgtgttttttattaaagagatcattcacgtgtggtttttattgaaaagaaattaaatgtacatttgattatttacatgtgttttttattaaagagatcatttacgtgtgttttttattgaaaagaaat

SEQ ID NO: 31612 - DNA, 24 bp, Ictalurid herpesvirus 1
tgttttttattaaagagatcattc

SEQ ID NO: 31613 - DNA, 21 bp, Homo sapiens
tgttttttattaagcacattc

SEQ ID NO: 31614 - DNA, 19 bp, Homo sapiens
tgtttttttttaaagagat

SEQ ID NO: 31615 - DNA, 19 bp, Homo sapiens
tgtcttttattagagaatc

SEQ ID NO: 31616 - DNA, 18 bp, Homo sapiens
tgtattttacagatcatt

SEQ ID NO: 31617 - DNA, 17 bp, Homo sapiens
tgttttttactagagac

SEQ ID NO: 31618 - DNA, 16 bp, Homo sapiens
tgtttttcattgagat

SEQ ID NO: 31619 - DNA, 21 bp, Homo sapiens
tgttttttaatagccagagat

SEQ ID NO: 31620 - DNA, 19 bp, Homo sapiens
tgtttattattaaagtgat

SEQ ID NO: 31621 - DNA, 73 bp, Ictalurid herpesvirus 1
tattcttatttcatgagagtatgagctcgtctgtgagagcctgaacgatgattattcttatttcatgagagta

SEQ ID NO: 31622 - DNA, 24 bp, Ictalurid herpesvirus 1
ttcatgagagtatgagctcgtctg

SEQ ID NO: 31623 - DNA, 25 bp, Homo sapiens
ttcttgagagtatgttgacagtctg

SEQ ID NO: 31624 - DNA, 22 bp, Homo sapiens
ttcatgaggagtgtggacagct

SEQ ID NO: 31625 - DNA, 18 bp, Homo sapiens
ttcatcagagtatggctc

SEQ ID NO: 31626 - DNA, 18 bp, Homo sapiens
ttcatggaagtatgagct

SEQ ID NO: 31627 - DNA, 16 bp, Homo sapiens
ttcatgagagtaggct

SEQ ID NO: 31628 - DNA, 18 bp, Homo sapiens
ttcaggagggactcgtct

SEQ ID NO: 31629 - DNA, 81 bp, Ictalurid herpesvirus 1
ccgtgatcgatcccctcccgcccggtggccccgaaacgagggtcgatttcaacggacgccccgggaggaaaaaatgcacgg

SEQ ID NO: 31630 - DNA, 24 bp, Ictalurid herpesvirus 1
tttcaacggacgccccgggaggaa

SEQ ID NO: 31631 - DNA, 16 bp, Homo sapiens
ttccaaccccgggggg

SEQ ID NO: 31632 - DNA, 18 bp, Homo sapiens
tttcaacggttgctggag

SEQ ID NO: 31633 - DNA, 16 bp, Homo sapiens
caaggtcccgggagga

SEQ ID NO: 31634 - DNA, 17 bp, Homo sapiens
tttcaacggattccggg

SEQ ID NO: 31635 - DNA, 20 bp, Homo sapiens
tttcaccatcccgggaggaa

SEQ ID NO: 31636 - DNA, 19 bp, Homo sapiens
tttcagcagacgcctggaa

SEQ ID NO: 31637 - DNA, 17 bp, Homo sapiens
tttcaaccccgggggga

SEQ ID NO: 31638 - DNA, 23 bp, Homo sapiens
tctcacatcagccctgggaggaa

SEQ ID NO: 31639 - DNA, 23 bp, Homo sapiens
tttcaccgggttgcggggaggaa

SEQ ID NO: 31640 - DNA, 20 bp, Homo sapiens
ttcaactctcctgggaggaa

SEQ ID NO: 31641 - DNA, 20 bp, Homo sapiens
tctcccggcgtcccgggagg

SEQ ID NO: 31642 - DNA, 18 bp, Homo sapiens
tttcaatgactgggagga

SEQ ID NO: 31643 - DNA, 18 bp, Homo sapiens
cttcaacgactgggagga

SEQ ID NO: 31644 - DNA, 88 bp, Ictalurid herpesvirus 1
tattcttatttcatgagagtatgagctagtctgtgagagcctgaacggtgatcattcttattatcattattcttatttcatgagagta

SEQ ID NO: 31645 - DNA, 24 bp, Ictalurid herpesvirus 1
tgatcattcttattatcattattc

SEQ ID NO: 31646 - DNA, 18 bp, Homo sapiens
cattcttccgtcattatt

SEQ ID NO: 31647 - DNA, 18 bp, Homo sapiens
attattattatcattatt

SEQ ID NO: 31648 - DNA, 20 bp, Homo sapiens
ccatttttattgtcattatt

SEQ ID NO: 31649 - DNA, 22 bp, Homo sapiens
tgttcattcttacagtttattc

SEQ ID NO: 31650 - DNA, 69 bp, Cowpox virus
atgaagttaatgatacacactacactgtcgaatttgatagggacaaagtagttgacgcgtttatttcat

SEQ ID NO: 31651 - DNA, 69 bp, Cowpox virus; identical to SEQ ID NO: 31650

SEQ ID NO: 31652 - DNA, 18 bp, Homo sapiens
ctaatgatacatgctaca

SEQ ID NO: 31653 - DNA, 18 bp, Homo sapiens
ttaatgatacaatactgc

SEQ ID NO: 31654 - DNA, 18 bp, Homo sapiens
ttaatgatctacactaca

SEQ ID NO: 31655 - DNA, 20 bp, Homo sapiens
ttaatgatatcactgcaccg

SEQ ID NO: 31656 - DNA, 21 bp, Homo sapiens
taacatgacgctacactgtcg

SEQ ID NO: 31657 - DNA, 18 bp, Homo sapiens
taatagtgcacactgcca

SEQ ID NO: 31658 - DNA, 88 bp, Rhesus monkey papillomavirus
tggccttccagatgctaacttttatgaccctaacacacagcgccttgtgtgggcctgtttaggcgtggaggtggggcgtggacagcca

SEQ ID NO: 31659 - DNA, 24 bp, Rhesus monkey papillomavirus
taacttttatgaccctaacacaca

SEQ ID NO: 31660 - DNA, 20 bp, Homo sapiens
ttttattttcttaacacaca

SEQ ID NO: 31661 - DNA, 19 bp, Homo sapiens
acttttatggagacacaca

SEQ ID NO: 31662 - DNA, 21 bp, Homo sapiens
cttttatgtgtagcctgacac

SEQ ID NO: 31663 - DNA, 17 bp, Homo sapiens
taacctttatgacctaa

SEQ ID NO: 31664 - DNA, 19 bp, Homo sapiens
cttttataatcttcacaca

SEQ ID NO: 31665 - DNA, 18 bp, Homo sapiens
ttttatgaccttaagaca

SEQ ID NO: 31666 - DNA, 20 bp, Homo sapiens
ttttaataccctaacataca

SEQ ID NO: 31667 - DNA, 19 bp, Homo sapiens
ttttacacattaacacaca

SEQ ID NO: 31668 - DNA, 20 bp, Homo sapiens
ttttataattttctaacaca

SEQ ID NO: 31669 - DNA, 19 bp, Homo sapiens
taactttatgacttccaca

SEQ ID NO: 31670 - DNA, 21 bp, Homo sapiens
taacatttatgactccaaaca

SEQ ID NO: 31671 - DNA, 20 bp, Homo sapiens
acttttatgacatccataca

SEQ ID NO: 31672 - DNA, 21 bp, Homo sapiens
acttctatgtacaaacacaca

SEQ ID NO: 31673 - DNA, 24 bp, Homo sapiens
acttttatgaaaataaaacacaca

SEQ ID NO: 31674 - DNA, 20 bp, Homo sapiens
acttttatggccatgacaca

SEQ ID NO: 31675 - DNA, 19 bp, Homo sapiens
caactttcctctctaacac

SEQ ID NO: 31676 - DNA, 19 bp, Homo sapiens
cttttgtgttttaacacac

SEQ ID NO: 31677 - DNA, 21 bp, Homo sapiens
acttagcaactttaacacaca

SEQ ID NO: 31678 - DNA, 22 bp, Homo sapiens
taaattttatgaagaacacaca

SEQ ID NO: 31679 - DNA, 22 bp, Homo sapiens
acttctactactttaacataca

SEQ ID NO: 31680 - DNA, 21 bp, Homo sapiens
ttttatgaaccattttaacac

SEQ ID NO: 31681 - DNA, 17 bp, Homo sapiens
ttttatgacacctcaca

SEQ ID NO: 31682 - DNA, 16 bp, Homo sapiens
cttttattaacacaca

SEQ ID NO: 31683 - DNA, 19 bp, Homo sapiens
aacttttatatataacaca

SEQ ID NO: 31684 - DNA, 18 bp, Homo sapiens
acttttatggctaacaca

SEQ ID NO: 31685 - DNA, 25 bp, Homo sapiens
caacttttttctctcctgacacaca

SEQ ID NO: 31686 - DNA, 19 bp, Homo sapiens
acctcctaatcctaacaca

SEQ ID NO: 31687 - DNA, 23 bp, Homo sapiens
taacttttcatggcccatttaca

SEQ ID NO: 31688 - DNA, 16 bp, Homo sapiens
cttcctccctaacaca

SEQ ID NO: 31689 - DNA, 29 bp, Homo sapiens
acttttatgcctgtcaccctgacatacat

SEQ ID NO: 31690 - DNA, 63 bp, Rhesus monkey papillomavirus
cctccacagttactacaccatataataatgagagttttaaagagtacctgcgacatgtggagg

SEQ ID NO: 31691 - DNA, 24 bp, Rhesus monkey papillomavirus
tccacagttactacaccatataat

SEQ ID NO: 31692 - DNA, 18 bp, Homo sapiens
gctaccatgtcatataat

SEQ ID NO: 31693 - DNA, 21 bp, Homo sapiens
cagtagctcctgccatataat

SEQ ID NO: 31694 - DNA, 18 bp, Homo sapiens
tccacatcaaccatataa

SEQ ID NO: 31695 - DNA, 24 bp, Homo sapiens
tccgcaattacttctggatataat

SEQ ID NO: 31696 - DNA, 19 bp, Homo sapiens
agttactactacaaataat

SEQ ID NO: 31697 - DNA, 16 bp, Homo sapiens
cacagttctcatataa

SEQ ID NO: 31698 - DNA, 21 bp, Homo sapiens
tccacagttattggatcacat

SEQ ID NO: 31699 - DNA, 18 bp, Homo sapiens
tccacagttttatacacc

SEQ ID NO: 31700 - DNA, 19 bp, Homo sapiens
tccacagtaactacagacc

SEQ ID NO: 31701 - DNA, 21 bp, Homo sapiens
ccacagttattgcattcatat

SEQ ID NO: 31702 - DNA, 109 bp, Cercopithecine herpesvirus 7
taagggcagggaggagatacgtatgcaaaagcgggggggactgcggtcaacaataagtaaaaacccgcccgccacatctttcgccacaatcggcctccagaggctttta

SEQ ID NO: 31703 - DNA, 24 bp, Cercopithecine herpesvirus 7
tgcaaaagcgggggggactgcggt

SEQ ID NO: 31704 - DNA, 18 bp, Homo sapiens
tgcaagagcgggggcagg

SEQ ID NO: 31705 - DNA, 19 bp, Homo sapiens
gcagaaggcgggctgtggt

SEQ ID NO: 31706 - DNA, 18 bp, Homo sapiens
agcgggagtgggggcagc

SEQ ID NO: 31707 - DNA, 20 bp, Homo sapiens
gcagaggcggctactgcggt

SEQ ID NO: 31708 - DNA, 21 bp, Homo sapiens
tgcaagagaggggagggtggt

SEQ ID NO: 31709 - DNA, 19 bp, Homo sapiens
tgtaagagtggagggaagg

SEQ ID NO: 31710 - DNA, 21 bp, Homo sapiens
tgcggcgggcgggactgcggt

SEQ ID NO: 31711 - DNA, 16 bp, Homo sapiens
agcggggagctgcggt

SEQ ID NO: 31712 - DNA, 18 bp, Homo sapiens
gcaagggtgggggcttgg

SEQ ID NO: 31713 - DNA, 21 bp, Homo sapiens
caaaagcacaaaggctgtggt

SEQ ID NO: 31714 - DNA, 23 bp, Homo sapiens
tacaaaagtgaacaaattgtggt

SEQ ID NO: 31715 - DNA, 22 bp, Homo sapiens
tgcaggggcagggggccagggt

SEQ ID NO: 31716 - DNA, 17 bp, Homo sapiens
agcagaaggaaatggat

SEQ ID NO: 31717 - DNA, 20 bp, Homo sapiens
gcgatcttggggactgtggt

SEQ ID NO: 31718 - DNA, 20 bp, Homo sapiens
gcggaagcggaggctgcggt

SEQ ID NO: 31719 - DNA, 22 bp, Homo sapiens
aagcgggggctgctgctgtggt

SEQ ID NO: 31720 - DNA, 63 bp, Rhesus monkey papillomavirus
taacgttgcttatatttatgttgttgtacccagtgtgcatgatttatgtatgtgtgcatgttg

SEQ ID NO: 31721 - DNA, 24 bp, Rhesus monkey papillomavirus
acgttgcttatatttatgttgttg

SEQ ID NO: 31722 - DNA, 18 bp, Homo sapiens
cgttgcttacatatgttg

SEQ ID NO: 31723 - DNA, 19 bp, Homo sapiens
gttgcttatatggatgttg

SEQ ID NO: 31724 - DNA, 21 bp, Homo sapiens
actttaatatttatgttgttg

SEQ ID NO: 31725 - DNA, 19 bp, Homo sapiens
attgcttatatttttattg

SEQ ID NO: 31726 - DNA, 20 bp, Homo sapiens
tgatgtaatttatgttgttg

SEQ ID NO: 31727 - DNA, 22 bp, Homo sapiens
gttgattatattcacattgttg

SEQ ID NO: 31728 - DNA, 66 bp, Rhesus monkey papillomavirus
caaaaccacaacactgctaatcctctggcttcctgcctctcctactgctgcatacctgtggttgtg

SEQ ID NO: 31729 - DNA, 24 bp, Rhesus monkey papillomavirus
aaccacaacactgctaatcctctg

SEQ ID NO: 31730 - DNA, 18 bp, Homo sapiens
cagcactgtgatcctctg

SEQ ID NO: 31731 - DNA, 21 bp, Homo sapiens
cctccacttgctgatcctctg

SEQ ID NO: 31732 - DNA, 18 bp, Homo sapiens
aacactgcctcccttctg

SEQ ID NO: 31733 - DNA, 20 bp, Homo sapiens
aaccatacactgccacccct

SEQ ID NO: 31734 - DNA, 21 bp, Homo sapiens
catcacagtactaaccctctg

SEQ ID NO: 31735 - DNA, 20 bp, Homo sapiens
ccagggctgcagatcctctg

SEQ ID NO: 31736 - DNA, 23 bp, Homo sapiens
aaccacaaataaaatcttctctg

SEQ ID NO: 31737 - DNA, 20 bp, Homo sapiens
aaccacaagctgacaattct

SEQ ID NO: 31738 - DNA, 24 bp, Homo sapiens
cacaacactgtttaatcagctctg

SEQ ID NO: 31739 - DNA, 27 bp, Homo sapiens
aaccactaatgctgctattcaaatctg

SEQ ID NO: 31740 - DNA, 21 bp, Homo sapiens
aaccacaacactgccacactg

SEQ ID NO: 31741 - DNA, 20 bp, Homo sapiens
acggtgcacataatcctctg

SEQ ID NO: 31742 - DNA, 20 bp, Homo sapiens
cacatgactgacatcctctg

SEQ ID NO: 31743 - DNA, 23 bp, Homo sapiens
cagcaacactgcagctgcttctg

SEQ ID NO: 31744 - DNA, 18 bp, Homo sapiens
acccagcgcccatcctct

SEQ ID NO: 31745 - DNA, 21 bp, Homo sapiens
actgcaacactgatttctctg

SEQ ID NO: 31746 - DNA, 21 bp, Homo sapiens
ccacactgacgtaatcctctg

SEQ ID NO: 31747 - DNA, 19 bp, Homo sapiens
cactgtctggaatcctctg

SEQ ID NO: 31748 - DNA, 19 bp, Homo sapiens
cagctgctgaaatcctctg

SEQ ID NO: 31749 - DNA, 21 bp, Homo sapiens
cagcagcaccaccatcctctg

SEQ ID NO: 31750 - DNA, 19 bp, Homo sapiens
accacaacacccagctaat

SEQ ID NO: 31751 - DNA, 21 bp, Homo sapiens
acctggccaaacaatcctctg

SEQ ID NO: 31752 - DNA, 16 bp, Homo sapiens
cccaatccaatcctct

SEQ ID NO: 31753 - DNA, 20 bp, Homo sapiens
acactgctggatcaagtctg

SEQ ID NO: 31754 - DNA, 23 bp, Homo sapiens
aaccatagaggacacatcctctg

SEQ ID NO: 31755 - DNA, 19 bp, Homo sapiens
aacttcaacactgtcttct

SEQ ID NO: 31756 - DNA, 21 bp, Homo sapiens
aaccacaactttgcttctctg

SEQ ID NO: 31757 - DNA, 25 bp, Homo sapiens
ccaccaacagactgctaattctctg

SEQ ID NO: 31758 - DNA, 20 bp, Homo sapiens
accaatacctaccttctctg

SEQ ID NO: 31759 - DNA, 67 bp, Cercopithecine herpesvirus 7
ctgaaatacccgtaaacggggatgtataaacgcaaaatgcccgtccctcccgaatggcgtatattag

SEQ ID NO: 31760 - DNA, 24 bp, Cercopithecine herpesvirus 7
tacccgtaaacggggatgtataaa

SEQ ID NO: 31761 - DNA, 18 bp, Homo sapiens
tactgtaaacaaagtgta

SEQ ID NO: 31762 - DNA, 19 bp, Homo sapiens
cacctgtgggtatgtataa

SEQ ID NO: 31763 - DNA, 18 bp, Homo sapiens
tacccctaaaatgtataa

SEQ ID NO: 31764 - DNA, 17 bp, Homo sapiens
gtagagaggtgtataaa

SEQ ID NO: 31765 - DNA, 95 bp, Rhesus monkey papillomavirus
aatccaaccctctttgtacaaaatgcttttggcagtacatttctaagagttactcatgctaattgcatagttggccacaatttcagggttggatt

SEQ ID NO: 31766 - DNA, 24 bp, Rhesus monkey papillomavirus
ttgcatagttggccacaatttcag

SEQ ID NO: 31767 - DNA, 20 bp, Homo sapiens
tgcatccgccatcacaattt

SEQ ID NO: 31768 - DNA, 22 bp, Homo sapiens
ttacataggcatgtgatttcag

SEQ ID NO: 31769 - DNA, 21 bp, Homo sapiens
ttgcatagttagtcacacctc

SEQ ID NO: 31770 - DNA, 19 bp, Homo sapiens
ttgcatggctttaatttca

SEQ ID NO: 31771 - DNA, 17 bp, Homo sapiens
ttgcatgtacaatttca

SEQ ID NO: 31772 - DNA, 22 bp, Homo sapiens
ttgaatagttatagaatttcag

SEQ ID NO: 31773 - DNA, 96 bp, Human papillomavirus type 66
tgggcatatgtttttatgcaggtgtttgcaatatattttgttggcgtgtagcccttattgtataagccaagtatctgtcttgcaaatatgtaacca

SEQ ID NO: 31774 - DNA, 24 bp, Human papillomavirus type 66
taagccaagtatctgtcttgcaaa

SEQ ID NO: 31775 - DNA, 17 bp, Homo sapiens
gcctgtgctgtcttgca

SEQ ID NO: 31776 - DNA, 18 bp, Homo sapiens
aagccgctttgtcttgca

SEQ ID NO: 31777 - DNA, 21 bp, Homo sapiens
agccaagtgtttgccccataa

SEQ ID NO: 31778 - DNA, 17 bp, Homo sapiens
agctgcacagtcttgca

SEQ ID NO: 31779 - DNA, 20 bp, Homo sapiens
agctggctgagtcttgcaaa

SEQ ID NO: 31780 - DNA, 16 bp, Homo sapiens
tgaccactgtcttgca

SEQ ID NO: 31781 - DNA, 20 bp, Homo sapiens
caagtatcttgttccccaaa

SEQ ID NO: 31782 - DNA, 19 bp, Homo sapiens
aagtcagtcagtcttgcaa

SEQ ID NO: 31783 - DNA, 16 bp, Homo sapiens
agccaaaggtcttgca

SEQ ID NO: 31784 - DNA, 23 bp, Homo sapiens
taagttaatatctgctccccaaa

SEQ ID NO: 31785 - DNA, 18 bp, Homo sapiens
taagccaagttatttcac

SEQ ID NO: 31786 - DNA, 22 bp, Homo sapiens
gctgcgcgctctgtcttgcaaa

SEQ ID NO: 31787 - DNA, 17 bp, Homo sapiens
agcaagtatctgaactg

SEQ ID NO: 31788 - DNA, 22 bp, Homo sapiens
tgaccaagtatctgaatgcaaa

SEQ ID NO: 31789 - DNA, 19 bp, Homo sapiens
taagccaagtggctccagc

SEQ ID NO: 31790 - DNA, 20 bp, Homo sapiens
taagttgagtacctacccta

SEQ ID NO: 31791 - DNA, 17 bp, Homo sapiens
gctgagcctgtcttgca

SEQ ID NO: 31792 - DNA, 16 bp, Homo sapiens
agccaagtgtcttcaa

SEQ ID NO: 31793 - DNA, 20 bp, Homo sapiens
aagtcatatccactgtcttg

SEQ ID NO: 31794 - DNA, 23 bp, Homo sapiens
taagtcaataatggctcttgcaa

SEQ ID NO: 31795 - DNA, 18 bp, Homo sapiens
agcaagcaggtcttgcaa

SEQ ID NO: 31796 - DNA, 19 bp, Homo sapiens
taagctaagtacctgctca

SEQ ID NO: 31797 - DNA, 18 bp, Homo sapiens
taagccaagatattttgt

SEQ ID NO: 31798 - DNA, 19 bp, Homo sapiens
gccaagacttatcttgcaa

SEQ ID NO: 31799 - DNA, 23 bp, Homo sapiens
caagccaggcatggttttgcaaa

SEQ ID NO: 31800 - DNA, 18 bp, Homo sapiens
agccagctatctgccctg

SEQ ID NO: 31801 - DNA, 67 bp, Ectromelia virus
tggtctgtgttaaatcccttctatattattattgatgtattgttgtagaaaactattacttagacca

SEQ ID NO: 31802 - DNA, 24 bp, Ectromelia virus
cccttctatattattattgatgta

SEQ ID NO: 31803 - DNA, 17 bp, Homo sapiens
cttctacatggtgatgt

SEQ ID NO: 31804 - DNA, 21 bp, Homo sapiens
cccttctatttgttattcttg

SEQ ID NO: 31805 - DNA, 19 bp, Homo sapiens
ccttttatattatcagctg

SEQ ID NO: 31806 - DNA, 19 bp, Homo sapiens
cccttatgtattattatta

SEQ ID NO: 31807 - DNA, 21 bp, Homo sapiens
cctttctctcccattgatgta

SEQ ID NO: 31808 - DNA, 19 bp, Homo sapiens
cccttcttcacattgatgt

SEQ ID NO: 31809 - DNA, 21 bp, Homo sapiens
ccatctatattattgcaaatg

SEQ ID NO: 31810 - DNA, 94 bp, Human papillomavirus type 66
aagtttggccttcctgatccatctttctataatcctgaccaggaacgtttggtatgggcctgtgtaggtttggaggtaggccgaggtcaacctt

SEQ ID NO: 31811 - DNA, 24 bp, Human papillomavirus type 66
tctttctataatcctgaccaggaa

SEQ ID NO: 31812 - DNA, 18 bp, Homo sapiens
ttctataatcctaaagaa

SEQ ID NO: 31813 - DNA, 19 bp, Homo sapiens
tttctatgatcctgaccaa

SEQ ID NO: 31814 - DNA, 15 bp, Homo sapiens
tctttcttgaccagg

SEQ ID NO: 31815 - DNA, 20 bp, Homo sapiens
tcattctgcagtgaccagga

SEQ ID NO: 31816 - DNA, 19 bp, Homo sapiens
tctttctatagttacagga

SEQ ID NO: 31817 - DNA, 22 bp, Homo sapiens
tcttctataattctgattttga

SEQ ID NO: 31818 - DNA, 17 bp, Homo sapiens
tttctgtaagaccagga

SEQ ID NO: 31819 - DNA, 21 bp, Homo sapiens
tctttctagaatcttactggg

SEQ ID NO: 31820 - DNA, 18 bp, Homo sapiens
tcttcctatgacctggga

SEQ ID NO: 31821 - DNA, 19 bp, Homo sapiens
tctctctgtgggaccagga

SEQ ID NO: 31822 - DNA, 24 bp, Homo sapiens
tctttctaaatgaggcctcaggaa

SEQ ID NO: 31823 - DNA, 90 bp, Ectromelia virus
gggatccatagttatgacacagtaacatagattattaccttcttgacggtcgcaaatatctatatacttattgttatcgtatcggattct

SEQ ID NO: 31824 - DNA, 24 bp, Ectromelia virus
tatgacacagtaacatagattatt

SEQ ID NO: 31825 - DNA, 18 bp, Homo sapiens
tatgattcagtaacatag

SEQ ID NO: 31826 - DNA, 22 bp, Homo sapiens
atggcacagtccacagattatt

SEQ ID NO: 31827 - DNA, 24 bp, Homo sapiens
tatgttctacaggcatagattatt

SEQ ID NO: 31828 - DNA, 20 bp, Homo sapiens
tataatatagtaacatagat

SEQ ID NO: 31829 - DNA, 20 bp, Homo sapiens
tatgacacagtaagtgtgat

SEQ ID NO: 31830 - DNA, 15 bp, Homo sapiens
gacacagtaacgact

SEQ ID NO: 31831 - DNA, 22 bp, Homo sapiens
tatgacactagtgacagaaatt

SEQ ID NO: 31832 - DNA, 23 bp, Homo sapiens
tatgactagtaatacaaattatt

SEQ ID NO: 31833 - DNA, 23 bp, Homo sapiens
tatgaggtagtaactaaattatt

SEQ ID NO: 31834 - DNA, 63 bp, Simian foamy virus
gcagaaggtagctccctcgactgggtgacaagaagaaaccattcaggaagtgcttccttctgc

SEQ ID NO: 31835 - DNA, 24 bp, Simian foamy virus
gaaggtagctccctcgactgggtg

SEQ ID NO: 31836 - DNA, 22 bp, Homo sapiens
aggtggctttggtgactgggtg

SEQ ID NO: 31837 - DNA, 17 bp, Homo sapiens
aggtggccccctctctg

SEQ ID NO: 31838 - DNA, 21 bp, Homo sapiens
aggtagttcctttgccctctg

SEQ ID NO: 31839 - DNA, 23 bp, Homo sapiens
aaaggtagtttttattctgggtg

SEQ ID NO: 31840 - DNA, 18 bp, Homo sapiens
ggtggtcccaactgggtg

SEQ ID NO: 31841 - DNA, 94 bp, Human adenovirus E
gttcgtgcgccaggcctgcaagatctccaacgtggagctgaccaacctggtctcgtacatgggcatcttgcacgagaaccgcctggggcagaac

SEQ ID NO: 31842 - DNA, 24 bp, Human adenovirus E
gtacatgggcatcttgcacgagaa

SEQ ID NO: 31843 - DNA, 17 bp, Homo sapiens
tgggccacacacgagaa

SEQ ID NO: 31844 - DNA, 21 bp, Homo sapiens
gcacatgggtgttgcaagaga

SEQ ID NO: 31845 - DNA, 24 bp, Homo sapiens
gtacatggcatcagatggtgagaa

SEQ ID NO: 31846 - DNA, 24 bp, Homo sapiens
gtacataggcatgcaacatgggag

SEQ ID NO: 31847 - DNA, 17 bp, Homo sapiens
atgggcatttcttggag

SEQ ID NO: 31848 - DNA, 19 bp, Homo sapiens
gtacatggtcaacggcgag

SEQ ID NO: 31849 - DNA, 20 bp, Homo sapiens
gtgcacgggcagggcgggag

SEQ ID NO: 31850 - DNA, 24 bp, Homo sapiens
gtacattggcatcttctggatgag

SEQ ID NO: 31851 - DNA, 21 bp, Homo sapiens
gtacataggtgtgtgttgaga

SEQ ID NO: 31852 - DNA, 19 bp, Homo sapiens
gtgcatgagcactggtgag

SEQ ID NO: 31853 - DNA, 19 bp, Homo sapiens
gtacatagggcattttgca

SEQ ID NO: 31854 - DNA, 20 bp, Homo sapiens
gcacatgggaagggcatgag

SEQ ID NO: 31855 - DNA, 18 bp, Homo sapiens
gtacatggcatctggaga

SEQ ID NO: 31856 - DNA, 21 bp, Homo sapiens
gtgcatgggcacttgtctgag

SEQ ID NO: 31857 - DNA, 22 bp, Homo sapiens
acatgggcattttaagtttgag

SEQ ID NO: 31858 - DNA, 19 bp, Homo sapiens
acatgggctcactgcgaga

SEQ ID NO: 31859 - DNA, 23 bp, Homo sapiens
gtgcatgggcaatccgacgagaa

SEQ ID NO: 31860 - DNA, 18 bp, Homo sapiens
acatgggcatcttgggag

SEQ ID NO: 31861 - DNA, 23 bp, Homo sapiens
tacatgggtgtcatatttgagaa

SEQ ID NO: 31862 - DNA, 17 bp, Homo sapiens
catgggcatctcagaga

SEQ ID NO: 31863 - DNA, 20 bp, Homo sapiens
atgggcatgaaccatgagaa

SEQ ID NO: 31864 - DNA, 18 bp, Homo sapiens
tgggcatctcccacggaa

SEQ ID NO: 31865 - DNA, 75 bp, Periplaneta fuliginosa densovirus
agatctattatgtctgttatttgagattcttcatcactacttaatggcattatctcgtcacaatgtaaccaatct

SEQ ID NO: 31866 - DNA, 24 bp, Periplaneta fuliginosa densovirus
tattatgtctgttatttgagattc

SEQ ID NO: 31867 - DNA, 19 bp, Homo sapiens
ttatgcctgttatgacact

SEQ ID NO: 31868 - DNA, 20 bp, Homo sapiens
tatcaacttgtttgagattc

SEQ ID NO: 31869 - DNA, 19 bp, Homo sapiens
ttatgggcatttgagattc

SEQ ID NO: 31870 - DNA, 18 bp, Homo sapiens
tattgtgtctattgtttg

SEQ ID NO: 31871 - DNA, 17 bp, Homo sapiens
tgtcccacttgagattc

SEQ ID NO: 31872 - DNA, 18 bp, Homo sapiens
cattatgtttgtgagatt

SEQ ID NO: 31873 - DNA, 18 bp, Homo sapiens
tgtttgtttttgagattc

SEQ ID NO: 31874 - DNA, 19 bp, Homo sapiens
tgaggagttatttgagatt

SEQ ID NO: 31875 - DNA, 18 bp, Homo sapiens
tatgtctgtacaaagatt

SEQ ID NO: 31876 - DNA, 20 bp, Homo sapiens
tgtacttgttatttgagatt

SEQ ID NO: 31877 - DNA, 64 bp, Simian foamy virus
ggaaggagtgtggctaatgctggtaaggcacctttctatcagtacaatcaagcccattcctccc

SEQ ID NO: 31878 - DNA, 24 bp, Simian foamy virus
tcagtacaatcaagcccattcctc

SEQ ID NO: 31879 - DNA, 20 bp, Homo sapiens
atacaacatcttcattcctc

SEQ ID NO: 31880 - DNA, 21 bp, Homo sapiens
agtacaatcaagtcatccctc

SEQ ID NO: 31881 - DNA, 22 bp, Homo sapiens
tcagtacagtcagcaacctcct

SEQ ID NO: 31882 - DNA, 23 bp, Homo sapiens
tcatgcctagtcagcccatttct

SEQ ID NO: 31883 - DNA, 18 bp, Homo sapiens
tcaatacagcccatttct

SEQ ID NO: 31884 - DNA, 16 bp, Homo sapiens
agtacaaaccattcct

SEQ ID NO: 31885 - DNA, 18 bp, Homo sapiens
tcagctatgcccattcct

SEQ ID NO: 31886 - DNA, 25 bp, Homo sapiens
tcagcacaattagaacaactttctc

SEQ ID NO: 31887 - DNA, 22 bp, Homo sapiens
tcagcacagattacccatttct

SEQ ID NO: 31888 - DNA, 20 bp, Homo sapiens
tcagcacaatcaggcagttc

SEQ ID NO: 31889 - DNA, 30 bp, Homo sapiens
tcagtacatacaaatcaagctcgttcttcg

SEQ ID NO: 31890 - DNA, 18 bp, Homo sapiens
tcagtacagcagcctttc

SEQ ID NO: 31891 - DNA, 22 bp, Homo sapiens
tcaaatcctcgagtccattcct

SEQ ID NO: 31892 - DNA, 21 bp, Homo sapiens
cagctttcaagcccattcctc

SEQ ID NO: 31893 - DNA, 19 bp, Homo sapiens
caatcaagtgcaaatcctc

SEQ ID NO: 31894 - DNA, 22 bp, Homo sapiens
tcagtacagacagcacttcctc

SEQ ID NO: 31895 - DNA, 20 bp, Homo sapiens
tcagtacaacttggcaattc

SEQ ID NO: 31896 - DNA, 23 bp, Homo sapiens
cagtacagccttcttcattcctc

SEQ ID NO: 31897 - DNA, 62 bp, Simian foamy virus
gaggtgtgtggctcagcacgtagagtgacaagtaaatctactgtaataggacacaacacctc

SEQ ID NO: 31898 - DNA, 62 bp, Simian foamy virus; identical to SEQ ID NO: 31897

SEQ ID NO: 31899 - DNA, 19 bp, Homo sapiens
aataggcagtgcagcacct

SEQ ID NO: 31900 - DNA, 19 bp, Homo sapiens
aatagaacacttgcaacac

SEQ ID NO: 31901 - DNA, 18 bp, Homo sapiens
cagtgacggcaacacctc

SEQ ID NO: 31902 - DNA, 20 bp, Homo sapiens
caataggacagcacatacct

SEQ ID NO: 31903 - DNA, 19 bp, Homo sapiens
taagacactctaacacttc

SEQ ID NO: 31904 - DNA, 17 bp, Homo sapiens
taacaggacaaaccctc

SEQ ID NO: 31905 - DNA, 19 bp, Homo sapiens
caatgaaaggcaacacctc

SEQ ID NO: 31906 - DNA, 19 bp, Homo sapiens
taagaggacacagcccctc

SEQ ID NO: 31907 - DNA, 18 bp, Homo sapiens
taacaggaccaaaacttc

SEQ ID NO: 31908 - DNA, 19 bp, Homo sapiens
taacaccacccaacacctc

SEQ ID NO: 31909 - DNA, 18 bp, Homo sapiens
taaaacagcaaacacctc

SEQ ID NO: 31910 - DNA, 18 bp, Homo sapiens
aacaaaacacaacacctc

SEQ ID NO: 31911 - DNA, 18 bp, Homo sapiens
aatacaacacaacacttc

SEQ ID NO: 31912 - DNA, 18 bp, Homo sapiens
tagagacacaagcatctc

SEQ ID NO: 31913 - DNA, 19 bp, Homo sapiens
taataagatacaatgcctc

SEQ ID NO: 31914 - DNA, 19 bp, Homo sapiens
tagagtcaccaaacacctc

SEQ ID NO: 31915 - DNA, 20 bp, Homo sapiens
taataggacaaggacaacct

SEQ ID NO: 31916 - DNA, 106 bp, Simian foamy virus
ggaattgtatattagccttgctaagggagacatctagtgatataagtgtgaactacacttatcttaaatgttgtaactccttaggataatcaatatacaaaattcc

SEQ ID NO: 31917 - DNA, 24 bp, Simian foamy virus
aattgtatattagccttgctaagg

SEQ ID NO: 31918 - DNA, 24 bp, Homo sapiens
aactgtacggtggtcttgctgagg

SEQ ID NO: 31919 - DNA, 23 bp, Homo sapiens
attgtatattcttaatgctaagg

SEQ ID NO: 31920 - DNA, 22 bp, Homo sapiens
attgtatatttgcatgcctggg

SEQ ID NO: 31921 - DNA, 67 bp, Simian foamy virus
tccctagggaggatctggctctgtaagctgaggcagtagtgttttcagttccagtcctctctaagga

SEQ ID NO: 31922 - DNA, 24 bp, Simian foamy virus
ttttcagttccagtcctctctaag

SEQ ID NO: 31923 - DNA, 18 bp, Homo sapiens
ttttcagctctgtcttct

SEQ ID NO: 31924 - DNA, 20 bp, Homo sapiens
gtcccttggtcttctctaag

SEQ ID NO: 31925 - DNA, 20 bp, Homo sapiens
tttcaccccaagtcctctct

SEQ ID NO: 31926 - DNA, 23 bp, Homo sapiens
tcttcagtgatcttctctctaag

SEQ ID NO: 31927 - DNA, 24 bp, Homo sapiens
ttttcagtctaatcagtctctaag

SEQ ID NO: 31928 - DNA, 24 bp, Homo sapiens
ttttcagttgctatcctctttaag

SEQ ID NO: 31929 - DNA, 21 bp, Homo sapiens
ttctcagttccacattctaag

SEQ ID NO: 31930 - DNA, 20 bp, Homo sapiens
tttcagggttcttctctaag

SEQ ID NO: 31931 - DNA, 23 bp, Homo sapiens
ttttcagttttccatctgcttct

SEQ ID NO: 31932 - DNA, 19 bp, Homo sapiens
tcttcagttctgggagcct

SEQ ID NO: 31933 - DNA, 20 bp, Homo sapiens
tttttaattccagtcctccc

SEQ ID NO: 31934 - DNA, 20 bp, Homo sapiens
ttttcagttctcagtcctct

SEQ ID NO: 31935 - DNA, 20 bp, Homo sapiens
tttcagtttccactatctct

SEQ ID NO: 31936 - DNA, 22 bp, Homo sapiens
ctttcagcatgtcctctttaag

SEQ ID NO: 31937 - DNA, 24 bp, Homo sapiens
ttttcagtctaattagtctctaag

SEQ ID NO: 31938 - DNA, 21 bp, Homo sapiens
tttccagtttttcagccttct

SEQ ID NO: 31939 - DNA, 76 bp, Human adenovirus E
gctgggctcgagcatgacggcgactacctccacctgagcgggggggaggacgcgctcatcaagcatctggcccggc

SEQ ID NO: 31940 - DNA, 24 bp, Human adenovirus E
gagcatgacggcgactacctccac

SEQ ID NO: 31941 - DNA, 21 bp, Homo sapiens
gagtgtgctgggagctctcca

SEQ ID NO: 31942 - DNA, 21 bp, Homo sapiens
gaccatgacagcataccttca

SEQ ID NO: 31943 - DNA, 19 bp, Homo sapiens
gcatgacagccggctctcc

SEQ ID NO: 31944 - DNA, 22 bp, Homo sapiens
gagcatgatgatggaggctcca

SEQ ID NO: 31945 - DNA, 19 bp, Homo sapiens
atgacagcattaacttcca

SEQ ID NO: 31946 - DNA, 21 bp, Homo sapiens
gcgtggtggctccacctccac

SEQ ID NO: 31947 - DNA, 22 bp, Homo sapiens
gagcgtgtcggcgacctgggcc

SEQ ID NO: 31948 - DNA, 19 bp, Homo sapiens
gcaagacggcgaccctcca

SEQ ID NO: 31949 - DNA, 19 bp, Homo sapiens
gagcctgcagctacctcca

SEQ ID NO: 31950 - DNA, 18 bp, Homo sapiens
gagcatgaggcggcccac

SEQ ID NO: 31951 - DNA, 20 bp, Homo sapiens
gagcacgatgcagcttccac

SEQ ID NO: 31952 - DNA, 20 bp, Homo sapiens
gcataacggctgcccttcac

SEQ ID NO: 31953 - DNA, 21 bp, Homo sapiens
gaacctcctgactacctccac

SEQ ID NO: 31954 - DNA, 15 bp, Homo sapiens
agcatgacggcgtcc

SEQ ID NO: 31955 - DNA, 19 bp, Homo sapiens
gaggatgacgccacctcca

SEQ ID NO: 31956 - DNA, 74 bp, Human herpesvirus 3
acatctgggacagttctgccgcttgacccatatacgtatttaatggtgcaggggttccattctgttctgatcgt

SEQ ID NO: 31957 - DNA, 24 bp, Human herpesvirus 3
gtgcaggggttccattctgttctg

SEQ ID NO: 31958 - DNA, 17 bp, Homo sapiens
gtgggggtttcatgctg

SEQ ID NO: 31959 - DNA, 17 bp, Homo sapiens
gtgcagggatttctact

SEQ ID NO: 31960 - DNA, 18 bp, Homo sapiens
atgtaggggttctgtctg

SEQ ID NO: 31961 - DNA, 27 bp, Homo sapiens
gtgcaggggtttctgtttcctcctctg

SEQ ID NO: 31962 - DNA, 16 bp, Homo sapiens
gtaaggccattctgtt

SEQ ID NO: 31963 - DNA, 21 bp, Homo sapiens
gtgcaggggtgctggtttctg

SEQ ID NO: 31964 - DNA, 23 bp, Homo sapiens
gtgcaagggttccattgatttct

SEQ ID NO: 31965 - DNA, 19 bp, Homo sapiens
gcaggggttcttcattctg

SEQ ID NO: 31966 - DNA, 15 bp, Homo sapiens
gaatcctctgttctg

SEQ ID NO: 31967 - DNA, 19 bp, Homo sapiens
atgcgaagcccattctgtt

SEQ ID NO: 31968 - DNA, 79 bp, Rat cytomegalovirus
cggctggacgttggtccgcaggcggtcgcggaggaaccccgggaagccgttggcgaccttgaggacccgcgcccggtcg

SEQ ID NO: 31969 - DNA, 24 bp, Rat cytomegalovirus
aagccgttggcgaccttgaggacc

SEQ ID NO: 31970 - DNA, 16 bp, Homo sapiens
gccgctggtgaccgac

SEQ ID NO: 31971 - DNA, 21 bp, Homo sapiens
gcccccacgtggccttgagga

SEQ ID NO: 31972 - DNA, 17 bp, Homo sapiens
agccgttggcgccgggc

SEQ ID NO: 31973 - DNA, 24 bp, Homo sapiens
aggcgttggcgatgccacctgggg

SEQ ID NO: 31974 - DNA, 22 bp, Homo sapiens
agccgttgcggctcaggaggac

SEQ ID NO: 31975 - DNA, 21 bp, Homo sapiens
gccgtggcggccccagcagga

SEQ ID NO: 31976 - DNA, 16 bp, Homo sapiens
gttgggcgtgaggacc

SEQ ID NO: 31977 - DNA, 19 bp, Homo sapiens
gccgctggcgacccgcagg

SEQ ID NO: 31978 - DNA, 22 bp, Homo sapiens
aactcgttacgcctttgaggac

SEQ ID NO: 31979 - DNA, 21 bp, Homo sapiens
gctccggcggctttgaggacc

SEQ ID NO: 31980 - DNA, 18 bp, Homo sapiens
agccttgggcctgaggac

SEQ ID NO: 31981 - DNA, 22 bp, Homo sapiens
aagccatcaaattcttgaggac

SEQ ID NO: 31982 - DNA, 20 bp, Homo sapiens
agccgctggcggcgacgacc

SEQ ID NO: 31983 - DNA, 18 bp, Homo sapiens
gccgtctccttgaggacc

SEQ ID NO: 31984 - DNA, 21 bp, Homo sapiens
gccgttggcagaggctgggga

SEQ ID NO: 31985 - DNA, 17 bp, Homo sapiens
aagcagttggtgacttg

SEQ ID NO: 31986 - DNA, 18 bp, Homo sapiens
aagccgctggcgatctcg

SEQ ID NO: 31987 - DNA, 20 bp, Homo sapiens
gctgttaggtctctgaggac

SEQ ID NO: 31988 - DNA, 17 bp, Homo sapiens
ccttggcgacgtaggcc

SEQ ID NO: 31989 - DNA, 23 bp, Homo sapiens
agccgttgcggccagtggggacc

SEQ ID NO: 31990 - DNA, 16 bp, Homo sapiens
gccgttggcgcgggac

SEQ ID NO: 31991 - DNA, 16 bp, Homo sapiens
gccattgggtgaggac

SEQ ID NO: 31992 - DNA, 18 bp, Homo sapiens
gctggtgaccttgaggac

SEQ ID NO: 31993 - DNA, 21 bp, Homo sapiens
gccgggtcgaggccttgagga

SEQ ID NO: 31994 - DNA, 22 bp, Homo sapiens
agctatatacactttgaggacc

SEQ ID NO: 31995 - DNA, 20 bp, Homo sapiens
aagccgttgatcttggggac

SEQ ID NO: 31996 - DNA, 17 bp, Homo sapiens
ccttggctttgaggacc

SEQ ID NO: 31997 - DNA, 15 bp, Homo sapiens
gccttggcctcgagg

SEQ ID NO: 31998 - DNA, 21 bp, Homo sapiens
aagcttttggtgaccttgaaa

SEQ ID NO: 31999 - DNA, 96 bp, Rat cytomegalovirus
gctgaggaggccggagtcgtcggcctgctcgtgcggcacgccgaagacgaaggtgaagccctcgggccaggccaggcgacagcggaactcctcggc

SEQ ID NO: 32000 - DNA, 24 bp, Rat cytomegalovirus
tgaagccctcgggccaggccaggc

SEQ ID NO: 32001 - DNA, 18 bp, Homo sapiens
gcgggggccgggccaggc

SEQ ID NO: 32002 - DNA, 16 bp, Homo sapiens
gccgggccaggccggg

SEQ ID NO: 32003 - DNA, 20 bp, Homo sapiens
tgagaccctcgggctgtggc

SEQ ID NO: 32004 - DNA, 23 bp, Homo sapiens
tggcagccgaggctgggccaggc

SEQ ID NO: 32005 - DNA, 20 bp, Homo sapiens
gaggccagatcaggccaggc

SEQ ID NO: 32006 - DNA, 22 bp, Homo sapiens
tgaggttcccggcagcccaggc

SEQ ID NO: 32007 - DNA, 22 bp, Homo sapiens
gccaggccgggccaggccgggc

SEQ ID NO: 32008 - DNA, 22 bp, Homo sapiens
tgagattcttgggccaaaaagc

SEQ ID NO: 32009 - DNA, 23 bp, Homo sapiens
cggagccttgtcccaggctgggc

SEQ ID NO: 32010 - DNA, 18 bp, Homo sapiens
tgaggccctcggatcggc

SEQ ID NO: 32011 - DNA, 21 bp, Homo sapiens
tgagccctcggggagccaggc

SEQ ID NO: 32012 - DNA, 19 bp, Homo sapiens
gccgggctccgggccaggc

SEQ ID NO: 32013 - DNA, 16 bp, Homo sapiens
tgagcctgggccaggc

SEQ ID NO: 32014 - DNA, 18 bp, Homo sapiens
tggagacctcgggctagc

SEQ ID NO: 32015 - DNA, 20 bp, Homo sapiens
gaagcccggtcaggccaggc

SEQ ID NO: 32016 - DNA, 17 bp, Homo sapiens
gccaggccaggccaggc

SEQ ID NO: 32017 - DNA, 21 bp, Homo sapiens
tgcggccctcgggtcgccggc

SEQ ID NO: 32018 - DNA, 20 bp, Homo sapiens
actcctcctccaggccaggc

SEQ ID NO: 32019 - DNA, 21 bp, Homo sapiens
gaggtcctctccgggccaggc

SEQ ID NO: 32020 - DNA, 19 bp, Homo sapiens
tggggccccgggcctcggc

SEQ ID NO: 32021 - DNA, 22 bp, Homo sapiens
tgaggccctcggcctagaacag

SEQ ID NO: 32022 - DNA, 24 bp, Homo sapiens
tgacaggacagggtcaggccaggc

SEQ ID NO: 32023 - DNA, 19 bp, Homo sapiens
gaagcctgagcaggccagg

SEQ ID NO: 32024 - DNA, 20 bp, Homo sapiens
tgaagctgcctaggccaggc

SEQ ID NO: 32025 - DNA, 21 bp, Homo sapiens
tgaagccctctgggcacaggc

SEQ ID NO: 32026 - DNA, 25 bp, Homo sapiens
tggagacctcgggcaggacccaggc

SEQ ID NO: 32027 - DNA, 20 bp, Homo sapiens
gaggcccagccaggccgggc

SEQ ID NO: 32028 - DNA, 22 bp, Homo sapiens
tgaggcccacggtgggccaggc

SEQ ID NO: 32029 - DNA, 16 bp, Homo sapiens
agccaccaggccaggc

SEQ ID NO: 32030 - DNA, 18 bp, Homo sapiens
tggagcccccggccaggc

SEQ ID NO: 32031 - DNA, 22 bp, Homo sapiens
tgagcctcaggccaggccaggc

SEQ ID NO: 32032 - DNA, 26 bp, Homo sapiens
tgggtccccactaagccaggccgggc

SEQ ID NO: 32033 - DNA, 22 bp, Homo sapiens
gcaggctcttgccaaagccagg

SEQ ID NO: 32034 - DNA, 21 bp, Homo sapiens
tggcagctccacgggccaggc

SEQ ID NO: 32035 - DNA, 19 bp, Homo sapiens
tggagccccgggctgctgg

SEQ ID NO: 32036 - DNA, 21 bp, Homo sapiens
gctcctcgggcagagctgggc

SEQ ID NO: 32037 - DNA, 19 bp, Homo sapiens
tgagccgagccaggctggg

SEQ ID NO: 32038 - DNA, 18 bp, Homo sapiens
tggagccccggctcaggc

SEQ ID NO: 32039 - DNA, 19 bp, Homo sapiens
tggagccccgggcgctagg

SEQ ID NO: 32040 - DNA, 28 bp, Homo sapiens
tgaagccctaattaagggctgggttagg

SEQ ID NO: 32041 - DNA, 18 bp, Homo sapiens
gccctgggccaggctggg

SEQ ID NO: 32042 - DNA, 21 bp, Homo sapiens
tgaaattaccttcaggccagg

SEQ ID NO: 32043 - DNA, 20 bp, Homo sapiens
gcgggcgggccaggtcaggc

SEQ ID NO: 32044 - DNA, 17 bp, Homo sapiens
tgaggccctcgggcacc

SEQ ID NO: 32045 - DNA, 22 bp, Homo sapiens
tgaacccagagccaggctgggc

SEQ ID NO: 32046 - DNA, 24 bp, Homo sapiens
tgggaccctcgggcccagccgggc

SEQ ID NO: 32047 - DNA, 18 bp, Homo sapiens
tgacgcggccaggccagg

SEQ ID NO: 32048 - DNA, 23 bp, Homo sapiens
tgcggcccaggcccaggctgggc

SEQ ID NO: 32049 - DNA, 21 bp, Homo sapiens
agccaggctgccaggtcaggc

SEQ ID NO: 32050 - DNA, 20 bp, Homo sapiens
aagtcctcgggccgcctggc

SEQ ID NO: 32051 - DNA, 18 bp, Homo sapiens
tgaagccctggggtaggc

SEQ ID NO: 32052 - DNA, 17 bp, Homo sapiens
gcgaggctaggccaggc

SEQ ID NO: 32053 - DNA, 23 bp, Homo sapiens
tgaaatgagggggctaggccagg

SEQ ID NO: 32054 - DNA, 17 bp, Homo sapiens
tgagctcccaggccggg

SEQ ID NO: 32055 - DNA, 20 bp, Homo sapiens
gaagccctcggagtccaggc

SEQ ID NO: 32056 - DNA, 23 bp, Homo sapiens
gctccctggcggccaggccgggc

SEQ ID NO: 32057 - DNA, 18 bp, Homo sapiens
gccccacccgggccaggc

SEQ ID NO: 32058 - DNA, 18 bp, Homo sapiens
gaagctctcgggctaggc

SEQ ID NO: 32059 - DNA, 20 bp, Homo sapiens
tgaaatccactgggccaggc

SEQ ID NO: 32060 - DNA, 20 bp, Homo sapiens
gaggctctcccaggccaggc

SEQ ID NO: 32061 - DNA, 20 bp, Homo sapiens
gctccagctccaggccaggc

SEQ ID NO: 32062 - DNA, 20 bp, Homo sapiens
tggggcccccggggctcagg

SEQ ID NO: 32063 - DNA, 23 bp, Homo sapiens
tgcagcggcgggccaggtcaggc

SEQ ID NO: 32064 - DNA, 21 bp, Homo sapiens
agcttgggggccaggctgggc

SEQ ID NO: 32065 - DNA, 20 bp, Homo sapiens
gaagccccatgcaggttagg

SEQ ID NO: 32066 - DNA, 18 bp, Homo sapiens
gccggggccgggccaggc

SEQ ID NO: 32067 - DNA, 23 bp, Homo sapiens
taaagcctaatacgtaggccagg

SEQ ID NO: 32068 - DNA, 21 bp, Homo sapiens
tgaggcactcacgggccaggc

SEQ ID NO: 32069 - DNA, 20 bp, Homo sapiens
gaaggaaggccaggccaggc

SEQ ID NO: 32070 - DNA, 22 bp, Homo sapiens
tgggtccctcgggcccccacac

SEQ ID NO: 32071 - DNA, 20 bp, Homo sapiens
agtcctggagcaggccaggc

SEQ ID NO: 32072 - DNA, 22 bp, Homo sapiens
agcagggtgggccaggccaggc

SEQ ID NO: 32073 - DNA, 22 bp, Homo sapiens
tggagcccccacaaggccaggc

SEQ ID NO: 32074 - DNA, 20 bp, Homo sapiens
tgaagcccctggggcacagg

SEQ ID NO: 32075 - DNA, 21 bp, Homo sapiens
tgaaccatagccaggctgggc

SEQ ID NO: 32076 - DNA, 22 bp, Homo sapiens
gccccaggctcttaggctgggc

SEQ ID NO: 32077 - DNA, 19 bp, Homo sapiens
tggggccctcaggtcacgc

SEQ ID NO: 32078 - DNA, 21 bp, Homo sapiens
cgatgcagggccaggccgggc

SEQ ID NO: 32079 - DNA, 22 bp, Homo sapiens
tgcagcaccggccaggccaggc

SEQ ID NO: 32080 - DNA, 23 bp, Homo sapiens
tgagctcctgccatgggccaggc

SEQ ID NO: 32081 - DNA, 22 bp, Homo sapiens
cggagctcttgggccagaaggc

SEQ ID NO: 32082 - DNA, 18 bp, Homo sapiens
gaggccgccgggccaggc

SEQ ID NO: 32083 - DNA, 21 bp, Homo sapiens
tggggctctccggccacgggc

SEQ ID NO: 32084 - DNA, 18 bp, Homo sapiens
gccctcggccccctgggc

SEQ ID NO: 32085 - DNA, 20 bp, Homo sapiens
tggagccgggtgggccaggc

SEQ ID NO: 32086 - DNA, 19 bp, Homo sapiens
tgaagctttgaagccaggc

SEQ ID NO: 32087 - DNA, 21 bp, Homo sapiens
tggagctccgggccagatggc

SEQ ID NO: 32088 - DNA, 23 bp, Homo sapiens
tggggccctggtgggaggccagg

SEQ ID NO: 32089 - DNA, 19 bp, Homo sapiens
tggcagccctgggccaggc

SEQ ID NO: 32090 - DNA, 20 bp, Homo sapiens
agccgccggccgggccaggc

SEQ ID NO: 32091 - DNA, 19 bp, Homo sapiens
tggagaccttgggccaggc

SEQ ID NO: 32092 - DNA, 21 bp, Homo sapiens
tgagctccaggccaggccggg

SEQ ID NO: 32093 - DNA, 18 bp, Homo sapiens
gcccgggccgggctgggc

SEQ ID NO: 32094 - DNA, 18 bp, Homo sapiens
ccctggagctggccaggc

SEQ ID NO: 32095 - DNA, 22 bp, Homo sapiens
tggagcctcctagcaggccagg

SEQ ID NO: 32096 - DNA, 21 bp, Homo sapiens
tgggaccctgggaggccaggc

SEQ ID NO: 32097 - DNA, 131 bp, Ectromelia virus
gctattaaacagtatggagacattgatctattatttaatgagaaacttaaagtagactccgattcgggactatttgactttgtcaactttgtaaaggatatgatatgttgtgattctagaatagtagtagc

SEQ ID NO: 32098 - DNA, 24 bp, Ectromelia virus
tgagaaacttaaagtagactccga

SEQ ID NO: 32099 - DNA, 19 bp, Homo sapiens
tgagaaacttggggctccg

SEQ ID NO: 32100 - DNA, 22 bp, Homo sapiens
gagaagcttaaggtaaacccga

SEQ ID NO: 32101 - DNA, 17 bp, Homo sapiens
tggaaacttaaagtaga

SEQ ID NO: 32102 - DNA, 19 bp, Homo sapiens
tgagggacttaaaagtaga

SEQ ID NO: 32103 - DNA, 22 bp, Homo sapiens
tggaaacttaaaaggcagattc

SEQ ID NO: 32104 - DNA, 15 bp, Homo sapiens
tgagaaactaaactc

SEQ ID NO: 32105 - DNA, 19 bp, Homo sapiens
tgagaaagttaaaactcca

SEQ ID NO: 32106 - DNA, 17 bp, Homo sapiens
aacttaaaaaactccga

SEQ ID NO: 32107 - DNA, 19 bp, Homo sapiens
tgagaaacttaagagtaga

SEQ ID NO: 32108 - DNA, 24 bp, Homo sapiens
tgagaaacatggattgatctctga

SEQ ID NO: 32109 - DNA, 21 bp, Homo sapiens
agaaacttaagaaaacttcga

SEQ ID NO: 32110 - DNA, 16 bp, Homo sapiens
tgaggaaagtagactc

SEQ ID NO: 32111 - DNA, 19 bp, Homo sapiens
gagaacttaaagataccga

SEQ ID NO: 32112 - DNA, 65 bp, Saimiriine herpesvirus 2
ttgaaactccgccccttacttttattaaaaatcttcaagatgaaatgtttacaatagaaattcga

SEQ ID NO: 32113 - DNA, 24 bp, Saimiriine herpesvirus 2
tgaaatgtttacaatagaaattcg

SEQ ID NO: 32114 - DNA, 18 bp, Homo sapiens
tggaatgtttacaacaga

SEQ ID NO: 32115 - DNA, 20 bp, Homo sapiens
tgaaatatttacagtagaaa

SEQ ID NO: 32116 - DNA, 19 bp, Homo sapiens
tgaaatgtttttaatagaa

SEQ ID NO: 32117 - DNA, 18 bp, Homo sapiens
tgaaatatttacagtaga

SEQ ID NO: 32118 - DNA, 88 bp, Ectromelia virus
gccggttagtatgacttacttgtataataagtatagttttaaactgattttagcagaatatataagacacagaaatactatatccggc

SEQ ID NO: 32119 - DNA, 24 bp, Ectromelia virus
taagacacagaaatactatatccg

SEQ ID NO: 32120 - DNA, 23 bp, Homo sapiens
aagaggaggaaatactatatccg

SEQ ID NO: 32121 - DNA, 19 bp, Homo sapiens
taaggcacagaaacagtat

SEQ ID NO: 32122 - DNA, 18 bp, Homo sapiens
taagaggcagaaacatct

SEQ ID NO: 32123 - DNA, 101 bp, Drosophila C virus
gttgttttcattgttgatggtaaggattcttattttgaagtggtttttcagaagataactctaaatatgaattatgccttattgttttcaatgttgatggc

SEQ ID NO: 32124 - DNA, 24 bp, Drosophila C virus
ttgatggtaaggattcttattttg

SEQ ID NO: 32125 - DNA, 22 bp, Homo sapiens
ttgatgtgtgatctttattttg

SEQ ID NO: 32126 - DNA, 18 bp, Homo sapiens
tggtggtatcttactttg

SEQ ID NO: 32127 - DNA, 97 bp, Drosophila C virus
attgacttcgaagaaagatgcgtcttttggatttgtaatgactgggccttaagttcataggtgttattacatggaggaacacattactttggttgat

SEQ ID NO: 32128 - DNA, 24 bp, Drosophila C virus
ttacatggaggaacacattacttt

SEQ ID NO: 32129 - DNA, 22 bp, Homo sapiens
tggatggattttacattacttt

SEQ ID NO: 32130 - DNA, 21 bp, Homo sapiens
ttacaggaagtgtattacttt

SEQ ID NO: 32131 - DNA, 21 bp, Homo sapiens
ttacatggagacggttacttt

SEQ ID NO: 32132 - DNA, 21 bp, Homo sapiens
ggaaagggaacacattacttt

SEQ ID NO: 32133 - DNA, 26 bp, Homo sapiens
ctacttggtcaggagtgcattgcttt

SEQ ID NO: 32134 - DNA, 23 bp, Homo sapiens
ttacataggggagtgttcacact

SEQ ID NO: 32135 - DNA, 21 bp, Homo sapiens
atgtataacacacattacttt

SEQ ID NO: 32136 - DNA, 22 bp, Homo sapiens
ttactgtgggggaaattacttt

SEQ ID NO: 32137 - DNA, 121 bp, Ateline herpesvirus 3
ggggcaagcaatgatgtcttttcgttggtcattttttccacatacgaattatttggtcagcacattgaatccttcaaattcgatatggcaaaagtgtttcgagaaattattgaaacgcctc

SEQ ID NO: 32138 - DNA, 24 bp, Ateline herpesvirus 3
tggcaaaagtgtttcgagaaatta

SEQ ID NO: 32139 - DNA, 17 bp, Homo sapiens
tgggaaagtgttttgag

SEQ ID NO: 32140 - DNA, 23 bp, Homo sapiens
tggtaagaatgcagtagaaatta

SEQ ID NO: 32141 - DNA, 18 bp, Homo sapiens
tggcacttttgagaaatt

SEQ ID NO: 32142 - DNA, 18 bp, Homo sapiens
tgttaaaagtgttttgaa

SEQ ID NO: 32143 - DNA, 26 bp, Homo sapiens
tggtaaaagtgctttcaatcccatta

SEQ ID NO: 32144 - DNA, 22 bp, Homo sapiens
tggtgaaaggtctgaagaaatt

SEQ ID NO: 32145 - DNA, 24 bp, Homo sapiens
tgccaaaaaggaattgagaaatta

SEQ ID NO: 32146 - DNA, 23 bp, Homo sapiens
tggcgcataatattgagaaatta

SEQ ID NO: 32147 - DNA, 22 bp, Homo sapiens
gctaaaagtgagaaagaaatta

SEQ ID NO: 32148 - DNA, 23 bp, Homo sapiens
tgacaggagttcaatagaaatta

SEQ ID NO: 32149 - DNA, 23 bp, Homo sapiens
ggtgaaaagtaagtgagaaatta

SEQ ID NO: 32150 - DNA, 23 bp, Homo sapiens
tgccaaaagatgagtgagagatt

SEQ ID NO: 32151 - DNA, 17 bp, Homo sapiens
gctaaagctgagaaatt

SEQ ID NO: 32152 - DNA, 19 bp, Homo sapiens
gcaaaaacttgagaaatta

SEQ ID NO: 32153 - DNA, 16 bp, Homo sapiens
tggcaaaatttcaaaa

SEQ ID NO: 32154 - DNA, 21 bp, Homo sapiens
ggtaaaagtgtcaatagagaa

SEQ ID NO: 32155 - DNA, 18 bp, Homo sapiens
gcagaagtgagagaaatt

SEQ ID NO: 32156 - DNA, 111 bp, Equine herpesvirus 4
gcggaagtgacgcaagcggaaggggaggagcaggaaggggaggagcaggacccactaacccgcccactaacccgcccactaacccgcccactaacccgcccactaacccgc

SEQ ID NO: 32157 - DNA, 24 bp, Equine herpesvirus 4
aacccgcccactaacccgcccact

SEQ ID NO: 32158 - DNA, 21 bp, Homo sapiens
actcctctggtcccgcccact

SEQ ID NO: 32159 - DNA, 20 bp, Homo sapiens
cgcccaccagcctgtccgct

SEQ ID NO: 32160 - DNA, 22 bp, Homo sapiens
cgcctgcatccacccgcccgct

SEQ ID NO: 32161 - DNA, 19 bp, Homo sapiens
ccctctgctaccacccact

SEQ ID NO: 32162 - DNA, 20 bp, Homo sapiens
cgcctctaacccagaccact

SEQ ID NO: 32163 - DNA, 20 bp, Homo sapiens
acccgccccctcggccccgc

SEQ ID NO: 32164 - DNA, 19 bp, Homo sapiens
ccgcctctcgccgcccact

SEQ ID NO: 32165 - DNA, 19 bp, Homo sapiens
ccgcccacggaggcccact

SEQ ID NO: 32166 - DNA, 25 bp, Homo sapiens
acccgccctgcctggcctgcccact

SEQ ID NO: 32167 - DNA, 22 bp, Homo sapiens
aacccgcccacaggttaacagc

SEQ ID NO: 32168 - DNA, 24 bp, Homo sapiens
acccacttgtcctgggcgcctact

SEQ ID NO: 32169 - DNA, 18 bp, Homo sapiens
cctcacccaccgcccact

SEQ ID NO: 32170 - DNA, 19 bp, Homo sapiens
aaccacgtccgccgcccac

SEQ ID NO: 32171 - DNA, 18 bp, Homo sapiens
aacccgcccgccgacccg

SEQ ID NO: 32172 - DNA, 21 bp, Homo sapiens
cccgcccagcatccgctcact

SEQ ID NO: 32173 - DNA, 22 bp, Homo sapiens
aaccctcttcccaccccgctca

SEQ ID NO: 32174 - DNA, 21 bp, Homo sapiens
cctgcccaccagccacccgct

SEQ ID NO: 32175 - DNA, 22 bp, Homo sapiens
acctgccgcgtccccgcccact

SEQ ID NO: 32176 - DNA, 23 bp, Homo sapiens
acccactctgaagcccgcctgct

SEQ ID NO: 32177 - DNA, 16 bp, Homo sapiens
cccgcccaccgctcac

SEQ ID NO: 32178 - DNA, 20 bp, Homo sapiens
acctgcccactagcctatgc

SEQ ID NO: 32179 - DNA, 18 bp, Homo sapiens
ccactaactacaaccact

SEQ ID NO: 32180 - DNA, 21 bp, Homo sapiens
aaccttctcactaaccccact

SEQ ID NO: 32181 - DNA, 18 bp, Homo sapiens
acccgcccactgggccac

SEQ ID NO: 32182 - DNA, 22 bp, Homo sapiens
aacttcccactaaaatactcgc

SEQ ID NO: 32183 - DNA, 23 bp, Homo sapiens
tgacctcaggtgatccgcccact

SEQ ID NO: 32184 - DNA, 18 bp, Homo sapiens
accctgccacccgcccac

SEQ ID NO: 32185 - DNA, 62 bp, Fowl adenovirus A
cctgcctttcagcagctggttagcaacgggatctttgaacgtgttacaatgagctgtgcagg

SEQ ID NO: 32186 - DNA, 24 bp, Fowl adenovirus A
cagcagctggttagcaacgggatc

SEQ ID NO: 32187 - DNA, 20 bp, Homo sapiens
ctgggtgttagcaatgggat

SEQ ID NO: 32188 - DNA, 18 bp, Homo sapiens
gcaggtggttagcaccag

SEQ ID NO: 32189 - DNA, 23 bp, Homo sapiens
cagcagccccccgtggcaacggg

SEQ ID NO: 32190 - DNA, 16 bp, Homo sapiens
cagagaggtaacggga

SEQ ID NO: 32191 - DNA, 18 bp, Homo sapiens
cagcaatttcagtgggat

SEQ ID NO: 32192 - DNA, 19 bp, Homo sapiens
gcagctggagagtgggatc

SEQ ID NO: 32193 - DNA, 17 bp, Homo sapiens
cagtggctggttaggga

SEQ ID NO: 32194 - DNA, 21 bp, Homo sapiens
cagcagctggtggtacaaaat

SEQ ID NO: 32195 - DNA, 19 bp, Homo sapiens
caggagctggttagcccca

SEQ ID NO: 32196 - DNA, 20 bp, Homo sapiens
cagcagctggtcagatggat

SEQ ID NO: 32197 - DNA, 24 bp, Homo sapiens
cagtcagctgggctcagtgggatc

SEQ ID NO: 32198 - DNA, 18 bp, Homo sapiens
gcagctggtgtagtggac

SEQ ID NO: 32199 - DNA, 18 bp, Homo sapiens
gcagctgggtggcaggac

SEQ ID NO: 32200 - DNA, 20 bp, Homo sapiens
acagttttatccaacgggat

SEQ ID NO: 32201 - DNA, 22 bp, Homo sapiens
cagcagctggctggagaaggat

SEQ ID NO: 32202 - DNA, 21 bp, Homo sapiens
actattgttagtgacgggatc

SEQ ID NO: 32203 - DNA, 20 bp, Homo sapiens
gcagctgagttgtttgggat

SEQ ID NO: 32204 - DNA, 15 bp, Homo sapiens
cagcagctggttggg

SEQ ID NO: 32205 - DNA, 19 bp, Homo sapiens
gctggttagtacagtaatc

SEQ ID NO: 32206 - DNA, 18 bp, Homo sapiens
cagcagctccgatgggat

SEQ ID NO: 32207 - DNA, 17 bp, Homo sapiens
gcagctggctcagcggg

SEQ ID NO: 32208 - DNA, 16 bp, Homo sapiens
cagcagctggtggaat

SEQ ID NO: 32209 - DNA, 18 bp, Homo sapiens
cagcagctggttgtggac

SEQ ID NO: 32210 - DNA, 22 bp, Homo sapiens
cagtactgatcagtagtgggat

SEQ ID NO: 32211 - DNA, 78 bp, Ovine adenovirus A
gccgctcttagcacaaaatcaaaaacaaatctagccaccgcagtctgtagagacttttgagttgaaaaagtaagcggc

SEQ ID NO: 32212 - DNA, 24 bp, Ovine adenovirus A
tagcacaaaatcaaaaacaaatct

SEQ ID NO: 32213 - DNA, 19 bp, Homo sapiens
tagcataaagacaaaaaca

SEQ ID NO: 32214 - DNA, 21 bp, Homo sapiens
gcacaggcattgaaaacaaat

SEQ ID NO: 32215 - DNA, 19 bp, Homo sapiens
gcacaaaacccacaaatct

SEQ ID NO: 32216 - DNA, 19 bp, Homo sapiens
gcaccatacaaaaacaaat

SEQ ID NO: 32217 - DNA, 22 bp, Homo sapiens
gcattttaataaaaacaaatct

SEQ ID NO: 32218 - DNA, 21 bp, Homo sapiens
tagtacaacaaaaacaaatct

SEQ ID NO: 32219 - DNA, 21 bp, Homo sapiens
gcacatcataaaaacaagtct

SEQ ID NO: 32220 - DNA, 19 bp, Homo sapiens
tagcacaaaattgaaaaca

SEQ ID NO: 32221 - DNA, 20 bp, Homo sapiens
gcatcaaacaccacaaatct

SEQ ID NO: 32222 - DNA, 21 bp, Homo sapiens
gcacatgccgaagacaaatct

SEQ ID NO: 32223 - DNA, 22 bp, Homo sapiens
agcacaaaatcactggggatct

SEQ ID NO: 32224 - DNA, 60 bp, Ovine adenovirus A
tttcaataactctcacttttttgctagaggcaggctcaacaatgtctggagttgttgggg

SEQ ID NO: 32225 - DNA, 24 bp, Ovine adenovirus A
tcaataactctcacttttttgcta

SEQ ID NO: 32226 - DNA, 17 bp, Homo sapiens
tcgataatctcactcct

SEQ ID NO: 32227 - DNA, 22 bp, Homo sapiens
tcaataactctgctgaccccct

SEQ ID NO: 32228 - DNA, 20 bp, Homo sapiens
tcagtaactctcctccttta

SEQ ID NO: 32229 - DNA, 21 bp, Homo sapiens
tcagaactttcactcccacta

SEQ ID NO: 32230 - DNA, 18 bp, Homo sapiens
aataattctcactatgct

SEQ ID NO: 32231 - DNA, 19 bp, Homo sapiens
tcaataactgtcatttgct

SEQ ID NO: 32232 - DNA, 19 bp, Homo sapiens
tcagtaactcttctccctt

SEQ ID NO: 32233 - DNA, 21 bp, Homo sapiens
tcagtgaccctcactcaggcc

SEQ ID NO: 32234 - DNA, 19 bp, Homo sapiens
ataactctcattttcttct

SEQ ID NO: 32235 - DNA, 21 bp, Homo sapiens
tcagtaactcttcactatctg

SEQ ID NO: 32236 - DNA, 19 bp, Homo sapiens
tcagtagctctctctctct

SEQ ID NO: 32237 - DNA, 18 bp, Homo sapiens
ataactccactcaaacta

SEQ ID NO: 32238 - DNA, 19 bp, Homo sapiens
actctccaactttttgcta

SEQ ID NO: 32239 - DNA, 22 bp, Homo sapiens
tcagtgacctcactccgggcta

SEQ ID NO: 32240 - DNA, 21 bp, Homo sapiens
tcagtaactctctagaggcta

SEQ ID NO: 32241 - DNA, 23 bp, Homo sapiens
ccaataattctcactatcttgct

SEQ ID NO: 32242 - DNA, 21 bp, Homo sapiens
tccacacattacttttttgct

SEQ ID NO: 32243 - DNA, 19 bp, Homo sapiens
aataactctgagcctgcta

SEQ ID NO: 32244 - DNA, 21 bp, Homo sapiens
tcaacaactctcacttccctg

SEQ ID NO: 32245 - DNA, 65 bp, Vaccinia virus
aatggtgctattagaatttacaaaactggtaatccacatagttgtaaagttaaaattgttccgtt

SEQ ID NO: 32246 - DNA, 24 bp, Vaccinia virus
tattagaatttacaaaactggtaa

SEQ ID NO: 32247 - DNA, 16 bp, Homo sapiens
tatcagcaaaactggt

SEQ ID NO: 32248 - DNA, 22 bp, Homo sapiens
tactagaatttgcaaagactag

SEQ ID NO: 32249 - DNA, 18 bp, Homo sapiens
ttagaatctacaaagctg

SEQ ID NO: 32250 - DNA, 24 bp, Homo sapiens
tatcagtcaccttgaaactggtaa

SEQ ID NO: 32251 - DNA, 23 bp, Homo sapiens
attgaaatttacagaattggtaa

SEQ ID NO: 32252 - DNA, 20 bp, Homo sapiens
tatcagtacggaactggtaa

SEQ ID NO: 32253 - DNA, 16 bp, Homo sapiens
gattacaaaattggta

SEQ ID NO: 32254 - DNA, 16 bp, Homo sapiens
tattagaataactggt

SEQ ID NO: 32255 - DNA, 68 bp, Human herpesvirus 6
gtcgctcatgcggacagtcaaacattcattaacacgcaggatgttgcattctctcacagcatgatgac

SEQ ID NO: 32256 - DNA, 19 bp, Human herpesvirus 6
tctctcacagcatgatgac

SEQ ID NO: 32257 - DNA, 19 bp, Homo sapiens
tctccacagcaaggatgac

SEQ ID NO: 32258 - DNA, 18 bp, Homo sapiens
tctcccacagcaagggac

SEQ ID NO: 32259 - DNA, 17 bp, Homo sapiens
tctctcacattaatgac

SEQ ID NO: 32260 - DNA, 18 bp, Homo sapiens
tctttccaagatgatgac

SEQ ID NO: 32261 - DNA, 20 bp, Homo sapiens
cctctcacaggctggggtga

SEQ ID NO: 32262 - DNA, 16 bp, Homo sapiens
tctctaacataatgac

SEQ ID NO: 32263 - DNA, 18 bp, Homo sapiens
tccctcacagacacagac

SEQ ID NO: 32264 - DNA, 18 bp, Homo sapiens
tccctcacaggcgctgac

SEQ ID NO: 32265 - DNA, 18 bp, Homo sapiens
tctctcacagacacagac

SEQ ID NO: 32266 - DNA, 18 bp, Homo sapiens
ctcttacaaacacgatga

SEQ ID NO: 32267 - DNA, 19 bp, Homo sapiens
tcttgtacagcatggtgac

SEQ ID NO: 32268 - DNA, 18 bp, Homo sapiens
tctcttagccataatgac

SEQ ID NO: 32269 - DNA, 16 bp, Homo sapiens
tcttcacagcatttga

SEQ ID NO: 32270 - DNA, 16 bp, Homo sapiens
tctctcacagacgtga

SEQ ID NO: 32271 - DNA, 19 bp, Homo sapiens
tctcccacaagaatgatga

SEQ ID NO: 32272 - DNA, 16 bp, Homo sapiens
tctccacagcaatgac

SEQ ID NO: 32273 - DNA, 19 bp, Homo sapiens
tctctcactcagctgtgac

SEQ ID NO: 32274 - DNA, 21 bp, Homo sapiens
tctctcactctgaatgatgac

SEQ ID NO: 32275 - DNA, 17 bp, Homo sapiens
tctccactgctgatgac

SEQ ID NO: 32276 - DNA, 19 bp, Homo sapiens
tctctcacatcaagaggac

SEQ ID NO: 32277 - DNA, 17 bp, Homo sapiens
tctccccagatgatgac

SEQ ID NO: 32278 - DNA, 19 bp, Homo sapiens
tcttcccaagaatgatgac

SEQ ID NO: 32279 - DNA, 20 bp, Homo sapiens
tctcacaggaccttgatgac

SEQ ID NO: 32280 - DNA, 18 bp, Homo sapiens
cctctcacagcaagaaga

SEQ ID NO: 32281 - DNA, 15 bp, Homo sapiens
cccctcacatgatga

SEQ ID NO: 32282 - DNA, 18 bp, Homo sapiens
tcattcacatatgatgac

SEQ ID NO: 32283 - DNA, 22 bp, Homo sapiens
cctctcacagcaccaagatgac

SEQ ID NO: 32284 - DNA, 18 bp, Homo sapiens
cctctcacagtccaggat

SEQ ID NO: 32285 - DNA, 18 bp, Homo sapiens
tcttcccagaatgatgac

SEQ ID NO: 32286 - DNA, 19 bp, Homo sapiens
tctgctcactcccaatgac

SEQ ID NO: 32287 - DNA, 18 bp, Homo sapiens
tctctcactgagcgtgac

SEQ ID NO: 32288 - DNA, 18 bp, Homo sapiens
cctctcacaggtgcagat

SEQ ID NO: 32289 - DNA, 20 bp, Homo sapiens
tctctcactcatgtagatga

SEQ ID NO: 32290 - DNA, 21 bp, Homo sapiens
tccctcacagcttctgatgac

SEQ ID NO: 32291 - DNA, 20 bp, Homo sapiens
tctctcacagatgcaatgac

SEQ ID NO: 32292 - DNA, 23 bp, Homo sapiens
tctctcacaatatatgtgtgatg

SEQ ID NO: 32293 - DNA, 15 bp, Homo sapiens
tctctcaccatgtga

SEQ ID NO: 32294 - DNA, 16 bp, Homo sapiens
tctctacagcatggac

SEQ ID NO: 32295 - DNA, 18 bp, Homo sapiens
tctcccacagcgctgtga

SEQ ID NO: 32296 - DNA, 15 bp, Homo sapiens
tcttcaccatgatga

SEQ ID NO: 32297 - DNA, 19 bp, Homo sapiens
tctctgcagtcatcttgac

SEQ ID NO: 32298 - DNA, 18 bp, Homo sapiens
tccctcacaggcaatgac

SEQ ID NO: 32299 - DNA, 16 bp, Homo sapiens
ctctccagatgatgac

SEQ ID NO: 32300 - DNA, 18 bp, Homo sapiens
tctcccacagtccaagac

SEQ ID NO: 32301 - DNA, 19 bp, Homo sapiens
tctgtcatggcacgatgac

SEQ ID NO: 32302 - DNA, 18 bp, Homo sapiens
tccctcacggaacacatg

SEQ ID NO: 32303 - DNA, 78 bp, Fowlpox virus
gcgttcatattagactacaaacctaatgataataacaaaaatcatttatattttacaagttttaacaatattgaacgc

SEQ ID NO: 32304 - DNA, 24 bp, Fowlpox virus
tattagactacaaacctaatgata

SEQ ID NO: 32305 - DNA, 19 bp, Homo sapiens
attaaaattaaacctaatg

SEQ ID NO: 32306 - DNA, 21 bp, Homo sapiens
ctaaatacaagtctaatgata

SEQ ID NO: 32307 - DNA, 19 bp, Homo sapiens
tatcagactacaaacacca

SEQ ID NO: 32308 - DNA, 19 bp, Homo sapiens
ttagactagaaccagaatg

SEQ ID NO: 32309 - DNA, 18 bp, Homo sapiens
tattaaactacagatacc

SEQ ID NO: 32310 - DNA, 16 bp, Homo sapiens
tattagactacatgat

SEQ ID NO: 32311 - DNA, 72 bp, Human herpesvirus 6
ttcgaatcgccccttttccaaaacatgtgaagaccttcttctcaaaccttgacaaaacctatttgattcgag

SEQ ID NO: 32312 - DNA, 24 bp, Human herpesvirus 6
tcaaaccttgacaaaacctatttg

SEQ ID NO: 32313 - DNA, 19 bp, Homo sapiens
ccatgatgaagcctatttg

SEQ ID NO: 32314 - DNA, 18 bp, Homo sapiens
cttggcaaggcctacctg

SEQ ID NO: 32315 - DNA, 19 bp, Homo sapiens
ctgaccatgaacctatttg

SEQ ID NO: 32316 - DNA, 21 bp, Homo sapiens
aaccttgacagaacagccctg

SEQ ID NO: 32317 - DNA, 22 bp, Homo sapiens
tcaaatcttaacaaagctatct

SEQ ID NO: 32318 - DNA, 26 bp, Homo sapiens
tcgaaccctgacatttttattatttg

SEQ ID NO: 32319 - DNA, 24 bp, Homo sapiens
tcaaacctgacgaaaaggtacttg

SEQ ID NO: 32320 - DNA, 21 bp, Homo sapiens
tcagatcttggaaaacccact

SEQ ID NO: 32321 - DNA, 91 bp, Human herpesvirus 6
gcgaaatgtattcagattcgttttcaggtccgaacgccacaaactcaacaacgtaagtgtcgtctcgattacgcctgattatacatttcgt

SEQ ID NO: 32322 - DNA, 24 bp, Human herpesvirus 6
aatgtattcagattcgttttcagg

SEQ ID NO: 32323 - DNA, 21 bp, Homo sapiens
tgtattcagttttgtcaatgg

SEQ ID NO: 32324 - DNA, 21 bp, Homo sapiens
aatgtatttaattcttccagg

SEQ ID NO: 32325 - DNA, 18 bp, Homo sapiens
aatgtattcaggctccag

SEQ ID NO: 32326 - DNA, 19 bp, Homo sapiens
aatgtcttcagtttttcag

SEQ ID NO: 32327 - DNA, 19 bp, Homo sapiens
aatgtattgcaattttcag

SEQ ID NO: 32328 - DNA, 20 bp, Homo sapiens
atgtttcaggcattttcagg

SEQ ID NO: 32329 - DNA, 22 bp, Homo sapiens
aatgtgttagtccattttcagg

SEQ ID NO: 32330 - DNA, 19 bp, Homo sapiens
gtattcaggttcttccggg

SEQ ID NO: 32331 - DNA, 18 bp, Homo sapiens
aatgtgctcagattacag

SEQ ID NO: 32332 - DNA, 25 bp, Homo sapiens
aatgtattcaagatttagccttagg

SEQ ID NO: 32333 - DNA, 78 bp, Gallid herpesvirus 2
tcgtcgagatcgtgatttggagaatataacgttggaagcactaacagttccctggcgtctgcaattccgtgtcgatga

SEQ ID NO: 32334 - DNA, 21 bp, Gallid herpesvirus 2
tctgcaattccgtgtcgatga

SEQ ID NO: 32335 - DNA, 19 bp, Homo sapiens
tctgcggttccacgtgtga

SEQ ID NO: 32336 - DNA, 19 bp, Homo sapiens
tctgcaatgctgtcgcctg

SEQ ID NO: 32337 - DNA, 21 bp, Homo sapiens
tctgcaatattggtgcgatga

SEQ ID NO: 32338 - DNA, 20 bp, Homo sapiens
tgcaactctggcctatatga

SEQ ID NO: 32339 - DNA, 19 bp, Homo sapiens
gcaatgccaatgtcgatga

SEQ ID NO: 32340 - DNA, 20 bp, Homo sapiens
tgcaattctcagttccgatg

SEQ ID NO: 32341 - DNA, 15 bp, Homo sapiens
tctgcaatgtcgatg

SEQ ID NO: 32342 - DNA, 18 bp, Homo sapiens
tacaattcctatgagatg

SEQ ID NO: 32343 - DNA, 19 bp, Homo sapiens
tctccagttccatgccctg

SEQ ID NO: 32344 - DNA, 16 bp, Homo sapiens
tctacaattccccatg

SEQ ID NO: 32345 - DNA, 16 bp, Homo sapiens
tctgcattccgtacaa

SEQ ID NO: 32346 - DNA, 16 bp, Homo sapiens
tctgcaatgtttcatg

SEQ ID NO: 32347 - DNA, 16 bp, Homo sapiens
tgcaattctgacaatg

SEQ ID NO: 32348 - DNA, 19 bp, Homo sapiens
tctgcaattgctgtcatga

SEQ ID NO: 32349 - DNA, 17 bp, Homo sapiens
tctgcaatttggtgtga

SEQ ID NO: 32350 - DNA, 18 bp, Homo sapiens
tctgcaatatctgtagtc

SEQ ID NO: 32351 - DNA, 20 bp, Homo sapiens
tcttcaattccgttcactga

SEQ ID NO: 32352 - DNA, 17 bp, Homo sapiens
cccgcagcgtgtcgatg

SEQ ID NO: 32353 - DNA, 17 bp, Homo sapiens
tctgcaatctgccggtg

SEQ ID NO: 32354 - DNA, 65 bp, Gallid herpesvirus 2
cgcgttaccaacaattgtgtgatctcgttactgaaatcggatttaaagcgcaaatatcaaacgtg

SEQ ID NO: 32355 - DNA, 24 bp, Gallid herpesvirus 2
aattgtgtgatctcgttactgaaa

SEQ ID NO: 32356 - DNA, 16 bp, Homo sapiens
aattgtgtgtctctga

SEQ ID NO: 32357 - DNA, 19 bp, Homo sapiens
tgtgaagaaattactgaaa

SEQ ID NO: 32358 - DNA, 18 bp, Homo sapiens
tgtgattgtttactgaaa

SEQ ID NO: 32359 - DNA, 15 bp, Homo sapiens
aattgtgtggttact

SEQ ID NO: 32360 - DNA, 21 bp, Homo sapiens
ttgccaacacttgttactgaa

SEQ ID NO: 32361 - DNA, 16 bp, Homo sapiens
tgtgtgacgtgctgaa

SEQ ID NO: 32362 - DNA, 22 bp, Homo sapiens
gtgtgatctcagctcgctgaaa

SEQ ID NO: 32363 - DNA, 18 bp, Homo sapiens
tgtgtgatcttgtcctaa

SEQ ID NO: 32364 - DNA, 20 bp, Homo sapiens
aattatgtgattgtacttga

SEQ ID NO: 32365 - DNA, 19 bp, Homo sapiens
aactgtgtggttccttctg

SEQ ID NO: 32366 - DNA, 17 bp, Homo sapiens
ttgtgtaaattactgaa

SEQ ID NO: 32367 - DNA, 20 bp, Homo sapiens
aattgtgtggtcttctcatt

SEQ ID NO: 32368 - DNA, 94 bp, Gallid herpesvirus 2
tgcatatttggacgctcatccatgaatctacgaagcttgattataatccccagtagatggcttccaaattcctggctaactattactatatgca

SEQ ID NO: 32369 - DNA, 24 bp, Gallid herpesvirus 2
tccatgaatctacgaagcttgatt

SEQ ID NO: 32370 - DNA, 17 bp, Homo sapiens
gaaagcaaagcttgatt

SEQ ID NO: 32371 - DNA, 17 bp, Homo sapiens
catgaatctatcttgat

SEQ ID NO: 32372 - DNA, 23 bp, Homo sapiens
tctgtggctccaaaggcttgatt

SEQ ID NO: 32373 - DNA, 24 bp, Homo sapiens
catgaatcagcgaaacaacagatt

SEQ ID NO: 32374 - DNA, 21 bp, Homo sapiens
caggaacacagaggcttgatt

SEQ ID NO: 32375 - DNA, 21 bp, Homo sapiens
tccatagtctatgacctgatt

SEQ ID NO: 32376 - DNA, 130 bp, Gallid herpesvirus 3
cgtaaatgcaggggttaatcgggcggatggggaccagcgcagggagcgcggaaggagtcctgctctgaaaaaaatgagggggaaccgtgagaaagcgttccccgcagttcgcatcgcttcttgccccccg

SEQ ID NO: 32377 - DNA, 24 bp, Gallid herpesvirus 3
agggagcgcggaaggagtcctgct

SEQ ID NO: 32378 - DNA, 19 bp, Homo sapiens
agggagcgagggaggcggc

SEQ ID NO: 32379 - DNA, 26 bp, Homo sapiens
agggagcgtggaggaggcaaatcctg

SEQ ID NO: 32380 - DNA, 23 bp, Homo sapiens
agggagcgagggggccgcttgct

SEQ ID NO: 32381 - DNA, 23 bp, Homo sapiens
agggatggcgatggggtcctgct

SEQ ID NO: 32382 - DNA, 23 bp, Homo sapiens
ggcgagcgcggggggccggggct

SEQ ID NO: 32383 - DNA, 21 bp, Homo sapiens
agggaggcggaaggcccagct

SEQ ID NO: 32384 - DNA, 20 bp, Homo sapiens
agggggctggaaggaagcct

SEQ ID NO: 32385 - DNA, 24 bp, Homo sapiens
aggggctgtggagtccccactgct

SEQ ID NO: 32386 - DNA, 19 bp, Homo sapiens
aggaaggcaggagtcctgc

SEQ ID NO: 32387 - DNA, 25 bp, Homo sapiens
agggagcgggaaggagcgccgagct

SEQ ID NO: 32388 - DNA, 23 bp, Homo sapiens
aggcggcgtggaaggaaaaggct

SEQ ID NO: 32389 - DNA, 17 bp, Homo sapiens
agggagcgtgcgggggc

SEQ ID NO: 32390 - DNA, 24 bp, Homo sapiens
gggtggtgtggagagaatcctgct

SEQ ID NO: 32391 - DNA, 18 bp, Homo sapiens
aggagcgcgggaggcagc

SEQ ID NO: 32392 - DNA, 19 bp, Homo sapiens
agggagagaagagtcctgc

SEQ ID NO: 32393 - DNA, 18 bp, Homo sapiens
aggaggtgagagtcctgc

SEQ ID NO: 32394 - DNA, 18 bp, Homo sapiens
agggaaggaggggtcctg

SEQ ID NO: 32395 - DNA, 21 bp, Homo sapiens
agggagcatgggagggcagct

SEQ ID NO: 32396 - DNA, 22 bp, Homo sapiens
gggtgaggatgggagtcctgct

SEQ ID NO: 32397 - DNA, 22 bp, Homo sapiens
agggagtttgggatgccctgct

SEQ ID NO: 32398 - DNA, 22 bp, Homo sapiens
agggagcgtgggggaagagacc

SEQ ID NO: 32399 - DNA, 21 bp, Homo sapiens
agggggctgccaggtcctgct

SEQ ID NO: 32400 - DNA, 19 bp, Homo sapiens
ggcgagcgcggagggcggc

SEQ ID NO: 32401 - DNA, 119 bp, Paramecium bursaria Chlorella virus 1
tgagagattcctctgtgtgttttttaccataaaaagagttattagttcccatttgagatttacttattttactcttaacttcttctttttgtggtttaccatacatatgacttttttca

SEQ ID NO: 32402 - DNA, 24 bp, Paramecium bursaria Chlorella virus 1
taccataaaaagagttattagttc

SEQ ID NO: 32403 - DNA, 20 bp, Homo sapiens
ccattaaaagaggatgagtt

SEQ ID NO: 32404 - DNA, 19 bp, Homo sapiens
taccacagaaagggttatt

SEQ ID NO: 32405 - DNA, 17 bp, Homo sapiens
taccataagaaagttat

SEQ ID NO: 32406 - DNA, 25 bp, Homo sapiens
taccacaaaaggagttaaggcagtt

SEQ ID NO: 32407 - DNA, 21 bp, Homo sapiens
catggaaaaagttattagttc

SEQ ID NO: 32408 - DNA, 24 bp, Homo sapiens
taccaaggaaagatctactagttc

SEQ ID NO: 32409 - DNA, 18 bp, Homo sapiens
ccataaaaagagtgagtt

SEQ ID NO: 32410 - DNA, 21 bp, Homo sapiens
accatgatgtagttattagtt

SEQ ID NO: 32411 - DNA, 22 bp, Homo sapiens
cataaaaaaatatttattagtt

SEQ ID NO: 32412 - DNA, 79 bp, Gallid herpesvirus 3
gggagagaaataccgacggccggacagagcgaattattaagcacccaacgctcacgccaacacgtcccacctctttccc

SEQ ID NO: 32413 - DNA, 24 bp, Gallid herpesvirus 3
tcacgccaacacgtcccacctctt

SEQ ID NO: 32414 - DNA, 21 bp, Homo sapiens
tcagctcaaatcccacctctt

SEQ ID NO: 32415 - DNA, 23 bp, Homo sapiens
cgccgccacaatctccacctctt

SEQ ID NO: 32416 - DNA, 18 bp, Homo sapiens
gcccagctcccacctctt

SEQ ID NO: 32417 - DNA, 22 bp, Homo sapiens
tcattcacatgttccacctctt

SEQ ID NO: 32418 - DNA, 20 bp, Homo sapiens
actccaacctaccacctctt

SEQ ID NO: 32419 - DNA, 24 bp, Homo sapiens
tcaggctggcagctctcacctctt

SEQ ID NO: 32420 - DNA, 28 bp, Homo sapiens
cgccaacatggctgagtcccacttctta

SEQ ID NO: 32421 - DNA, 21 bp, Homo sapiens
tcacgccagcgtgccccagct

SEQ ID NO: 32422 - DNA, 22 bp, Homo sapiens
tcaggctggcaaaacacctctt

SEQ ID NO: 32423 - DNA, 21 bp, Homo sapiens
gcctgggcagccccacctctt

SEQ ID NO: 32424 - DNA, 20 bp, Homo sapiens
caccctaatctgcacctctt

SEQ ID NO: 32425 - DNA, 18 bp, Homo sapiens
tccgcttttcccacctct

SEQ ID NO: 32426 - DNA, 17 bp, Homo sapiens
cacccacattcacctct

SEQ ID NO: 32427 - DNA, 19 bp, Homo sapiens
gccagcaatcccacctctt

SEQ ID NO: 32428 - DNA, 24 bp, Homo sapiens
tcacgtcaaaatttcacacctctt

SEQ ID NO: 32429 - DNA, 22 bp, Homo sapiens
tcacaccatttccccatctctt

SEQ ID NO: 32430 - DNA, 69 bp, Variola virus
atgaagttaatgatacacactatactgtcgaatttgatagggacaaagtagttgacacgtttatttcgt

SEQ ID NO: 32431 - DNA, 24 bp, Variola virus
ttaatgatacacactatactgtcg

SEQ ID NO: 32432 - DNA, 17 bp, Homo sapiens
tggtaccactatactgt

SEQ ID NO: 32433 - DNA, 18 bp, Homo sapiens
ttaatatacacactgtac

SEQ ID NO: 32434 - DNA, 20 bp, Homo sapiens
ttaatgagacatactgtact

SEQ ID NO: 32435 - DNA, 19 bp, Homo sapiens
ttaatgataaacattactg

SEQ ID NO: 32436 - DNA, 113 bp, Human herpesvirus 1
cgctcccgcggccccgccccccacgcccgccgcgcgcgcgcacgccgcccggaccgccgcccgccttttttgcgcgcgcgcgcgcccgcggggggcccgggctgccacaggtg

SEQ ID NO: 32437 - DNA, 24 bp, Human herpesvirus 1
ccgcggccccgccccccacgcccg

SEQ ID NO: 32438 - DNA, 19 bp, Homo sapiens
cccggccccgctcggctcc

SEQ ID NO: 32439 - DNA, 22 bp, Homo sapiens
ccttggccttgctccatccccg

SEQ ID NO: 32440 - DNA, 16 bp, Homo sapiens
ccgcgacctccacgcc

SEQ ID NO: 32441 - DNA, 25 bp, Homo sapiens
ccgcctcgcgctcgcccctcgtgcc

SEQ ID NO: 32442 - DNA, 21 bp, Homo sapiens
ccgtgccccgcctcgcgctcg

SEQ ID NO: 32443 - DNA, 18 bp, Homo sapiens
cggcgtcctccacgcccg

SEQ ID NO: 32444 - DNA, 21 bp, Homo sapiens
ccgcgccccgcccaccgcccg

SEQ ID NO: 32445 - DNA, 24 bp, Homo sapiens
ccgcggcccttcccagctggctcg

SEQ ID NO: 32446 - DNA, 21 bp, Homo sapiens
ccgcggccctcgtgtcgcccg

SEQ ID NO: 32447 - DNA, 20 bp, Homo sapiens
cccggccccgccccccctcg

SEQ ID NO: 32448 - DNA, 19 bp, Homo sapiens
ccgccgtcccgcctcagcc

SEQ ID NO: 32449 - DNA, 18 bp, Homo sapiens
cgcggccccgcccggccc

SEQ ID NO: 32450 - DNA, 18 bp, Homo sapiens
cgtggccccgccctgccc

SEQ ID NO: 32451 - DNA, 19 bp, Homo sapiens
ccgcggcccggcccggccc

SEQ ID NO: 32452 - DNA, 16 bp, Homo sapiens
cggccccgctcccagc

SEQ ID NO: 32453 - DNA, 20 bp, Homo sapiens
cccggctccgcccccctcac

SEQ ID NO: 32454 - DNA, 18 bp, Homo sapiens
cacggccccgctttcacc

SEQ ID NO: 32455 - DNA, 17 bp, Homo sapiens
cggccccgccccggccc

SEQ ID NO: 32456 - DNA, 22 bp, Homo sapiens
ccgcgcctccgggccgcgtccg

SEQ ID NO: 32457 - DNA, 22 bp, Homo sapiens
gcagccccgctcccgccatgcc

SEQ ID NO: 32458 - DNA, 18 bp, Homo sapiens
cccggccccgccccgccc

SEQ ID NO: 32459 - DNA, 18 bp, Homo sapiens
ccgcgctccgcccggccc

SEQ ID NO: 32460 - DNA, 16 bp, Homo sapiens
gcgccccgcccggccc

SEQ ID NO: 32461 - DNA, 26 bp, Homo sapiens
ccgcgcttccgctccccactctcccg

SEQ ID NO: 32462 - DNA, 18 bp, Homo sapiens
ccgcgtccccgcccagca

SEQ ID NO: 32463 - DNA, 19 bp, Homo sapiens
ccgcgctccgcccgcatcc

SEQ ID NO: 32464 - DNA, 20 bp, Homo sapiens
ccgcggccgccgcctctcca

SEQ ID NO: 32465 - DNA, 19 bp, Homo sapiens
ccgtgcccccgccccgggc

SEQ ID NO: 32466 - DNA, 20 bp, Homo sapiens
cgggcccccgcccatgcccg

SEQ ID NO: 32467 - DNA, 23 bp, Homo sapiens
cccggccccgcccctactgtccg

SEQ ID NO: 32468 - DNA, 24 bp, Homo sapiens
ccggggctccagaggccacgcccg

SEQ ID NO: 32469 - DNA, 18 bp, Homo sapiens
cccggccccgctccccac

SEQ ID NO: 32470 - DNA, 27 bp, Homo sapiens
ccgcggcccccgctccacgcacgcccg

SEQ ID NO: 32471 - DNA, 15 bp, Homo sapiens
ggccccgccccaccc

SEQ ID NO: 32472 - DNA, 17 bp, Homo sapiens
ccgcggccccgccgcgc

SEQ ID NO: 32473 - DNA, 19 bp, Homo sapiens
cctcggccccgctgcgccc

SEQ ID NO: 32474 - DNA, 19 bp, Homo sapiens
ccgccggccctgcccgtcc

SEQ ID NO: 32475 - DNA, 18 bp, Homo sapiens
ccgcggccgccgccctcc

SEQ ID NO: 32476 - DNA, 29 bp, Homo sapiens
cgcggctcctgctcgtctcccgcgctcgc

SEQ ID NO: 32477 - DNA, 20 bp, Homo sapiens
ccgcgcccccgcccccgccc

SEQ ID NO: 32478 - DNA, 22 bp, Homo sapiens
cctcggccccgcgccgcgctcg

SEQ ID NO: 32479 - DNA, 20 bp, Homo sapiens
gcgccccgccggcgcgctcg

SEQ ID NO: 32480 - DNA, 18 bp, Homo sapiens
ccgccgccgcccgcgccc

SEQ ID NO: 32481 - DNA, 22 bp, Homo sapiens
ccgcggcctcccggggggcccg

SEQ ID NO: 32482 - DNA, 18 bp, Homo sapiens
ccgcgccccgcctccgcg

SEQ ID NO: 32483 - DNA, 24 bp, Homo sapiens
ccctgcccgcgccccccgcgcccg

SEQ ID NO: 32484 - DNA, 19 bp, Homo sapiens
gcggccccgcccgaggccc

SEQ ID NO: 32485 - DNA, 26 bp, Homo sapiens
ccgcggccgccgctgagctacgtgcc

SEQ ID NO: 32486 - DNA, 17 bp, Homo sapiens
ccgggccccgcgtcgcc

SEQ ID NO: 32487 - DNA, 18 bp, Homo sapiens
ccagcgggcccccacgcc

SEQ ID NO: 32488 - DNA, 20 bp, Homo sapiens
gcgcccccgccccgcccccg

SEQ ID NO: 32489 - DNA, 22 bp, Homo sapiens
ccgcgagcttcgccttgacccc

SEQ ID NO: 32490 - DNA, 20 bp, Homo sapiens
ccgcgccctcgccctcatcg

SEQ ID NO: 32491 - DNA, 21 bp, Homo sapiens
cccggccccgtttgggcctcg

SEQ ID NO: 32492 - DNA, 22 bp, Homo sapiens
ccgcggccgccgctcctgggcc

SEQ ID NO: 32493 - DNA, 19 bp, Homo sapiens
ccccggccccgcccggccc

SEQ ID NO: 32494 - DNA, 24 bp, Homo sapiens
ccgggctccggcgcctcacgcccg

SEQ ID NO: 32495 - DNA, 22 bp, Homo sapiens
cgcggtcctgcttcccacaccc

SEQ ID NO: 32496 - DNA, 21 bp, Homo sapiens
cctggctcgtgtccccacgcc

SEQ ID NO: 32497 - DNA, 23 bp, Homo sapiens
gcgccccgccccagcgaagcccg

SEQ ID NO: 32498 - DNA, 21 bp, Homo sapiens
ccgcggccccgccaggcctcg

SEQ ID NO: 32499 - DNA, 18 bp, Homo sapiens
ccgcggctccacccgtcc

SEQ ID NO: 32500 - DNA, 19 bp, Homo sapiens
cctggccccgccccggccc

SEQ ID NO: 32501 - DNA, 31 bp, Homo sapiens
ccggggccccgcgtgcgtcctccgcgcccgc

SEQ ID NO: 32502 - DNA, 26 bp, Homo sapiens
ccgcgctctgcccctcccccagctcg

SEQ ID NO: 32503 - DNA, 20 bp, Homo sapiens
gcggccccgctccggctccg

SEQ ID NO: 32504 - DNA, 23 bp, Homo sapiens
ccgcggccgccgccttctcctcg

SEQ ID NO: 32505 - DNA, 21 bp, Homo sapiens
ccggggccccgcccgcctccg

SEQ ID NO: 32506 - DNA, 18 bp, Homo sapiens
ccgcgccccgcccccacg

SEQ ID NO: 32507 - DNA, 20 bp, Homo sapiens
cgggccccgccgtgcgcccg

SEQ ID NO: 32508 - DNA, 23 bp, Homo sapiens
ccgcggcccgcgctcccggtgcc

SEQ ID NO: 32509 - DNA, 22 bp, Homo sapiens
ccacggtctccggccgcgcccg

SEQ ID NO: 32510 - DNA, 19 bp, Homo sapiens
cccggccccgcctcccccg

SEQ ID NO: 32511 - DNA, 16 bp, Homo sapiens
gcgtccccgcccgccc

SEQ ID NO: 32512 - DNA, 24 bp, Homo sapiens
gctgcccacgccgtcctccgtgcc

SEQ ID NO: 32513 - DNA, 24 bp, Homo sapiens
ccgtggctcctgcctccactcacc

SEQ ID NO: 32514 - DNA, 18 bp, Homo sapiens
cgggccccgccgccgccc

SEQ ID NO: 32515 - DNA, 19 bp, Homo sapiens
ccgcgcccgccccgcgccc

SEQ ID NO: 32516 - DNA, 21 bp, Homo sapiens
ccgcggctcggcccggccccc

SEQ ID NO: 32517 - DNA, 18 bp, Homo sapiens
ccgccgccagcccacgcc

SEQ ID NO: 32518 - DNA, 21 bp, Homo sapiens
ccgcggcctccgctccacacc

SEQ ID NO: 32519 - DNA, 18 bp, Homo sapiens
ccgcggccctgctgcccc

SEQ ID NO: 32520 - DNA, 19 bp, Homo sapiens
ccgcggccgccgcctctcc

SEQ ID NO: 32521 - DNA, 20 bp, Homo sapiens
cgcggccccgctccatcccg

SEQ ID NO: 32522 - DNA, 23 bp, Homo sapiens
cctggccccgcctccagttaccc

SEQ ID NO: 32523 - DNA, 18 bp, Homo sapiens
ccgcggccccgcgctccg

SEQ ID NO: 32524 - DNA, 22 bp, Homo sapiens
ccgcgcccccgccccccgctcg

SEQ ID NO: 32525 - DNA, 16 bp, Homo sapiens
ggccccgtccacgccc

SEQ ID NO: 32526 - DNA, 25 bp, Homo sapiens
ccgccggtctcggccaccatgtccg

SEQ ID NO: 32527 - DNA, 22 bp, Homo sapiens
cgcggccccgcctccctccccg

SEQ ID NO: 32528 - DNA, 18 bp, Homo sapiens
ccgcggctccgctgcagc

SEQ ID NO: 32529 - DNA, 18 bp, Homo sapiens
ccatggccccgcgcgccc

SEQ ID NO: 32530 - DNA, 20 bp, Homo sapiens
ccacggccccgctccttaca

SEQ ID NO: 32531 - DNA, 20 bp, Homo sapiens
ccgcggcccggcccctgccc

SEQ ID NO: 32532 - DNA, 16 bp, Homo sapiens
ccgcggccccggcgcc

SEQ ID NO: 32533 - DNA, 20 bp, Homo sapiens
cgcggcccccgagccgcccg

SEQ ID NO: 32534 - DNA, 23 bp, Homo sapiens
ccgcggcctctctctcccgcccg

SEQ ID NO: 32535 - DNA, 19 bp, Homo sapiens
ccgcggcgcccgctccgcc

SEQ ID NO: 32536 - DNA, 19 bp, Homo sapiens
ccgcggccccggccagggc

SEQ ID NO: 32537 - DNA, 17 bp, Homo sapiens
cgcggccccgcccccgc

SEQ ID NO: 32538 - DNA, 23 bp, Homo sapiens
ggctccgccccctcagccgcccg

SEQ ID NO: 32539 - DNA, 20 bp, Homo sapiens
ccgctgccccgtccacaccc

SEQ ID NO: 32540 - DNA, 22 bp, Homo sapiens
ccccggccccgcccctcatacc

SEQ ID NO: 32541 - DNA, 23 bp, Homo sapiens
ccgcggccccggtcccctgcccg

SEQ ID NO: 32542 - DNA, 21 bp, Homo sapiens
ccgcgccccgccccgggctcg

SEQ ID NO: 32543 - DNA, 24 bp, Homo sapiens
ccgcggccactcggcccacgcccg

SEQ ID NO: 32544 - DNA, 18 bp, Homo sapiens
ccgcggcgcatcacgccc

SEQ ID NO: 32545 - DNA, 25 bp, Homo sapiens
ccgcggcctctccctcgcggctccg

SEQ ID NO: 32546 - DNA, 21 bp, Homo sapiens
gcgccccgcccctatatcccg

SEQ ID NO: 32547 - DNA, 20 bp, Homo sapiens
cccggccccagccacgctcg

SEQ ID NO: 32548 - DNA, 26 bp, Homo sapiens
ccacggcctccacacacctgtgcccg

SEQ ID NO: 32549 - DNA, 18 bp, Homo sapiens
ccgtgccccgcccccggc

SEQ ID NO: 32550 - DNA, 17 bp, Homo sapiens
gcggccccgctccagcc

SEQ ID NO: 32551 - DNA, 19 bp, Homo sapiens
ccgggccccgctcgggccc

SEQ ID NO: 32552 - DNA, 25 bp, Homo sapiens
ccgcggcctccgcctcctccatgcc

SEQ ID NO: 32553 - DNA, 19 bp, Homo sapiens
ccccggccccgcccccggc

SEQ ID NO: 32554 - DNA, 22 bp, Homo sapiens
ccgcggccccggcgccggcgcc

SEQ ID NO: 32555 - DNA, 21 bp, Homo sapiens
ccgcggcctccgtctcctcca

SEQ ID NO: 32556 - DNA, 19 bp, Homo sapiens
gcggcccagcccagacccg

SEQ ID NO: 32557 - DNA, 19 bp, Homo sapiens
cgcggccctggccctgacg

SEQ ID NO: 32558 - DNA, 20 bp, Homo sapiens
ccgcggcccccgcccccccg

SEQ ID NO: 32559 - DNA, 22 bp, Homo sapiens
ccgcggccgctgctcctgcccg

SEQ ID NO: 32560 - DNA, 23 bp, Homo sapiens
ccgccgccccgccccggctcccg

SEQ ID NO: 32561 - DNA, 20 bp, Homo sapiens
ccgcggccctggccgccccc

SEQ ID NO: 32562 - DNA, 17 bp, Homo sapiens
ggtcccgccccgcgccc

SEQ ID NO: 32563 - DNA, 21 bp, Homo sapiens
cggccccgcccctcccatccg

SEQ ID NO: 32564 - DNA, 19 bp, Homo sapiens
ccgggccccgcctccaagc

SEQ ID NO: 32565 - DNA, 19 bp, Homo sapiens
ccgcggccccgctcgcacg

SEQ ID NO: 32566 - DNA, 21 bp, Homo sapiens
ccacggcctcgccccgcgccc

SEQ ID NO: 32567 - DNA, 18 bp, Homo sapiens
cccggtcccgtcagcgcc

SEQ ID NO: 32568 - DNA, 24 bp, Homo sapiens
cgggctccgcccccctcctcctcg

SEQ ID NO: 32569 - DNA, 19 bp, Homo sapiens
cgcggccccgcctcgcccg

SEQ ID NO: 32570 - DNA, 23 bp, Homo sapiens
cgcggccccaaggatcctgcgcc

SEQ ID NO: 32571 - DNA, 22 bp, Homo sapiens
ggccccgcttcccccagcctcg

SEQ ID NO: 32572 - DNA, 19 bp, Homo sapiens
ccccggcctcgcctggccc

SEQ ID NO: 32573 - DNA, 24 bp, Homo sapiens
ccgcggcccggcccccgccacccg

SEQ ID NO: 32574 - DNA, 19 bp, Homo sapiens
ccgcggcccggcttcgccc

SEQ ID NO: 32575 - DNA, 19 bp, Homo sapiens
cccggcttcgcccgcgccc

SEQ ID NO: 32576 - DNA, 22 bp, Homo sapiens
ccttccccgccccctgcgctcg

SEQ ID NO: 32577 - DNA, 19 bp, Homo sapiens
cccggccctgcctgtcccc

SEQ ID NO: 32578 - DNA, 16 bp, Homo sapiens
gcggccccaccgcgcc

SEQ ID NO: 32579 - DNA, 22 bp, Homo sapiens
ccgcggccgccgcccccacccg

SEQ ID NO: 32580 - DNA, 18 bp, Homo sapiens
cggccccgtctcagcccg

SEQ ID NO: 32581 - DNA, 19 bp, Homo sapiens
ccgcggcccgcccggctcc

SEQ ID NO: 32582 - DNA, 21 bp, Homo sapiens
gaccccgccctcgtcactccg

SEQ ID NO: 32583 - DNA, 21 bp, Homo sapiens
ccgcggcctcgcacttcccca

SEQ ID NO: 32584 - DNA, 19 bp, Homo sapiens
ccgcggcccccgccccacc

SEQ ID NO: 32585 - DNA, 26 bp, Homo sapiens
ccgcggcctcgttgtcccacggcccg

SEQ ID NO: 32586 - DNA, 22 bp, Homo sapiens
ccgcgccccgcgcccgcgcccg

SEQ ID NO: 32587 - DNA, 24 bp, Homo sapiens
ccgcggccgcgcgaggcgcgctcg

SEQ ID NO: 32588 - DNA, 17 bp, Homo sapiens
gcggccccgccccgcgc

SEQ ID NO: 32589 - DNA, 18 bp, Homo sapiens
cctggccccgcctccgcc

SEQ ID NO: 32590 - DNA, 22 bp, Homo sapiens
cggccccgccccgaagcgcccg

SEQ ID NO: 32591 - DNA, 18 bp, Homo sapiens
gcagccccgcccccgccc

SEQ ID NO: 32592 - DNA, 19 bp, Homo sapiens
cgcggccccgcgccggcgc

SEQ ID NO: 32593 - DNA, 19 bp, Homo sapiens
ccgcggcccgtcgccgccc

SEQ ID NO: 32594 - DNA, 18 bp, Homo sapiens
ccgcggcccgcccggccc

SEQ ID NO: 32595 - DNA, 15 bp, Homo sapiens
ccgcgccccgccgcc

SEQ ID NO: 32596 - DNA, 18 bp, Homo sapiens
ccgcgcccccgccccgcc

SEQ ID NO: 32597 - DNA, 19 bp, Homo sapiens
ccccggccctgcccggccc

SEQ ID NO: 32598 - DNA, 18 bp, Homo sapiens
gcggccccgcccaggccc

SEQ ID NO: 32599 - DNA, 25 bp, Homo sapiens
cccggccccgccccacccgtgcccg

SEQ ID NO: 32600 - DNA, 18 bp, Homo sapiens
gccgccccgcccccgccc

SEQ ID NO: 32601 - DNA, 18 bp, Homo sapiens
cccggctccgctcctgcc

SEQ ID NO: 32602 - DNA, 22 bp, Homo sapiens
gcggttccaccccgcacgcccg

SEQ ID NO: 32603 - DNA, 23 bp, Homo sapiens
ccgcggcccccctccgaggtccg

SEQ ID NO: 32604 - DNA, 18 bp, Homo sapiens
ccgcgctccgctccgccc

SEQ ID NO: 32605 - DNA, 20 bp, Homo sapiens
ccgggtcccgcccctcacac

SEQ ID NO: 32606 - DNA, 22 bp, Homo sapiens
cggggctcgccccccgcgctcg

SEQ ID NO: 32607 - DNA, 18 bp, Homo sapiens
ccgcggccgccgccgccc

SEQ ID NO: 32608 - DNA, 21 bp, Homo sapiens
cctggcctgcccaccccacgc

SEQ ID NO: 32609 - DNA, 17 bp, Homo sapiens
ccacgctcccccacgcc

SEQ ID NO: 32610 - DNA, 21 bp, Homo sapiens
cctggctctgcccctcctccg

SEQ ID NO: 32611 - DNA, 17 bp, Homo sapiens
ccgcggccacccgcgcc

SEQ ID NO: 32612 - DNA, 24 bp, Homo sapiens
cgctcgccccgcccctcgcgtccg

SEQ ID NO: 32613 - DNA, 23 bp, Homo sapiens
ccgggccccgctcctcagctccg

SEQ ID NO: 32614 - DNA, 19 bp, Homo sapiens
ccggggcccctgcacgccc

SEQ ID NO: 32615 - DNA, 16 bp, Homo sapiens
cggccccgccccaccc

SEQ ID NO: 32616 - DNA, 20 bp, Homo sapiens
ccgctgtcccgccccacgcc

SEQ ID NO: 32617 - DNA, 22 bp, Homo sapiens
gccccggggtcccctgcgcccg

SEQ ID NO: 32618 - DNA, 20 bp, Homo sapiens
gcgccccgcccgccggcccg

SEQ ID NO: 32619 - DNA, 18 bp, Homo sapiens
cctggccccgcgtcgccc

SEQ ID NO: 32620 - DNA, 19 bp, Homo sapiens
ggccccgcccacgcgtccg

SEQ ID NO: 32621 - DNA, 19 bp, Homo sapiens
ccgcggcccgcgcccttcc

SEQ ID NO: 32622 - DNA, 18 bp, Homo sapiens
ccgcgccccgcccggccc

SEQ ID NO: 32623 - DNA, 20 bp, Homo sapiens
ccgcggccccgcgcttcccc

SEQ ID NO: 32624 - DNA, 19 bp, Homo sapiens
ccgcggccccgcatccccc

SEQ ID NO: 32625 - DNA, 16 bp, Homo sapiens
gcgctccgcccccgcc

SEQ ID NO: 32626 - DNA, 26 bp, Homo sapiens
cgcggcccccgcacgctccacgcccg

SEQ ID NO: 32627 - DNA, 21 bp, Homo sapiens
ccacggccacctttccctgcg

SEQ ID NO: 32628 - DNA, 21 bp, Homo sapiens
ccggtgctgcctccacgcccg

SEQ ID NO: 32629 - DNA, 20 bp, Homo sapiens
ccgcggcccgcgtctccccc

SEQ ID NO: 32630 - DNA, 21 bp, Homo sapiens
ccgaggtccgggccacgcccg

SEQ ID NO: 32631 - DNA, 18 bp, Homo sapiens
cgcggcccgcgcccgccc

SEQ ID NO: 32632 - DNA, 23 bp, Homo sapiens
ccgcagccccgggtgcgcgctcg

SEQ ID NO: 32633 - DNA, 22 bp, Homo sapiens
ccgccgccccgcctcctccacc

SEQ ID NO: 32634 - DNA, 17 bp, Homo sapiens
cccggccccgggcgccc

SEQ ID NO: 32635 - DNA, 19 bp, Homo sapiens
ccgggccccgcccctcccc

SEQ ID NO: 32636 - DNA, 18 bp, Homo sapiens
ccgcggccccctcccacg

SEQ ID NO: 32637 - DNA, 22 bp, Homo sapiens
ccgcggcctccccggcgctccg

SEQ ID NO: 32638 - DNA, 20 bp, Homo sapiens
cccggccccgccccgtagcc

SEQ ID NO: 32639 - DNA, 24 bp, Homo sapiens
ccgcggcccggcccccgccgcccg

SEQ ID NO: 32640 - DNA, 18 bp, Homo sapiens
gctcccgcccccgggccc

SEQ ID NO: 32641 - DNA, 25 bp, Homo sapiens
ccatggccccgctttcggaggcccg

SEQ ID NO: 32642 - DNA, 21 bp, Homo sapiens
cggccccgcccgcgccgcccg

SEQ ID NO: 32643 - DNA, 25 bp, Homo sapiens
ccgcggcccagctttccttcatgcc

SEQ ID NO: 32644 - DNA, 21 bp, Homo sapiens
ggcctggcctcccctcagccc

SEQ ID NO: 32645 - DNA, 22 bp, Homo sapiens
gcggccccgctccccgcgctcg

SEQ ID NO: 32646 - DNA, 20 bp, Homo sapiens
ccgccggctccgctcccgcc

SEQ ID NO: 32647 - DNA, 18 bp, Homo sapiens
cccgggccccccacgccc

SEQ ID NO: 32648 - DNA, 17 bp, Homo sapiens
cgggccgcttcacgccc

SEQ ID NO: 32649 - DNA, 22 bp, Homo sapiens
ccgcggcccccgttccccatcg

SEQ ID NO: 32650 - DNA, 18 bp, Homo sapiens
gcggtccccacccacgcc

SEQ ID NO: 32651 - DNA, 20 bp, Homo sapiens
ccgcggcccctcccctgcgc

SEQ ID NO: 32652 - DNA, 18 bp, Homo sapiens
ccccggccccgccccgcc

SEQ ID NO: 32653 - DNA, 19 bp, Homo sapiens
cgcggcccccctccgcagc

SEQ ID NO: 32654 - DNA, 30 bp, Homo sapiens
ccacgcccccgccccgctcctcgcgcccgc

SEQ ID NO: 32655 - DNA, 24 bp, Homo sapiens
cgcagccgccgccctccacgcccg

SEQ ID NO: 32656 - DNA, 20 bp, Homo sapiens
cgaggccccgccccttcacg

SEQ ID NO: 32657 - DNA, 18 bp, Homo sapiens
ccgggccccgcccctgcc

SEQ ID NO: 32658 - DNA, 22 bp, Homo sapiens
ccgcggcgtcgcccttgacagc

SEQ ID NO: 32659 - DNA, 23 bp, Homo sapiens
cgcggccccgcctccgccgctcg

SEQ ID NO: 32660 - DNA, 16 bp, Homo sapiens
cggccgccccacgccc

SEQ ID NO: 32661 - DNA, 18 bp, Homo sapiens
ccgcgccccgccccgccc

SEQ ID NO: 32662 - DNA, 21 bp, Homo sapiens
cgtggccccgcatcctgcgcc

SEQ ID NO: 32663 - DNA, 21 bp, Homo sapiens
ccgccgcctcgtcctcaagcc

SEQ ID NO: 32664 - DNA, 17 bp, Homo sapiens
cgcggccccagcccacg

SEQ ID NO: 32665 - DNA, 60 bp, Human herpesvirus 1
gcccctcgccccctcccgcccctcgccccctcccgcccctcgccccctcccgcccctcgc

SEQ ID NO: 32666 - DNA, 23 bp, Human herpesvirus 1
cctcgccccctcccgcccctcgc

SEQ ID NO: 32667 - DNA, 18 bp, Homo sapiens
cctcgcgctcgcccctcg

SEQ ID NO: 32668 - DNA, 20 bp, Homo sapiens
cctcgtgcctgccttctcgc

SEQ ID NO: 32669 - DNA, 17 bp, Homo sapiens
cccgccgccgcctctcg

SEQ ID NO: 32670 - DNA, 24 bp, Homo sapiens
ctcccccctccccccacccctcgc

SEQ ID NO: 32671 - DNA, 25 bp, Homo sapiens
ctcgcaccagaggccccgctcttcg

SEQ ID NO: 32672 - DNA, 23 bp, Homo sapiens
cctcgcgctcttctgcccctcgc

SEQ ID NO: 32673 - DNA, 20 bp, Homo sapiens
ctgcgccccccggcccctcg

SEQ ID NO: 32674 - DNA, 23 bp, Homo sapiens
cctgcgggcctcccgctccttgc

SEQ ID NO: 32675 - DNA, 23 bp, Homo sapiens
cctgcccccccgctgcttctcgc

SEQ ID NO: 32676 - DNA, 17 bp, Homo sapiens
cctgcccttccacccct

SEQ ID NO: 32677 - DNA, 18 bp, Homo sapiens
cctccgcctcctcctgcc

SEQ ID NO: 32678 - DNA, 21 bp, Homo sapiens
ctcgccgctccctgcccctcg

SEQ ID NO: 32679 - DNA, 18 bp, Homo sapiens
cctcccggccgcccctcg

SEQ ID NO: 32680 - DNA, 20 bp, Homo sapiens
ctcgcccctttcctccccct

SEQ ID NO: 32681 - DNA, 23 bp, Homo sapiens
cctctccggctcccgcctctcgc

SEQ ID NO: 32682 - DNA, 23 bp, Homo sapiens
cctgccccctcctctagattcgc

SEQ ID NO: 32683 - DNA, 17 bp, Homo sapiens
cgcgctccggcccctcg

SEQ ID NO: 32684 - DNA, 18 bp, Homo sapiens
cctgcctcgaacccctcg

SEQ ID NO: 32685 - DNA, 20 bp, Homo sapiens
ccttcgcctcccactctcgc

SEQ ID NO: 32686 - DNA, 20 bp, Homo sapiens
cctcgccctcactgcctcgc

SEQ ID NO: 32687 - DNA, 16 bp, Homo sapiens
cctgcctcctcccccc

SEQ ID NO: 32688 - DNA, 18 bp, Homo sapiens
ccttaccccctccccacg

SEQ ID NO: 32689 - DNA, 24 bp, Homo sapiens
cctcgcccccgccggccgcttcgc

SEQ ID NO: 32690 - DNA, 21 bp, Homo sapiens
ccgccctgccctgcccctcgc

SEQ ID NO: 32691 - DNA, 20 bp, Homo sapiens
ccttgcgctcgcctccttgc

SEQ ID NO: 32692 - DNA, 18 bp, Homo sapiens
cctccgccctctcccagc

SEQ ID NO: 32693 - DNA, 23 bp, Homo sapiens
ccatgcccccaagcccccctcgc

SEQ ID NO: 32694 - DNA, 18 bp, Homo sapiens
ccttccccctccttctcg

SEQ ID NO: 32695 - DNA, 20 bp, Homo sapiens
ccttgtcctccccgcccctc

SEQ ID NO: 32696 - DNA, 27 bp, Homo sapiens
ctctgtcccctccccgggccccctcgc

SEQ ID NO: 32697 - DNA, 18 bp, Homo sapiens
cctcctcccctcccgccc

SEQ ID NO: 32698 - DNA, 18 bp, Homo sapiens
cctctccccctccccctg

SEQ ID NO: 32699 - DNA, 18 bp, Homo sapiens
ccccgccccccccttcgc

SEQ ID NO: 32700 - DNA, 21 bp, Homo sapiens
cctgtccttccctgcccctcg

SEQ ID NO: 32701 - DNA, 22 bp, Homo sapiens
ccccgcccgcctccgtccttcg

SEQ ID NO: 32702 - DNA, 23 bp, Homo sapiens
cctcctccgcccccgcccttcgc

SEQ ID NO: 32703 - DNA, 17 bp, Homo sapiens
ctcgccccgctccctcg

SEQ ID NO: 32704 - DNA, 25 bp, Homo sapiens
cctcgccatctgccccgcccctcgc

SEQ ID NO: 32705 - DNA, 17 bp, Homo sapiens
cccgccccctctgctcg

SEQ ID NO: 32706 - DNA, 18 bp, Homo sapiens
tcgccctcggcccctcgc

SEQ ID NO: 32707 - DNA, 23 bp, Homo sapiens
ccgcgcccccccgagcccctcgc

SEQ ID NO: 32708 - DNA, 24 bp, Homo sapiens
ctcaccccttcctggtctccttgc

SEQ ID NO: 32709 - DNA, 22 bp, Homo sapiens
ccttcgcccacttgcccctcgc

SEQ ID NO: 32710 - DNA, 20 bp, Homo sapiens
ctgcgctcccctcccctcgc

SEQ ID NO: 32711 - DNA, 18 bp, Homo sapiens
cctcgccctctccttccc

SEQ ID NO: 32712 - DNA, 21 bp, Homo sapiens
gcacccctcccatttccctcg

SEQ ID NO: 32713 - DNA, 18 bp, Homo sapiens
cctcccctctccgctcct

SEQ ID NO: 32714 - DNA, 17 bp, Homo sapiens
cctttccccctcccctc

SEQ ID NO: 32715 - DNA, 20 bp, Homo sapiens
tcaccccctctcgacattcg

SEQ ID NO: 32716 - DNA, 18 bp, Homo sapiens
cctcgccctcccccatcg

SEQ ID NO: 32717 - DNA, 18 bp, Homo sapiens
cctcttcccctcccccgc

SEQ ID NO: 32718 - DNA, 20 bp, Homo sapiens
cctcgccccgcccccttcgc

SEQ ID NO: 32719 - DNA, 20 bp, Homo sapiens
cctcgtcctcttcgcccctc

SEQ ID NO: 32720 - DNA, 19 bp, Homo sapiens
gccccctcgtcctcttcgc

SEQ ID NO: 32721 - DNA, 20 bp, Homo sapiens
ccccgcccctgtcctcctcg

SEQ ID NO: 32722 - DNA, 21 bp, Homo sapiens
cctccctccctccttccttgc

SEQ ID NO: 32723 - DNA, 18 bp, Homo sapiens
cctcgccctccccagcgc

SEQ ID NO: 32724 - DNA, 21 bp, Homo sapiens
cctcgcacccctcctgcctcg

SEQ ID NO: 32725 - DNA, 22 bp, Homo sapiens
cctcgcctcccctccccctcgc

SEQ ID NO: 32726 - DNA, 17 bp, Homo sapiens
cctcgccctcgccctcg

SEQ ID NO: 32727 - DNA, 19 bp, Homo sapiens
ctcgccccttctcggccgc

SEQ ID NO: 32728 - DNA, 17 bp, Homo sapiens
cctcgcgccctcccccc

SEQ ID NO: 32729 - DNA, 18 bp, Homo sapiens
cctcgccctcgcccggcg

SEQ ID NO: 32730 - DNA, 20 bp, Homo sapiens
cctcaccctggcctcctcgc

SEQ ID NO: 32731 - DNA, 22 bp, Homo sapiens
ccccctcaccggccgcccctcg

SEQ ID NO: 32732 - DNA, 20 bp, Homo sapiens
cctcctctccccgcccttgc

SEQ ID NO: 32733 - DNA, 22 bp, Homo sapiens
cctcgccaccctccgcggtcgc

SEQ ID NO: 32734 - DNA, 18 bp, Homo sapiens
ctggccccctcccatctc

SEQ ID NO: 32735 - DNA, 20 bp, Homo sapiens
tcgctccccccgcccttcgc

SEQ ID NO: 32736 - DNA, 23 bp, Homo sapiens
cctttccccctttctggccttcg

SEQ ID NO: 32737 - DNA, 18 bp, Homo sapiens
cctcttccttgcccctcg

SEQ ID NO: 32738 - DNA, 20 bp, Homo sapiens
cctcgccccctcgctttcgc

SEQ ID NO: 32739 - DNA, 22 bp, Homo sapiens
cctgcttccctgactccctcgc

SEQ ID NO: 32740 - DNA, 22 bp, Homo sapiens
cctcctttcctccgccccttgc

SEQ ID NO: 32741 - DNA, 20 bp, Homo sapiens
cctcgccccggcactcctcg

SEQ ID NO: 32742 - DNA, 29 bp, Homo sapiens
cctccctctctccctttctccccctcgcg

SEQ ID NO: 32743 - DNA, 19 bp, Homo sapiens
cccgccccctccccggcgc

SEQ ID NO: 32744 - DNA, 19 bp, Homo sapiens
cctgcgtccgcgcccctcg

SEQ ID NO: 32745 - DNA, 24 bp, Homo sapiens
cctcgccctcgtcatcctcctcgc

SEQ ID NO: 32746 - DNA, 17 bp, Homo sapiens
cctcggccccacccctg

SEQ ID NO: 32747 - DNA, 17 bp, Homo sapiens
tctcccctcgccctcgc

SEQ ID NO: 32748 - DNA, 15 bp, Homo sapiens
cctcgctcccgcccc

SEQ ID NO: 32749 - DNA, 19 bp, Homo sapiens
cctcgcctcctctccctcc

SEQ ID NO: 32750 - DNA, 22 bp, Homo sapiens
ccgcgctcgggccgcccctcgc

SEQ ID NO: 32751 - DNA, 22 bp, Homo sapiens
ccccggcgactcccgcccctcg

SEQ ID NO: 32752 - DNA, 19 bp, Homo sapiens
ccgcgccccctcccgcccc

SEQ ID NO: 32753 - DNA, 18 bp, Homo sapiens
cctcgcccccgccccccg

SEQ ID NO: 32754 - DNA, 17 bp, Homo sapiens
cccgccctcggccctcg

SEQ ID NO: 32755 - DNA, 23 bp, Homo sapiens
cctcgcccctcctgcctccttgc

SEQ ID NO: 32756 - DNA, 18 bp, Homo sapiens
ccttgccccctcaccctg

SEQ ID NO: 32757 - DNA, 19 bp, Homo sapiens
ccgcccccctcctcctcgc

SEQ ID NO: 32758 - DNA, 21 bp, Homo sapiens
ccccgccttctccccgcccct

SEQ ID NO: 32759 - DNA, 17 bp, Homo sapiens
cctcgcccccccactcg

SEQ ID NO: 32760 - DNA, 18 bp, Homo sapiens
ctcgcccccttctcccgc

SEQ ID NO: 32761 - DNA, 21 bp, Homo sapiens
cctcggccttctcttcctcgc

SEQ ID NO: 32762 - DNA, 21 bp, Homo sapiens
cccgccttccccgccccttgc

SEQ ID NO: 32763 - DNA, 18 bp, Homo sapiens
cctgccccctctctccgc

SEQ ID NO: 32764 - DNA, 23 bp, Homo sapiens
ctctgccccctccctgaaagcgc

SEQ ID NO: 32765 - DNA, 17 bp, Homo sapiens
cctgccccgccccctcg

SEQ ID NO: 32766 - DNA, 20 bp, Homo sapiens
ccttgcctcctcccacttcc

SEQ ID NO: 32767 - DNA, 18 bp, Homo sapiens
ctgcgccccctctcatcg

SEQ ID NO: 32768 - DNA, 23 bp, Homo sapiens
ccgcgccccccgggaccccttgc

SEQ ID NO: 32769 - DNA, 20 bp, Homo sapiens
cccgcccttcacagacccct

SEQ ID NO: 32770 - DNA, 21 bp, Homo sapiens
cctcacctcctcccgcctcgc

SEQ ID NO: 32771 - DNA, 21 bp, Homo sapiens
ccgctccctcccgcgggccgc

SEQ ID NO: 32772 - DNA, 25 bp, Homo sapiens
cctccgcccccttccctctcctcgc

SEQ ID NO: 32773 - DNA, 18 bp, Homo sapiens
ccgcgcccctgcccctcg

SEQ ID NO: 32774 - DNA, 24 bp, Homo sapiens
cctccgcccctacgccgcccctcg

SEQ ID NO: 32775 - DNA, 19 bp, Homo sapiens
tcgcctgtcctcccctcgc

SEQ ID NO: 32776 - DNA, 27 bp, Homo sapiens
cctccccctctccctcctctccctcgc

SEQ ID NO: 32777 - DNA, 21 bp, Homo sapiens
ccctgctcggctgcccctcgc

SEQ ID NO: 32778 - DNA, 18 bp, Homo sapiens
ccccgccccagctcctcg

SEQ ID NO: 32779 - DNA, 17 bp, Homo sapiens
cctcgcctcccggactg

SEQ ID NO: 32780 - DNA, 22 bp, Homo sapiens
tctcccctcgggcccccctcgc

SEQ ID NO: 32781 - DNA, 21 bp, Homo sapiens
cctcgcccctgcctacttcgc

SEQ ID NO: 32782 - DNA, 21 bp, Homo sapiens
cctccgctctcgtcccctcgc

SEQ ID NO: 32783 - DNA, 18 bp, Homo sapiens
ccccgccccctcctgagc

SEQ ID NO: 32784 - DNA, 21 bp, Homo sapiens
ccgcgttccgcttgcccctcg

SEQ ID NO: 32785 - DNA, 17 bp, Homo sapiens
cctcgcccagctcctcg

SEQ ID NO: 32786 - DNA, 17 bp, Homo sapiens
ccgcgccccctcctccc

SEQ ID NO: 32787 - DNA, 19 bp, Homo sapiens
tcgccttccctccgcctcg

SEQ ID NO: 32788 - DNA, 20 bp, Homo sapiens
tcaccccctccacttcctcg

SEQ ID NO: 32789 - DNA, 24 bp, Homo sapiens
tcttccctcccaggtctcccttgc

SEQ ID NO: 32790 - DNA, 22 bp, Homo sapiens
cctttcctccccgccccttcgc

SEQ ID NO: 32791 - DNA, 17 bp, Homo sapiens
ctcgccccgcccctcgc

SEQ ID NO: 32792 - DNA, 19 bp, Homo sapiens
gcccctcccccagtcccct

SEQ ID NO: 32793 - DNA, 18 bp, Homo sapiens
cctcgccctcctctccac

SEQ ID NO: 32794 - DNA, 18 bp, Homo sapiens
ccgcgcccccttccctgc

SEQ ID NO: 32795 - DNA, 23 bp, Homo sapiens
ccccgccccctctacctcctcgc

SEQ ID NO: 32796 - DNA, 23 bp, Homo sapiens
ccgcgcccacgcgcgcccctcgc

SEQ ID NO: 32797 - DNA, 21 bp, Homo sapiens
ccgcgctcctcaggcccctcg

SEQ ID NO: 32798 - DNA, 21 bp, Homo sapiens
cctcgccctcttcctccttgc

SEQ ID NO: 32799 - DNA, 20 bp, Homo sapiens
ccccgccctgctcccctcgc

SEQ ID NO: 32800 - DNA, 22 bp, Homo sapiens
cctcgcccccgccgccacctcg

SEQ ID NO: 32801 - DNA, 21 bp, Homo sapiens
cctccccctgaggcccctcgc

SEQ ID NO: 32802 - DNA, 22 bp, Homo sapiens
cctcgtcccctcccggtctcgc

SEQ ID NO: 32803 - DNA, 20 bp, Homo sapiens
ctcttgctccgccccctcgc

SEQ ID NO: 32804 - DNA, 23 bp, Homo sapiens
cctcttcccctccctgggcttct

SEQ ID NO: 32805 - DNA, 21 bp, Homo sapiens
cccgcccccagccctcttcgc

SEQ ID NO: 32806 - DNA, 18 bp, Homo sapiens
cctcgccctccagcagct

SEQ ID NO: 32807 - DNA, 21 bp, Homo sapiens
cctcgccctgcttcggctcgc

SEQ ID NO: 32808 - DNA, 16 bp, Homo sapiens
cctgccccctccctcg

SEQ ID NO: 32809 - DNA, 20 bp, Homo sapiens
ccttccctcttcgtcctcgc

SEQ ID NO: 32810 - DNA, 21 bp, Homo sapiens
ctgcgccccctcggcgccctc

SEQ ID NO: 32811 - DNA, 17 bp, Homo sapiens
cctccctccctccctcg

SEQ ID NO: 32812 - DNA, 24 bp, Homo sapiens
ccacgcccccgccccgctcctcgc

SEQ ID NO: 32813 - DNA, 23 bp, Homo sapiens
cctcctcccgcagccgctcctcg

SEQ ID NO: 32814 - DNA, 17 bp, Homo sapiens
ccgcgcctcctccctcg

SEQ ID NO: 32815 - DNA, 20 bp, Homo sapiens
cctcacccctgccctcttgc

SEQ ID NO: 32816 - DNA, 20 bp, Homo sapiens
ccttgctctctcacccctgc

SEQ ID NO: 32817 - DNA, 20 bp, Homo sapiens
cctctccctggggcccctcg

SEQ ID NO: 32818 - DNA, 21 bp, Homo sapiens
ccccgttccctctcagagcgc

SEQ ID NO: 32819 - DNA, 21 bp, Homo sapiens
ccgcgcccggccgccccttgc

SEQ ID NO: 32820 - DNA, 21 bp, Homo sapiens
cctcgcccgcggctccctcgc

SEQ ID NO: 32821 - DNA, 19 bp, Homo sapiens
cctcaggacctgcccctcg

SEQ ID NO: 32822 - DNA, 17 bp, Homo sapiens
ccgcgccccgcccctcg

SEQ ID NO: 32823 - DNA, 20 bp, Homo sapiens
ccgcttctgcagcccctcgc

SEQ ID NO: 32824 - DNA, 64 bp, Meleagrid herpesvirus 1
gcatatggaacggtactggatgtagaacacttgtgtgtctatatgataacagagcttccaatgc

SEQ ID NO: 32825 - DNA, 24 bp, Meleagrid herpesvirus 1
tatggaacggtactggatgtagaa

SEQ ID NO: 32826 - DNA, 20 bp, Homo sapiens
tatggagcgtggatgtagaa

SEQ ID NO: 32827 - DNA, 20 bp, Homo sapiens
atggaatgcaagaggtgtag

SEQ ID NO: 32828 - DNA, 22 bp, Homo sapiens
tgggatggggctagatatggaa

SEQ ID NO: 32829 - DNA, 20 bp, Homo sapiens
tatgggagctgaagatgtag

SEQ ID NO: 32830 - DNA, 21 bp, Homo sapiens
tggggtgccaaggatgtagaa

SEQ ID NO: 32831 - DNA, 22 bp, Homo sapiens
tgtgtataaactggatgtagaa

SEQ ID NO: 32832 - DNA, 18 bp, Homo sapiens
ggaacactgggatgtaga

SEQ ID NO: 32833 - DNA, 19 bp, Homo sapiens
cggggtgccctgatgtaga

SEQ ID NO: 32834 - DNA, 17 bp, Homo sapiens
ggagcggtactgtcaga

SEQ ID NO: 32835 - DNA, 95 bp, Paramecium bursaria Chlorella virus 1
ttcggcatttacttctaatataaggacgttaaatactccaaatgcatttatttggaatacgagcgtaccgagtagcggacttttagatgcgagaa

SEQ ID NO: 32836 - DNA, 24 bp, Paramecium bursaria Chlorella virus 1
tctaatataaggacgttaaatact

SEQ ID NO: 32837 - DNA, 22 bp, Homo sapiens
tctaagataaaaacattaaata

SEQ ID NO: 32838 - DNA, 17 bp, Homo sapiens
cctgatataaggagtca

SEQ ID NO: 32839 - DNA, 117 bp, Melanoplus sanguinipes entomopoxvirus
tagaaatatatttttgttcaggtatatcaacaaatgtatatgatggaaaatatatatttaaaaaaatatttataccatcatataatatagttaaatgctttttattaatattttcta

SEQ ID NO: 32840 - DNA, 24 bp, Melanoplus sanguinipes entomopoxvirus
ttcaggtatatcaacaaatgtata

SEQ ID NO: 32841 - DNA, 18 bp, Homo sapiens
ttcaagtatattaatgta

SEQ ID NO: 32842 - DNA, 19 bp, Homo sapiens
agttaccaacaaatgtata

SEQ ID NO: 32843 - DNA, 16 bp, Homo sapiens
aggtagacaaatgtat

SEQ ID NO: 32844 - DNA, 20 bp, Homo sapiens
ttcaggtaagtcagcatctg

SEQ ID NO: 32845 - DNA, 22 bp, Homo sapiens
ttcaggtataatcaactaacat

SEQ ID NO: 32846 - DNA, 17 bp, Homo sapiens
ttcaggtatgtctgtat

SEQ ID NO: 32847 - DNA, 19 bp, Homo sapiens
ttcaggtatggtcaacaaa

SEQ ID NO: 32848 - DNA, 19 bp, Homo sapiens
ttcaggtaatcagcaaata

SEQ ID NO: 32849 - DNA, 20 bp, Homo sapiens
ttcaggtaatcaatttgcat

SEQ ID NO: 32850 - DNA, 61 bp, Human papillomavirus type 17
gttgggaagtgcatgttaatgaggacactatctttgctcctgttactagctcttcgccggc

SEQ ID NO: 32851 - DNA, 24 bp, Human papillomavirus type 17
ctcctgttactagctcttcgccgg

SEQ ID NO: 32852 - DNA, 19 bp, Homo sapiens
tcctgttactgttccccag

SEQ ID NO: 32853 - DNA, 22 bp, Homo sapiens
ctcctggtgctgtcctcgccgg

SEQ ID NO: 32854 - DNA, 16 bp, Homo sapiens
tcctgttactatcgtg

SEQ ID NO: 32855 - DNA, 25 bp, Homo sapiens
ctcctgttgctaggacgagagctgg

SEQ ID NO: 32856 - DNA, 19 bp, Homo sapiens
ctcctgctgctgtttgccg

SEQ ID NO: 32857 - DNA, 19 bp, Homo sapiens
ctcctgctgctgttcgccg

SEQ ID NO: 32858 - DNA, 19 bp, Homo sapiens
tcttggtactggctctcca

SEQ ID NO: 32859 - DNA, 21 bp, Homo sapiens
ctcctgttggctggttcctgg

SEQ ID NO: 32860 - DNA, 112 bp, Melanoplus sanguinipes entomopoxvirus
catatggtattttatcggtatataaatctaataaactatgtgtattttttacagcatttgccataggaaaatcatatataattatttcttccattgttaaaatatctatatg

SEQ ID NO: 32861 - DNA, 24 bp, Melanoplus sanguinipes entomopoxvirus
tattttatcggtatataaatctaa

SEQ ID NO: 32862 - DNA, 27 bp, Homo sapiens
tattttacattgcagtatataaatcta

SEQ ID NO: 32863 - DNA, 23 bp, Homo sapiens
tattttactggtaacaaatctaa

SEQ ID NO: 32864 - DNA, 24 bp, Homo sapiens
tattttatctggttaccagtctaa

SEQ ID NO: 32865 - DNA, 62 bp, Melanoplus sanguinipes entomopoxvirus
tataaaatcgtaatactagtatatcataatgagattttaattctggtgttaatatttttata

SEQ ID NO: 32866 - DNA, 23 bp, Melanoplus sanguinipes entomopoxvirus
attctggtgttaatatttttata

SEQ ID NO: 32867 - DNA, 25 bp, Homo sapiens
attctgattttaaaaatatttttat

SEQ ID NO: 32868 - DNA, 18 bp, Homo sapiens
ttctggggctatttttat

SEQ ID NO: 32869 - DNA, 21 bp, Homo sapiens
attctgataaaatatttttat

SEQ ID NO: 32870 - DNA, 18 bp, Homo sapiens
ctctggtgttcttttata

SEQ ID NO: 32871 - DNA, 23 bp, Homo sapiens
tctgacatgataatatttttata

SEQ ID NO: 32872 - DNA, 16 bp, Homo sapiens
tggtgttagtcctcat

SEQ ID NO: 32873 - DNA, 19 bp, Homo sapiens
tgattttaatatttttata

SEQ ID NO: 32874 - DNA, 21 bp, Homo sapiens
attctggaaaactatttttat

SEQ ID NO: 32875 - DNA, 80 bp, Melanoplus sanguinipes entomopoxvirus
aaatggtaatggatcactaaaatataataatttaaaatattcatttccaattattttaaaaggtgattcgtttattattt

SEQ ID NO: 32876 - DNA, 24 bp, Melanoplus sanguinipes entomopoxvirus
taatggatcactaaaatataataa

SEQ ID NO: 32877 - DNA, 21 bp, Homo sapiens
tggatcactaaaatataacaa

SEQ ID NO: 32878 - DNA, 23 bp, Homo sapiens
tagttcatactaaaatataataa

SEQ ID NO: 32879 - DNA, 22 bp, Homo sapiens
taatagaaccaaaaatataata

SEQ ID NO: 32880 - DNA, 63 bp, Fowl adenovirus A
gccgcgcctgactagagtacacactataaattccattccggtgacttactactaggcgctggc

SEQ ID NO: 32881 - DNA, 17 bp, Fowl adenovirus A
tactactaggcgctggc

SEQ ID NO: 32882 - DNA, 18 bp, Homo sapiens
cactactagagacaaggc

SEQ ID NO: 32883 - DNA, 19 bp, Homo sapiens
tactactagatcagctggc

SEQ ID NO: 32884 - DNA, 20 bp, Homo sapiens
tactactaacaatgcttggc

SEQ ID NO: 32885 - DNA, 18 bp, Homo sapiens
tacactagcacccttggc

SEQ ID NO: 32886 - DNA, 65 bp, Human herpesvirus 7
cagtcttttgtccaatagtgtcgaataagcgttctatttctagtagtgctattggaaaaagactg

SEQ ID NO: 32887 - DNA, 24 bp, Human herpesvirus 7
tcttttgtccaatagtgtcgaata

SEQ ID NO: 32888 - DNA, 23 bp, Homo sapiens
tctttgtccaatatctacgaata

SEQ ID NO: 32889 - DNA, 22 bp, Homo sapiens
tcttttatctagttctctgaat

SEQ ID NO: 32890 - DNA, 17 bp, Homo sapiens
cttttgtccagtgttaa

SEQ ID NO: 32891 - DNA, 22 bp, Homo sapiens
tctttttgtccagtaccgaata

SEQ ID NO: 32892 - DNA, 24 bp, Homo sapiens
tcttttgcctaataaaaaagaata

SEQ ID NO: 32893 - DNA, 19 bp, Homo sapiens
tcttttgttcaaatgccaa

SEQ ID NO: 32894 - DNA, 17 bp, Homo sapiens
tcttttgttagtgatca

SEQ ID NO: 32895 - DNA, 16 bp, Homo sapiens
ttttgtacagtgccga

SEQ ID NO: 32896 - DNA, 23 bp, Homo sapiens
tctttgtccaattcccttgaata

SEQ ID NO: 32897 - DNA, 18 bp, Homo sapiens
ccttttgtccagtggtga

SEQ ID NO: 32898 - DNA, 19 bp, Homo sapiens
tcttttatccagtgaaaat

SEQ ID NO: 32899 - DNA, 15 bp, Homo sapiens
ttctgtccagtggaa

SEQ ID NO: 32900 - DNA, 18 bp, Homo sapiens
tcttttgcccagtgttcg

SEQ ID NO: 32901 - DNA, 23 bp, Homo sapiens
tcttttgtctgtggtatgagaat

SEQ ID NO: 32902 - DNA, 96 bp, Fowl adenovirus A
aattcaccacgcccgggagatttcgaaattgctatttccgtgcagttccgcattccgaagtacaatttaaccggttttatgggtgttcggtgtttt

SEQ ID NO: 32903 - DNA, 22 bp, Fowl adenovirus A
ttttatgggtgttcggtgtttt

SEQ ID NO: 32904 - DNA, 19 bp, Homo sapiens
atagtgtgtttggtgtttt

SEQ ID NO: 32905 - DNA, 21 bp, Homo sapiens
ttttaaggctcaaggtgtttt

SEQ ID NO: 32906 - DNA, 20 bp, Homo sapiens
ttttagcaggttggtgtttt

SEQ ID NO: 32907 - DNA, 20 bp, Homo sapiens
ttttatgggtggtttatttt

SEQ ID NO: 32908 - DNA, 20 bp, Homo sapiens
ttttatgggagtagtatttt

SEQ ID NO: 32909 - DNA, 20 bp, Homo sapiens
ttttgtagagacggtgtttt

SEQ ID NO: 32910 - DNA, 21 bp, Homo sapiens
ctttgtgggtgggaatgtttt

SEQ ID NO: 32911 - DNA, 21 bp, Homo sapiens
ttttatgagggtctgtgtttt

SEQ ID NO: 32912 - DNA, 22 bp, Homo sapiens
tcttgtgggttccaagtgtttt

SEQ ID NO: 32913 - DNA, 21 bp, Homo sapiens
ctttttgaagtttggtgtttt

SEQ ID NO: 32914 - DNA, 22 bp, Homo sapiens
ctttgtgggtgttttgtatttt

SEQ ID NO: 32915 - DNA, 82 bp, Fowl adenovirus A
gcggttttcggtctctcctcactcggcagatgacttcggaagagaagctgcagagttcgtctccggagaccggcctcgccgc

SEQ ID NO: 32916 - DNA, 24 bp, Fowl adenovirus A
aagctgcagagttcgtctccggag

SEQ ID NO: 32917 - DNA, 18 bp, Homo sapiens
aaactgcagggtctgggg

SEQ ID NO: 32918 - DNA, 21 bp, Homo sapiens
gctcggcgcgcgtctccggag

SEQ ID NO: 32919 - DNA, 16 bp, Homo sapiens
gctggcaggcctccgg

SEQ ID NO: 32920 - DNA, 22 bp, Homo sapiens
agctgcaggatcgggtccggag

SEQ ID NO: 32921 - DNA, 22 bp, Homo sapiens
aagctgggggtccaggctggag

SEQ ID NO: 32922 - DNA, 19 bp, Homo sapiens
agctgcagagtccgcagag

SEQ ID NO: 32923 - DNA, 21 bp, Homo sapiens
agctgcagagtccagctgggg

SEQ ID NO: 32924 - DNA, 21 bp, Homo sapiens
gctgcagaggggtgtctgggg

SEQ ID NO: 32925 - DNA, 17 bp, Homo sapiens
acttgcagaactctgga

SEQ ID NO: 32926 - DNA, 22 bp, Homo sapiens
gccgcagagagccactctggag

SEQ ID NO: 32927 - DNA, 21 bp, Homo sapiens
aggtgcagagtcagtctgggg

SEQ ID NO: 32928 - DNA, 19 bp, Homo sapiens
aagctgcagacgtttgcgg

SEQ ID NO: 32929 - DNA, 21 bp, Homo sapiens
aagttgcaggggcctctggag

SEQ ID NO: 32930 - DNA, 18 bp, Homo sapiens
agctgtgctgtttctgga

SEQ ID NO: 32931 - DNA, 18 bp, Homo sapiens
aagctgcacaggctccgg

SEQ ID NO: 32932 - DNA, 20 bp, Homo sapiens
aagctgcagagttttaccag

SEQ ID NO: 32933 - DNA, 22 bp, Homo sapiens
aagctgcagggtcagccctggg

SEQ ID NO: 32934 - DNA, 22 bp, Homo sapiens
aagttcagagaaagatctggag

SEQ ID NO: 32935 - DNA, 23 bp, Homo sapiens
aagcgcagggtttctgattggag

SEQ ID NO: 32936 - DNA, 19 bp, Homo sapiens
tgcagaagcagctccggag

SEQ ID NO: 32937 - DNA, 18 bp, Homo sapiens
agctgcagagttgaggga

SEQ ID NO: 32938 - DNA, 21 bp, Homo sapiens
gctgctgaaaacgctccggag

SEQ ID NO: 32939 - DNA, 17 bp, Homo sapiens
aagctgcagggtgccgg

SEQ ID NO: 32940 - DNA, 19 bp, Homo sapiens
aagttgcagagtttcgtct

SEQ ID NO: 32941 - DNA, 18 bp, Homo sapiens
agctgcagagtcgaagga

SEQ ID NO: 32942 - DNA, 19 bp, Homo sapiens
gctgcaaagtatcttggag

SEQ ID NO: 32943 - DNA, 25 bp, Homo sapiens
aagttgcagcgtgaggcttttggag

SEQ ID NO: 32944 - DNA, 20 bp, Homo sapiens
agctgcagccgtttccggag

SEQ ID NO: 32945 - DNA, 23 bp, Homo sapiens
agctgcgtgcgagagctccggag

SEQ ID NO: 32946 - DNA, 22 bp, Homo sapiens
gctccaggactcatctctggag

SEQ ID NO: 32947 - DNA, 23 bp, Homo sapiens
aagctcagaatgcttttccggag

SEQ ID NO: 32948 - DNA, 19 bp, Homo sapiens
agctgcagggtcgctgggg

SEQ ID NO: 32949 - DNA, 18 bp, Homo sapiens
cagaggcctcctttggag

SEQ ID NO: 32950 - DNA, 22 bp, Homo sapiens
agctgcagggtccctatcccgg

SEQ ID NO: 32951 - DNA, 17 bp, Homo sapiens
aagctgcaggtctgggg

SEQ ID NO: 32952 - DNA, 22 bp, Homo sapiens
aagctgccaggccactctggag

SEQ ID NO: 32953 - DNA, 21 bp, Homo sapiens
agctgcagggttgtagactgg

SEQ ID NO: 32954 - DNA, 18 bp, Homo sapiens
aagctgcaaagtgctgga

SEQ ID NO: 32955 - DNA, 21 bp, Homo sapiens
gcgcagagtcccaatctgggg

SEQ ID NO: 32956 - DNA, 18 bp, Homo sapiens
ctgcagagccttctgggg

SEQ ID NO: 32957 - DNA, 16 bp, Homo sapiens
aagctcaggtctctgg

SEQ ID NO: 32958 - DNA, 67 bp, Gallid herpesvirus 3
gcgctggtccccatccgcccgattaacccctgcatttacgcccctgtaaggagcggatcgccagtgc

SEQ ID NO: 32959 - DNA, 24 bp, Gallid herpesvirus 3
tccccatccgcccgattaacccct

SEQ ID NO: 32960 - DNA, 22 bp, Homo sapiens
ccatccgccctgcagcgcccct

SEQ ID NO: 32961 - DNA, 16 bp, Homo sapiens
cccccatccattaacc

SEQ ID NO: 32962 - DNA, 22 bp, Homo sapiens
tccccatctctactcaaattcc

SEQ ID NO: 32963 - DNA, 19 bp, Homo sapiens
tcctcacccgcccccgcct

SEQ ID NO: 32964 - DNA, 22 bp, Homo sapiens
cccatctgatgtgttaacccct

SEQ ID NO: 32965 - DNA, 22 bp, Homo sapiens
tctccatccacagaaggcctct

SEQ ID NO: 32966 - DNA, 18 bp, Homo sapiens
tccccatctggccaaatt

SEQ ID NO: 32967 - DNA, 18 bp, Homo sapiens
tcctcctccgcccgctcc

SEQ ID NO: 32968 - DNA, 22 bp, Homo sapiens
tccccatctccccagtttccct

SEQ ID NO: 32969 - DNA, 23 bp, Homo sapiens
tccccattctttgcttccagatt

SEQ ID NO: 32970 - DNA, 19 bp, Homo sapiens
tccccatcagcctagcccc

SEQ ID NO: 32971 - DNA, 26 bp, Homo sapiens
tccccatccccccagcccaggcccct

SEQ ID NO: 32972 - DNA, 25 bp, Homo sapiens
tccccatctcccctggacggtccct

SEQ ID NO: 32973 - DNA, 19 bp, Homo sapiens
tccccatcgctatagcccc

SEQ ID NO: 32974 - DNA, 18 bp, Homo sapiens
tctccatccgcttcccct

SEQ ID NO: 32975 - DNA, 20 bp, Homo sapiens
cccatccgtactcagcctct

SEQ ID NO: 32976 - DNA, 18 bp, Homo sapiens
ccaccacgcccggttaac

SEQ ID NO: 32977 - DNA, 19 bp, Homo sapiens
tccccattcctccaacccc

SEQ ID NO: 32978 - DNA, 21 bp, Homo sapiens
cccagcctaatgttaacccct

SEQ ID NO: 32979 - DNA, 22 bp, Homo sapiens
tctccgcccgcccgcctcccct

SEQ ID NO: 32980 - DNA, 24 bp, Homo sapiens
tccccatccccttagcaccggcct

SEQ ID NO: 32981 - DNA, 18 bp, Homo sapiens
ccatctgcattaacccct

SEQ ID NO: 32982 - DNA, 26 bp, Homo sapiens
tccccatcctgtcaccaccaacctct

SEQ ID NO: 32983 - DNA, 21 bp, Homo sapiens
tccccatcccccaccaaaccc

SEQ ID NO: 32984 - DNA, 22 bp, Homo sapiens
tcctcctccgcccgggacctct

SEQ ID NO: 32985 - DNA, 21 bp, Homo sapiens
tcctacatcatattaacccct

SEQ ID NO: 32986 - DNA, 21 bp, Homo sapiens
tccccaccgaactgttggcct

SEQ ID NO: 32987 - DNA, 26 bp, Homo sapiens
cccccatctgccccttcagaactcct

SEQ ID NO: 32988 - DNA, 15 bp, Homo sapiens
tcccctcattaaccc

SEQ ID NO: 32989 - DNA, 20 bp, Homo sapiens
tccccatccgacttcaaata

SEQ ID NO: 32990 - DNA, 21 bp, Homo sapiens
cctcgtccgcccggtcgccct

SEQ ID NO: 32991 - DNA, 20 bp, Homo sapiens
cccaacctagattaacctct

SEQ ID NO: 32992 - DNA, 18 bp, Homo sapiens
cccactgcccaaccgcct

SEQ ID NO: 32993 - DNA, 23 bp, Homo sapiens
tccccatcctcctgggacttcct

SEQ ID NO: 32994 - DNA, 22 bp, Homo sapiens
tccccattcccgaccagcctct

SEQ ID NO: 32995 - DNA, 17 bp, Homo sapiens
tccccacccgcccaccc

SEQ ID NO: 32996 - DNA, 23 bp, Homo sapiens
tccccatccggggattgtagcct

SEQ ID NO: 32997 - DNA, 19 bp, Homo sapiens
tccccatcttcccacttaa

SEQ ID NO: 32998 - DNA, 19 bp, Homo sapiens
cctccgcccgacaccccct

SEQ ID NO: 32999 - DNA, 19 bp, Homo sapiens
catctgttcaacaacccct

SEQ ID NO: 33000 - DNA, 16 bp, Homo sapiens
tccccattcacaaccc

SEQ ID NO: 33001 - DNA, 22 bp, Homo sapiens
tccccatccaccagggatccct

SEQ ID NO: 33002 - DNA, 19 bp, Homo sapiens
tccccacccgcctgtgact

SEQ ID NO: 33003 - DNA, 20 bp, Homo sapiens
tccccatcagcccggtcacc

SEQ ID NO: 33004 - DNA, 19 bp, Homo sapiens
tccccatccttcgattccc

SEQ ID NO: 33005 - DNA, 18 bp, Homo sapiens
tccccatcttctacctcc

SEQ ID NO: 33006 - DNA, 22 bp, Homo sapiens
tccttatccttagacaacccct

SEQ ID NO: 33007 - DNA, 18 bp, Homo sapiens
tccccatccggaataacc

SEQ ID NO: 33008 - DNA, 25 bp, Homo sapiens
tccctgtccgcccacagaaactcct

SEQ ID NO: 33009 - DNA, 21 bp, Homo sapiens
tccccaccgctcttcactcct

SEQ ID NO: 33010 - DNA, 17 bp, Homo sapiens
cctacccgccccccact

SEQ ID NO: 33011 - DNA, 17 bp, Homo sapiens
catcatccgtcaacccc

SEQ ID NO: 33012 - DNA, 62 bp, Blackcurrant reversion virus
tcttaaagcggccatcgttcagtacttgctggcatggtgacatgagtgatgatgctttatga

SEQ ID NO: 33013 - DNA, 24 bp, Blackcurrant reversion virus
tggcatggtgacatgagtgatgat

SEQ ID NO: 33014 - DNA, 20 bp, Homo sapiens
tggtgtggtgagatgataac

SEQ ID NO: 33015 - DNA, 23 bp, Homo sapiens
tggcatggtggtaggcacctgtg

SEQ ID NO: 33016 - DNA, 21 bp, Homo sapiens
tggcatggtggcatgcacctg

SEQ ID NO: 33017 - DNA, 17 bp, Homo sapiens
tggcaggtggcatgagt

SEQ ID NO: 33018 - DNA, 20 bp, Homo sapiens
ggcatggtggcatgagcctg

SEQ ID NO: 33019 - DNA, 19 bp, Homo sapiens
tggcatgggactggctctg

SEQ ID NO: 33020 - DNA, 21 bp, Homo sapiens
gcatggtgataataaaatgat

SEQ ID NO: 33021 - DNA, 20 bp, Homo sapiens
tggcataggtggcatgggca

SEQ ID NO: 33022 - DNA, 15 bp, Homo sapiens
tggtgatggtgatga

SEQ ID NO: 33023 - DNA, 15 bp, Homo sapiens
tggctgggagtgatg

SEQ ID NO: 33024 - DNA, 23 bp, Homo sapiens
tggtgatggtgatgatagcgatg

SEQ ID NO: 33025 - DNA, 20 bp, Homo sapiens
tggtgatggtggtaatgatg

SEQ ID NO: 33026 - DNA, 22 bp, Homo sapiens
ggcatggtggcatgcacctgtg

SEQ ID NO: 33027 - DNA, 21 bp, Homo sapiens
gacattgacatgagtgatgat

SEQ ID NO: 33028 - DNA, 19 bp, Homo sapiens
tggcatggtggcatgtctg

SEQ ID NO: 33029 - DNA, 21 bp, Homo sapiens
tggcatggtggcatgcgcctg

SEQ ID NO: 33030 - DNA, 21 bp, Homo sapiens
tggcatggtggtgggcacctg

SEQ ID NO: 33031 - DNA, 17 bp, Homo sapiens
tggcatggtgaggtgat

SEQ ID NO: 33032 - DNA, 16 bp, Homo sapiens
ggcattgagagtgatg

SEQ ID NO: 33033 - DNA, 76 bp, Blackcurrant reversion virus
gcgtgtaatacgctggtgtctcattatatactagcgttgcagcgctaggactacctaagacaaccgtattatacgt

SEQ ID NO: 33034 - DNA, 24 bp, Blackcurrant reversion virus
tggtgtctcattatatactagcgt

SEQ ID NO: 33035 - DNA, 20 bp, Homo sapiens
tagtgttttgttatatacca

SEQ ID NO: 33036 - DNA, 22 bp, Homo sapiens
tggtgtcttgttcctctagtgt

SEQ ID NO: 33037 - DNA, 67 bp, Human herpesvirus 6B
acagtagttttcacggtatttttgaaattaataaattttaaatcgggtaaatggtaaagcatgctgt

SEQ ID NO: 33038 - DNA, 24 bp, Human herpesvirus 6B
ttaaatcgggtaaatggtaaagca

SEQ ID NO: 33039 - DNA, 20 bp, Homo sapiens
ttaaatcgggtggtcctcgc

SEQ ID NO: 33040 - DNA, 20 bp, Homo sapiens
ttaaatcaggtcctagggta

SEQ ID NO: 33041 - DNA, 20 bp, Homo sapiens
tcagatcttcgatggtaaag

SEQ ID NO: 33042 - DNA, 19 bp, Homo sapiens
ttaaatcggggaggatggt

SEQ ID NO: 33043 - DNA, 130 bp, Rice tungro bacilliform virus
gttataatccataagctttgaaagatctgctagtgtggataccaaaaggctgtcgtggttcgcccagtcgacggatgaggtcataaacgaagcactagtaggtaactaagaggcttagggatgaagcaac

SEQ ID NO: 33044 - DNA, 24 bp, Rice tungro bacilliform virus
aagcactagtaggtaactaagagg

SEQ ID NO: 33045 - DNA, 20 bp, Homo sapiens
agcactagggatacaagagg

SEQ ID NO: 33046 - DNA, 16 bp, Homo sapiens
gcaccagtcctaagag

SEQ ID NO: 33047 - DNA, 21 bp, Homo sapiens
aagcaataggagattgagagg

SEQ ID NO: 33048 - DNA, 19 bp, Homo sapiens
gcactagtgggttgggagg

SEQ ID NO: 33049 - DNA, 22 bp, Homo sapiens
aagcactagggggtcactgagg

SEQ ID NO: 33050 - DNA, 20 bp, Homo sapiens
gcagctagagtgctaagagg

SEQ ID NO: 33051 - DNA, 26 bp, Homo sapiens
gcactagtgggttattttacaagagg

SEQ ID NO: 33052 - DNA, 23 bp, Homo sapiens
acattagtaggtgaaatgtaagg

SEQ ID NO: 33053 - DNA, 25 bp, Homo sapiens
aagcactagtaaaactcttaggagg

SEQ ID NO: 33054 - DNA, 16 bp, Homo sapiens
gcaccagtggcaggag

SEQ ID NO: 33055 - DNA, 23 bp, Homo sapiens
aagactagtaggacttggagagg

SEQ ID NO: 33056 - DNA, 18 bp, Homo sapiens
agcactagcggcgtgagg

SEQ ID NO: 33057 - DNA, 18 bp, Homo sapiens
actgttggccactgagag

SEQ ID NO: 33058 - DNA, 20 bp, Homo sapiens
gcaccagttcttcctaaggg

SEQ ID NO: 33059 - DNA, 20 bp, Homo sapiens
gcaccagtggaagggagagg

SEQ ID NO: 33060 - DNA, 18 bp, Homo sapiens
acaccagtaactaagagg

SEQ ID NO: 33061 - DNA, 15 bp, Homo sapiens
agcacagagctaaga

SEQ ID NO: 33062 - DNA, 22 bp, Homo sapiens
agcgctagtaggcaggcacagg

SEQ ID NO: 33063 - DNA, 20 bp, Homo sapiens
tagtaggtggcgtactgagg

SEQ ID NO: 33064 - DNA, 19 bp, Homo sapiens
ctggcaagggactaagagg

SEQ ID NO: 33065 - DNA, 21 bp, Homo sapiens
gcactggagccagctaagagg

SEQ ID NO: 33066 - DNA, 24 bp, Homo sapiens
agcactagcccagggactgggagg

SEQ ID NO: 33067 - DNA, 66 bp, Frog adenovirus 1
atgatgtgtacttgtggcttaaatttattttacttaattaaattttatcgcagtttaataaatcat

SEQ ID NO: 33068 - DNA, 24 bp, Frog adenovirus 1
tgtgtacttgtggcttaaatttat

SEQ ID NO: 33069 - DNA, 20 bp, Homo sapiens
tgcgtagtgggtttaaattt

SEQ ID NO: 33070 - DNA, 21 bp, Homo sapiens
tgggtaaaacagcttaaattt

SEQ ID NO: 33071 - DNA, 20 bp, Homo sapiens
tgtgtacgtgtggcttaaat

SEQ ID NO: 33072 - DNA, 27 bp, Homo sapiens
tatgtacttggtccctcttagatttat

SEQ ID NO: 33073 - DNA, 63 bp, Meleagrid herpesvirus 1
tcatcccggcgcgcccgacatccctgcgcgatcagctagcgcgcgctcggcgcgccgagatga

SEQ ID NO: 33074 - DNA, 21 bp, Meleagrid herpesvirus 1
gcgctcggcgcgccgagatga

SEQ ID NO: 33075 - DNA, 18 bp, Homo sapiens
gcgctcggccgcgcccga

SEQ ID NO: 33076 - DNA, 16 bp, Homo sapiens
cgctcggcggaggatg

SEQ ID NO: 33077 - DNA, 18 bp, Homo sapiens
gctgctcggtgcgcgccg

SEQ ID NO: 33078 - DNA, 19 bp, Homo sapiens
gcgtcggcgcgccctctga

SEQ ID NO: 33079 - DNA, 18 bp, Homo sapiens
gcgctcggggcgctcaga

SEQ ID NO: 33080 - DNA, 22 bp, Homo sapiens
gcgcctttggggtgccgggatg

SEQ ID NO: 33081 - DNA, 16 bp, Homo sapiens
gcgctcggcggcccga

SEQ ID NO: 33082 - DNA, 17 bp, Homo sapiens
gcctcagggccgagatg

SEQ ID NO: 33083 - DNA, 16 bp, Homo sapiens
gccctcggcgcgcatg

SEQ ID NO: 33084 - DNA, 18 bp, Homo sapiens
gcgctcagcagaaaggtg

SEQ ID NO: 33085 - DNA, 18 bp, Homo sapiens
gccttggcacagcagatg

SEQ ID NO: 33086 - DNA, 15 bp, Homo sapiens
ctcggccagagatga

SEQ ID NO: 33087 - DNA, 21 bp, Homo sapiens
gcactttaggaggccgaggtg

SEQ ID NO: 33088 - DNA, 17 bp, Homo sapiens
gcactcccaccgagatg

SEQ ID NO: 33089 - DNA, 21 bp, Homo sapiens
gcactttaggaagccgaggtg

SEQ ID NO: 33090 - DNA, 21 bp, Homo sapiens
gcactttcggaggctgaggtg

SEQ ID NO: 33091 - DNA, 19 bp, Homo sapiens
gcgctcggcgctcgggctg

SEQ ID NO: 33092 - DNA, 19 bp, Homo sapiens
gcgcccggcgcgcgctctg

SEQ ID NO: 33093 - DNA, 21 bp, Homo sapiens
cgtccaccagcgccgagatga

SEQ ID NO: 33094 - DNA, 16 bp, Homo sapiens
gcgcacggcggcgatg

SEQ ID NO: 33095 - DNA, 15 bp, Homo sapiens
gcgcccggccggatg

SEQ ID NO: 33096 - DNA, 18 bp, Homo sapiens
gccttcggcgcgaaggtg

SEQ ID NO: 33097 - DNA, 21 bp, Homo sapiens
gcgctttgggagaccgaggtg

SEQ ID NO: 33098 - DNA, 17 bp, Homo sapiens
gccctcggcgcgcctga

SEQ ID NO: 33099 - DNA, 21 bp, Homo sapiens
gcacttcgggacgctgaggtg

SEQ ID NO: 33100 - DNA, 18 bp, Homo sapiens
gctccacgggccgaggtg

SEQ ID NO: 33101 - DNA, 21 bp, Homo sapiens
gcactcggtgcggcaaggatg

SEQ ID NO: 33102 - DNA, 20 bp, Homo sapiens
cgctcggcgcgcccagtcga

SEQ ID NO: 33103 - DNA, 21 bp, Homo sapiens
gcactcggggagactgaggtg

SEQ ID NO: 33104 - DNA, 21 bp, Homo sapiens
gcactcggggaggctgaggtg

SEQ ID NO: 33105 - DNA, 21 bp, Homo sapiens
gcgctcggccgccttcccctg

SEQ ID NO: 33106 - DNA, 22 bp, Homo sapiens
gcacttttggaggccgaggtga

SEQ ID NO: 33107 - DNA, 15 bp, Homo sapiens
gcgctcaggccggat

SEQ ID NO: 33108 - DNA, 20 bp, Homo sapiens
gcgcgttggcgaaccaggtg

SEQ ID NO: 33109 - DNA, 19 bp, Homo sapiens
gcgcccaagcgccgaggtg

SEQ ID NO: 33110 - DNA, 20 bp, Homo sapiens
gcgctaggttggcgagatga

SEQ ID NO: 33111 - DNA, 17 bp, Homo sapiens
gctcggcggaccagatg

SEQ ID NO: 33112 - DNA, 18 bp, Homo sapiens
gcgctcggcacgctggga

SEQ ID NO: 33113 - DNA, 19 bp, Homo sapiens
gcctccgaacgccgagatg

SEQ ID NO: 33114 - DNA, 21 bp, Homo sapiens
gcactttaggatgccgaggtg

SEQ ID NO: 33115 - DNA, 71 bp, Strawberry vein banding virus
gcgcacaattgcctgtagtagcgtgaatcccgagagtcaggaggacgttggtagcgaagatcggcatgcgt

SEQ ID NO: 33116 - DNA, 24 bp, Strawberry vein banding virus
agcgtgaatcccgagagtcaggag

SEQ ID NO: 33117 - DNA, 20 bp, Homo sapiens
gtggatcacaaagtcaggag

SEQ ID NO: 33118 - DNA, 21 bp, Homo sapiens
gcgtgaacctgggaggcggag

SEQ ID NO: 33119 - DNA, 22 bp, Homo sapiens
aggtggatcacaaggtcaggag

SEQ ID NO: 33120 - DNA, 20 bp, Homo sapiens
gtggatcatgaggtcaggag

SEQ ID NO: 33121 - DNA, 21 bp, Homo sapiens
gcgtgaacccgggagttggag

SEQ ID NO: 33122 - DNA, 20 bp, Homo sapiens
gtggatcacgaggtcaggag

SEQ ID NO: 33123 - DNA, 21 bp, Homo sapiens
gcgtgaacccgggaggcggag

SEQ ID NO: 33124 - DNA, 23 bp, Homo sapiens
gcagatcacttgagggtcaggag

SEQ ID NO: 33125 - DNA, 22 bp, Homo sapiens
gtggggtcctgggagccaggag

SEQ ID NO: 33126 - DNA, 20 bp, Homo sapiens
gtgggtcacgaggtcaggag

SEQ ID NO: 33127 - DNA, 22 bp, Homo sapiens
aggtggatcacgaggtcaggag

SEQ ID NO: 33128 - DNA, 20 bp, Homo sapiens
gtggatcaccaggtcaggag

SEQ ID NO: 33129 - DNA, 15 bp, Homo sapiens
agctggagagtcagg

SEQ ID NO: 33130 - DNA, 21 bp, Homo sapiens
gcgtgaacccgggaggtggag

SEQ ID NO: 33131 - DNA, 20 bp, Homo sapiens
gtggatcacaaggtcaggag

SEQ ID NO: 33132 - DNA, 18 bp, Homo sapiens
agcgatggagagtcagga

SEQ ID NO: 33133 - DNA, 17 bp, Homo sapiens
gccgaccgagagtcggg

SEQ ID NO: 33134 - DNA, 22 bp, Homo sapiens
gcgtgaaccctgggaaccccgg

SEQ ID NO: 33135 - DNA, 22 bp, Homo sapiens
gtggatcaactgaggtcaggag

SEQ ID NO: 33136 - DNA, 21 bp, Homo sapiens
gcgtgaacccgagaggcggag

SEQ ID NO: 33137 - DNA, 21 bp, Homo sapiens
gtgagtcccgagattgcggag

SEQ ID NO: 33138 - DNA, 20 bp, Homo sapiens
gtggatcatgaagtcaggag

SEQ ID NO: 33139 - DNA, 20 bp, Homo sapiens
gcgtgaacctgggaagcaga

SEQ ID NO: 33140 - DNA, 20 bp, Homo sapiens
gcggatcacagggtcaggag

SEQ ID NO: 33141 - DNA, 19 bp, Homo sapiens
gtgaacccgggaggcggag

SEQ ID NO: 33142 - DNA, 22 bp, Homo sapiens
aggtggatcatgaggtcaggag

SEQ ID NO: 33143 - DNA, 21 bp, Homo sapiens
gcttgagtccttaatcaggag

SEQ ID NO: 33144 - DNA, 24 bp, Homo sapiens
agctgagtcccgactcaccaggag

SEQ ID NO: 33145 - DNA, 23 bp, Homo sapiens
agggtggatcactaggtcaggag

SEQ ID NO: 33146 - DNA, 20 bp, Homo sapiens
gcgtgaacccgggaggcaga

SEQ ID NO: 33147 - DNA, 22 bp, Homo sapiens
gtggatcccctgaggtcaggag

SEQ ID NO: 33148 - DNA, 21 bp, Homo sapiens
agcgagagtcccgaggcccag

SEQ ID NO: 33149 - DNA, 20 bp, Homo sapiens
gcgtgaacctgggaggcaga

SEQ ID NO: 33150 - DNA, 21 bp, Homo sapiens
atgaaccccctgggagttggg

SEQ ID NO: 33151 - DNA, 19 bp, Homo sapiens
agctggaagatgagtcagg

SEQ ID NO: 33152 - DNA, 19 bp, Homo sapiens
atgacttgagggtcaggag

SEQ ID NO: 33153 - DNA, 20 bp, Homo sapiens
gtggatcccgaggtcaggag

SEQ ID NO: 33154 - DNA, 23 bp, Homo sapiens
agggtggatcacgaggtcaggag

SEQ ID NO: 33155 - DNA, 21 bp, Homo sapiens
gcgtgaacctgggagatggag

SEQ ID NO: 33156 - DNA, 24 bp, Homo sapiens
aggtggatcacctggggtcaggag

SEQ ID NO: 33157 - DNA, 19 bp, Homo sapiens
aggtggatctttatcagga

SEQ ID NO: 33158 - DNA, 21 bp, Homo sapiens
gtgaggtaggagagtcaggag

SEQ ID NO: 33159 - DNA, 21 bp, Homo sapiens
agcgtgggttctgaagtcagg

SEQ ID NO: 33160 - DNA, 21 bp, Homo sapiens
gcgtgaatctgggaggcggag

SEQ ID NO: 33161 - DNA, 20 bp, Homo sapiens
gtggatcaggaggtcaggag

SEQ ID NO: 33162 - DNA, 19 bp, Homo sapiens
gctggccggcagagtcagg

SEQ ID NO: 33163 - DNA, 21 bp, Homo sapiens
gcgtgaacctgggaggtggag

SEQ ID NO: 33164 - DNA, 20 bp, Homo sapiens
gtgaatcacgaggtcaggag

SEQ ID NO: 33165 - DNA, 22 bp, Homo sapiens
aggtggatcacttggtcaggag

SEQ ID NO: 33166 - DNA, 22 bp, Homo sapiens
gctgtaccctgggagtcaggag

SEQ ID NO: 33167 - DNA, 21 bp, Homo sapiens
gcgtgaacttgggaggcggag

SEQ ID NO: 33168 - DNA, 19 bp, Homo sapiens
gcgtgaacctcggggcgag

SEQ ID NO: 33169 - DNA, 22 bp, Homo sapiens
aggtggattacgaggtcaggag

SEQ ID NO: 33170 - DNA, 22 bp, Homo sapiens
aggtggatcaccacgtcaggag

SEQ ID NO: 33171 - DNA, 24 bp, Homo sapiens
aggtggatcaactgaggtcaggag

SEQ ID NO: 33172 - DNA, 18 bp, Homo sapiens
gtgaacccgggaggcaga

SEQ ID NO: 33173 - DNA, 21 bp, Homo sapiens
gcgtgaacctgggagccggag

SEQ ID NO: 33174 - DNA, 19 bp, Homo sapiens
gtgaacccggaaggcggag

SEQ ID NO: 33175 - DNA, 22 bp, Homo sapiens
aggtggatcaccaggtcaggag

SEQ ID NO: 33176 - DNA, 22 bp, Homo sapiens
agcgtgaatctcggcagcacag

SEQ ID NO: 33177 - DNA, 21 bp, Homo sapiens
gcgtgaacctggaaggcggag

SEQ ID NO: 33178 - DNA, 22 bp, Homo sapiens
aggtggatcacagggtcaggag

SEQ ID NO: 33179 - DNA, 21 bp, Homo sapiens
agctgtggcctgagagtcagg

SEQ ID NO: 33180 - DNA, 21 bp, Homo sapiens
gtggatcaccaaggtcaggag

SEQ ID NO: 33181 - DNA, 19 bp, Homo sapiens
gtgaacccgggaggtggag

SEQ ID NO: 33182 - DNA, 101 bp, Gallid herpesvirus 2
ttgtttgctcatctcatatttggaaaaccggaacgtcagctcatccgacccgtcactatatgttcaacttcaaagttttctgaaatatgcatggtcgacag

SEQ ID NO: 33183 - DNA, 24 bp, Gallid herpesvirus 2
tggaaaaccggaacgtcagctcat

SEQ ID NO: 33184 - DNA, 20 bp, Homo sapiens
gaactgagatgtcagctcat

SEQ ID NO: 33185 - DNA, 24 bp, Homo sapiens
tggaggctgggcacagcagctcat

SEQ ID NO: 33186 - DNA, 18 bp, Homo sapiens
tggaaaactggcagccac

SEQ ID NO: 33187 - DNA, 21 bp, Homo sapiens
tggaaacatccatcagctcat

SEQ ID NO: 33188 - DNA, 18 bp, Homo sapiens
tggaaaatctgaacatca

SEQ ID NO: 33189 - DNA, 22 bp, Homo sapiens
tggggggtgggggtcagctcat

SEQ ID NO: 33190 - DNA, 18 bp, Homo sapiens
tggaagccgatcagctca

SEQ ID NO: 33191 - DNA, 21 bp, Homo sapiens
ggaggcggaacacacactcat

SEQ ID NO: 33192 - DNA, 62 bp, Gallid herpesvirus 2
acttggttactaaataccctaatggaactgagttctattagtccattcgatagtaatcatgt

SEQ ID NO: 33193 - DNA, 24 bp, Gallid herpesvirus 2
ttagtccattcgatagtaatcatg

SEQ ID NO: 33194 - DNA, 19 bp, Homo sapiens
ttaatccattttcagtcat

SEQ ID NO: 33195 - DNA, 104 bp, Chimpanzee cytomegalovirus
tattatttttgtaccggattcgcttgtcttgtgttcttttcggggtcgggagagttcgacagtttatgagataggacaggaaaagtaaggatataaaagaaata

SEQ ID NO: 33196 - DNA, 24 bp, Chimpanzee cytomegalovirus
tgagataggacaggaaaagtaagg

SEQ ID NO: 33197 - DNA, 19 bp, Homo sapiens
gagattggggaaagtaagg

SEQ ID NO: 33198 - DNA, 24 bp, Homo sapiens
tgaggtggaacaggaggctttagg

SEQ ID NO: 33199 - DNA, 22 bp, Homo sapiens
tgaggcaggtagagaagtaagg

SEQ ID NO: 33200 - DNA, 19 bp, Homo sapiens
gaaaacaggaaaggtgagg

SEQ ID NO: 33201 - DNA, 22 bp, Homo sapiens
tgggacaggatagggagcaggg

SEQ ID NO: 33202 - DNA, 20 bp, Homo sapiens
agatcacaggagaagtaagg

SEQ ID NO: 33203 - DNA, 17 bp, Homo sapiens
cagggaggagaagtaag

SEQ ID NO: 33204 - DNA, 22 bp, Homo sapiens
tggtatagggcagaaagtaagg

SEQ ID NO: 33205 - DNA, 21 bp, Homo sapiens
tgagaggaaggaaaagtgagg

SEQ ID NO: 33206 - DNA, 22 bp, Homo sapiens
tgagagaggacagggagcaggg

SEQ ID NO: 33207 - DNA, 21 bp, Homo sapiens
tgggaaggacagggggctcgg

SEQ ID NO: 33208 - DNA, 23 bp, Homo sapiens
tgagggagcacaaaaaagtgagg

SEQ ID NO: 33209 - DNA, 21 bp, Homo sapiens
tgaggtagggaggggcccagg

SEQ ID NO: 33210 - DNA, 18 bp, Homo sapiens
gatcccagggaagtaagg

SEQ ID NO: 33211 - DNA, 22 bp, Homo sapiens
tgagacaaagagaagggtaagg

SEQ ID NO: 33212 - DNA, 18 bp, Homo sapiens
tgaggtagacaggaagca

SEQ ID NO: 33213 - DNA, 21 bp, Homo sapiens
gagacaagaggaaaggtaagg

SEQ ID NO: 33214 - DNA, 22 bp, Homo sapiens
tgagatgggaagggaagaaagg

SEQ ID NO: 33215 - DNA, 19 bp, Homo sapiens
tgggacggggcaggaaaag

SEQ ID NO: 33216 - DNA, 19 bp, Homo sapiens
tgagataggacaagagaag

SEQ ID NO: 33217 - DNA, 21 bp, Homo sapiens
tgaggaaggacaggggtaggg

SEQ ID NO: 33218 - DNA, 22 bp, Homo sapiens
agacctccagggaaaagtgggg

SEQ ID NO: 33219 - DNA, 18 bp, Homo sapiens
gatagacagaaagtaggg

SEQ ID NO: 33220 - DNA, 22 bp, Homo sapiens
tgagcaaatgggaaaagtaagg

SEQ ID NO: 33221 - DNA, 19 bp, Homo sapiens
tgaggtaggacaggggtag

SEQ ID NO: 33222 - DNA, 24 bp, Homo sapiens
tgggagaggacaggaggtgcaggg

SEQ ID NO: 33223 - DNA, 17 bp, Homo sapiens
gaaaagggaaaagtgag

SEQ ID NO: 33224 - DNA, 23 bp, Homo sapiens
gaggggccccaggaaaagtgagg

SEQ ID NO: 33225 - DNA, 21 bp, Homo sapiens
gaccggacaggaggggtgagg

SEQ ID NO: 33226 - DNA, 22 bp, Homo sapiens
tgaattcggaggaaaagtaggg

SEQ ID NO: 33227 - DNA, 17 bp, Homo sapiens
agatgggagagggtaag

SEQ ID NO: 33228 - DNA, 22 bp, Homo sapiens
gagggccccaggaaaagtgagg

SEQ ID NO: 33229 - DNA, 84 bp, Chimpanzee cytomegalovirus
ttcttcggatacgccgttttactcgccgtcgcttggcaacgcctgaagaaagagcgtgccgcgagcctacggcgctatgaagaa

SEQ ID NO: 33230 - DNA, 24 bp, Chimpanzee cytomegalovirus
acgccgttttactcgccgtcgctt

SEQ ID NO: 33231 - DNA, 19 bp, Homo sapiens
gccgtttctgcctttgctt

SEQ ID NO: 33232 - DNA, 21 bp, Homo sapiens
caccgtgctgcgccgtcgctt

SEQ ID NO: 33233 - DNA, 16 bp, Homo sapiens
ccgtgccgccgtcgct

SEQ ID NO: 33234 - DNA, 18 bp, Homo sapiens
acgccgtttattcgcact

SEQ ID NO: 33235 - DNA, 19 bp, Homo sapiens
gcgacactcgccgtcgctt

SEQ ID NO: 33236 - DNA, 87 bp, Rat cytomegalovirus
ctgatatcataatgaagacattttagagcaccacatcgtctattgacggttgtctcatgaaacgtcgaattgttcgtttgatgtcgg

SEQ ID NO: 33237 - DNA, 24 bp, Rat cytomegalovirus
tatcataatgaagacattttagag

SEQ ID NO: 33238 - DNA, 19 bp, Homo sapiens
tcacaatgaagacaaacag

SEQ ID NO: 33239 - DNA, 23 bp, Homo sapiens
tattataataaagaatcccagag

SEQ ID NO: 33240 - DNA, 20 bp, Homo sapiens
cattgccagagacattttag

SEQ ID NO: 33241 - DNA, 17 bp, Homo sapiens
cataatgaagaatcaga

SEQ ID NO: 33242 - DNA, 22 bp, Homo sapiens
tattataaagaagattccagag

SEQ ID NO: 33243 - DNA, 24 bp, Homo sapiens
tattataaagaagacatccatgag

SEQ ID NO: 33244 - DNA, 19 bp, Homo sapiens
taacacaggcattttagag

SEQ ID NO: 33245 - DNA, 60 bp, Rat cytomegalovirus
tttttacgttgggatgctcgtcgatgtctgtgacataacaattgcagtaaaatgtaggag

SEQ ID NO: 33246 - DNA, 24 bp, Rat cytomegalovirus
tacgttgggatgctcgtcgatgtc

SEQ ID NO: 33247 - DNA, 18 bp, Homo sapiens
gttgggatacctaatgtc

SEQ ID NO: 33248 - DNA, 21 bp, Homo sapiens
ttgggatgttctagccaatgt

SEQ ID NO: 33249 - DNA, 15 bp, Homo sapiens
gttgagatctgatgt

SEQ ID NO: 33250 - DNA, 21 bp, Homo sapiens
gtggtctgtcttgtcgatgtc

SEQ ID NO: 33251 - DNA, 73 bp, Human herpesvirus 4
ctcctgtagcccccagtaaatggatttcagggagggaccgtccttgctgtcattctcttggactaacgaggag

SEQ ID NO: 33252 - DNA, 24 bp, Human herpesvirus 4
taaatggatttcagggagggaccg

SEQ ID NO: 33253 - DNA, 22 bp, Homo sapiens
tggaaagcatttggggagggac

SEQ ID NO: 33254 - DNA, 22 bp, Homo sapiens
aatggagggcagggaggggccg

SEQ ID NO: 33255 - DNA, 18 bp, Homo sapiens
taaattgatttcaggggg

SEQ ID NO: 33256 - DNA, 19 bp, Homo sapiens
taaatgcatttcaggtaag

SEQ ID NO: 33257 - DNA, 19 bp, Homo sapiens
aaatggatttcaggaacca

SEQ ID NO: 33258 - DNA, 19 bp, Homo sapiens
tgggagtcaggggagggac

SEQ ID NO: 33259 - DNA, 17 bp, Homo sapiens
aatggtttcagggaaag

SEQ ID NO: 33260 - DNA, 107 bp, Human herpesvirus 4
gtgggtccattcttaatggtggagagcagcttggaagaggaaattatgccatttcgcaatatgtcccacatcaggttctcagactgccccctggtcatggactccac

SEQ ID NO: 33261 - DNA, 24 bp, Human herpesvirus 4
tatgtcccacatcaggttctcaga

SEQ ID NO: 33262 - DNA, 17 bp, Homo sapiens
tatgtcccacggcacag

SEQ ID NO: 33263 - DNA, 19 bp, Homo sapiens
tgtttcactggttctcaga

SEQ ID NO: 33264 - DNA, 15 bp, Homo sapiens
gtctcaagttctcag

SEQ ID NO: 33265 - DNA, 23 bp, Homo sapiens
tatgtctcacctcactccccaga

SEQ ID NO: 33266 - DNA, 22 bp, Homo sapiens
tgtcttgtacagttttctcaga

SEQ ID NO: 33267 - DNA, 20 bp, Homo sapiens
gtcccacaaactttttcaga

SEQ ID NO: 33268 - DNA, 18 bp, Homo sapiens
tgtctcattcacccccag

SEQ ID NO: 33269 - DNA, 16 bp, Homo sapiens
tatatctcagttctca

SEQ ID NO: 33270 - DNA, 24 bp, Homo sapiens
tatgtctcccatttcatcctcaga

SEQ ID NO: 33271 - DNA, 19 bp, Homo sapiens
tatgtcccacagtcagact

SEQ ID NO: 33272 - DNA, 22 bp, Homo sapiens
tgtctttcatggtattctcaga

SEQ ID NO: 33273 - DNA, 19 bp, Homo sapiens
tatgtcccatgctaaattc

SEQ ID NO: 33274 - DNA, 20 bp, Homo sapiens
tgtctgacctctgttctcag

SEQ ID NO: 33275 - DNA, 21 bp, Homo sapiens
tgtcttttatcagttctcaga

SEQ ID NO: 33276 - DNA, 24 bp, Homo sapiens
tatattttacattcacctctcaga

SEQ ID NO: 33277 - DNA, 21 bp, Homo sapiens
tgttttaaccagatttctcag

SEQ ID NO: 33278 - DNA, 18 bp, Homo sapiens
tatgtatcatatcaggtt

SEQ ID NO: 33279 - DNA, 19 bp, Homo sapiens
tatgtcccaaaggtttcag

SEQ ID NO: 33280 - DNA, 22 bp, Homo sapiens
tgtctcccatgtcatcctcaga

SEQ ID NO: 33281 - DNA, 95 bp, Pea enation mosaic virus-2
gtagaacacgtgggataggggatgaccttgtcgaccgtttgtcggtcccctgctccttagagctggcaaggcgcccattggttctacatttctac

SEQ ID NO: 33282 - DNA, 24 bp, Pea enation mosaic virus-2
tggcaaggcgcccattggttctac

SEQ ID NO: 33283 - DNA, 22 bp, Homo sapiens
tggcaaggcttgagctgttcta

SEQ ID NO: 33284 - DNA, 21 bp, Homo sapiens
tggtaggtttatttggttcta

SEQ ID NO: 33285 - DNA, 19 bp, Homo sapiens
tggtgagtgccctggctct

SEQ ID NO: 33286 - DNA, 15 bp, Homo sapiens
tggcaggcgccctct

SEQ ID NO: 33287 - DNA, 19 bp, Homo sapiens
tggtggggcactcggctcc

SEQ ID NO: 33288 - DNA, 19 bp, Homo sapiens
tggtgaggtggctggttct

SEQ ID NO: 33289 - DNA, 19 bp, Homo sapiens
tggcaaggtgttgtgttct

SEQ ID NO: 33290 - DNA, 21 bp, Homo sapiens
tggttagcatacattggttct

SEQ ID NO: 33291 - DNA, 17 bp, Homo sapiens
tggcaagggcctgggct

SEQ ID NO: 33292 - DNA, 22 bp, Homo sapiens
tagcaaggtgcctatcccagct

SEQ ID NO: 33293 - DNA, 18 bp, Homo sapiens
tggcaagggcctgaggcc

SEQ ID NO: 33294 - DNA, 22 bp, Homo sapiens
ggcaaggcgccctaagttctac

SEQ ID NO: 33295 - DNA, 17 bp, Homo sapiens
tggcaaggagcccatgg

SEQ ID NO: 33296 - DNA, 19 bp, Homo sapiens
tggaggctttattggttct

SEQ ID NO: 33297 - DNA, 20 bp, Homo sapiens
tggcaaggcactgaatttct

SEQ ID NO: 33298 - DNA, 16 bp, Homo sapiens
tggaggggctggttct

SEQ ID NO: 33299 - DNA, 20 bp, Homo sapiens
tggcaagggtgtccacagcc

SEQ ID NO: 33300 - DNA, 78 bp, Macaca mulatta rhadinovirus
cggtacgcctgcctgatggcttgatagtagggctgctgggctgctagtagggctgctgggctgctagtagggctgctg

SEQ ID NO: 33301 - DNA, 24 bp, Macaca mulatta rhadinovirus
tagggctgctgggctgctagtagg

SEQ ID NO: 33302 - DNA, 20 bp, Homo sapiens
aggccaaagctgctagtggg

SEQ ID NO: 33303 - DNA, 19 bp, Homo sapiens
cagggttgctgggctacag

SEQ ID NO: 33304 - DNA, 18 bp, Homo sapiens
gggctgctggacagtggg

SEQ ID NO: 33305 - DNA, 22 bp, Homo sapiens
tagggctgatggaaagagtggg

SEQ ID NO: 33306 - DNA, 19 bp, Homo sapiens
gggctgtcgggctagtcgg

SEQ ID NO: 33307 - DNA, 16 bp, Homo sapiens
gggctctgggctgcag

SEQ ID NO: 33308 - DNA, 18 bp, Homo sapiens
tagggctagcagctggtg

SEQ ID NO: 33309 - DNA, 20 bp, Homo sapiens
gggctgctggggcttgctgg

SEQ ID NO: 33310 - DNA, 22 bp, Homo sapiens
aggctgctgggtcccctgtggg

SEQ ID NO: 33311 - DNA, 20 bp, Homo sapiens
ggctgctggtgtgtggtggg

SEQ ID NO: 33312 - DNA, 25 bp, Homo sapiens
taggactgctgctggccctggtggg

SEQ ID NO: 33313 - DNA, 23 bp, Homo sapiens
tagggctgcttggggatagtggg

SEQ ID NO: 33314 - DNA, 21 bp, Homo sapiens
aggcttgttgggtgtgttagg

SEQ ID NO: 33315 - DNA, 19 bp, Homo sapiens
gggctgctgggtgtatagg

SEQ ID NO: 33316 - DNA, 19 bp, Homo sapiens
cagggctgttgggctggcc

SEQ ID NO: 33317 - DNA, 20 bp, Homo sapiens
agccgtgggctgctggtagg

SEQ ID NO: 33318 - DNA, 21 bp, Homo sapiens
gggtgtcaagctgctggtggg

SEQ ID NO: 33319 - DNA, 19 bp, Homo sapiens
gggctactgggccctctag

SEQ ID NO: 33320 - DNA, 19 bp, Homo sapiens
gggctgctgctgtggtggg

SEQ ID NO: 33321 - DNA, 18 bp, Homo sapiens
gggtcaggctgctggtag

SEQ ID NO: 33322 - DNA, 18 bp, Homo sapiens
gggctgctggagctgcta

SEQ ID NO: 33323 - DNA, 19 bp, Homo sapiens
gggctgcttgctcggtagg

SEQ ID NO: 33324 - DNA, 19 bp, Homo sapiens
tagaggctgctgggctgag

SEQ ID NO: 33325 - DNA, 19 bp, Homo sapiens
tagggctatttgctggtag

SEQ ID NO: 33326 - DNA, 72 bp, Macaca mulatta rhadinovirus
agtaggcctgcttgctcgctggcctgcttgctgaggggacagtagggctgctggcttgctagtagggctgct

SEQ ID NO: 33327 - DNA, 21 bp, Macaca mulatta rhadinovirus
tggcttgctagtagggctgct

SEQ ID NO: 33328 - DNA, 17 bp, Homo sapiens
tggcatgctgggctgcc

SEQ ID NO: 33329 - DNA, 16 bp, Homo sapiens
tggctgcccaggctgc

SEQ ID NO: 33330 - DNA, 18 bp, Homo sapiens
gctcggggtggggctgct

SEQ ID NO: 33331 - DNA, 18 bp, Homo sapiens
ggttgttgtagggctgct

SEQ ID NO: 33332 - DNA, 18 bp, Homo sapiens
tggcctgctggctatgct

SEQ ID NO: 33333 - DNA, 15 bp, Homo sapiens
cggcttcagggctgc

SEQ ID NO: 33334 - DNA, 19 bp, Homo sapiens
tggttttgagacagggctg

SEQ ID NO: 33335 - DNA, 19 bp, Homo sapiens
tggctgtccagaggctgct

SEQ ID NO: 33336 - DNA, 21 bp, Homo sapiens
tggcatgactccagggctgct

SEQ ID NO: 33337 - DNA, 18 bp, Homo sapiens
tggcgttgatgggctgct

SEQ ID NO: 33338 - DNA, 18 bp, Homo sapiens
ggcggcggtggggctgct

SEQ ID NO: 33339 - DNA, 17 bp, Homo sapiens
gcttacaaggggctgct

SEQ ID NO: 33340 - DNA, 19 bp, Homo sapiens
agccccgggtagggctgct

SEQ ID NO: 33341 - DNA, 19 bp, Homo sapiens
tgggtttgtcaaggctgct

SEQ ID NO: 33342 - DNA, 15 bp, Homo sapiens
gcttgctgcagctgc

SEQ ID NO: 33343 - DNA, 19 bp, Homo sapiens
tggcttgcagggtgctgct

SEQ ID NO: 33344 - DNA, 18 bp, Homo sapiens
tggttacacagggctgct

SEQ ID NO: 33345 - DNA, 15 bp, Homo sapiens
tggcttactaattgc

SEQ ID NO: 33346 - DNA, 20 bp, Homo sapiens
tgttttgtcccgaggctgct

SEQ ID NO: 33347 - DNA, 20 bp, Homo sapiens
ggctccactgtggggctgct

SEQ ID NO: 33348 - DNA, 18 bp, Homo sapiens
tggcttgctcatactgct

SEQ ID NO: 33349 - DNA, 16 bp, Homo sapiens
tagcttgcccaggctg

SEQ ID NO: 33350 - DNA, 17 bp, Homo sapiens
tggtttgcagtaggacc

SEQ ID NO: 33351 - DNA, 22 bp, Homo sapiens
ggcttgcttgatgcgggctgct

SEQ ID NO: 33352 - DNA, 19 bp, Homo sapiens
tggctgggctggggctgct

SEQ ID NO: 33353 - DNA, 18 bp, Homo sapiens
tggtttcccatagggctg

SEQ ID NO: 33354 - DNA, 23 bp, Homo sapiens
tggcttgtcagtagccccaagct

SEQ ID NO: 33355 - DNA, 17 bp, Homo sapiens
tggcttgctgtggtacc

SEQ ID NO: 33356 - DNA, 19 bp, Homo sapiens
tggcttgcttgtgtggact

SEQ ID NO: 33357 - DNA, 21 bp, Homo sapiens
tggttggttcagggggctgct

SEQ ID NO: 33358 - DNA, 20 bp, Homo sapiens
tgggggcaggtggggctgct

SEQ ID NO: 33359 - DNA, 19 bp, Homo sapiens
tgatttgctagtagaaact

SEQ ID NO: 33360 - DNA, 15 bp, Homo sapiens
tggcttacagggctg

SEQ ID NO: 33361 - DNA, 16 bp, Homo sapiens
tgggctgtggggctgc

SEQ ID NO: 33362 - DNA, 18 bp, Homo sapiens
tggcttgcaagtcccgct

SEQ ID NO: 33363 - DNA, 23 bp, Homo sapiens
ggcttctctggggtggggctgct

SEQ ID NO: 33364 - DNA, 20 bp, Homo sapiens
tgacttgctgtcctcctgct

SEQ ID NO: 33365 - DNA, 18 bp, Homo sapiens
tggcttttggtagggcca

SEQ ID NO: 33366 - DNA, 18 bp, Homo sapiens
tagcttgctagtaaatcc

SEQ ID NO: 33367 - DNA, 20 bp, Homo sapiens
tggcttgcggtggtcaggct

SEQ ID NO: 33368 - DNA, 18 bp, Homo sapiens
gcctcctgtagggctgct

SEQ ID NO: 33369 - DNA, 20 bp, Homo sapiens
gcttgccgtcgggggctgct

SEQ ID NO: 33370 - DNA, 19 bp, Homo sapiens
ggcactgagtggggctgct

SEQ ID NO: 33371 - DNA, 16 bp, Homo sapiens
tggctgctagtggccc

SEQ ID NO: 33372 - DNA, 18 bp, Homo sapiens
tgtcttgaaggggctgct

SEQ ID NO: 33373 - DNA, 18 bp, Homo sapiens
gctatgcctggggctgct

SEQ ID NO: 33374 - DNA, 20 bp, Homo sapiens
tgggttgcatttaggctgct

SEQ ID NO: 33375 - DNA, 18 bp, Homo sapiens
tggcttgctgtgaagtct

SEQ ID NO: 33376 - DNA, 19 bp, Homo sapiens
tgggggcggtggggctgct

SEQ ID NO: 33377 - DNA, 17 bp, Homo sapiens
ggcttccgggggctgct

SEQ ID NO: 33378 - DNA, 16 bp, Homo sapiens
tggctgccgaggctgc

SEQ ID NO: 33379 - DNA, 20 bp, Homo sapiens
tggtttactagtattttgct

SEQ ID NO: 33380 - DNA, 19 bp, Homo sapiens
gcttgcccacagggctgct

SEQ ID NO: 33381 - DNA, 18 bp, Homo sapiens
ggtttgctaatccctgct

SEQ ID NO: 33382 - DNA, 15 bp, Homo sapiens
tggctcaagggctgc

SEQ ID NO: 33383 - DNA, 21 bp, Homo sapiens
tggcttgctaggtataaagct

SEQ ID NO: 33384 - DNA, 19 bp, Homo sapiens
ggcttggccctgggctgct

SEQ ID NO: 33385 - DNA, 19 bp, Homo sapiens
tggcttgcagacgtctgct

SEQ ID NO: 33386 - DNA, 15 bp, Homo sapiens
tgacttgctggatgc

SEQ ID NO: 33387 - DNA, 18 bp, Homo sapiens
tggcttgctagcagagcc

SEQ ID NO: 33388 - DNA, 15 bp, Homo sapiens
tggctgctaggctgc

SEQ ID NO: 33389 - DNA, 17 bp, Homo sapiens
tggcctgctggtggcac

SEQ ID NO: 33390 - DNA, 18 bp, Homo sapiens
tggcttactgcagctgct

SEQ ID NO: 33391 - DNA, 18 bp, Homo sapiens
tggcttttagtagggcca

SEQ ID NO: 33392 - DNA, 16 bp, Homo sapiens
tgacttctggggctgc

SEQ ID NO: 33393 - DNA, 20 bp, Homo sapiens
tggctgtaattggggttgct

SEQ ID NO: 33394 - DNA, 15 bp, Homo sapiens
tggcctgctggctgc

SEQ ID NO: 33395 - DNA, 19 bp, Homo sapiens
tggcttgctgggagcagag

SEQ ID NO: 33396 - DNA, 16 bp, Homo sapiens
tggtttgctaatgact

SEQ ID NO: 33397 - DNA, 19 bp, Homo sapiens
tggtttctccaaggctgct

SEQ ID NO: 33398 - DNA, 21 bp, Homo sapiens
tggctgggtctcagggctgct

SEQ ID NO: 33399 - DNA, 19 bp, Homo sapiens
ggcttggccgggggctgct

SEQ ID NO: 33400 - DNA, 19 bp, Homo sapiens
cggcttagtaagggctgct

SEQ ID NO: 33401 - DNA, 19 bp, Homo sapiens
ggtcttgggtggggctgct

SEQ ID NO: 33402 - DNA, 21 bp, Homo sapiens
tgggttgctagtagcatggct

SEQ ID NO: 33403 - DNA, 24 bp, Homo sapiens
tggcttgctaatgatgtcactgct

SEQ ID NO: 33404 - DNA, 19 bp, Homo sapiens
tggtgtgatcagggctgct

SEQ ID NO: 33405 - DNA, 18 bp, Homo sapiens
tggcttctggtgcctgct

SEQ ID NO: 33406 - DNA, 20 bp, Homo sapiens
tggcttgctgcttttctgct

SEQ ID NO: 33407 - DNA, 20 bp, Homo sapiens
tggcctgctccagggctgct

SEQ ID NO: 33408 - DNA, 18 bp, Homo sapiens
ggcttgctgtcttctgct

SEQ ID NO: 33409 - DNA, 21 bp, Homo sapiens
tggtttcttcccagggctgct

SEQ ID NO: 33410 - DNA, 21 bp, Homo sapiens
tggcttcagcaatgggctgct

SEQ ID NO: 33411 - DNA, 15 bp, Homo sapiens
tggcctgctggatgc

SEQ ID NO: 33412 - DNA, 19 bp, Homo sapiens
tggttgctagtgcagatct

SEQ ID NO: 33413 - DNA, 16 bp, Homo sapiens
tggttgcttgagctgc

SEQ ID NO: 33414 - DNA, 16 bp, Homo sapiens
tggctcccagggctgc

SEQ ID NO: 33415 - DNA, 17 bp, Homo sapiens
gcttgtaataggctgct

SEQ ID NO: 33416 - DNA, 20 bp, Homo sapiens
tggcttgctaggtggaagct

SEQ ID NO: 33417 - DNA, 124 bp, Macaca mulatta rhadinovirus
ggcctgcttgcttgctcgctggcctgcttgcttgctcgctggcctgcttgcttgctcgctggcctgcttgcttgctcgctggcctgcttgcttgctcgctggcctgcttgcttgctcgctggcc

SEQ ID NO: 33418 - DNA, 24 bp, Macaca mulatta rhadinovirus
tcgctggcctgcttgcttgctcgc

SEQ ID NO: 33419 - DNA, 19 bp, Homo sapiens
tcctggcttgctttgcttg

SEQ ID NO: 33420 - DNA, 18 bp, Homo sapiens
ccttccttgcttgcttgc

SEQ ID NO: 33421 - DNA, 20 bp, Homo sapiens
tcgcttgccggcttgctcgc

SEQ ID NO: 33422 - DNA, 21 bp, Homo sapiens
gctggcttactcactgctcgc

SEQ ID NO: 33423 - DNA, 21 bp, Homo sapiens
tcgctcgctgcctcgtttgct

SEQ ID NO: 33424 - DNA, 17 bp, Homo sapiens
tagcctgcttgcactca

SEQ ID NO: 33425 - DNA, 26 bp, Homo sapiens
gcttgctttcttgcttgcttgcttgc

SEQ ID NO: 33426 - DNA, 20 bp, Homo sapiens
tcgctcgcttgcttgcttgc

SEQ ID NO: 33427 - DNA, 17 bp, Homo sapiens
tcgcttgcttgcttgct

SEQ ID NO: 33428 - DNA, 27 bp, Homo sapiens
gcttgctttcttgcttgcttgcttgcg

SEQ ID NO: 33429 - DNA, 22 bp, Homo sapiens
gcttgctttcttgcttgcttgc

SEQ ID NO: 33430 - DNA, 22 bp, Homo sapiens
ctggcttgcttttctggcttgc

SEQ ID NO: 33431 - DNA, 18 bp, Homo sapiens
gcctggcctgcttgcttg

SEQ ID NO: 33432 - DNA, 19 bp, Homo sapiens
tcgctggcccgccgcttgc

SEQ ID NO: 33433 - DNA, 18 bp, Homo sapiens
ccgctggcctgtttgctc

SEQ ID NO: 33434 - DNA, 21 bp, Homo sapiens
gctggcctgttgcccatttgc

SEQ ID NO: 33435 - DNA, 20 bp, Homo sapiens
tcactggtttgactgcttgc

SEQ ID NO: 33436 - DNA, 16 bp, Homo sapiens
gctgcttgctacttgc

SEQ ID NO: 33437 - DNA, 18 bp, Homo sapiens
cctgtccttgcttgctcg

SEQ ID NO: 33438 - DNA, 103 bp, Macaca mulatta rhadinovirus
ctagtagggctgctgggctgctagtagggctgctgggctgctagtagggctgcctgctggcttgcttgcttgcttgctagtggggccgcttgcctgctactag

SEQ ID NO: 33439 - DNA, 24 bp, Macaca mulatta rhadinovirus
tgctagtagggctgctgggctgct

SEQ ID NO: 33440 - DNA, 20 bp, Homo sapiens
ctggtgtggactgggctgct

SEQ ID NO: 33441 - DNA, 20 bp, Homo sapiens
tgctgctgtttgctgggctg

SEQ ID NO: 33442 - DNA, 17 bp, Homo sapiens
gtgggctgctgggctgc

SEQ ID NO: 33443 - DNA, 20 bp, Homo sapiens
gctgctgggctgctgggctg

SEQ ID NO: 33444 - DNA, 19 bp, Homo sapiens
tgctgctggggccggttgc

SEQ ID NO: 33445 - DNA, 19 bp, Homo sapiens
tgccagtgccctgggctgc

SEQ ID NO: 33446 - DNA, 16 bp, Homo sapiens
gttggctggggctgct

SEQ ID NO: 33447 - DNA, 22 bp, Homo sapiens
tgctgatcactgctgggctgct

SEQ ID NO: 33448 - DNA, 24 bp, Homo sapiens
tgtgagtagggagcacaggctgct

SEQ ID NO: 33449 - DNA, 19 bp, Homo sapiens
tgctggtgggggaaggctg

SEQ ID NO: 33450 - DNA, 20 bp, Homo sapiens
tgctggtgggaagcaggctg

SEQ ID NO: 33451 - DNA, 18 bp, Homo sapiens
tgctagtcgggctgcgtg

SEQ ID NO: 33452 - DNA, 21 bp, Homo sapiens
tgctggaactgctgggttgct

SEQ ID NO: 33453 - DNA, 28 bp, Homo sapiens
tgctactggggctgctggtggagctgct

SEQ ID NO: 33454 - DNA, 25 bp, Homo sapiens
tgctactggggctgctggagctgct

SEQ ID NO: 33455 - DNA, 25 bp, Homo sapiens
tgctactggggctgctgccgctgct

SEQ ID NO: 33456 - DNA, 23 bp, Homo sapiens
tgcgggtgggggcaggggctgct

SEQ ID NO: 33457 - DNA, 21 bp, Homo sapiens
tgctggaggggctgaactgct

SEQ ID NO: 33458 - DNA, 18 bp, Homo sapiens
gtaaggctgtggcctgct

SEQ ID NO: 33459 - DNA, 21 bp, Homo sapiens
tgctggtggagggattggctg

SEQ ID NO: 33460 - DNA, 20 bp, Homo sapiens
tgctgtggggctgctgtact

SEQ ID NO: 33461 - DNA, 61 bp, Macaca mulatta rhadinovirus
ggccacattatgccacggaagtcaatcttagaacaggtgggaacgtccgggtacggtggct

SEQ ID NO: 33462 - DNA, 24 bp, Macaca mulatta rhadinovirus
tatgccacggaagtcaatcttaga

SEQ ID NO: 33463 - DNA, 18 bp, Homo sapiens
gccacggaggtccattag

SEQ ID NO: 33464 - DNA, 18 bp, Homo sapiens
gccacaaataatcttgga

SEQ ID NO: 33465 - DNA, 70 bp, Macaca mulatta rhadinovirus
ggcagcgtcataccatgtcgcctgcttgtggcactgagctactgtttggcgttttgggggcacgctgacc

SEQ ID NO: 33466 - DNA, 24 bp, Macaca mulatta rhadinovirus
tactgtttggcgttttgggggcac

SEQ ID NO: 33467 - DNA, 17 bp, Homo sapiens
ctgttctgttttggggg

SEQ ID NO: 33468 - DNA, 19 bp, Homo sapiens
tactcttttgctttggggg

SEQ ID NO: 33469 - DNA, 18 bp, Homo sapiens
tatttggcaaaggggtgc

SEQ ID NO: 33470 - DNA, 24 bp, Homo sapiens
cttcccagcgtgttttgggggcac

SEQ ID NO: 33471 - DNA, 16 bp, Homo sapiens
ctgttaggctgggggc

SEQ ID NO: 33472 - DNA, 21 bp, Homo sapiens
tgtttgtgatggcaggggcac

SEQ ID NO: 33473 - DNA, 19 bp, Homo sapiens
tactgtttggggtcttggg

SEQ ID NO: 33474 - DNA, 18 bp, Homo sapiens
ctgtctggctccaggggg

SEQ ID NO: 33475 - DNA, 22 bp, Homo sapiens
tactgtttgtgtttcttctgca

SEQ ID NO: 33476 - DNA, 60 bp, Rhesus monkey papillomavirus
gtggagatccagtgcgggccttggacggtaaaagccggtcagtcctttgtggatctgcac

SEQ ID NO: 33477 - DNA, 24 bp, Rhesus monkey papillomavirus
cggtcagtcctttgtggatctgca

SEQ ID NO: 33478 - DNA, 20 bp, Homo sapiens
agtaaatttttgtggatttg

SEQ ID NO: 33479 - DNA, 20 bp, Homo sapiens
gttagttttgtggatctgca

SEQ ID NO: 33480 - DNA, 19 bp, Homo sapiens
cggtcagttttgtgtgcct

SEQ ID NO: 33481 - DNA, 19 bp, Homo sapiens
gggcagtcctcctcatctg

SEQ ID NO: 33482 - DNA, 17 bp, Homo sapiens
ggtcaggtgtggatctg

SEQ ID NO: 33483 - DNA, 75 bp, Paramecium bursaria Chlorella virus 1
aataccactgacatactcgtaatcgtcagtgtatttctttacgacggacgtaatatcagtattttcggttgtatt

SEQ ID NO: 33484 - DNA, 24 bp, Paramecium bursaria Chlorella virus 1
ccactgacatactcgtaatcgtca

SEQ ID NO: 33485 - DNA, 18 bp, Homo sapiens
cattaatatactcgtaat

SEQ ID NO: 33486 - DNA, 21 bp, Homo sapiens
catagacatactcaactgtca

SEQ ID NO: 33487 - DNA, 21 bp, Homo sapiens
ccactgactacttggctctca

SEQ ID NO: 33488 - DNA, 64 bp, Rabbit fibroma virus
gttgtctaaaacctacacgtggaatgacgattcacaaagagtctctgccacgggatttagcaat

SEQ ID NO: 33489 - DNA, 19 bp, Rabbit fibroma virus
tgccacgggatttagcaat

SEQ ID NO: 33490 - DNA, 16 bp, Homo sapiens
tgccacctctagcaat

SEQ ID NO: 33491 - DNA, 16 bp, Homo sapiens
tgccacgcttagcaat

SEQ ID NO: 33492 - DNA, 16 bp, Homo sapiens
tgtcacagttagcaat

SEQ ID NO: 33493 - DNA, 19 bp, Homo sapiens
tgacgagatgtttagcaat

SEQ ID NO: 33494 - DNA, 16 bp, Homo sapiens
tgccacttttagcaat

SEQ ID NO: 33495 - DNA, 17 bp, Homo sapiens
tgccctggtccagcaat

SEQ ID NO: 33496 - DNA, 18 bp, Homo sapiens
tgtcaggtcctcagcaat

SEQ ID NO: 33497 - DNA, 19 bp, Homo sapiens
tgctgggcagtttagcaat

SEQ ID NO: 33498 - DNA, 16 bp, Homo sapiens
tgccaagtccagcaat

SEQ ID NO: 33499 - DNA, 20 bp, Homo sapiens
taccacggcatgaaggcaat

SEQ ID NO: 33500 - DNA, 18 bp, Homo sapiens
gcaaaaagatttagcaat

SEQ ID NO: 33501 - DNA, 20 bp, Homo sapiens
tgccacaggaggtcctggca

SEQ ID NO: 33502 - DNA, 20 bp, Homo sapiens
gccacggggcctagagcaat

SEQ ID NO: 33503 - DNA, 16 bp, Homo sapiens
tgccacaggaaacaat

SEQ ID NO: 33504 - DNA, 18 bp, Homo sapiens
tgccacggaccaagcaat

SEQ ID NO: 33505 - DNA, 18 bp, Homo sapiens
tgccccgggctcagcaat

SEQ ID NO: 33506 - DNA, 18 bp, Homo sapiens
tgcctgaacccaagcaat

SEQ ID NO: 33507 - DNA, 17 bp, Homo sapiens
gccacagagttagcaat

SEQ ID NO: 33508 - DNA, 16 bp, Homo sapiens
tggcacgactagcaat

SEQ ID NO: 33509 - DNA, 19 bp, Homo sapiens
tgccacagctctcagcaat

SEQ ID NO: 33510 - DNA, 18 bp, Homo sapiens
tgccattggtccagcaat

SEQ ID NO: 33511 - DNA, 17 bp, Homo sapiens
tgccacaggagtacaat

SEQ ID NO: 33512 - DNA, 21 bp, Homo sapiens
tgtcacgagatgactaacaat

SEQ ID NO: 33513 - DNA, 17 bp, Homo sapiens
tgccattgattagcaat

SEQ ID NO: 33514 - DNA, 18 bp, Homo sapiens
tgcgcgggactcctcaat

SEQ ID NO: 33515 - DNA, 18 bp, Homo sapiens
taccagaattttagcaat

SEQ ID NO: 33516 - DNA, 16 bp, Homo sapiens
tgcgaggattagcaat

SEQ ID NO: 33517 - DNA, 16 bp, Homo sapiens
tgctgggaccagcaat

SEQ ID NO: 33518 - DNA, 17 bp, Homo sapiens
gccacggggtcagaaat

SEQ ID NO: 33519 - DNA, 18 bp, Homo sapiens
tgctggaaccccagcaat

SEQ ID NO: 33520 - DNA, 17 bp, Homo sapiens
tgtcacggaataacaat

SEQ ID NO: 33521 - DNA, 16 bp, Homo sapiens
tgacacgactagcaat

SEQ ID NO: 33522 - DNA, 16 bp, Homo sapiens
tgctgggcccagcaat

SEQ ID NO: 33523 - DNA, 17 bp, Homo sapiens
tgccacaggaccagcaa

SEQ ID NO: 33524 - DNA, 19 bp, Homo sapiens
taccatatggtttagcaat

SEQ ID NO: 33525 - DNA, 19 bp, Homo sapiens
tgcctggaatcccagcaat

SEQ ID NO: 33526 - DNA, 16 bp, Homo sapiens
tgcacgggatggcaat

SEQ ID NO: 33527 - DNA, 17 bp, Homo sapiens
tgcgtgggatttacaat

SEQ ID NO: 33528 - DNA, 103 bp, Human adenovirus A
taaatgttaggtttgctggagataagtttaaaggcattatgttcgaagctaatacctgtcttgtcttgcatggtgtttactttcttaactttagtaacatttg

SEQ ID NO: 33529 - DNA, 24 bp, Human adenovirus A
ttgcatggtgtttactttcttaac

SEQ ID NO: 33530 - DNA, 19 bp, Homo sapiens
tgacatttattttcttaac

SEQ ID NO: 33531 - DNA, 17 bp, Homo sapiens
ttgcacggtgtttcttt

SEQ ID NO: 33532 - DNA, 19 bp, Homo sapiens
gcatggtgtctacttctta

SEQ ID NO: 33533 - DNA, 20 bp, Homo sapiens
tgtttaagtgctttcttaac

SEQ ID NO: 33534 - DNA, 20 bp, Homo sapiens
catggtgttttatccctctt

SEQ ID NO: 33535 - DNA, 21 bp, Homo sapiens
ttgcatgggctgtttttctta

SEQ ID NO: 33536 - DNA, 18 bp, Homo sapiens
tgcaattcttactttctt

SEQ ID NO: 33537 - DNA, 19 bp, Homo sapiens
ttccatggtgttctgtctt

SEQ ID NO: 33538 - DNA, 23 bp, Homo sapiens
tgctcaggtgtttacttttttaa

SEQ ID NO: 33539 - DNA, 22 bp, Homo sapiens
ctgcatgtttacttgttttctt

SEQ ID NO: 33540 - DNA, 18 bp, Homo sapiens
ttacatacttactttctt

SEQ ID NO: 33541 - DNA, 62 bp, Human adenovirus A
aaactgttcatattgtgagccacagtagacattgttggcctgtatgtgatcataacatgttt

SEQ ID NO: 33542 - DNA, 24 bp, Human adenovirus A
ttcatattgtgagccacagtagac

SEQ ID NO: 33543 - DNA, 20 bp, Homo sapiens
ttgctcaacagccacagtag

SEQ ID NO: 33544 - DNA, 20 bp, Homo sapiens
ttcagattgtgtacagtaga

SEQ ID NO: 33545 - DNA, 19 bp, Homo sapiens
ttcatatatatgcagtaga

SEQ ID NO: 33546 - DNA, 22 bp, Homo sapiens
ttcatattgtgatcccacgaga

SEQ ID NO: 33547 - DNA, 92 bp, Human adenovirus A
cattatgctggaacctgaagtgttttctagagtgtgtttaaatggggtatttgatttatctgtggaattatgtaaggttataagatataatg

SEQ ID NO: 33548 - DNA, 22 bp, Human adenovirus A
tgtaaggttataagatataatg

SEQ ID NO: 33549 - DNA, 22 bp, Homo sapiens
tgtaaggtcatgaaggtcaatg

SEQ ID NO: 33550 - DNA, 19 bp, Homo sapiens
taaggttatagaagtaatg

SEQ ID NO: 33551 - DNA, 23 bp, Homo sapiens
tgcaggtcacaggggatatgatg

SEQ ID NO: 33552 - DNA, 16 bp, Homo sapiens
tgtaaggttaaaacat

SEQ ID NO: 33553 - DNA, 91 bp, Human adenovirus A
gacagtgtgagtgtggtagcagtcatctagaacttcgtcccattgtgctaaatgtaactgaggagctgagaagtgaccaccttaccctgtc

SEQ ID NO: 33554 - DNA, 24 bp, Human adenovirus A
taactgaggagctgagaagtgacc

SEQ ID NO: 33555 - DNA, 17 bp, Homo sapiens
tgagaaacaaggtgacc

SEQ ID NO: 33556 - DNA, 26 bp, Homo sapiens
taactgagtggtcctgatgggtgacc

SEQ ID NO: 33557 - DNA, 16 bp, Homo sapiens
aactgcctgagaagtg

SEQ ID NO: 33558 - DNA, 17 bp, Homo sapiens
actgaggactggagagt

SEQ ID NO: 33559 - DNA, 19 bp, Homo sapiens
actgaggagcttgataaat

SEQ ID NO: 33560 - DNA, 19 bp, Homo sapiens
actgaggagcagagaaatg

SEQ ID NO: 33561 - DNA, 18 bp, Homo sapiens
taactgagagctggaggt

SEQ ID NO: 33562 - DNA, 17 bp, Homo sapiens
aactgaggacaagtgac

SEQ ID NO: 33563 - DNA, 19 bp, Homo sapiens
caactgaaaaagagaggtg

SEQ ID NO: 33564 - DNA, 19 bp, Homo sapiens
gactgagcttggaagtgac

SEQ ID NO: 33565 - DNA, 20 bp, Homo sapiens
tgatggaggaataaagtgac

SEQ ID NO: 33566 - DNA, 15 bp, Homo sapiens
ctgaagagcagtgac

SEQ ID NO: 33567 - DNA, 17 bp, Homo sapiens
tgaggagctgggaggac

SEQ ID NO: 33568 - DNA, 18 bp, Homo sapiens
aagctgcttgagaagtgc

SEQ ID NO: 33569 - DNA, 19 bp, Homo sapiens
acttggggaaaaaaaagtg

SEQ ID NO: 33570 - DNA, 21 bp, Homo sapiens
aactgaggacggcgggtgacc

SEQ ID NO: 33571 - DNA, 16 bp, Homo sapiens
ctgaggggctggagca

SEQ ID NO: 33572 - DNA, 20 bp, Homo sapiens
ctgccagttgagaagtggcc

SEQ ID NO: 33573 - DNA, 23 bp, Homo sapiens
ctgaggaaagggctggggagtga

SEQ ID NO: 33574 - DNA, 17 bp, Homo sapiens
actgagggcctgaacac

SEQ ID NO: 33575 - DNA, 18 bp, Homo sapiens
taactgtgacagaagtga

SEQ ID NO: 33576 - DNA, 18 bp, Homo sapiens
ctgaggggctgggagagc

SEQ ID NO: 33577 - DNA, 19 bp, Homo sapiens
aactgaggcctagaagtga

SEQ ID NO: 33578 - DNA, 17 bp, Homo sapiens
aactgaggaggggtgac

SEQ ID NO: 33579 - DNA, 22 bp, Homo sapiens
acttgaggtaaacagaagtgac

SEQ ID NO: 33580 - DNA, 18 bp, Homo sapiens
ctgaggatgtaaagtgac

SEQ ID NO: 33581 - DNA, 18 bp, Homo sapiens
ctgggggcaggaagtgac

SEQ ID NO: 33582 - DNA, 17 bp, Homo sapiens
ctgaagcaacagaggtg

SEQ ID NO: 33583 - DNA, 20 bp, Homo sapiens
taactgatgagaaaagtgac

SEQ ID NO: 33584 - DNA, 17 bp, Homo sapiens
tgaggagctgccatgac

SEQ ID NO: 33585 - DNA, 19 bp, Homo sapiens
aactgagggggacttagtg

SEQ ID NO: 33586 - DNA, 19 bp, Homo sapiens
taactgagggctgaggggt

SEQ ID NO: 33587 - DNA, 20 bp, Homo sapiens
actgaggagctgaaagaacc

SEQ ID NO: 33588 - DNA, 19 bp, Homo sapiens
actgatgagaaaagtgacc

SEQ ID NO: 33589 - DNA, 16 bp, Homo sapiens
actgggagctgacagt

SEQ ID NO: 33590 - DNA, 19 bp, Homo sapiens
ctgagagaagggaagtgac

SEQ ID NO: 33591 - DNA, 65 bp, African swine fever virus
gtcttttatggctggtaagtgctgacatcaggccccctgtttcagcgtggccagccatcgctgac

SEQ ID NO: 33592 - DNA, 24 bp, African swine fever virus
tttcagcgtggccagccatcgctg

SEQ ID NO: 33593 - DNA, 18 bp, Homo sapiens
tttcagcgggttagcgct

SEQ ID NO: 33594 - DNA, 60 bp, African swine fever virus
gtggcacgtcaccatcaaaaacattgcccaacaacacgggcttgatataaaggtggccat

SEQ ID NO: 33595 - DNA, 20 bp, African swine fever virus
cttgatataaaggtggccat

SEQ ID NO: 33596 - DNA, 18 bp, Homo sapiens
ttgatacattttagccat

SEQ ID NO: 33597 - DNA, 17 bp, Homo sapiens
ttaatataataggccat

SEQ ID NO: 33598 - DNA, 16 bp, Homo sapiens
ctgaaaaggtggccat

SEQ ID NO: 33599 - DNA, 17 bp, Homo sapiens
cttgatactgaatagcc

SEQ ID NO: 33600 - DNA, 19 bp, Homo sapiens
cttgatgatagatgaccat

SEQ ID NO: 33601 - DNA, 17 bp, Homo sapiens
ttgatataaaccaccat

SEQ ID NO: 33602 - DNA, 15 bp, Homo sapiens
cttgatataggtcca

SEQ ID NO: 33603 - DNA, 19 bp, Homo sapiens
ttaatataaaaaatgccat

SEQ ID NO: 33604 - DNA, 19 bp, Homo sapiens
ctcgatatgaggacaccat

SEQ ID NO: 33605 - DNA, 19 bp, Homo sapiens
cttgatactgtttagccat

SEQ ID NO: 33606 - DNA, 18 bp, Homo sapiens
ctggatagtaatggccat

SEQ ID NO: 33607 - DNA, 18 bp, Homo sapiens
aacatgaaaggtggtcat

SEQ ID NO: 33608 - DNA, 17 bp, Homo sapiens
ttaataatagtggccat

SEQ ID NO: 33609 - DNA, 22 bp, Homo sapiens
cttgatatgcatccagagtggc

SEQ ID NO: 33610 - DNA, 20 bp, Homo sapiens
ttggtacaaagatgaaccat

SEQ ID NO: 33611 - DNA, 18 bp, Homo sapiens
ttcatataaaatggtagc

SEQ ID NO: 33612 - DNA, 19 bp, Homo sapiens
cctgcactcaggtggccat

SEQ ID NO: 33613 - DNA, 19 bp, Homo sapiens
ttgaaataaaagttcccat

SEQ ID NO: 33614 - DNA, 21 bp, Homo sapiens
cttggtataaaaataatccat

SEQ ID NO: 33615 - DNA, 19 bp, Homo sapiens
ttgatataaaagaggtcat

SEQ ID NO: 33616 - DNA, 19 bp, Homo sapiens
ttgatggaaagatggtcat

SEQ ID NO: 33617 - DNA, 19 bp, Homo sapiens
ctgatataagagaggccat

SEQ ID NO: 33618 - DNA, 19 bp, Homo sapiens
ctggatataaggcagccat

SEQ ID NO: 33619 - DNA, 15 bp, Homo sapiens
cttgatatatggcca

SEQ ID NO: 33620 - DNA, 18 bp, Homo sapiens
cttgatacaggttacagc

SEQ ID NO: 33621 - DNA, 19 bp, Homo sapiens
ttgaaataaaaatttccat

SEQ ID NO: 33622 - DNA, 17 bp, Homo sapiens
cttgatataaaggctcc

SEQ ID NO: 33623 - DNA, 18 bp, Homo sapiens
cttgatatggaaaggacc

SEQ ID NO: 33624 - DNA, 21 bp, Homo sapiens
tgatgtagccacgatggccat

SEQ ID NO: 33625 - DNA, 18 bp, Homo sapiens
ctcccacagggtggccat

SEQ ID NO: 33626 - DNA, 18 bp, Homo sapiens
cttggtaaagcggctcat

SEQ ID NO: 33627 - DNA, 20 bp, Homo sapiens
cctgatacgccatggtggcc

SEQ ID NO: 33628 - DNA, 15 bp, Homo sapiens
cttgatggtgaccat

SEQ ID NO: 33629 - DNA, 17 bp, Homo sapiens
cttgaataaaagcccat

SEQ ID NO: 33630 - DNA, 19 bp, Homo sapiens
cttaatataaagcaaaagc

SEQ ID NO: 33631 - DNA, 18 bp, Homo sapiens
ttggtgaaagataaccat

SEQ ID NO: 33632 - DNA, 17 bp, Homo sapiens
cttgatagaaaataacc

SEQ ID NO: 33633 - DNA, 19 bp, Homo sapiens
ctggacatggggtggccat

SEQ ID NO: 33634 - DNA, 64 bp, Cercopithecine herpesvirus 7
gaatatcgcagttatcaaggttagttatacctgtttatacagttaaccctaatctttgcttttc

SEQ ID NO: 33635 - DNA, 24 bp, Cercopithecine herpesvirus 7
tatcgcagttatcaaggttagtta

SEQ ID NO: 33636 - DNA, 23 bp, Homo sapiens
tatggcagttactgagttagtta

SEQ ID NO: 33637 - DNA, 18 bp, Homo sapiens
gcattatcaaaatggtta

SEQ ID NO: 33638 - DNA, 16 bp, Homo sapiens
acagtcaaggttagtt

SEQ ID NO: 33639 - DNA, 81 bp, Vaccinia virus
gatgatgatttatgaattgattccggaagatcgctatcgtattttgtggttccacaattcatttccatacatgttattgtc

SEQ ID NO: 33640 - DNA, 24 bp, Vaccinia virus
tgatgatttatgaattgattccgg

SEQ ID NO: 33641 - DNA, 22 bp, Homo sapiens
tgatgatttatttatattctgg

SEQ ID NO: 33642 - DNA, 18 bp, Homo sapiens
tgatgattcatatgtgat

SEQ ID NO: 33643 - DNA, 122 bp, Human adenovirus B
ttgattttgcatggttgtagcttttttggttttaataatatatgtgtggaagcttgggggcaggtcagtgtaagaggctgtagtttctatgcatgctggattgcaacatcaggcaggaccaa

SEQ ID NO: 33644 - DNA, 24 bp, Human adenovirus B
tggaagcttgggggcaggtcagtg

SEQ ID NO: 33645 - DNA, 23 bp, Homo sapiens
tgggagctgggagagtgttggtg

SEQ ID NO: 33646 - DNA, 22 bp, Homo sapiens
tggaagtttggggtgggtggtg

SEQ ID NO: 33647 - DNA, 19 bp, Homo sapiens
gaagtttggggggacaagt

SEQ ID NO: 33648 - DNA, 23 bp, Homo sapiens
tgggggttgggggcctgctggtg

SEQ ID NO: 33649 - DNA, 17 bp, Homo sapiens
tggaggcctgggggggt

SEQ ID NO: 33650 - DNA, 19 bp, Homo sapiens
tggacatgggcaggtcagt

SEQ ID NO: 33651 - DNA, 22 bp, Homo sapiens
tggggctacaggcaggtcagtg

SEQ ID NO: 33652 - DNA, 21 bp, Homo sapiens
tggggtttggggacctcagtg

SEQ ID NO: 33653 - DNA, 18 bp, Homo sapiens
tgggagttgggggcagat

SEQ ID NO: 33654 - DNA, 26 bp, Homo sapiens
tgggggcttagggcagttggtcggtg

SEQ ID NO: 33655 - DNA, 22 bp, Homo sapiens
tgggagccttgggggagcagtg

SEQ ID NO: 33656 - DNA, 17 bp, Homo sapiens
tgggggctgggggcagg

SEQ ID NO: 33657 - DNA, 21 bp, Homo sapiens
ggaggtggcggtgggtcagtg

SEQ ID NO: 33658 - DNA, 22 bp, Homo sapiens
ggggcgtaggggtgggtcagtg

SEQ ID NO: 33659 - DNA, 23 bp, Homo sapiens
ggaagcttgggggccgaagggtg

SEQ ID NO: 33660 - DNA, 19 bp, Homo sapiens
tggaggctgggggccatgt

SEQ ID NO: 33661 - DNA, 19 bp, Homo sapiens
tggaagcattgggggcagg

SEQ ID NO: 33662 - DNA, 18 bp, Homo sapiens
cctgggggtgggtcagtg

SEQ ID NO: 33663 - DNA, 18 bp, Homo sapiens
tggaggctgggggcaaat

SEQ ID NO: 33664 - DNA, 22 bp, Homo sapiens
tggaggtttggggtctcgagtg

SEQ ID NO: 33665 - DNA, 19 bp, Homo sapiens
ggagcttggggctgtagtg

SEQ ID NO: 33666 - DNA, 19 bp, Homo sapiens
tgggggcttggggaagggt

SEQ ID NO: 33667 - DNA, 20 bp, Homo sapiens
tgggggctgggggcagggtc

SEQ ID NO: 33668 - DNA, 19 bp, Homo sapiens
tgggagcctgggcctcagt

SEQ ID NO: 33669 - DNA, 18 bp, Homo sapiens
tggaagcctggggctggt

SEQ ID NO: 33670 - DNA, 21 bp, Homo sapiens
tgggataggggcaggttggtg

SEQ ID NO: 33671 - DNA, 20 bp, Homo sapiens
gaagtacccgcaggtcagtg

SEQ ID NO: 33672 - DNA, 22 bp, Homo sapiens
tgggagctgtggggcttcagtg

SEQ ID NO: 33673 - DNA, 19 bp, Homo sapiens
tgggagcttgggggagggt

SEQ ID NO: 33674 - DNA, 18 bp, Homo sapiens
tggaaccttcaggtcagt

SEQ ID NO: 33675 - DNA, 63 bp, Vaccinia virus
agccgctgagtggtaaacaacagaacagatagtttattatctttaccaacaccctcagccgct

SEQ ID NO: 33676 - DNA, 24 bp, Vaccinia virus
ccgctgagtggtaaacaacagaac

SEQ ID NO: 33677 - DNA, 16 bp, Homo sapiens
gcctgggcaacagaac

SEQ ID NO: 33678 - DNA, 18 bp, Homo sapiens
ccagcttgggcaacagaa

SEQ ID NO: 33679 - DNA, 22 bp, Homo sapiens
gcagagccctgggtaacagaac

SEQ ID NO: 33680 - DNA, 21 bp, Homo sapiens
gctgagtggcagagcagcaga

SEQ ID NO: 33681 - DNA, 23 bp, Homo sapiens
ccctgctataaaaacaacagaac

SEQ ID NO: 33682 - DNA, 22 bp, Homo sapiens
gctgtgttcatagcaacagaac

SEQ ID NO: 33683 - DNA, 17 bp, Homo sapiens
ccttggggtaacaacag

SEQ ID NO: 33684 - DNA, 16 bp, Homo sapiens
gcttagtagcaacaga

SEQ ID NO: 33685 - DNA, 20 bp, Homo sapiens
ctgtatgagacacaacagaa

SEQ ID NO: 33686 - DNA, 19 bp, Homo sapiens
ccactgagtggggagacag

SEQ ID NO: 33687 - DNA, 19 bp, Homo sapiens
ccgtgagtggtgggcagaa

SEQ ID NO: 33688 - DNA, 17 bp, Homo sapiens
ccttgagtgacagcaga

SEQ ID NO: 33689 - DNA, 16 bp, Homo sapiens
tgagtaactaacagaa

SEQ ID NO: 33690 - DNA, 21 bp, Homo sapiens
ccacagagtaaatagcagaac

SEQ ID NO: 33691 - DNA, 18 bp, Homo sapiens
gcttttagacaacagaac

SEQ ID NO: 33692 - DNA, 23 bp, Homo sapiens
ccccttaatggtgaacaacagaa

SEQ ID NO: 33693 - DNA, 23 bp, Homo sapiens
tgactgattggaaatagcagaac

SEQ ID NO: 33694 - DNA, 21 bp, Homo sapiens
ccgtgagcctctgacaacaga

SEQ ID NO: 33695 - DNA, 18 bp, Homo sapiens
ccctgagttctaacagaa

SEQ ID NO: 33696 - DNA, 19 bp, Homo sapiens
ccactgaagcaagtaacag

SEQ ID NO: 33697 - DNA, 17 bp, Homo sapiens
gcaagtaagtaacagaa

SEQ ID NO: 33698 - DNA, 19 bp, Homo sapiens
gctgccttaggcaacagaa

SEQ ID NO: 33699 - DNA, 22 bp, Homo sapiens
cctctgagtggtgaaatccaga

SEQ ID NO: 33700 - DNA, 16 bp, Homo sapiens
cactgctgaacaacag

SEQ ID NO: 33701 - DNA, 63 bp, Yaba-like disease virus
tataaataatctgatcttttttcatgttcaaaaaaatgaaacatataagaaaagtaatttata

SEQ ID NO: 33702 - DNA, 24 bp, Yaba-like disease virus
taaataatctgatcttttttcatg

SEQ ID NO: 33703 - DNA, 21 bp, Homo sapiens
ataaaatgattttttttcatg

SEQ ID NO: 33704 - DNA, 21 bp, Homo sapiens
ataatccctaattttttcatg

SEQ ID NO: 33705 - DNA, 24 bp, Homo sapiens
taaatgactggtccccctttcatg

SEQ ID NO: 33706 - DNA, 17 bp, Homo sapiens
aatctgattccttcatg

SEQ ID NO: 33707 - DNA, 20 bp, Homo sapiens
atagtctgattttcttcatg

SEQ ID NO: 33708 - DNA, 70 bp, Porcine enterovirus B
tcacgcctaccaataagacaagccctatatttacttgttgcattttactcgtcagaagaaatcacagagt

SEQ ID NO: 33709 - DNA, 24 bp, Porcine enterovirus B
taagacaagccctatatttacttg

SEQ ID NO: 33710 - DNA, 19 bp, Homo sapiens
agaaagctatatttacttg

SEQ ID NO: 33711 - DNA, 24 bp, Homo sapiens
taagacagtgaaaacatttacttg

SEQ ID NO: 33712 - DNA, 19 bp, Homo sapiens
gaccatatatatttacttg

SEQ ID NO: 33713 - DNA, 18 bp, Homo sapiens
aggcaggcccccatattt

SEQ ID NO: 33714 - DNA, 22 bp, Homo sapiens
gacaagccccatgggggccttg

SEQ ID NO: 33715 - DNA, 21 bp, Homo sapiens
agacagccctactcccacttg

SEQ ID NO: 33716 - DNA, 62 bp, Yaba-like disease virus
gcacatacaattaactttttttcatcacctttaaggttaagatataaaaacttaggtatggt

SEQ ID NO: 33717 - DNA, 20 bp, Yaba-like disease virus
tataaaaacttaggtatggt

SEQ ID NO: 33718 - DNA, 24 bp, Homo sapiens
tataaaaacattggcattaatggt

SEQ ID NO: 33719 - DNA, 20 bp, Homo sapiens
tataaaaactgtgtcatggt

SEQ ID NO: 33720 - DNA, 18 bp, Homo sapiens
tataaaaactcattaggt

SEQ ID NO: 33721 - DNA, 23 bp, Homo sapiens
tacaaaaatttgctaggcatggt

SEQ ID NO: 33722 - DNA, 23 bp, Homo sapiens
tacaaaaattagctgggtatggt

SEQ ID NO: 33723 - DNA, 19 bp, Homo sapiens
tataaaaattaggtatgat

SEQ ID NO: 33724 - DNA, 23 bp, Homo sapiens
tacaaaaattagccaggtgtggt

SEQ ID NO: 33725 - DNA, 23 bp, Homo sapiens
tacaaaaattacctgggtgtggt

SEQ ID NO: 33726 - DNA, 18 bp, Homo sapiens
taaaaacttggacacggt

SEQ ID NO: 33727 - DNA, 23 bp, Homo sapiens
tataaaaattagccaggcatggt

SEQ ID NO: 33728 - DNA, 20 bp, Homo sapiens
ataaaaacttagccacaggt

SEQ ID NO: 33729 - DNA, 20 bp, Homo sapiens
taagaaaatacagatatggt

SEQ ID NO: 33730 - DNA, 17 bp, Homo sapiens
taaaaactcagtctggt

SEQ ID NO: 33731 - DNA, 17 bp, Homo sapiens
tataaaatagatatggt

SEQ ID NO: 33732 - DNA, 19 bp, Homo sapiens
aaacaatattaggtatggt

SEQ ID NO: 33733 - DNA, 23 bp, Homo sapiens
tacaaaaatcacccaggtgtggt

SEQ ID NO: 33734 - DNA, 23 bp, Homo sapiens
tacaaaaattagctaggtgtggt

SEQ ID NO: 33735 - DNA, 24 bp, Homo sapiens
tataaaaaattagccaggcatggt

SEQ ID NO: 33736 - DNA, 23 bp, Homo sapiens
tataaaaattagctgggtatggt

SEQ ID NO: 33737 - DNA, 23 bp, Homo sapiens
tacaaaaactactccggtgtggt

SEQ ID NO: 33738 - DNA, 20 bp, Homo sapiens
tataaaaactcaggccaagt

SEQ ID NO: 33739 - DNA, 23 bp, Homo sapiens
tataaaaattagccgggtatggt

SEQ ID NO: 33740 - DNA, 18 bp, Homo sapiens
tatataagcttaggtata

SEQ ID NO: 33741 - DNA, 22 bp, Homo sapiens
cataaaaatgccagagtatggt

SEQ ID NO: 33742 - DNA, 16 bp, Homo sapiens
taaaaactgatatggt

SEQ ID NO: 33743 - DNA, 17 bp, Homo sapiens
ataaaaactgatatggt

SEQ ID NO: 33744 - DNA, 18 bp, Homo sapiens
tataaaaatagacatggt

SEQ ID NO: 33745 - DNA, 23 bp, Homo sapiens
tacaaaaattagccaggtatggt

SEQ ID NO: 33746 - DNA, 23 bp, Homo sapiens
tacaaaaactagccaggtgtggt

SEQ ID NO: 33747 - DNA, 17 bp, Homo sapiens
taaaaacttcagtaggt

SEQ ID NO: 33748 - DNA, 16 bp, Homo sapiens
taaacactggtatggt

SEQ ID NO: 33749 - DNA, 23 bp, Homo sapiens
tacaaaaatttgccgggcatggt

SEQ ID NO: 33750 - DNA, 17 bp, Homo sapiens
taaaaagcaggtatggt

SEQ ID NO: 33751 - DNA, 23 bp, Homo sapiens
tacaaaaattagtcaggtgtggt

SEQ ID NO: 33752 - DNA, 23 bp, Homo sapiens
tataaaaattagccgggcatggt

SEQ ID NO: 33753 - DNA, 23 bp, Homo sapiens
cataaaaattagttaggtgtggt

SEQ ID NO: 33754 - DNA, 23 bp, Homo sapiens
tataaaaactagccaggtgtggt

SEQ ID NO: 33755 - DNA, 21 bp, Homo sapiens
tataaaaactctgaaaatggt

SEQ ID NO: 33756 - DNA, 19 bp, Homo sapiens
tgaaagaccagagtatggt

SEQ ID NO: 33757 - DNA, 21 bp, Homo sapiens
taaaaacttagcgggcatggt

SEQ ID NO: 33758 - DNA, 18 bp, Homo sapiens
tataaaaaaaggtatggt

SEQ ID NO: 33759 - DNA, 105 bp, Melanoplus sanguinipes entomopoxvirus
aaatatatgtcttaaaatatcaatattatgatataaatatgaagttttttcgttttgtatattatatcttttaatattcatatcagtatctataaacatatattt

SEQ ID NO: 33760 - DNA, 24 bp, Melanoplus sanguinipes entomopoxvirus
tcaatattatgatataaatatgaa

SEQ ID NO: 33761 - DNA, 19 bp, Homo sapiens
tcaatattataataaatga

SEQ ID NO: 33762 - DNA, 18 bp, Homo sapiens
tcaacattataaatatga

SEQ ID NO: 33763 - DNA, 21 bp, Homo sapiens
tcaacattatgagttttatga

SEQ ID NO: 33764 - DNA, 22 bp, Homo sapiens
tctatatccatcataaatatga

SEQ ID NO: 33765 - DNA, 23 bp, Homo sapiens
tcaatattatgggataaaatgaa

SEQ ID NO: 33766 - DNA, 24 bp, Homo sapiens
tcaatttactacaataaatatgaa

SEQ ID NO: 33767 - DNA, 65 bp, Rat cytomegalovirus
gcggccggtcattcgagtgaattcattttccagggcggagaagatctcgtcggcggacgggtcgt

SEQ ID NO: 33768 - DNA, 21 bp, Rat cytomegalovirus
tctcgtcggcggacgggtcgt

SEQ ID NO: 33769 - DNA, 19 bp, Homo sapiens
ctcttgagggacgggttgt

SEQ ID NO: 33770 - DNA, 87 bp, Melanoplus sanguinipes entomopoxvirus
attaattttaatatctttttctgataaataaatatataacatatttattaaatattctttcatttcaaattcagatttaaaattaat

SEQ ID NO: 33771 - DNA, 24 bp, Melanoplus sanguinipes entomopoxvirus
tttcaaattcagatttaaaattaa

SEQ ID NO: 33772 - DNA, 19 bp, Homo sapiens
tttcaaattcagatactaa

SEQ ID NO: 33773 - DNA, 23 bp, Homo sapiens
ttcggaatcacatttaaaattaa

SEQ ID NO: 33774 - DNA, 19 bp, Homo sapiens
tttcaaattcagataaaat

SEQ ID NO: 33775 - DNA, 69 bp, Rat cytomegalovirus
tctcgcgatcgaaggtcggcgcgtgggcctgcgacgcaggagtcggcggcgacgatggagatggcgaga

SEQ ID NO: 33776 - DNA, 24 bp, Rat cytomegalovirus
aggagtcggcggcgacgatggaga

SEQ ID NO: 33777 - DNA, 17 bp, Homo sapiens
gcggcagcgacggtggg

SEQ ID NO: 33778 - DNA, 18 bp, Homo sapiens
aggaggcggcggcggcga

SEQ ID NO: 33779 - DNA, 23 bp, Homo sapiens
aggagccggcggcggagccgagg

SEQ ID NO: 33780 - DNA, 21 bp, Homo sapiens
gaagtcgagcgacggtggaga

SEQ ID NO: 33781 - DNA, 23 bp, Homo sapiens
aggggtcaggcatatgatggaga

SEQ ID NO: 33782 - DNA, 19 bp, Homo sapiens
ggaggcggcggcggcgcgg

SEQ ID NO: 33783 - DNA, 23 bp, Homo sapiens
ggaggcggcggcgggcaaggaga

SEQ ID NO: 33784 - DNA, 19 bp, Homo sapiens
ggagctggcggcgagtgag

SEQ ID NO: 33785 - DNA, 18 bp, Homo sapiens
ggagtgggcggcgagggg

SEQ ID NO: 33786 - DNA, 21 bp, Homo sapiens
aggagcggcggcggcccgagg

SEQ ID NO: 33787 - DNA, 18 bp, Homo sapiens
aggagctgggcgatggag

SEQ ID NO: 33788 - DNA, 21 bp, Homo sapiens
ggattcctgggacgatggaga

SEQ ID NO: 33789 - DNA, 20 bp, Homo sapiens
ggagtcggcgggcttggaga

SEQ ID NO: 33790 - DNA, 19 bp, Homo sapiens
ggggcggcggcggcacagg

SEQ ID NO: 33791 - DNA, 18 bp, Homo sapiens
ggagtcggtggcaacggg

SEQ ID NO: 33792 - DNA, 17 bp, Homo sapiens
agggttggcaggtggag

SEQ ID NO: 33793 - DNA, 22 bp, Homo sapiens
aggagcggcggcggccagccgg

SEQ ID NO: 33794 - DNA, 19 bp, Homo sapiens
ggggcggcggcggcgctgg

SEQ ID NO: 33795 - DNA, 16 bp, Homo sapiens
aggaggcggcggcgga

SEQ ID NO: 33796 - DNA, 22 bp, Homo sapiens
aggggctggggtccgatggaga

SEQ ID NO: 33797 - DNA, 20 bp, Homo sapiens
ggaggcggcggcgcaggaga

SEQ ID NO: 33798 - DNA, 18 bp, Homo sapiens
aagaatcggtgatgatgg

SEQ ID NO: 33799 - DNA, 21 bp, Homo sapiens
ggggttggggctgaatggaga

SEQ ID NO: 33800 - DNA, 22 bp, Homo sapiens
ggagtcagcggctgcttgggga

SEQ ID NO: 33801 - DNA, 17 bp, Homo sapiens
ggaggtggcggatggag

SEQ ID NO: 33802 - DNA, 18 bp, Homo sapiens
ggggcggcggcgcggggg

SEQ ID NO: 33803 - DNA, 21 bp, Homo sapiens
aggaggcggcggcggcacaga

SEQ ID NO: 33804 - DNA, 24 bp, Homo sapiens
ggagtcaggtggtgaaatctcgga

SEQ ID NO: 33805 - DNA, 18 bp, Homo sapiens
ggagccggcggccgctgg

SEQ ID NO: 33806 - DNA, 22 bp, Homo sapiens
ggagttggcggcgagacgtaga

SEQ ID NO: 33807 - DNA, 25 bp, Homo sapiens
ggagtcaggctggaggtgatggaga

SEQ ID NO: 33808 - DNA, 25 bp, Homo sapiens
agcagtcctgctctggcgatggaga

SEQ ID NO: 33809 - DNA, 23 bp, Homo sapiens
ggggtcggctgtgactcaccaga

SEQ ID NO: 33810 - DNA, 21 bp, Homo sapiens
ggaggtcggcggtggcgggga

SEQ ID NO: 33811 - DNA, 19 bp, Homo sapiens
ggaggcggcggcggcccgg

SEQ ID NO: 33812 - DNA, 21 bp, Homo sapiens
aggaggtggcggcgacagcgg

SEQ ID NO: 33813 - DNA, 20 bp, Homo sapiens
aggaggcggcggcagcggag

SEQ ID NO: 33814 - DNA, 16 bp, Homo sapiens
ggagagtgacgatggg

SEQ ID NO: 33815 - DNA, 20 bp, Homo sapiens
aggaggcggcggcagaggag

SEQ ID NO: 33816 - DNA, 21 bp, Homo sapiens
aggaggcggcggcgactgagg

SEQ ID NO: 33817 - DNA, 20 bp, Homo sapiens
ggagccggccggtggtggag

SEQ ID NO: 33818 - DNA, 18 bp, Homo sapiens
aggagtcgggggcgggga

SEQ ID NO: 33819 - DNA, 28 bp, Homo sapiens
ggaggcggcggcggtggtggtggtggag

SEQ ID NO: 33820 - DNA, 23 bp, Homo sapiens
aggagcggcggcggcagcaacag

SEQ ID NO: 33821 - DNA, 20 bp, Homo sapiens
ggggtcggcggcggcagcgg

SEQ ID NO: 33822 - DNA, 19 bp, Homo sapiens
aagttgatggtgacgatgg

SEQ ID NO: 33823 - DNA, 19 bp, Homo sapiens
ggactcggcggcgtgctgg

SEQ ID NO: 33824 - DNA, 23 bp, Homo sapiens
aggaggcggcggcggcggccgag

SEQ ID NO: 33825 - DNA, 18 bp, Homo sapiens
ggggcggcggcgagggag

SEQ ID NO: 33826 - DNA, 21 bp, Homo sapiens
gggttggtagccagatggaga

SEQ ID NO: 33827 - DNA, 18 bp, Homo sapiens
ggagtcgatggaatggag

SEQ ID NO: 33828 - DNA, 21 bp, Homo sapiens
ggggcggcggcggctgcgaga

SEQ ID NO: 33829 - DNA, 22 bp, Homo sapiens
aggagtcggtggccggcaggag

SEQ ID NO: 33830 - DNA, 22 bp, Homo sapiens
ggtagcagcggcggcggtggag

SEQ ID NO: 33831 - DNA, 18 bp, Homo sapiens
aggagctggccggtggag

SEQ ID NO: 33832 - DNA, 17 bp, Homo sapiens
ggggcggcggcgcgggg

SEQ ID NO: 33833 - DNA, 19 bp, Homo sapiens
ggtgtcggcggcgctgagg

SEQ ID NO: 33834 - DNA, 22 bp, Homo sapiens
aggaggcggcggcgggcggggg

SEQ ID NO: 33835 - DNA, 17 bp, Homo sapiens
ggagccggtggcggtgg

SEQ ID NO: 33836 - DNA, 22 bp, Homo sapiens
ggcggcggcggcggcggtggag

SEQ ID NO: 33837 - DNA, 22 bp, Homo sapiens
aggggttggggtgaagtgggga

SEQ ID NO: 33838 - DNA, 21 bp, Homo sapiens
agcggacagtgacggtggaga

SEQ ID NO: 33839 - DNA, 19 bp, Homo sapiens
ggggcggcggcggcgaagg

SEQ ID NO: 33840 - DNA, 75 bp, Meleagrid herpesvirus 1
ctaggacggattctgtcgcttcttcgcccgttttggtcctgggctgggagaggcgagtcaaaccttccctcttgg

SEQ ID NO: 33841 - DNA, 24 bp, Meleagrid herpesvirus 1
tctgtcgcttcttcgcccgttttg

SEQ ID NO: 33842 - DNA, 18 bp, Homo sapiens
gctcgaccgcccgttttg

SEQ ID NO: 33843 - DNA, 20 bp, Homo sapiens
tgttgcttgttcccattttg

SEQ ID NO: 33844 - DNA, 62 bp, Human foamy virus
gaggtgtgtggctcaacacgtagggtgacaagaaaatctactgtaataggacacaacacctc

SEQ ID NO: 33845 - DNA, 64 bp, Human herpesvirus 8
tgtccaccggacgagtggcgcggcgaagacgtcgccagcaccagcttctgtcggtgtcatgaca

SEQ ID NO: 33846 - DNA, 24 bp, Human herpesvirus 8
ccagcaccagcttctgtcggtgtc

SEQ ID NO: 33847 - DNA, 19 bp, Homo sapiens
ccagtctggcttctgtagc

SEQ ID NO: 33848 - DNA, 19 bp, Homo sapiens
ccagcatcaggttttctgt

SEQ ID NO: 33849 - DNA, 18 bp, Homo sapiens
cagcacagagcttggtgt

SEQ ID NO: 33850 - DNA, 21 bp, Homo sapiens
cagcatctgcttctgatttgt

SEQ ID NO: 33851 - DNA, 18 bp, Homo sapiens
ccagcacctggctggtgt

SEQ ID NO: 33852 - DNA, 18 bp, Homo sapiens
gcaccagccttagggtgt

SEQ ID NO: 33853 - DNA, 22 bp, Homo sapiens
ccagcgccggctgcttctagtc

SEQ ID NO: 33854 - DNA, 21 bp, Homo sapiens
gcaatggctgaaatcggtgtc

SEQ ID NO: 33855 - DNA, 19 bp, Homo sapiens
ccagcccggtgtccggtgt

SEQ ID NO: 33856 - DNA, 21 bp, Homo sapiens
ccagtgcctgctcgtcggtgt

SEQ ID NO: 33857 - DNA, 17 bp, Homo sapiens
accagcttctcctagtc

SEQ ID NO: 33858 - DNA, 20 bp, Homo sapiens
cagcaccggcttctttaggc

SEQ ID NO: 33859 - DNA, 22 bp, Homo sapiens
ccagggctgggtttgtcggtgt

SEQ ID NO: 33860 - DNA, 22 bp, Homo sapiens
cagtgtcatttctgaacgtgtc

SEQ ID NO: 33861 - DNA, 20 bp, Homo sapiens
gctccagcttcccacttgtc

SEQ ID NO: 33862 - DNA, 22 bp, Homo sapiens
gcgcccggttcgctccggtgtc

SEQ ID NO: 33863 - DNA, 18 bp, Homo sapiens
ccagcatcagcctctgtc

SEQ ID NO: 33864 - DNA, 17 bp, Homo sapiens
gctacttctgttggtgt

SEQ ID NO: 33865 - DNA, 21 bp, Homo sapiens
ccgcgctggcttctgtgaggc

SEQ ID NO: 33866 - DNA, 18 bp, Homo sapiens
ccagtgcctgtctggtgt

SEQ ID NO: 33867 - DNA, 25 bp, Homo sapiens
ccagcaccagcttgctcccagtgtc

SEQ ID NO: 33868 - DNA, 21 bp, Homo sapiens
ccagcaccagttatcttcagt

SEQ ID NO: 33869 - DNA, 16 bp, Homo sapiens
ccagcccagttcggtg

SEQ ID NO: 33870 - DNA, 16 bp, Homo sapiens
agcaccagctgttggc

SEQ ID NO: 33871 - DNA, 19 bp, Homo sapiens
cagcaccagattctccagt

SEQ ID NO: 33872 - DNA, 22 bp, Homo sapiens
ccgggactagcttctgagcctc

SEQ ID NO: 33873 - DNA, 20 bp, Homo sapiens
ccagtactagttcccgttgt

SEQ ID NO: 33874 - DNA, 22 bp, Homo sapiens
ccagctccagctggctggtgtc

SEQ ID NO: 33875 - DNA, 19 bp, Homo sapiens
gcatcagtatcagtctgtc

SEQ ID NO: 33876 - DNA, 20 bp, Homo sapiens
accgtcagcttccaccgtgt

SEQ ID NO: 33877 - DNA, 18 bp, Homo sapiens
cagcatcagtgtctgtgg

SEQ ID NO: 33878 - DNA, 22 bp, Homo sapiens
ccagcatccgctttttcttgtc

SEQ ID NO: 33879 - DNA, 19 bp, Homo sapiens
ccaggccagcttccctgtc

SEQ ID NO: 33880 - DNA, 20 bp, Homo sapiens
ccagcgccggcttatgcggc

SEQ ID NO: 33881 - DNA, 21 bp, Homo sapiens
cagtgctggcttctggggtgt

SEQ ID NO: 33882 - DNA, 18 bp, Homo sapiens
ccagtgccagcctttgcc

SEQ ID NO: 33883 - DNA, 17 bp, Homo sapiens
gcccagcttctcagcac

SEQ ID NO: 33884 - DNA, 22 bp, Homo sapiens
ccagcctcagcttccctatgtc

SEQ ID NO: 33885 - DNA, 22 bp, Homo sapiens
cagtctagcttctgtggaagtc

SEQ ID NO: 33886 - DNA, 19 bp, Homo sapiens
ccagcaccagtttttgagt

SEQ ID NO: 33887 - DNA, 16 bp, Homo sapiens
ccagcgccagtgtgtg

SEQ ID NO: 33888 - DNA, 19 bp, Homo sapiens
ccggcaccggcctctgagt

SEQ ID NO: 33889 - DNA, 21 bp, Homo sapiens
ccagcatcattttctgaggat

SEQ ID NO: 33890 - DNA, 22 bp, Homo sapiens
cagcaccggcgaagttggtgtc

SEQ ID NO: 33891 - DNA, 23 bp, Homo sapiens
taagcaccagttggtttggtgtc

SEQ ID NO: 33892 - DNA, 23 bp, Homo sapiens
ccagtactgctttggacagtgtc

SEQ ID NO: 33893 - DNA, 16 bp, Homo sapiens
accagcttttaaatgt

SEQ ID NO: 33894 - DNA, 23 bp, Homo sapiens
agcaccagctgtaaccaagtgtc

SEQ ID NO: 33895 - DNA, 90 bp, Human herpesvirus 8
gtattatcgtcccgttcccagaaggagtatgcgtcgttgggtcggagcccatggtggcactcactggcattctaaacaggacgataaagc

SEQ ID NO: 33896 - DNA, 24 bp, Human herpesvirus 8
aggagtatgcgtcgttgggtcgga

SEQ ID NO: 33897 - DNA, 19 bp, Homo sapiens
aggggtgggcgttgagcgg

SEQ ID NO: 33898 - DNA, 20 bp, Homo sapiens
aggggttgtttttgggtcgg

SEQ ID NO: 33899 - DNA, 18 bp, Homo sapiens
aggggtagtgagggtcgg

SEQ ID NO: 33900 - DNA, 20 bp, Homo sapiens
aggggtgtgcgccgcgtggg

SEQ ID NO: 33901 - DNA, 19 bp, Homo sapiens
agtggtgtgcaggggtcgg

SEQ ID NO: 33902 - DNA, 22 bp, Homo sapiens
ggaggggttgttgttgggtcgg

SEQ ID NO: 33903 - DNA, 16 bp, Homo sapiens
agggtgtgtggggtcg

SEQ ID NO: 33904 - DNA, 17 bp, Homo sapiens
ggagtgtgtgtgttgga

SEQ ID NO: 33905 - DNA, 21 bp, Homo sapiens
ggagggtgcggggtgggtcgg

SEQ ID NO: 33906 - DNA, 20 bp, Homo sapiens
aggagtactgcgtgggtcgg

SEQ ID NO: 33907 - DNA, 19 bp, Homo sapiens
gggtgtgtgtgcgggtcgg

SEQ ID NO: 33908 - DNA, 22 bp, Homo sapiens
ggagcatgcgtttgaatttgga

SEQ ID NO: 33909 - DNA, 92 bp, Human herpesvirus 8
ggtcatgtcggccgaatcatctatagcatcatggatcgcaatgagaattttttagaaaacaagaccattagctatctgccggccaaaatacc

SEQ ID NO: 33910 - DNA, 18 bp, Human herpesvirus 8
tctgccggccaaaatacc

SEQ ID NO: 33911 - DNA, 18 bp, Homo sapiens
ccgaccgaccaggatacc

SEQ ID NO: 33912 - DNA, 17 bp, Homo sapiens
cctgtgaccaaaatacc

SEQ ID NO: 33913 - DNA, 18 bp, Homo sapiens
tctattagctaaaatacc

SEQ ID NO: 33914 - DNA, 16 bp, Homo sapiens
tctgagccaaaatgcc

SEQ ID NO: 33915 - DNA, 19 bp, Homo sapiens
gccaaaatgccaaaatacc

SEQ ID NO: 33916 - DNA, 18 bp, Homo sapiens
tgcacataccaaaatacc

SEQ ID NO: 33917 - DNA, 18 bp, Homo sapiens
cctgccaaatcaaagtac

SEQ ID NO: 33918 - DNA, 19 bp, Homo sapiens
tctgccagccacgcatgcc

SEQ ID NO: 33919 - DNA, 17 bp, Homo sapiens
tctgtgctcaaaatacc

SEQ ID NO: 33920 - DNA, 19 bp, Homo sapiens
tctaccaacagcaagatac

SEQ ID NO: 33921 - DNA, 18 bp, Homo sapiens
cctgcagcctaaaatacc

SEQ ID NO: 33922 - DNA, 15 bp, Homo sapiens
tctaccagcaatacc

SEQ ID NO: 33923 - DNA, 15 bp, Homo sapiens
tctgccagccacacc

SEQ ID NO: 33924 - DNA, 18 bp, Homo sapiens
cctacaggttaaaatacc

SEQ ID NO: 33925 - DNA, 18 bp, Homo sapiens
ctgacaagctaaaatacc

SEQ ID NO: 33926 - DNA, 15 bp, Homo sapiens
tctgcccaaaatacc

SEQ ID NO: 33927 - DNA, 17 bp, Homo sapiens
tctcctggccacacacc

SEQ ID NO: 33928 - DNA, 123 bp, Ateline herpesvirus 3
tctctaatttttgccgggttaaaacatagacacaaaagacagtataataaaaatagaacaccattttattttgtcttttttccaatgtgtttaacaaggtatcttcgccctatcagtttgaga

SEQ ID NO: 33929 - DNA, 24 bp, Ateline herpesvirus 3
tgccgggttaaaacatagacacaa

SEQ ID NO: 33930 - DNA, 22 bp, Homo sapiens
tgccgggtaaaagacatataca

SEQ ID NO: 33931 - DNA, 19 bp, Homo sapiens
agctaaaagcataggcaca

SEQ ID NO: 33932 - DNA, 19 bp, Homo sapiens
ccgggttaaaaagctatag

SEQ ID NO: 33933 - DNA, 18 bp, Homo sapiens
tgcagggttaaaatacaa

SEQ ID NO: 33934 - DNA, 17 bp, Homo sapiens
tgccgggctgcaggcac

SEQ ID NO: 33935 - DNA, 18 bp, Homo sapiens
ggatcaatatagacacaa

SEQ ID NO: 33936 - DNA, 19 bp, Homo sapiens
gctgggttaggtaaacaca

SEQ ID NO: 33937 - DNA, 20 bp, Homo sapiens
agctaaaaacatagatgcaa

SEQ ID NO: 33938 - DNA, 21 bp, Homo sapiens
tgctgggtaaaacacatcaca

SEQ ID NO: 33939 - DNA, 16 bp, Homo sapiens
ccgggttacaggcaca

SEQ ID NO: 33940 - DNA, 94 bp, Saimiriine herpesvirus 2
tattagctatgctcactaaacttcattaatcaagcttaatttttttatttgttataaaatatatacttgtagtagtttgtgcagtatgtttgtg

SEQ ID NO: 33941 - DNA, 24 bp, Saimiriine herpesvirus 2
acttcattaatcaagcttaatttt

SEQ ID NO: 33942 - DNA, 23 bp, Homo sapiens
ttcattaattattactcaatttt

SEQ ID NO: 33943 - DNA, 23 bp, Homo sapiens
acttcactagcaattttaatttt

SEQ ID NO: 33944 - DNA, 17 bp, Homo sapiens
acttattaatcagctta

SEQ ID NO: 33945 - DNA, 82 bp, Saimiriine herpesvirus 2
agtttactatttagctacaagtttcttaaaaacaatattttgtatattgtttttaagaaacttgtagctagttttttgaact

SEQ ID NO: 33946 - DNA, 24 bp, Saimiriine herpesvirus 2
caagtttcttaaaaacaatatttt

SEQ ID NO: 33947 - DNA, 22 bp, Homo sapiens
aagtttcttaaaatgttatttt

SEQ ID NO: 33948 - DNA, 19 bp, Homo sapiens
caagtttctttaaaagcaa

SEQ ID NO: 33949 - DNA, 17 bp, Homo sapiens
caagtttttaaaaacaa

SEQ ID NO: 33950 - DNA, 21 bp, Homo sapiens
agtttcttaataaaatatttt

SEQ ID NO: 33951 - DNA, 25 bp, Homo sapiens
caagtctcttaggagctactatttt

SEQ ID NO: 33952 - DNA, 83 bp, Saimiriine herpesvirus 2
ctttattacttaaattttgtttaaatagctacaaatttattaagcatagagcattgctttataaacaatttttagttttagag

SEQ ID NO: 33953 - DNA, 24 bp, Saimiriine herpesvirus 2
gagcattgctttataaacaatttt

SEQ ID NO: 33954 - DNA, 24 bp, Homo sapiens
gagtattgctttaatggtcaattt

SEQ ID NO: 33955 - DNA, 21 bp, Homo sapiens
gcctaaaccataaacaatttt

SEQ ID NO: 33956 - DNA, 19 bp, Homo sapiens
gagcattgcttgataaaca

SEQ ID NO: 33957 - DNA, 16 bp, Homo sapiens
aagcatttaaacaatt

SEQ ID NO: 33958 - DNA, 66 bp, Camelpox virus
aacaaagaaatggaaatcgtaataccagttatgttcaactttgaaattgttttttattttcttgtt

SEQ ID NO: 33959 - DNA, 24 bp, Camelpox virus
tatgttcaactttgaaattgtttt

SEQ ID NO: 33960 - DNA, 23 bp, Homo sapiens
tatgtacaactttgatacagttt

SEQ ID NO: 33961 - DNA, 16 bp, Homo sapiens
gttcaggaaattgttt

SEQ ID NO: 33962 - DNA, 23 bp, Homo sapiens
tatgttcaaaataaagttgtttt

SEQ ID NO: 33963 - DNA, 16 bp, Homo sapiens
gttcaacttcctgttt

SEQ ID NO: 33964 - DNA, 107 bp, Cowpox virus
agttgtcgcaacagggtagctcgtaaactttaatgtataacagagacatctgtaaaaagataaactttatatattgtaccaaagatttaaatcctaatttgatagct

SEQ ID NO: 33965 - DNA, 24 bp, Cowpox virus
tatattgtaccaaagatttaaatc

SEQ ID NO: 33966 - DNA, 23 bp, Homo sapiens
tacagattaccagggatttaaat

SEQ ID NO: 33967 - DNA, 21 bp, Homo sapiens
ttgtaccaaacatcaaaaatc

SEQ ID NO: 33968 - DNA, 18 bp, Homo sapiens
tatattgtattaaagatc

SEQ ID NO: 33969 - DNA, 77 bp, Feline leukemia virus
tgcaaccccctgattttgcagttcacccagaagggaagacaagcctcttgggacggacctaagatatggggattgcg

SEQ ID NO: 33970 - DNA, 24 bp, Feline leukemia virus
cccctgattttgcagttcacccag

SEQ ID NO: 33971 - DNA, 23 bp, Homo sapiens
tgattgtgcagttctgattccag

SEQ ID NO: 33972 - DNA, 16 bp, Homo sapiens
cctgacttacaatcac

SEQ ID NO: 33973 - DNA, 17 bp, Homo sapiens
cccctgatgttggttca

SEQ ID NO: 33974 - DNA, 22 bp, Homo sapiens
cccctgatttagtataagttca

SEQ ID NO: 33975 - DNA, 15 bp, Homo sapiens
ctaattattcaccca

SEQ ID NO: 33976 - DNA, 24 bp, Homo sapiens
cccttggttctgcagtccaaacag

SEQ ID NO: 33977 - DNA, 15 bp, Homo sapiens
ctgattttgcaccca

SEQ ID NO: 33978 - DNA, 15 bp, Homo sapiens
ctgattttgccccca

SEQ ID NO: 33979 - DNA, 24 bp, Homo sapiens
ccgctgatttctgcattcattcag

SEQ ID NO: 33980 - DNA, 16 bp, Homo sapiens
cctctgacttcttcac

SEQ ID NO: 33981 - DNA, 18 bp, Homo sapiens
cctctattttgcagaccc

SEQ ID NO: 33982 - DNA, 21 bp, Homo sapiens
ctgtattagcagttcactcag

SEQ ID NO: 33983 - DNA, 17 bp, Homo sapiens
cctgacttcatcactca

SEQ ID NO: 33984 - DNA, 19 bp, Homo sapiens
atttgtgcacttcacccag

SEQ ID NO: 33985 - DNA, 25 bp, Homo sapiens
ccttgattttgaagaagtagcccag

SEQ ID NO: 33986 - DNA, 15 bp, Homo sapiens
cctgattttcaccca

SEQ ID NO: 33987 - DNA, 16 bp, Homo sapiens
ccctgatttgaggccc

SEQ ID NO: 33988 - DNA, 19 bp, Homo sapiens
cctcaccctgtggttcgcc

SEQ ID NO: 33989 - DNA, 15 bp, Homo sapiens
tgatttcagccaccc

SEQ ID NO: 33990 - DNA, 21 bp, Homo sapiens
ctgattttgcagagctcccag

SEQ ID NO: 33991 - DNA, 22 bp, Homo sapiens
ccttgtttctgagttcacccag

SEQ ID NO: 33992 - DNA, 21 bp, Homo sapiens
ccctgatttctgcaagaccag

SEQ ID NO: 33993 - DNA, 21 bp, Homo sapiens
ctagattttctcgtcacccag

SEQ ID NO: 33994 - DNA, 16 bp, Homo sapiens
ctgatttcatcatcca

SEQ ID NO: 33995 - DNA, 24 bp, Homo sapiens
cctctaattttgtaaactgcccag

SEQ ID NO: 33996 - DNA, 22 bp, Homo sapiens
ccttgggtttacagctacccag

SEQ ID NO: 33997 - DNA, 23 bp, Homo sapiens
cctgatttgcatcttgaatccag

SEQ ID NO: 33998 - DNA, 15 bp, Homo sapiens
cctgattttgaaacc

SEQ ID NO: 33999 - DNA, 20 bp, Homo sapiens
ctggaaattgcagttcatcc

SEQ ID NO: 34000 - DNA, 22 bp, Homo sapiens
tgtttttgtagcccccatccag

SEQ ID NO: 34001 - DNA, 130 bp, Human herpesvirus 5
cgtgtgtatattattttttttttttgtgtgtgtttgcgcccccgtgtgtctaatgtgctgtttgaaacacgtaaagtagctggtggaagaacagataaacctttaataaaaaaaaaagtatgtgctcccg

SEQ ID NO: 34002 - DNA, 24 bp, Human herpesvirus 5
tgtatattattttttttttttgtg

SEQ ID NO: 34003 - DNA, 30 bp, Homo sapiens
tgtatatatttttttattatttttttgtgc

SEQ ID NO: 34004 - DNA, 22 bp, Homo sapiens
tgtatattatttttattcaatg

SEQ ID NO: 34005 - DNA, 24 bp, Homo sapiens
tgtatatatacatttttttttgtg

SEQ ID NO: 34006 - DNA, 100 bp, Human adenovirus A
gtccaggctaaacgaccgccttttctagaacaaaaaggaggaagaacatccaactgattttcatctggggggtcggcatctatagtaaaaatgccaggac

SEQ ID NO: 34007 - DNA, 24 bp, Human adenovirus A
tctagaacaaaaaggaggaagaac

SEQ ID NO: 34008 - DNA, 17 bp, Homo sapiens
tagagtaaggaggaaga

SEQ ID NO: 34009 - DNA, 20 bp, Homo sapiens
tctagacaaaaaaaaaagaa

SEQ ID NO: 34010 - DNA, 16 bp, Homo sapiens
tagaacaggaaggaag

SEQ ID NO: 34011 - DNA, 17 bp, Homo sapiens
tccagaacaagtggagg

SEQ ID NO: 34012 - DNA, 22 bp, Homo sapiens
tcaagaacaaaatacagggagg

SEQ ID NO: 34013 - DNA, 22 bp, Homo sapiens
tctagagtaaaagaggggagga

SEQ ID NO: 34014 - DNA, 21 bp, Homo sapiens
tctagaggggggaaaaaggag

SEQ ID NO: 34015 - DNA, 23 bp, Homo sapiens
tctaggacaaaaagggcggagga

SEQ ID NO: 34016 - DNA, 17 bp, Homo sapiens
tagaagcaagaaggaag

SEQ ID NO: 34017 - DNA, 17 bp, Homo sapiens
tctaaataaaaagagga

SEQ ID NO: 34018 - DNA, 22 bp, Homo sapiens
tagaacaagggttggcaggaga

SEQ ID NO: 34019 - DNA, 16 bp, Homo sapiens
tagaaaaaaggggaag

SEQ ID NO: 34020 - DNA, 21 bp, Homo sapiens
tctaagacagggaggaaagaa

SEQ ID NO: 34021 - DNA, 21 bp, Homo sapiens
tctgagcggaaaggagagaag

SEQ ID NO: 34022 - DNA, 17 bp, Homo sapiens
tctgagcaagaagaagg

SEQ ID NO: 34023 - DNA, 21 bp, Homo sapiens
cctaggcaaaggaggaggaag

SEQ ID NO: 34024 - DNA, 18 bp, Homo sapiens
tctagaatgaaaaagaaa

SEQ ID NO: 34025 - DNA, 20 bp, Homo sapiens
tcttgagcaaagggaagaag

SEQ ID NO: 34026 - DNA, 17 bp, Homo sapiens
tctaggaggaggaagaa

SEQ ID NO: 34027 - DNA, 20 bp, Homo sapiens
tctaaaacagaaggtgagga

SEQ ID NO: 34028 - DNA, 21 bp, Homo sapiens
tctagaggaaaaaggcttaag

SEQ ID NO: 34029 - DNA, 16 bp, Homo sapiens
cctagaatggagaaag

SEQ ID NO: 34030 - DNA, 18 bp, Homo sapiens
tctagaggaaaggatgaa

SEQ ID NO: 34031 - DNA, 18 bp, Homo sapiens
taaaacaaagagaacaga

SEQ ID NO: 34032 - DNA, 18 bp, Homo sapiens
tctagaggaaaagggaaa

SEQ ID NO: 34033 - DNA, 19 bp, Homo sapiens
ctggaaggaaaaaggagga

SEQ ID NO: 34034 - DNA, 21 bp, Homo sapiens
tccagaggaaaagagggagga

SEQ ID NO: 34035 - DNA, 20 bp, Homo sapiens
tctggataaaaggaggcaag

SEQ ID NO: 34036 - DNA, 21 bp, Homo sapiens
taaaacaaagggagaaagaac

SEQ ID NO: 34037 - DNA, 20 bp, Homo sapiens
ctagggtaaaaggaagagga

SEQ ID NO: 34038 - DNA, 20 bp, Homo sapiens
tcaagggcaggaagaggaag

SEQ ID NO: 34039 - DNA, 24 bp, Homo sapiens
tctgggatgaaaggagaagggaac

SEQ ID NO: 34040 - DNA, 16 bp, Homo sapiens
tctgaacgaaggagga

SEQ ID NO: 34041 - DNA, 20 bp, Homo sapiens
ctagaatgaaaggaaagaga

SEQ ID NO: 34042 - DNA, 19 bp, Homo sapiens
tccagggcaaaaaggagaa

SEQ ID NO: 34043 - DNA, 22 bp, Homo sapiens
tcgagaatggaataggaagaac

SEQ ID NO: 34044 - DNA, 18 bp, Homo sapiens
tagaacaaagagatgagg

SEQ ID NO: 34045 - DNA, 21 bp, Homo sapiens
cctgggacaaaagaagaaaga

SEQ ID NO: 34046 - DNA, 20 bp, Homo sapiens
aaaataaaagggaggaagaa

SEQ ID NO: 34047 - DNA, 22 bp, Homo sapiens
tctcagattcaaggaggaggaa

SEQ ID NO: 34048 - DNA, 21 bp, Homo sapiens
tctaggacggaagggagaaag

SEQ ID NO: 34049 - DNA, 18 bp, Homo sapiens
tctggaagcaagggagga

SEQ ID NO: 34050 - DNA, 20 bp, Homo sapiens
tctcaaaaaagggggaagaa

SEQ ID NO: 34051 - DNA, 23 bp, Homo sapiens
tctagagcaagaaaaagcgggag

SEQ ID NO: 34052 - DNA, 22 bp, Homo sapiens
tctggagcagggggaggaagaa

SEQ ID NO: 34053 - DNA, 18 bp, Homo sapiens
tctagaaccaaggaagaa

SEQ ID NO: 34054 - DNA, 19 bp, Homo sapiens
tctaaacaaataaggagaa

SEQ ID NO: 34055 - DNA, 21 bp, Homo sapiens
tccagaacaaaaacaaaagga

SEQ ID NO: 34056 - DNA, 20 bp, Homo sapiens
acaaaagaaggagggggaac

SEQ ID NO: 34057 - DNA, 19 bp, Homo sapiens
cctagaacagcaggaagga

SEQ ID NO: 34058 - DNA, 16 bp, Homo sapiens
tctagaataagaagaa

SEQ ID NO: 34059 - DNA, 16 bp, Homo sapiens
tagaaaaggaggaaga

SEQ ID NO: 34060 - DNA, 20 bp, Homo sapiens
taaaacaaagagagcagaac

SEQ ID NO: 34061 - DNA, 20 bp, Homo sapiens
cctagaacaagaaataagga

SEQ ID NO: 34062 - DNA, 24 bp, Homo sapiens
tagaaaaaatacctgaggaagaac

SEQ ID NO: 34063 - DNA, 22 bp, Homo sapiens
cagaacaagggtacaaaaggaa

SEQ ID NO: 34064 - DNA, 20 bp, Homo sapiens
caaatggaaggaggaggaac

SEQ ID NO: 34065 - DNA, 22 bp, Homo sapiens
tctagggggaaaaaaagggaac

SEQ ID NO: 34066 - DNA, 20 bp, Homo sapiens
tctggaaccaaaaggaagaa

SEQ ID NO: 34067 - DNA, 23 bp, Homo sapiens
tagaacaagaagcccataaagga

SEQ ID NO: 34068 - DNA, 18 bp, Homo sapiens
tccagaacagggaggaga

SEQ ID NO: 34069 - DNA, 15 bp, Homo sapiens
tctagaaaaagagga

SEQ ID NO: 34070 - DNA, 16 bp, Homo sapiens
cagaacaaggaagaga

SEQ ID NO: 34071 - DNA, 19 bp, Homo sapiens
tccagggcggcaggaagaa

SEQ ID NO: 34072 - DNA, 16 bp, Homo sapiens
tctaggaaaggaagaa

SEQ ID NO: 34073 - DNA, 16 bp, Homo sapiens
tctagaaaagaagaga

SEQ ID NO: 34074 - DNA, 22 bp, Homo sapiens
tctagaacagaaatacaagggg

SEQ ID NO: 34075 - DNA, 20 bp, Homo sapiens
tctagaacaaagttctggag

SEQ ID NO: 34076 - DNA, 21 bp, Homo sapiens
tagaggggaaaagaaaaagaa

SEQ ID NO: 34077 - DNA, 20 bp, Homo sapiens
tctagagcatgaaggaaaaa

SEQ ID NO: 34078 - DNA, 21 bp, Homo sapiens
tctagaatataaagaaaagaa

SEQ ID NO: 34079 - DNA, 19 bp, Homo sapiens
caaaggagggaggaagaac

SEQ ID NO: 34080 - DNA, 19 bp, Homo sapiens
tctggaacaaaacacagga

SEQ ID NO: 34081 - DNA, 17 bp, Homo sapiens
gaaaaaaaggaaaaaaa

SEQ ID NO: 34082 - DNA, 19 bp, Homo sapiens
tctagaagaaaagattgga

SEQ ID NO: 34083 - DNA, 18 bp, Homo sapiens
ctaggacaaggaggaaga

SEQ ID NO: 34084 - DNA, 22 bp, Homo sapiens
tctacaacagaagggaagaaaa

SEQ ID NO: 34085 - DNA, 16 bp, Homo sapiens
tctaggaaagagaaag

SEQ ID NO: 34086 - DNA, 22 bp, Homo sapiens
tctggaatgtagggggaaaaac

SEQ ID NO: 34087 - DNA, 19 bp, Homo sapiens
tctagcagcaaggagaaga

SEQ ID NO: 34088 - DNA, 19 bp, Homo sapiens
tctagaggaaaaggcagga

SEQ ID NO: 34089 - DNA, 20 bp, Homo sapiens
cagagtgaaagggaagaaaa

SEQ ID NO: 34090 - DNA, 18 bp, Homo sapiens
tccagggcagaaggagga

SEQ ID NO: 34091 - DNA, 20 bp, Homo sapiens
tagaggaaagggagaaagaa

SEQ ID NO: 34092 - DNA, 17 bp, Homo sapiens
tctggaaaaggaagaag

SEQ ID NO: 34093 - DNA, 19 bp, Homo sapiens
tctgaaacaagaaggaaaa

SEQ ID NO: 34094 - DNA, 21 bp, Homo sapiens
tcatagagtaggaggaaagaa

SEQ ID NO: 34095 - DNA, 22 bp, Homo sapiens
tctggggcaaaaaagagaaaaa

SEQ ID NO: 34096 - DNA, 20 bp, Homo sapiens
tagaacaaaaaagaaagaac

SEQ ID NO: 34097 - DNA, 19 bp, Homo sapiens
tagaacaaaaaggttgaag

SEQ ID NO: 34098 - DNA, 19 bp, Homo sapiens
ccagaagaaggaggaagaa

SEQ ID NO: 34099 - DNA, 19 bp, Homo sapiens
tagaacagaggaaacggaa

SEQ ID NO: 34100 - DNA, 18 bp, Homo sapiens
aaacaaaataaaaaagaa

SEQ ID NO: 34101 - DNA, 22 bp, Homo sapiens
tctggaagggaaaggaaagaag

SEQ ID NO: 34102 - DNA, 22 bp, Homo sapiens
tccagaacagaaaatagggaag

SEQ ID NO: 34103 - DNA, 17 bp, Homo sapiens
taaaacccaggaggaag

SEQ ID NO: 34104 - DNA, 18 bp, Homo sapiens
tctataacaaaaatggaa

SEQ ID NO: 34105 - DNA, 22 bp, Homo sapiens
tctgaacaaaactataaaggaa

SEQ ID NO: 34106 - DNA, 19 bp, Homo sapiens
taaaacaaaagcaaaaaga

SEQ ID NO: 34107 - DNA, 24 bp, Homo sapiens
ctagaacaaaaaactgacaagaac

SEQ ID NO: 34108 - DNA, 21 bp, Homo sapiens
ctagaacagaaatttagggga

SEQ ID NO: 34109 - DNA, 21 bp, Homo sapiens
tagaacaatgctccaaagaac

SEQ ID NO: 34110 - DNA, 19 bp, Homo sapiens
tctggagagaaaaggagaa

SEQ ID NO: 34111 - DNA, 17 bp, Homo sapiens
tctggaaaaaggggaag

SEQ ID NO: 34112 - DNA, 20 bp, Homo sapiens
cctagggcaagggaaggaag

SEQ ID NO: 34113 - DNA, 18 bp, Homo sapiens
tccaggacagaaaggaaa

SEQ ID NO: 34114 - DNA, 16 bp, Homo sapiens
taaaacaagaagagaa

SEQ ID NO: 34115 - DNA, 25 bp, Homo sapiens
tctagaggcaaaaaggattccagaa

SEQ ID NO: 34116 - DNA, 21 bp, Homo sapiens
tctagcaataaaaggaatgaa

SEQ ID NO: 34117 - DNA, 17 bp, Homo sapiens
tctagaaggaaggggaa

SEQ ID NO: 34118 - DNA, 19 bp, Homo sapiens
gaacagaaagggaaaaaac

SEQ ID NO: 34119 - DNA, 18 bp, Homo sapiens
tcaggaacataaggaaga

SEQ ID NO: 34120 - DNA, 24 bp, Homo sapiens
tctagaaaaaaatgatcaaagaac

SEQ ID NO: 34121 - DNA, 18 bp, Homo sapiens
tctggaacgaagagaaaa

SEQ ID NO: 34122 - DNA, 17 bp, Homo sapiens
tctagaactggaaaaag

SEQ ID NO: 34123 - DNA, 17 bp, Homo sapiens
tagagcaaaaggaaaaa

SEQ ID NO: 34124 - DNA, 17 bp, Homo sapiens
tagaaagaaggaacgaa

SEQ ID NO: 34125 - DNA, 18 bp, Homo sapiens
tccagaataaagaggaga

SEQ ID NO: 34126 - DNA, 16 bp, Homo sapiens
tagaacaaaggaagaa

SEQ ID NO: 34127 - DNA, 19 bp, Homo sapiens
tctagaacaagaatgtagg

SEQ ID NO: 34128 - DNA, 19 bp, Homo sapiens
tctaggacaaaaaaaggaa

SEQ ID NO: 34129 - DNA, 19 bp, Homo sapiens
tctaaacaaggaggatgaa

SEQ ID NO: 34130 - DNA, 18 bp, Homo sapiens
tctagagcacagaaagaa

SEQ ID NO: 34131 - DNA, 21 bp, Homo sapiens
tctagactggaaaggaagaag

SEQ ID NO: 34132 - DNA, 20 bp, Homo sapiens
tctggaacaaaagctaggag

SEQ ID NO: 34133 - DNA, 23 bp, Homo sapiens
tctagatcaggaaaaacaaggaa

SEQ ID NO: 34134 - DNA, 16 bp, Homo sapiens
cctagaatggagaaaa

SEQ ID NO: 34135 - DNA, 19 bp, Homo sapiens
tctagagaaagagggcaga

SEQ ID NO: 34136 - DNA, 18 bp, Homo sapiens
tcaagaacaaaaacagag

SEQ ID NO: 34137 - DNA, 16 bp, Homo sapiens
ctagaacaaaagagga

SEQ ID NO: 34138 - DNA, 15 bp, Homo sapiens
tctaaacaaaggagg

SEQ ID NO: 34139 - DNA, 18 bp, Homo sapiens
tctggaatgaaagaagga

SEQ ID NO: 34140 - DNA, 18 bp, Homo sapiens
tctggaacaaaagggcag

SEQ ID NO: 34141 - DNA, 21 bp, Homo sapiens
tctaaaacagaaaaataagga

SEQ ID NO: 34142 - DNA, 18 bp, Homo sapiens
tctaagcaatgaggaaga

SEQ ID NO: 34143 - DNA, 19 bp, Homo sapiens
tagaacaaaatagatggaa

SEQ ID NO: 34144 - DNA, 23 bp, Homo sapiens
tctaaattctaaggaggaagaac

SEQ ID NO: 34145 - DNA, 21 bp, Homo sapiens
tagaacaaaatttcctaggag

SEQ ID NO: 34146 - DNA, 20 bp, Homo sapiens
tagggacaggggaggaaaga

SEQ ID NO: 34147 - DNA, 18 bp, Homo sapiens
tctagaactaaaagaaga

SEQ ID NO: 34148 - DNA, 24 bp, Homo sapiens
cagaacaaaaaggcctgtgggaac

SEQ ID NO: 34149 - DNA, 19 bp, Homo sapiens
tctggaacaagaaagatga

SEQ ID NO: 34150 - DNA, 23 bp, Homo sapiens
tcttaaaaaaagggaggaagaac

SEQ ID NO: 34151 - DNA, 23 bp, Homo sapiens
tctgggacaaaaagggaaaagaa

SEQ ID NO: 34152 - DNA, 16 bp, Homo sapiens
tctagggcaggaagaa

SEQ ID NO: 34153 - DNA, 22 bp, Homo sapiens
tctatagcaagaaggactagaa

SEQ ID NO: 34154 - DNA, 20 bp, Homo sapiens
taaaacaaactattggagga

SEQ ID NO: 34155 - DNA, 18 bp, Homo sapiens
ctggaacaaaagtgaaga

SEQ ID NO: 34156 - DNA, 17 bp, Homo sapiens
tctaggaaggagaagga

SEQ ID NO: 34157 - DNA, 19 bp, Homo sapiens
tctgggaccaaggagaaag

SEQ ID NO: 34158 - DNA, 17 bp, Homo sapiens
tagaacaaagaataaga

SEQ ID NO: 34159 - DNA, 15 bp, Homo sapiens
tctagaaaaggaaga

SEQ ID NO: 34160 - DNA, 20 bp, Homo sapiens
gagcaaaaaagataaaagaa

SEQ ID NO: 34161 - DNA, 18 bp, Homo sapiens
aacaaaaaggcacaaaga

SEQ ID NO: 34162 - DNA, 19 bp, Homo sapiens
tagtataaaaaggaaaaag

SEQ ID NO: 34163 - DNA, 102 bp, Meleagrid herpesvirus 1
gttgatgcacatggtagactgtgtgtctgtgtcattcaacagtgctttgcgacgaagtgtgggaataataaattgcgcacgctttttaccgtggacgtcgat

SEQ ID NO: 34164 - DNA, 24 bp, Meleagrid herpesvirus 1
ttgcgcacgctttttaccgtggac

SEQ ID NO: 34165 - DNA, 19 bp, Homo sapiens
ttgcgcacattagtgtgga

SEQ ID NO: 34166 - DNA, 64 bp, Human adenovirus A
ggcattacctctgtactcaacgtgtcagtttctataaacgatgaggatttgatgtttaatcgcc

SEQ ID NO: 34167 - DNA, 17 bp, Human adenovirus A
tttgatgtttaatcgcc

SEQ ID NO: 34168 - DNA, 18 bp, Homo sapiens
tttgatgctgcaaatgcc

SEQ ID NO: 34169 - DNA, 18 bp, Homo sapiens
cttgatgccaagatcgcc

SEQ ID NO: 34170 - DNA, 19 bp, Homo sapiens
tttgatgtttatacctgcc

SEQ ID NO: 34171 - DNA, 88 bp, Ectromelia virus
taatttgttactaatttctttatccacatattcgttagaattgtcatgagtgaattcgaatgtgtaaggaggttgctgtaacacgtta

SEQ ID NO: 34172 - DNA, 24 bp, Ectromelia virus
tttgttactaatttctttatccac

SEQ ID NO: 34173 - DNA, 21 bp, Homo sapiens
gttacttaatactttatccac

SEQ ID NO: 34174 - DNA, 18 bp, Homo sapiens
tttattactaaaatatcc

SEQ ID NO: 34175 - DNA, 21 bp, Homo sapiens
tcactttaatttctttattca

SEQ ID NO: 34176 - DNA, 22 bp, Homo sapiens
tttgtcaaacatttttatccac

SEQ ID NO: 34177 - DNA, 18 bp, Homo sapiens
tttgtcactaattacttt

SEQ ID NO: 34178 - DNA, 20 bp, Homo sapiens
tttgttactatgcttatcca

SEQ ID NO: 34179 - DNA, 22 bp, Homo sapiens
tttgttactggtgtcttaacca

SEQ ID NO: 34180 - DNA, 24 bp, Homo sapiens
tttcttatcttcttctttatccac

SEQ ID NO: 34181 - DNA, 18 bp, Homo sapiens
tttgctactgatttcttc

SEQ ID NO: 34182 - DNA, 21 bp, Homo sapiens
tttgttactgatttcctcctc

SEQ ID NO: 34183 - DNA, 105 bp, Bovine herpesvirus 4
aagtgatcacagcctgagaaaggaggccacagcgaaggccgcgtgccccgagctgcaagtggagaaggatgctgggccttcaggattaaatgttgttggttattt

SEQ ID NO: 34184 - DNA, 24 bp, Bovine herpesvirus 4
aggaggccacagcgaaggccgcgt

SEQ ID NO: 34185 - DNA, 17 bp, Homo sapiens
ggaggcccgaggccgcg

SEQ ID NO: 34186 - DNA, 17 bp, Homo sapiens
ggaggcaggaggctgcg

SEQ ID NO: 34187 - DNA, 18 bp, Homo sapiens
ggcgggccacagcggagg

SEQ ID NO: 34188 - DNA, 25 bp, Homo sapiens
agggggctgcggtgtgggggcgcgt

SEQ ID NO: 34189 - DNA, 18 bp, Homo sapiens
aggagccacagtgaggcc

SEQ ID NO: 34190 - DNA, 23 bp, Homo sapiens
ggaggccaaggtgggcagatcgt

SEQ ID NO: 34191 - DNA, 21 bp, Homo sapiens
gggagcctgcagtgagggcgt

SEQ ID NO: 34192 - DNA, 21 bp, Homo sapiens
ggaggccgcgcggaggctgcg

SEQ ID NO: 34193 - DNA, 19 bp, Homo sapiens
gggggccacagacccccgt

SEQ ID NO: 34194 - DNA, 22 bp, Homo sapiens
ggcaggctgcagagagccgcgt

SEQ ID NO: 34195 - DNA, 16 bp, Homo sapiens
ggaggccacggcgagc

SEQ ID NO: 34196 - DNA, 22 bp, Homo sapiens
aggaggccacagagggaaaagg

SEQ ID NO: 34197 - DNA, 18 bp, Homo sapiens
ggaggccacgggaagccc

SEQ ID NO: 34198 - DNA, 21 bp, Homo sapiens
aggaggccactagtgaggagg

SEQ ID NO: 34199 - DNA, 19 bp, Homo sapiens
aggaggccactgtggaaga

SEQ ID NO: 34200 - DNA, 16 bp, Homo sapiens
ggaggccgcagcaggc

SEQ ID NO: 34201 - DNA, 16 bp, Homo sapiens
ggaggccacggcagac

SEQ ID NO: 34202 - DNA, 22 bp, Homo sapiens
agggcgccatagtgagccgcgt

SEQ ID NO: 34203 - DNA, 22 bp, Homo sapiens
aggaagcccagtgaggccgtgt

SEQ ID NO: 34204 - DNA, 22 bp, Homo sapiens
ggcaggctggcctgggccgcgt

SEQ ID NO: 34205 - DNA, 18 bp, Homo sapiens
aggaggccacagcagggc

SEQ ID NO: 34206 - DNA, 15 bp, Homo sapiens
gaggccacaggccgg

SEQ ID NO: 34207 - DNA, 18 bp, Homo sapiens
aggaggccccagcgaggc

SEQ ID NO: 34208 - DNA, 21 bp, Homo sapiens
aggaagtcatagcgaagggcc

SEQ ID NO: 34209 - DNA, 17 bp, Homo sapiens
ggaggccacaggctgcg

SEQ ID NO: 34210 - DNA, 18 bp, Homo sapiens
aggaggccgtggcgaggc

SEQ ID NO: 34211 - DNA, 18 bp, Homo sapiens
aggaggcctggcggaggc

SEQ ID NO: 34212 - DNA, 19 bp, Homo sapiens
aggaggccacagaggaagg

SEQ ID NO: 34213 - DNA, 17 bp, Homo sapiens
ggaggccgcagtgaggc

SEQ ID NO: 34214 - DNA, 22 bp, Homo sapiens
aggagcccatctctggccgcgt

SEQ ID NO: 34215 - DNA, 18 bp, Homo sapiens
aggaggccactgcgaaaa

SEQ ID NO: 34216 - DNA, 17 bp, Homo sapiens
ggaggtccagggccgcg

SEQ ID NO: 34217 - DNA, 19 bp, Homo sapiens
aggggtcacagcgaggagg

SEQ ID NO: 34218 - DNA, 22 bp, Homo sapiens
aggagtcggtgtgaggccgcgt

SEQ ID NO: 34219 - DNA, 19 bp, Homo sapiens
ggaggcaggaaggccgcgt

SEQ ID NO: 34220 - DNA, 21 bp, Homo sapiens
aggaggccagggtgaggaaga

SEQ ID NO: 34221 - DNA, 18 bp, Homo sapiens
aggaggccgcatgagccg

SEQ ID NO: 34222 - DNA, 17 bp, Homo sapiens
agggggccacatgaagg

SEQ ID NO: 34223 - DNA, 17 bp, Homo sapiens
ggaggccacagtgaggc

SEQ ID NO: 34224 - DNA, 113 bp, Ectromelia virus
gtcttgtttgtaacatggatatcattaactagattgtatattttatattttatatcttcatatcttaatatattataatagttttcttgtttgagcctatttatatcattgac

SEQ ID NO: 34225 - DNA, 24 bp, Ectromelia virus
ttaatatattataatagttttctt

SEQ ID NO: 34226 - DNA, 18 bp, Homo sapiens
catcttaatagttttctt

SEQ ID NO: 34227 - DNA, 24 bp, Homo sapiens
ttaatatattttggcaattttctt

SEQ ID NO: 34228 - DNA, 26 bp, Homo sapiens
aatatattcatcaaaatagttttctt

SEQ ID NO: 34229 - DNA, 20 bp, Homo sapiens
atatatttgctagttttctt

SEQ ID NO: 34230 - DNA, 60 bp, Human herpesvirus 8
gtggtagcggcacagaatctttccagggctttaaagtcctactgtcccactatataccac

SEQ ID NO: 34231 - DNA, 22 bp, Human herpesvirus 8
ctactgtcccactatataccac

SEQ ID NO: 34232 - DNA, 18 bp, Homo sapiens
tgccccactgtatatcac

SEQ ID NO: 34233 - DNA, 19 bp, Homo sapiens
ctgctgtcccatcatccca

SEQ ID NO: 34234 - DNA, 19 bp, Homo sapiens
cactgtccctgaataccac

SEQ ID NO: 34235 - DNA, 16 bp, Homo sapiens
cactgtcctacatcca

SEQ ID NO: 34236 - DNA, 18 bp, Homo sapiens
tgactgtcccgttatata

SEQ ID NO: 34237 - DNA, 18 bp, Homo sapiens
ctgtcccattaaattcca

SEQ ID NO: 34238 - DNA, 17 bp, Homo sapiens
cactgtctcacacacca

SEQ ID NO: 34239 - DNA, 18 bp, Homo sapiens
cactgtccttcattacca

SEQ ID NO: 34240 - DNA, 19 bp, Homo sapiens
cacttttcactatatatca

SEQ ID NO: 34241 - DNA, 18 bp, Homo sapiens
tactgtcccgttactcac

SEQ ID NO: 34242 - DNA, 19 bp, Homo sapiens
tactgtcccgttccaacac

SEQ ID NO: 34243 - DNA, 20 bp, Homo sapiens
cactgttcagtctataccac

SEQ ID NO: 34244 - DNA, 24 bp, Homo sapiens
ctactgtcttacctcctctaccac

SEQ ID NO: 34245 - DNA, 21 bp, Homo sapiens
ctgctattccatttataccac

SEQ ID NO: 34246 - DNA, 22 bp, Homo sapiens
ccactgtcccaggacctgtcac

SEQ ID NO: 34247 - DNA, 19 bp, Homo sapiens
ctatatcactatatgtcac

SEQ ID NO: 34248 - DNA, 21 bp, Homo sapiens
ctactggaaacctatatacca

SEQ ID NO: 34249 - DNA, 20 bp, Homo sapiens
cactgtcccagcctgaccac

SEQ ID NO: 34250 - DNA, 17 bp, Homo sapiens
ccactgtcccattccac

SEQ ID NO: 34251 - DNA, 19 bp, Homo sapiens
tactgtcccctatttccca

SEQ ID NO: 34252 - DNA, 17 bp, Homo sapiens
ccactgtcccatctcca

SEQ ID NO: 34253 - DNA, 18 bp, Homo sapiens
ctacagtcccactgatat

SEQ ID NO: 34254 - DNA, 18 bp, Homo sapiens
ctactgtcttcactccca

SEQ ID NO: 34255 - DNA, 22 bp, Homo sapiens
ccatgtaaacattatataccac

SEQ ID NO: 34256 - DNA, 19 bp, Homo sapiens
ctactgtctgccatcctat

SEQ ID NO: 34257 - DNA, 19 bp, Homo sapiens
taactgtggcatataccac

SEQ ID NO: 34258 - DNA, 20 bp, Homo sapiens
ctactatccagcatgtacca

SEQ ID NO: 34259 - DNA, 19 bp, Homo sapiens
ctacttttccatataccac

SEQ ID NO: 34260 - DNA, 20 bp, Homo sapiens
cactgtcctgtgtatcccac

SEQ ID NO: 34261 - DNA, 19 bp, Homo sapiens
cactgtttcacacacacca

SEQ ID NO: 34262 - DNA, 21 bp, Homo sapiens
ctgctgtcccactctggccac

SEQ ID NO: 34263 - DNA, 19 bp, Homo sapiens
ctgctgctcccacagccac

SEQ ID NO: 34264 - DNA, 16 bp, Homo sapiens
ctactgtctacaccca

SEQ ID NO: 34265 - DNA, 17 bp, Homo sapiens
ctactgtcatcacatcc

SEQ ID NO: 34266 - DNA, 20 bp, Homo sapiens
ccactgtatggatataccac

SEQ ID NO: 34267 - DNA, 22 bp, Homo sapiens
ccactgtcccagtacttactac

SEQ ID NO: 34268 - DNA, 18 bp, Homo sapiens
ccactgtcctgcacccac

SEQ ID NO: 34269 - DNA, 19 bp, Homo sapiens
ctactgtcccccctcccac

SEQ ID NO: 34270 - DNA, 18 bp, Homo sapiens
ctacttcaaaatatacca

SEQ ID NO: 34271 - DNA, 17 bp, Homo sapiens
ctgtcccaccccaccac

SEQ ID NO: 34272 - DNA, 80 bp, Bovine herpesvirus 4
tgttaaaagaggaatgagttctagcaagctctaaataaatatttctgagacttggtggaactggtttgtctatgtgaaca

SEQ ID NO: 34273 - DNA, 24 bp, Bovine herpesvirus 4
tgagttctagcaagctctaaataa

SEQ ID NO: 34274 - DNA, 21 bp, Homo sapiens
tgtagttctatttctaaataa

SEQ ID NO: 34275 - DNA, 21 bp, Homo sapiens
tgagttctattgctaaaataa

SEQ ID NO: 34276 - DNA, 17 bp, Homo sapiens
agctgcaagttctaaat

SEQ ID NO: 34277 - DNA, 22 bp, Homo sapiens
tgagttctaacaggttttaaat

SEQ ID NO: 34278 - DNA, 19 bp, Homo sapiens
tgagttctagcagtttgct

SEQ ID NO: 34279 - DNA, 22 bp, Homo sapiens
tgggttttaacaagccttccaa

SEQ ID NO: 34280 - DNA, 18 bp, Homo sapiens
tgagttctaataagtact

SEQ ID NO: 34281 - DNA, 18 bp, Homo sapiens
tgggttttaacaagcccc

SEQ ID NO: 34282 - DNA, 19 bp, Homo sapiens
tgggttctagcagggctct

SEQ ID NO: 34283 - DNA, 21 bp, Homo sapiens
tgagttctgtgagccactcta

SEQ ID NO: 34284 - DNA, 89 bp, Ectromelia virus
taatatctagttaaatttataataatgttttagatggttacgaccatacaaaatagtatttaaatcgtattcgcttaacttggatatta

SEQ ID NO: 34285 - DNA, 24 bp, Ectromelia virus
tttataataatgttttagatggtt

SEQ ID NO: 34286 - DNA, 20 bp, Homo sapiens
tttattataatgttttaaac

SEQ ID NO: 34287 - DNA, 20 bp, Homo sapiens
tttataataaagttttaaat

SEQ ID NO: 34288 - DNA, 21 bp, Homo sapiens
tttataaatgtgtagatggtt

SEQ ID NO: 34289 - DNA, 23 bp, Homo sapiens
tttataatatgcagataatggtt

SEQ ID NO: 34290 - DNA, 90 bp, Human herpesvirus 8
tccaggaggacagcgcctcagcgaggacctgcgcagaaagatgccctccatagttgtccaggactcatcggggttcattgcctgcctgga

SEQ ID NO: 34291 - DNA, 24 bp, Human herpesvirus 8
tgtccaggactcatcggggttcat

SEQ ID NO: 34292 - DNA, 19 bp, Homo sapiens
tgtctggattcatcagtca

SEQ ID NO: 34293 - DNA, 18 bp, Homo sapiens
gtccaggacaggagggtt

SEQ ID NO: 34294 - DNA, 18 bp, Homo sapiens
tgtctaggactcattgaa

SEQ ID NO: 34295 - DNA, 21 bp, Homo sapiens
tgccggggctcatcgccgggt

SEQ ID NO: 34296 - DNA, 24 bp, Homo sapiens
tgtctagagctcatttggattcat

SEQ ID NO: 34297 - DNA, 22 bp, Homo sapiens
tgtctgtggggagggggttcat

SEQ ID NO: 34298 - DNA, 22 bp, Homo sapiens
gtctagggctcattcctttcat

SEQ ID NO: 34299 - DNA, 22 bp, Homo sapiens
tggccagggcttcctgagggtt

SEQ ID NO: 34300 - DNA, 22 bp, Homo sapiens
tccagggttcatgtctattcat

SEQ ID NO: 34301 - DNA, 23 bp, Homo sapiens
tgtctgggtctcatcggcaggct

SEQ ID NO: 34302 - DNA, 22 bp, Homo sapiens
tgcctgggactggagggttcat

SEQ ID NO: 34303 - DNA, 18 bp, Homo sapiens
tgctaggactcataagtt

SEQ ID NO: 34304 - DNA, 20 bp, Homo sapiens
cgtccagggctcgttgggtt

SEQ ID NO: 34305 - DNA, 24 bp, Homo sapiens
tgtccagagtttattcaagttcat

SEQ ID NO: 34306 - DNA, 21 bp, Homo sapiens
tgtccaggacttctccctgcc

SEQ ID NO: 34307 - DNA, 20 bp, Homo sapiens
tgatcagggtcggggttcat

SEQ ID NO: 34308 - DNA, 16 bp, Homo sapiens
cagggtcggggttcat

SEQ ID NO: 34309 - DNA, 20 bp, Homo sapiens
tgtctggggctcatggaacc

SEQ ID NO: 34310 - DNA, 23 bp, Homo sapiens
tgttgagggctcatctgcttctc

SEQ ID NO: 34311 - DNA, 26 bp, Homo sapiens
tgtccagggtcatccaatgagttcat

SEQ ID NO: 34312 - DNA, 21 bp, Homo sapiens
tgtccgggtacttgagttcat

SEQ ID NO: 34313 - DNA, 16 bp, Homo sapiens
tgtccaggctcacttc

SEQ ID NO: 34314 - DNA, 22 bp, Homo sapiens
tgtctggactcagaaaattcat

SEQ ID NO: 34315 - DNA, 19 bp, Homo sapiens
tgtctaggactcagcgtgc

SEQ ID NO: 34316 - DNA, 20 bp, Homo sapiens
gtccagggctcattctaggc

SEQ ID NO: 34317 - DNA, 130 bp, Ectromelia virus
tatagcttattatctgtttgtgctaatataatatcaaatatactcttgttatcgttagttgggagattaatattacatccaatatatacgagataagacattatatcaacgttgcacgctataagcatta

SEQ ID NO: 34318 - DNA, 24 bp, Ectromelia virus
tagcttattatctgtttgtgctaa

SEQ ID NO: 34319 - DNA, 18 bp, Homo sapiens
gcttattgtctgtctgtg

SEQ ID NO: 34320 - DNA, 15 bp, Homo sapiens
gctttattgtttgtg

SEQ ID NO: 34321 - DNA, 20 bp, Homo sapiens
tagcttgtttgtttgtgtct

SEQ ID NO: 34322 - DNA, 17 bp, Homo sapiens
tagcttattactgaact

SEQ ID NO: 34323 - DNA, 18 bp, Homo sapiens
gcttattatttgtctata

SEQ ID NO: 34324 - DNA, 18 bp, Homo sapiens
ttattatctgagtactaa

SEQ ID NO: 34325 - DNA, 24 bp, Homo sapiens
gctagttgtctgttcagcagtgct

SEQ ID NO: 34326 - DNA, 20 bp, Homo sapiens
gcttattatttctgtctata

SEQ ID NO: 34327 - DNA, 19 bp, Homo sapiens
tagtttattgatctgcttg

SEQ ID NO: 34328 - DNA, 20 bp, Homo sapiens
tagcttgtttctgtgctgct

SEQ ID NO: 34329 - DNA, 17 bp, Homo sapiens
gctttattatttggcta

SEQ ID NO: 34330 - DNA, 16 bp, Homo sapiens
tagcttatgtttggct

SEQ ID NO: 34331 - DNA, 20 bp, Homo sapiens
tagcttataatctgttgtct

SEQ ID NO: 34332 - DNA, 61 bp, Human herpesvirus 8
cgcttatgtgtacagtttccttagtaccctgctatataatgccatgtactcattttacgcg

SEQ ID NO: 34333 - DNA, 24 bp, Human herpesvirus 8
tgtacagtttccttagtaccctgc

SEQ ID NO: 34334 - DNA, 22 bp, Homo sapiens
tgacagtttcttcagtctctgc

SEQ ID NO: 34335 - DNA, 23 bp, Homo sapiens
tgctgaattccttagtgctttgc

SEQ ID NO: 34336 - DNA, 22 bp, Homo sapiens
tgtgcagtctcccgactcctgc

SEQ ID NO: 34337 - DNA, 18 bp, Homo sapiens
tgtagggtttccctcctg

SEQ ID NO: 34338 - DNA, 22 bp, Homo sapiens
tgtcagtttcccattgttttgc

SEQ ID NO: 34339 - DNA, 21 bp, Homo sapiens
tacagttttttcagtactttg

SEQ ID NO: 34340 - DNA, 24 bp, Homo sapiens
tgtcggtttcctttgatgtcctgc

SEQ ID NO: 34341 - DNA, 23 bp, Homo sapiens
tgcacactcccttggtgccctgc

SEQ ID NO: 34342 - DNA, 23 bp, Homo sapiens
tgtacagttgctttaaaaaactg

SEQ ID NO: 34343 - DNA, 22 bp, Homo sapiens
tacagtttttattataccttgc

SEQ ID NO: 34344 - DNA, 16 bp, Homo sapiens
tgtaagtttccttgct

SEQ ID NO: 34345 - DNA, 18 bp, Homo sapiens
tgtgcagtttcctttctg

SEQ ID NO: 34346 - DNA, 18 bp, Homo sapiens
tacagtttccccaccttg

SEQ ID NO: 34347 - DNA, 24 bp, Homo sapiens
tgtacagcttctcgctgagctctg

SEQ ID NO: 34348 - DNA, 17 bp, Homo sapiens
gtgcagtttcccctctg

SEQ ID NO: 34349 - DNA, 18 bp, Homo sapiens
tctcttcttagtactctg

SEQ ID NO: 34350 - DNA, 16 bp, Homo sapiens
tgtaaagtttccctct

SEQ ID NO: 34351 - DNA, 17 bp, Homo sapiens
agtttcctaagaccttg

SEQ ID NO: 34352 - DNA, 18 bp, Homo sapiens
tacagtttctagtttttg

SEQ ID NO: 34353 - DNA, 21 bp, Homo sapiens
tgtgtggcttccttccactgc

SEQ ID NO: 34354 - DNA, 21 bp, Homo sapiens
tgttagtttcccagcctctgc

SEQ ID NO: 34355 - DNA, 18 bp, Homo sapiens
tgtacagtgtcactttgt

SEQ ID NO: 34356 - DNA, 21 bp, Homo sapiens
tgtagtttcctgtgtccctgc

SEQ ID NO: 34357 - DNA, 21 bp, Homo sapiens
tgacagtttctctctttctgc

SEQ ID NO: 34358 - DNA, 20 bp, Homo sapiens
tgtacaatttctgaaccttg

SEQ ID NO: 34359 - DNA, 130 bp, Ectromelia virus
gaatagcgccacatatgatatataatatattgtagatatctgacgaactgtttagataattatcttcttcttttattataataacacttacgtttttatcgaattccttaaacatgtcattcaatgcttc

SEQ ID NO: 34360 - DNA, 24 bp, Ectromelia virus
taataacacttacgtttttatcga

SEQ ID NO: 34361 - DNA, 19 bp, Homo sapiens
taataacatttacatttct

SEQ ID NO: 34362 - DNA, 18 bp, Homo sapiens
taataacacttgtgtttc

SEQ ID NO: 34363 - DNA, 19 bp, Homo sapiens
acacttacagctttattga

SEQ ID NO: 34364 - DNA, 19 bp, Homo sapiens
taacaacacttacaatttt

SEQ ID NO: 34365 - DNA, 76 bp, Ectromelia virus
gttatgataaatgattctgatgacatctcgctagttataaaatctatcgtatcattaaacatcgttgcatcataat

SEQ ID NO: 34366 - DNA, 24 bp, Ectromelia virus
taaatgattctgatgacatctcgc

SEQ ID NO: 34367 - DNA, 19 bp, Homo sapiens
tgattctgttgatttctgc

SEQ ID NO: 34368 - DNA, 21 bp, Homo sapiens
taagtgattctgctgatatct

SEQ ID NO: 34369 - DNA, 67 bp, Gibbon ape leukemia virus
attctcaccccaggactaaaagagaggctgtctcacttaccctagctgttttactggggttgggaat

SEQ ID NO: 34370 - DNA, 24 bp, Gibbon ape leukemia virus
tctcaccccaggactaaaagagag

SEQ ID NO: 34371 - DNA, 24 bp, Homo sapiens
tctctgccctgggaacaaagagag

SEQ ID NO: 34372 - DNA, 22 bp, Homo sapiens
tccaccttaaaaaaaaagagag

SEQ ID NO: 34373 - DNA, 23 bp, Homo sapiens
cctcacccccacagctagaggag

SEQ ID NO: 34374 - DNA, 20 bp, Homo sapiens
ccaccccaggaaggagagag

SEQ ID NO: 34375 - DNA, 18 bp, Homo sapiens
tcccaccccgagaaggga

SEQ ID NO: 34376 - DNA, 18 bp, Homo sapiens
ccttgccctggaaagaga

SEQ ID NO: 34377 - DNA, 23 bp, Homo sapiens
tctctttttggttaaaaagagag

SEQ ID NO: 34378 - DNA, 15 bp, Homo sapiens
tctaccccaaaagag

SEQ ID NO: 34379 - DNA, 20 bp, Homo sapiens
tcacaccaggataaaaagag

SEQ ID NO: 34380 - DNA, 18 bp, Homo sapiens
ctcaccccggggctcgag

SEQ ID NO: 34381 - DNA, 19 bp, Homo sapiens
tctcgtccaggaccctgag

SEQ ID NO: 34382 - DNA, 21 bp, Homo sapiens
ctcaccccagggctcccggag

SEQ ID NO: 34383 - DNA, 17 bp, Homo sapiens
tctctcctgaaaagaga

SEQ ID NO: 34384 - DNA, 22 bp, Homo sapiens
tctcaactttggtaaaagagag

SEQ ID NO: 34385 - DNA, 16 bp, Homo sapiens
cctcaccccaaggaga

SEQ ID NO: 34386 - DNA, 23 bp, Homo sapiens
tctgaccctggagaaaaagagag

SEQ ID NO: 34387 - DNA, 22 bp, Homo sapiens
tctcaccccagaggcctcagag

SEQ ID NO: 34388 - DNA, 18 bp, Homo sapiens
tctctctcagaaaagaga

SEQ ID NO: 34389 - DNA, 19 bp, Homo sapiens
tcattccagccaaagagag

SEQ ID NO: 34390 - DNA, 18 bp, Homo sapiens
cccagaaataaaagagag

SEQ ID NO: 34391 - DNA, 20 bp, Homo sapiens
ccaccccatctcaaagagag

SEQ ID NO: 34392 - DNA, 22 bp, Homo sapiens
tctcctaaactctaaaagagag

SEQ ID NO: 34393 - DNA, 23 bp, Homo sapiens
tctcaccctgtggctgactggag

SEQ ID NO: 34394 - DNA, 23 bp, Homo sapiens
tcccaccccagggatccaggaag

SEQ ID NO: 34395 - DNA, 23 bp, Homo sapiens
tcccacccccttgggaaggggag

SEQ ID NO: 34396 - DNA, 20 bp, Homo sapiens
tctttcctcaggactatgag

SEQ ID NO: 34397 - DNA, 19 bp, Homo sapiens
tcacactaggactaataag

SEQ ID NO: 34398 - DNA, 24 bp, Homo sapiens
cctcaccctgaaaaaagaagagag

SEQ ID NO: 34399 - DNA, 17 bp, Homo sapiens
tctaccccaggaaagga

SEQ ID NO: 34400 - DNA, 21 bp, Homo sapiens
tcccaccccaggaggagggag

SEQ ID NO: 34401 - DNA, 22 bp, Homo sapiens
ccacctcgggacctggagggag

SEQ ID NO: 34402 - DNA, 19 bp, Homo sapiens
tctcacccagctagagaga

SEQ ID NO: 34403 - DNA, 19 bp, Homo sapiens
tcccaccccagcagcagag

SEQ ID NO: 34404 - DNA, 18 bp, Homo sapiens
tctgcccccaagaggaga

SEQ ID NO: 34405 - DNA, 18 bp, Homo sapiens
tcttccccagaacgggag

SEQ ID NO: 34406 - DNA, 20 bp, Homo sapiens
tctcgcctcaggaccataag

SEQ ID NO: 34407 - DNA, 18 bp, Homo sapiens
tctcactgcaggactgag

SEQ ID NO: 34408 - DNA, 23 bp, Homo sapiens
tctcatattgaacaaaaagagag

SEQ ID NO: 34409 - DNA, 20 bp, Homo sapiens
ccaccccaggcctgggggag

SEQ ID NO: 34410 - DNA, 18 bp, Homo sapiens
tctcaatccaggactgag

SEQ ID NO: 34411 - DNA, 19 bp, Homo sapiens
tctctcccaggacaaagag

SEQ ID NO: 34412 - DNA, 16 bp, Homo sapiens
tctctccccaaaagag

SEQ ID NO: 34413 - DNA, 77 bp, Camelpox virus
gtagtttccatgggactatataattttgtggcctcgaatacaaattttactacatagttatctatcttaaagactat

SEQ ID NO: 34414 - DNA, 24 bp, Camelpox virus
ttactacatagttatctatcttaa

SEQ ID NO: 34415 - DNA, 20 bp, Homo sapiens
actaccaccatctgtcttaa

SEQ ID NO: 34416 - DNA, 19 bp, Homo sapiens
tacatgttatctattttaa

SEQ ID NO: 34417 - DNA, 22 bp, Homo sapiens
ttactacaaagttgttcttcct

SEQ ID NO: 34418 - DNA, 23 bp, Homo sapiens
ttaccattttgcatctatcttaa

SEQ ID NO: 34419 - DNA, 17 bp, Homo sapiens
tacatagttcagtctta

SEQ ID NO: 34420 - DNA, 18 bp, Homo sapiens
ttactatgtgttatctat

SEQ ID NO: 34421 - DNA, 21 bp, Homo sapiens
ttaccacaggactctatctta

SEQ ID NO: 34422 - DNA, 19 bp, Homo sapiens
ttactacatagtggtatct

SEQ ID NO: 34423 - DNA, 76 bp, Porcine adenovirus C
caccgccatgcttcccctctcccactcttgaaactcctttctcttttcaaacaacgggttgggcagcccaaaggtg

SEQ ID NO: 34424 - DNA, 24 bp, Porcine adenovirus C
acaacgggttgggcagcccaaagg

SEQ ID NO: 34425 - DNA, 20 bp, Homo sapiens
gggtggtgcccggcccgagg

SEQ ID NO: 34426 - DNA, 21 bp, Homo sapiens
gagcctgcggcagcccagagg

SEQ ID NO: 34427 - DNA, 19 bp, Homo sapiens
cgggcaggcggcctaaagg

SEQ ID NO: 34428 - DNA, 20 bp, Homo sapiens
gggccagggcagcccaaagg

SEQ ID NO: 34429 - DNA, 21 bp, Homo sapiens
gggcggcgggcagcctgaagg

SEQ ID NO: 34430 - DNA, 15 bp, Homo sapiens
cgcgagcagcccaag

SEQ ID NO: 34431 - DNA, 20 bp, Homo sapiens
cagcggcggcagcctaaagg

SEQ ID NO: 34432 - DNA, 19 bp, Homo sapiens
gggtaatccagcccaaagg

SEQ ID NO: 34433 - DNA, 16 bp, Homo sapiens
acagcaggttcccaaa

SEQ ID NO: 34434 - DNA, 22 bp, Homo sapiens
gggatggcgggcagctcagggg

SEQ ID NO: 34435 - DNA, 18 bp, Homo sapiens
acatcgggctggcccgag

SEQ ID NO: 34436 - DNA, 21 bp, Homo sapiens
acgtgccaagcagctcaaagg

SEQ ID NO: 34437 - DNA, 19 bp, Homo sapiens
acgggcctacagcttgagg

SEQ ID NO: 34438 - DNA, 23 bp, Homo sapiens
acagcagttttgcggctcaaggg

SEQ ID NO: 34439 - DNA, 21 bp, Homo sapiens
ggtgacatggcagcccagagg

SEQ ID NO: 34440 - DNA, 20 bp, Homo sapiens
cgggttggtcagctctgagg

SEQ ID NO: 34441 - DNA, 22 bp, Homo sapiens
acaatataaggcagcccaaagg

SEQ ID NO: 34442 - DNA, 21 bp, Homo sapiens
caacggggtggatggcggagg

SEQ ID NO: 34443 - DNA, 22 bp, Homo sapiens
accacgggaggcagcccagagg

SEQ ID NO: 34444 - DNA, 20 bp, Homo sapiens
aactggttgaacctccgagg

SEQ ID NO: 34445 - DNA, 22 bp, Homo sapiens
accagcatgggcagctcagagg

SEQ ID NO: 34446 - DNA, 18 bp, Homo sapiens
gaccgagcagcccagagg

SEQ ID NO: 34447 - DNA, 18 bp, Homo sapiens
ggctgggcagcttgaagg

SEQ ID NO: 34448 - DNA, 20 bp, Homo sapiens
gggttgagaacttttaaagg

SEQ ID NO: 34449 - DNA, 19 bp, Homo sapiens
gctgggcagggcccaaggg

SEQ ID NO: 34450 - DNA, 16 bp, Homo sapiens
caacaggcagtccaag

SEQ ID NO: 34451 - DNA, 16 bp, Homo sapiens
gggttggacacaaggg

SEQ ID NO: 34452 - DNA, 19 bp, Homo sapiens
ggctggtccagcccaaagg

SEQ ID NO: 34453 - DNA, 18 bp, Homo sapiens
acaacggggtgggggaag

SEQ ID NO: 34454 - DNA, 18 bp, Homo sapiens
acggcgggtgacctaaag

SEQ ID NO: 34455 - DNA, 20 bp, Homo sapiens
gggccgaggcagtccgaagg

SEQ ID NO: 34456 - DNA, 20 bp, Homo sapiens
catggaggctggtccaaagg

SEQ ID NO: 34457 - DNA, 19 bp, Homo sapiens
cgggaggacagcccagagg

SEQ ID NO: 34458 - DNA, 18 bp, Homo sapiens
gggggcacggcccaaagg

SEQ ID NO: 34459 - DNA, 22 bp, Homo sapiens
acaagtgggcgcagcccagggg

SEQ ID NO: 34460 - DNA, 25 bp, Homo sapiens
caacaggtgtgacccggcccggagg

SEQ ID NO: 34461 - DNA, 21 bp, Homo sapiens
cagggggcccaggcccaaagg

SEQ ID NO: 34462 - DNA, 19 bp, Homo sapiens
cggggagacagcccggagg

SEQ ID NO: 34463 - DNA, 23 bp, Homo sapiens
accacagctgggcagcttggagg

SEQ ID NO: 34464 - DNA, 22 bp, Homo sapiens
ggaccacagggcagcccagggg

SEQ ID NO: 34465 - DNA, 20 bp, Homo sapiens
gggtgagggcagcccagggg

SEQ ID NO: 34466 - DNA, 19 bp, Homo sapiens
ggcgggtcaagcccagagg

SEQ ID NO: 34467 - DNA, 20 bp, Homo sapiens
cgggaagggcagcccagggg

SEQ ID NO: 34468 - DNA, 23 bp, Homo sapiens
gggcgcgagaggcagcccggagg

SEQ ID NO: 34469 - DNA, 17 bp, Homo sapiens
ggttgggcaaccgaagg

SEQ ID NO: 34470 - DNA, 19 bp, Homo sapiens
cgggttggcagcgccgagg

SEQ ID NO: 34471 - DNA, 23 bp, Homo sapiens
acgcacgggcagcagcctggagg

SEQ ID NO: 34472 - DNA, 20 bp, Homo sapiens
gagaaggggcagcccagggg

SEQ ID NO: 34473 - DNA, 22 bp, Homo sapiens
aacattttgggtggcccaaagg

SEQ ID NO: 34474 - DNA, 20 bp, Homo sapiens
acaagcctcgcagcctgagg

SEQ ID NO: 34475 - DNA, 23 bp, Homo sapiens
cagcgggtggggggagctggagg

SEQ ID NO: 34476 - DNA, 20 bp, Homo sapiens
gggttggggctccttgaagg

SEQ ID NO: 34477 - DNA, 19 bp, Homo sapiens
acaatgagttgggtagcag

SEQ ID NO: 34478 - DNA, 18 bp, Homo sapiens
agacgaagcagcccagag

SEQ ID NO: 34479 - DNA, 24 bp, Homo sapiens
caaggggttgggatcatccagagg

SEQ ID NO: 34480 - DNA, 19 bp, Homo sapiens
acgggcagcagcctgaagg

SEQ ID NO: 34481 - DNA, 19 bp, Homo sapiens
ggttaaaggcagcctgagg

SEQ ID NO: 34482 - DNA, 18 bp, Homo sapiens
acggattgggtgacaagg

SEQ ID NO: 34483 - DNA, 19 bp, Homo sapiens
cggtccgggcagtccgagg

SEQ ID NO: 34484 - DNA, 18 bp, Homo sapiens
caacagtacagctcagag

SEQ ID NO: 34485 - DNA, 24 bp, Homo sapiens
acagcaggaagaatagcccaaagg

SEQ ID NO: 34486 - DNA, 17 bp, Homo sapiens
aggcagcggcccagagg

SEQ ID NO: 34487 - DNA, 21 bp, Homo sapiens
gggcggggctaagctcaaagg

SEQ ID NO: 34488 - DNA, 24 bp, Homo sapiens
cgatggtggcaccaggcccaaggg

SEQ ID NO: 34489 - DNA, 21 bp, Homo sapiens
gggcgggagctagcctgaagg

SEQ ID NO: 34490 - DNA, 18 bp, Homo sapiens
gggttagggagagaaagg

SEQ ID NO: 34491 - DNA, 19 bp, Homo sapiens
cagcgggctgggtgccagg

SEQ ID NO: 34492 - DNA, 21 bp, Homo sapiens
gggcagcaggtggcccaaggg

SEQ ID NO: 34493 - DNA, 60 bp, Porcine adenovirus C
gtcgagtaaggaatcagtctgttctggtctatctgggtcagagtcttgtccttccacggc

SEQ ID NO: 34494 - DNA, 24 bp, Porcine adenovirus C
agtaaggaatcagtctgttctggt

SEQ ID NO: 34495 - DNA, 18 bp, Homo sapiens
agtaaggattagtttctg

SEQ ID NO: 34496 - DNA, 22 bp, Homo sapiens
agtgagggagcaggactctggt

SEQ ID NO: 34497 - DNA, 22 bp, Homo sapiens
gtaaggaaatcggctctctggt

SEQ ID NO: 34498 - DNA, 23 bp, Homo sapiens
agtgaagaatcgtaagttctggt

SEQ ID NO: 34499 - DNA, 18 bp, Homo sapiens
agtgagaggttgctctgg

SEQ ID NO: 34500 - DNA, 15 bp, Homo sapiens
gtaagggttattctg

SEQ ID NO: 34501 - DNA, 18 bp, Homo sapiens
agcaaggaattgttttgg

SEQ ID NO: 34502 - DNA, 20 bp, Homo sapiens
gtaggaagtcaggttctggt

SEQ ID NO: 34503 - DNA, 20 bp, Homo sapiens
gtaggaatcaaagatctggt

SEQ ID NO: 34504 - DNA, 20 bp, Homo sapiens
gtgaggaaccagcggttggt

SEQ ID NO: 34505 - DNA, 25 bp, Homo sapiens
aatgaggaatcagtcttagagaggt

SEQ ID NO: 34506 - DNA, 21 bp, Homo sapiens
agcgaggcagtctgttctggt

SEQ ID NO: 34507 - DNA, 24 bp, Homo sapiens
agtaaggaattagatgtgagtggt

SEQ ID NO: 34508 - DNA, 23 bp, Homo sapiens
agagaggaatcctggcttctggt

SEQ ID NO: 34509 - DNA, 78 bp, Porcine adenovirus C
gtgggaggcgtacctgttgttaagtacgagggaggagctactttctagagtgtgcagacacacgtcatcgtcttccac

SEQ ID NO: 34510 - DNA, 24 bp, Porcine adenovirus C
tgttgttaagtacgagggaggagc

SEQ ID NO: 34511 - DNA, 21 bp, Homo sapiens
gttgttaagtaaaaatgggag

SEQ ID NO: 34512 - DNA, 20 bp, Homo sapiens
tgatgttgtacagggaggag

SEQ ID NO: 34513 - DNA, 21 bp, Homo sapiens
tgttgttggggtggggaggag

SEQ ID NO: 34514 - DNA, 19 bp, Homo sapiens
tgcttgagtgggggaggag

SEQ ID NO: 34515 - DNA, 16 bp, Homo sapiens
tgttgtggtgggagga

SEQ ID NO: 34516 - DNA, 19 bp, Homo sapiens
tgttgtgcagggggaggag

SEQ ID NO: 34517 - DNA, 22 bp, Homo sapiens
tggtgttgaacaagggaggagc

SEQ ID NO: 34518 - DNA, 20 bp, Homo sapiens
tgttgttagtatcacaggag

SEQ ID NO: 34519 - DNA, 18 bp, Homo sapiens
tgctgttgtggggaggag

SEQ ID NO: 34520 - DNA, 22 bp, Homo sapiens
tgtgttaagtgtgaacaggagc

SEQ ID NO: 34521 - DNA, 22 bp, Homo sapiens
tgttgatagggtctggaggagc

SEQ ID NO: 34522 - DNA, 94 bp, Porcine adenovirus C
agtgcgtttgataaaagtttggcaatgcttcgcatggtttggttcttttccctgtctgccttttcctttgctgcgatgttcagctgcacgtact

SEQ ID NO: 34523 - DNA, 23 bp, Porcine adenovirus C
tgcgatgttcagctgcacgtact

SEQ ID NO: 34524 - DNA, 23 bp, Homo sapiens
tgtgatgttcagcatgtgtcagt

SEQ ID NO: 34525 - DNA, 22 bp, Homo sapiens
tgcggtgagagctgcacgtgct

SEQ ID NO: 34526 - DNA, 20 bp, Homo sapiens
tgtgagttcagctgtctact

SEQ ID NO: 34527 - DNA, 17 bp, Homo sapiens
tgcgcgtgtgcacgtac

SEQ ID NO: 34528 - DNA, 19 bp, Homo sapiens
tgcagtcttgctgcacgta

SEQ ID NO: 34529 - DNA, 18 bp, Homo sapiens
tgctttgctgcacgtgct

SEQ ID NO: 34530 - DNA, 61 bp, Porcine adenovirus C
gccttgatggttttggactggtgacaaatcacctgcgcggccagaacaatctcatcaaagc

SEQ ID NO: 34531 - DNA, 24 bp, Porcine adenovirus C
tggttttggactggtgacaaatca

SEQ ID NO: 34532 - DNA, 18 bp, Homo sapiens
tggtattggactggtaca

SEQ ID NO: 34533 - DNA, 19 bp, Homo sapiens
tggttttgggctaaacaaa

SEQ ID NO: 34534 - DNA, 23 bp, Homo sapiens
tggttttggcaaaaacatggcaa

SEQ ID NO: 34535 - DNA, 20 bp, Homo sapiens
tggttctggccgttgtgaca

SEQ ID NO: 34536 - DNA, 22 bp, Homo sapiens
tggtttgtggtctccgacaaat

SEQ ID NO: 34537 - DNA, 21 bp, Homo sapiens
gttttggatggatgcaggtca

SEQ ID NO: 34538 - DNA, 17 bp, Homo sapiens
tggtttggaggtcaaac

SEQ ID NO: 34539 - DNA, 23 bp, Homo sapiens
tggttttgggctggtaaacatca

SEQ ID NO: 34540 - DNA, 20 bp, Homo sapiens
tggctttgcctatggcaaat

SEQ ID NO: 34541 - DNA, 18 bp, Homo sapiens
tggttttggctggaagca

SEQ ID NO: 34542 - DNA, 17 bp, Homo sapiens
tggctttggattggaca

SEQ ID NO: 34543 - DNA, 16 bp, Homo sapiens
gttttgggtgacaaat

SEQ ID NO: 34544 - DNA, 24 bp, Homo sapiens
tagttttgtttatgtgatgaatca

SEQ ID NO: 34545 - DNA, 19 bp, Homo sapiens
tggttttgaacatatgtga

SEQ ID NO: 34546 - DNA, 103 bp, Rabbit fibroma virus
gttatgtttcttaacttcttcaggtagaacgtctttgggacatccgtaccgtaatacaaacccgaaggatcgtttcacacactcgtcctctacctcccgtaac

SEQ ID NO: 34547 - DNA, 24 bp, Rabbit fibroma virus
tttcacacactcgtcctctacctc

SEQ ID NO: 34548 - DNA, 19 bp, Homo sapiens
tttcacacactctccatct

SEQ ID NO: 34549 - DNA, 21 bp, Homo sapiens
acgcacccacccctctacttc

SEQ ID NO: 34550 - DNA, 21 bp, Homo sapiens
cacccatcagtgctctacctc

SEQ ID NO: 34551 - DNA, 19 bp, Homo sapiens
tttcaacagcactctacct

SEQ ID NO: 34552 - DNA, 18 bp, Homo sapiens
tttcacacacatgtatct

SEQ ID NO: 34553 - DNA, 19 bp, Homo sapiens
cacacccatcttttacttc

SEQ ID NO: 34554 - DNA, 18 bp, Homo sapiens
tctcacactcctttgcct

SEQ ID NO: 34555 - DNA, 21 bp, Homo sapiens
tttcccacagttttctacctc

SEQ ID NO: 34556 - DNA, 22 bp, Homo sapiens
tctcacactaatcttttacctc

SEQ ID NO: 34557 - DNA, 20 bp, Homo sapiens
tttcacacatacaaatctac

SEQ ID NO: 34558 - DNA, 18 bp, Homo sapiens
cattctgtcttctacctc

SEQ ID NO: 34559 - DNA, 22 bp, Homo sapiens
tttcactatttttcctctacct

SEQ ID NO: 34560 - DNA, 21 bp, Homo sapiens
tttcggcatcatcctctgcct

SEQ ID NO: 34561 - DNA, 18 bp, Homo sapiens
tctcacgtcccctctact

SEQ ID NO: 34562 - DNA, 23 bp, Homo sapiens
tttcaaatcacatacctctacct

SEQ ID NO: 34563 - DNA, 74 bp, Rabbit fibroma virus
atacccgtgcattttaccctcgttaatcatctgaagttgtgcggtgttccatagaggatcgtgtgtacgggcgt

SEQ ID NO: 34564 - DNA, 24 bp, Rabbit fibroma virus
acccgtgcattttaccctcgttaa

SEQ ID NO: 34565 - DNA, 18 bp, Homo sapiens
cctgggctctcctcgtta

SEQ ID NO: 34566 - DNA, 19 bp, Homo sapiens
cccgtgcggccctcgttaa

SEQ ID NO: 34567 - DNA, 22 bp, Homo sapiens
ccgtgcatttgacccaggttaa

SEQ ID NO: 34568 - DNA, 20 bp, Homo sapiens
ccttgcattttatccattta

SEQ ID NO: 34569 - DNA, 21 bp, Homo sapiens
gtgcatcttgtgctcagttaa

SEQ ID NO: 34570 - DNA, 18 bp, Homo sapiens
acctgtgcatttactcct

SEQ ID NO: 34571 - DNA, 23 bp, Homo sapiens
cccagagactttatcctcgttaa

SEQ ID NO: 34572 - DNA, 72 bp, Bovine herpesvirus 1
ggcctcggcgaaggggcgttccagcatgacggcatgctggacgaggcgcgcgatgcccttgagcgtggggcc

SEQ ID NO: 34573 - DNA, 19 bp, Bovine herpesvirus 1
tgcccttgagcgtggggcc

SEQ ID NO: 34574 - DNA, 16 bp, Homo sapiens
gcccttgggcagggcc

SEQ ID NO: 34575 - DNA, 17 bp, Homo sapiens
tgccaaaaacgtggggc

SEQ ID NO: 34576 - DNA, 17 bp, Homo sapiens
tgcccttgcgtggtgcc

SEQ ID NO: 34577 - DNA, 17 bp, Homo sapiens
tgccctggagcagagcc

SEQ ID NO: 34578 - DNA, 19 bp, Homo sapiens
tgcccttgaccggcaggcc

SEQ ID NO: 34579 - DNA, 17 bp, Homo sapiens
gcccttgagtaggagcc

SEQ ID NO: 34580 - DNA, 17 bp, Homo sapiens
tgcctttgcatggggcc

SEQ ID NO: 34581 - DNA, 18 bp, Homo sapiens
tgcccttgagctgagagc

SEQ ID NO: 34582 - DNA, 20 bp, Homo sapiens
tgcccctgagctggggggcc

SEQ ID NO: 34583 - DNA, 19 bp, Homo sapiens
tgtccttgacgcagatgcc

SEQ ID NO: 34584 - DNA, 17 bp, Homo sapiens
tgctcctgagagaggcc

SEQ ID NO: 34585 - DNA, 20 bp, Homo sapiens
tgcccatggagcctcggggc

SEQ ID NO: 34586 - DNA, 16 bp, Homo sapiens
gcctccccgtggggcc

SEQ ID NO: 34587 - DNA, 18 bp, Homo sapiens
tgctcttcagtgatggcc

SEQ ID NO: 34588 - DNA, 18 bp, Homo sapiens
tgccctagagcgcagggc

SEQ ID NO: 34589 - DNA, 16 bp, Homo sapiens
tgccccaggtggggcc

SEQ ID NO: 34590 - DNA, 18 bp, Homo sapiens
tgccctgagctcggggcc

SEQ ID NO: 34591 - DNA, 18 bp, Homo sapiens
tgccctcgggcaggatgc

SEQ ID NO: 34592 - DNA, 16 bp, Homo sapiens
tgcccttggagcgagc

SEQ ID NO: 34593 - DNA, 19 bp, Homo sapiens
tgcccctggggtgggggcc

SEQ ID NO: 34594 - DNA, 16 bp, Homo sapiens
tgcccctgaggaagcc

SEQ ID NO: 34595 - DNA, 17 bp, Homo sapiens
tgcccttggaccgcacc

SEQ ID NO: 34596 - DNA, 19 bp, Homo sapiens
tgcccctctcactggggcc

SEQ ID NO: 34597 - DNA, 19 bp, Homo sapiens
tgccctgagccagcgggcc

SEQ ID NO: 34598 - DNA, 18 bp, Homo sapiens
gcccttgacatcatggcc

SEQ ID NO: 34599 - DNA, 18 bp, Homo sapiens
tgcccctggagttggggc

SEQ ID NO: 34600 - DNA, 18 bp, Homo sapiens
tgtccttaagcacaagcc

SEQ ID NO: 34601 - DNA, 19 bp, Homo sapiens
tgcccttcaaagtggggcc

SEQ ID NO: 34602 - DNA, 16 bp, Homo sapiens
gcccttggcctaggcc

SEQ ID NO: 34603 - DNA, 16 bp, Homo sapiens
tgcccttagccacagc

SEQ ID NO: 34604 - DNA, 18 bp, Homo sapiens
tgcccctgggtggaaggc

SEQ ID NO: 34605 - DNA, 16 bp, Homo sapiens
tacccttgagcaggcc

SEQ ID NO: 34606 - DNA, 16 bp, Homo sapiens
tgctttgaacagggcc

SEQ ID NO: 34607 - DNA, 19 bp, Homo sapiens
tgacctttgacgtggggcc

SEQ ID NO: 34608 - DNA, 18 bp, Homo sapiens
tgcccttgtggatgcgcc

SEQ ID NO: 34609 - DNA, 17 bp, Homo sapiens
tgcccttgcccaaggcc

SEQ ID NO: 34610 - DNA, 17 bp, Homo sapiens
tgccctggggcggggcc

SEQ ID NO: 34611 - DNA, 20 bp, Homo sapiens
tgcccttagcaagtggggcc

SEQ ID NO: 34612 - DNA, 19 bp, Homo sapiens
tgcccctgctacggggggc

SEQ ID NO: 34613 - DNA, 18 bp, Homo sapiens
tgtccctggggtgaggcc

SEQ ID NO: 34614 - DNA, 18 bp, Homo sapiens
tgccttccacatggggcc

SEQ ID NO: 34615 - DNA, 21 bp, Homo sapiens
tgcccttggggcagggtggcc

SEQ ID NO: 34616 - DNA, 18 bp, Homo sapiens
tgcatctaccatggggcc

SEQ ID NO: 34617 - DNA, 16 bp, Homo sapiens
taccctccatggggcc

SEQ ID NO: 34618 - DNA, 15 bp, Homo sapiens
tgccgaggtggggcc

SEQ ID NO: 34619 - DNA, 19 bp, Homo sapiens
tgcctctgtaaacagggcc

SEQ ID NO: 34620 - DNA, 23 bp, Homo sapiens
tgccctgagccttctgtggggcc

SEQ ID NO: 34621 - DNA, 19 bp, Homo sapiens
tgcccctggagtcacggcc

SEQ ID NO: 34622 - DNA, 17 bp, Homo sapiens
tgcccctagtcggggcc

SEQ ID NO: 34623 - DNA, 20 bp, Homo sapiens
tgcccctgccaccctggggc

SEQ ID NO: 34624 - DNA, 19 bp, Homo sapiens
tgtcctgtggagcaaggcc

SEQ ID NO: 34625 - DNA, 19 bp, Homo sapiens
tgctatgtgctgtggggcc

SEQ ID NO: 34626 - DNA, 18 bp, Homo sapiens
tgcatcttccgtggggcc

SEQ ID NO: 34627 - DNA, 16 bp, Homo sapiens
tgctccctgtggggcc

SEQ ID NO: 34628 - DNA, 18 bp, Homo sapiens
tgcccctggcttggggcc

SEQ ID NO: 34629 - DNA, 16 bp, Homo sapiens
tgccctgggcagagcc

SEQ ID NO: 34630 - DNA, 17 bp, Homo sapiens
tgtcctagagtggggcc

SEQ ID NO: 34631 - DNA, 18 bp, Homo sapiens
tgtcctctcagccggggc

SEQ ID NO: 34632 - DNA, 16 bp, Homo sapiens
tgcccttgaagtaacc

SEQ ID NO: 34633 - DNA, 16 bp, Homo sapiens
tgcgcttagtggggcc

SEQ ID NO: 34634 - DNA, 16 bp, Homo sapiens
tgctcttgaacagggc

SEQ ID NO: 34635 - DNA, 18 bp, Homo sapiens
tgcccattgagtgagacc

SEQ ID NO: 34636 - DNA, 19 bp, Homo sapiens
tgtccagaggtgtggggcc

SEQ ID NO: 34637 - DNA, 15 bp, Homo sapiens
tgcccttgaaggggc

SEQ ID NO: 34638 - DNA, 17 bp, Homo sapiens
tgcccttggcatgtgcc

SEQ ID NO: 34639 - DNA, 16 bp, Homo sapiens
tgccctgagcacagcc

SEQ ID NO: 34640 - DNA, 18 bp, Homo sapiens
tggcctggatgtggggcc

SEQ ID NO: 34641 - DNA, 16 bp, Homo sapiens
tgtcctgcatggggcc

SEQ ID NO: 34642 - DNA, 19 bp, Homo sapiens
tgcccttgggaacagaggg

SEQ ID NO: 34643 - DNA, 16 bp, Homo sapiens
tgcccctgcgccgggc

SEQ ID NO: 34644 - DNA, 18 bp, Homo sapiens
tgcccttgtgacccagcc

SEQ ID NO: 34645 - DNA, 18 bp, Homo sapiens
tgccttgagccaaaaacc

SEQ ID NO: 34646 - DNA, 16 bp, Homo sapiens
gccctcacatggggcc

SEQ ID NO: 34647 - DNA, 17 bp, Homo sapiens
tgtccctgagctgcagc

SEQ ID NO: 34648 - DNA, 19 bp, Homo sapiens
tgcccctgtgtaggtgggg

SEQ ID NO: 34649 - DNA, 16 bp, Homo sapiens
tgcccatggcagggcc

SEQ ID NO: 34650 - DNA, 19 bp, Homo sapiens
ccttgaactacgtggggcc

SEQ ID NO: 34651 - DNA, 19 bp, Homo sapiens
tgcccttggctggaatgcc

SEQ ID NO: 34652 - DNA, 16 bp, Homo sapiens
tgctctgagtggggcc

SEQ ID NO: 34653 - DNA, 17 bp, Homo sapiens
gcccttggcctggggcc

SEQ ID NO: 34654 - DNA, 20 bp, Homo sapiens
tgctgcttgcacctggggcc

SEQ ID NO: 34655 - DNA, 17 bp, Homo sapiens
tgcccttagcccgggcc

SEQ ID NO: 34656 - DNA, 17 bp, Homo sapiens
tgcccatgagcgcagcc

SEQ ID NO: 34657 - DNA, 16 bp, Homo sapiens
tgcccttggagagagc

SEQ ID NO: 34658 - DNA, 17 bp, Homo sapiens
tgcccttggccagaggc

SEQ ID NO: 34659 - DNA, 18 bp, Homo sapiens
tgccctcggctccaggcc

SEQ ID NO: 34660 - DNA, 17 bp, Homo sapiens
tgcccctgagcctggcc

SEQ ID NO: 34661 - DNA, 17 bp, Homo sapiens
tgcaccttggtggggcc

SEQ ID NO: 34662 - DNA, 22 bp, Homo sapiens
tgcccttggccaatgaggggcc

SEQ ID NO: 34663 - DNA, 18 bp, Homo sapiens
tgctcgctggcgtggggc

SEQ ID NO: 34664 - DNA, 18 bp, Homo sapiens
tgcccctcctgtggggcc

SEQ ID NO: 34665 - DNA, 18 bp, Homo sapiens
gctctgaggtcgtggggc

SEQ ID NO: 34666 - DNA, 17 bp, Homo sapiens
tgcccttgaagcaaacc

SEQ ID NO: 34667 - DNA, 18 bp, Homo sapiens
gcccagctgtgtggggcc

SEQ ID NO: 34668 - DNA, 16 bp, Homo sapiens
tgccccacgtggggcc

SEQ ID NO: 34669 - DNA, 17 bp, Homo sapiens
tgccctggaatgaggcc

SEQ ID NO: 34670 - DNA, 15 bp, Homo sapiens
gccctaggtggggcc

SEQ ID NO: 34671 - DNA, 18 bp, Homo sapiens
tgcccctgggccagaagc

SEQ ID NO: 34672 - DNA, 20 bp, Homo sapiens
tactcttgagcacggtgggc

SEQ ID NO: 34673 - DNA, 17 bp, Homo sapiens
tacccttgagagaagcc

SEQ ID NO: 34674 - DNA, 19 bp, Homo sapiens
tgctctgggcaatggggcc

SEQ ID NO: 34675 - DNA, 17 bp, Homo sapiens
gcctccccagtggggcc

SEQ ID NO: 34676 - DNA, 16 bp, Homo sapiens
tgtccttgagcagaac

SEQ ID NO: 34677 - DNA, 18 bp, Homo sapiens
tgcccctccagtggggcc

SEQ ID NO: 34678 - DNA, 19 bp, Homo sapiens
cccttgaaggcttggggcc

SEQ ID NO: 34679 - DNA, 15 bp, Homo sapiens
tgccaagcgtggggc

SEQ ID NO: 34680 - DNA, 19 bp, Homo sapiens
tgcccttggcagagtgggg

SEQ ID NO: 34681 - DNA, 22 bp, Homo sapiens
tgcccctggccccctgtggggc

SEQ ID NO: 34682 - DNA, 19 bp, Homo sapiens
tgaccttgagcagactgcc

SEQ ID NO: 34683 - DNA, 16 bp, Homo sapiens
tgtccttagcagagcc

SEQ ID NO: 34684 - DNA, 18 bp, Homo sapiens
tgcctcacctgtggggcc

SEQ ID NO: 34685 - DNA, 17 bp, Homo sapiens
tgtccctgagcccagcc

SEQ ID NO: 34686 - DNA, 19 bp, Homo sapiens
tgcccttgagagacaggcc

SEQ ID NO: 34687 - DNA, 16 bp, Homo sapiens
tgaccttgagcaagcc

SEQ ID NO: 34688 - DNA, 17 bp, Homo sapiens
tgcacctaggtggggcc

SEQ ID NO: 34689 - DNA, 20 bp, Homo sapiens
tgccctgagcgcacgcggcc

SEQ ID NO: 34690 - DNA, 17 bp, Homo sapiens
tgcccttgactggcagc

SEQ ID NO: 34691 - DNA, 18 bp, Homo sapiens
gctcctgccacgtggggc

SEQ ID NO: 34692 - DNA, 17 bp, Homo sapiens
tgcccctgagaggggcc

SEQ ID NO: 34693 - DNA, 17 bp, Homo sapiens
tgcccttggcacagagc

SEQ ID NO: 34694 - DNA, 17 bp, Homo sapiens
gcacttagtgtggggcc

SEQ ID NO: 34695 - DNA, 19 bp, Homo sapiens
tgccctgtggggtgaggcc

SEQ ID NO: 34696 - DNA, 18 bp, Homo sapiens
tgtccctgagctaaggcc

SEQ ID NO: 34697 - DNA, 18 bp, Homo sapiens
tgcccttggggctggggc

SEQ ID NO: 34698 - DNA, 17 bp, Homo sapiens
tgcccctgagcacagcc

SEQ ID NO: 34699 - DNA, 16 bp, Homo sapiens
tgcctttgataaggcc

SEQ ID NO: 34700 - DNA, 18 bp, Homo sapiens
tgccttggaggcggggcc

SEQ ID NO: 34701 - DNA, 17 bp, Homo sapiens
gccctgagagtggggcc

SEQ ID NO: 34702 - DNA, 20 bp, Homo sapiens
gccttgaaccaagtgtgggg

SEQ ID NO: 34703 - DNA, 21 bp, Homo sapiens
tgcgcttgagcagcaggggcc

SEQ ID NO: 34704 - DNA, 17 bp, Homo sapiens
tgctctccagtggggcc

SEQ ID NO: 34705 - DNA, 19 bp, Homo sapiens
tgccctgagctctggggcc

SEQ ID NO: 34706 - DNA, 17 bp, Homo sapiens
tgcccctggctgaggcc

SEQ ID NO: 34707 - DNA, 17 bp, Homo sapiens
gcccttgacctggggcc

SEQ ID NO: 34708 - DNA, 16 bp, Homo sapiens
tgcccttgaaggtgcc

SEQ ID NO: 34709 - DNA, 18 bp, Homo sapiens
tgtcccttggacaaggcc

SEQ ID NO: 34710 - DNA, 18 bp, Homo sapiens
gcctggagctgtggggcc

SEQ ID NO: 34711 - DNA, 17 bp, Homo sapiens
tgccttgcacagggggc

SEQ ID NO: 34712 - DNA, 17 bp, Homo sapiens
tgccctggcaatggggc

SEQ ID NO: 34713 - DNA, 17 bp, Homo sapiens
gccatcaccgtggggcc

SEQ ID NO: 34714 - DNA, 16 bp, Homo sapiens
tgccctgaactggggc

SEQ ID NO: 34715 - DNA, 18 bp, Homo sapiens
tgcccttagaagggggcc

SEQ ID NO: 34716 - DNA, 18 bp, Homo sapiens
tgcctttctgactggggc

SEQ ID NO: 34717 - DNA, 19 bp, Homo sapiens
tgcccctggcatcctggcc

SEQ ID NO: 34718 - DNA, 20 bp, Homo sapiens
tgcccctgagaggaagggcc

SEQ ID NO: 34719 - DNA, 19 bp, Homo sapiens
tgccctgagcacgagggcc

SEQ ID NO: 34720 - DNA, 16 bp, Homo sapiens
tgccctgagctgtgcc

SEQ ID NO: 34721 - DNA, 19 bp, Homo sapiens
tgcccttgggacgggtacc

SEQ ID NO: 34722 - DNA, 20 bp, Homo sapiens
tgcccttagtggtgaaggcc

SEQ ID NO: 34723 - DNA, 17 bp, Homo sapiens
tgtccatgagtggaacc

SEQ ID NO: 34724 - DNA, 19 bp, Homo sapiens
tgcccttcagtgcagagcc

SEQ ID NO: 34725 - DNA, 17 bp, Homo sapiens
tgcctctgagtgaggcc

SEQ ID NO: 34726 - DNA, 16 bp, Homo sapiens
tgcccttgagtggaac

SEQ ID NO: 34727 - DNA, 21 bp, Homo sapiens
tgctcctgagcgggtgaggcc

SEQ ID NO: 34728 - DNA, 18 bp, Homo sapiens
tgcccctgcagtggggcc

SEQ ID NO: 34729 - DNA, 19 bp, Homo sapiens
tgctcctggcagcggggcc

SEQ ID NO: 34730 - DNA, 20 bp, Homo sapiens
tgcccctgctacagtggggc

SEQ ID NO: 34731 - DNA, 18 bp, Homo sapiens
tgccctgagccccagggc

SEQ ID NO: 34732 - DNA, 18 bp, Homo sapiens
tgcccttggggcattggg

SEQ ID NO: 34733 - DNA, 17 bp, Homo sapiens
tgctcttgaataaaacc

SEQ ID NO: 34734 - DNA, 17 bp, Homo sapiens
tgcccctgggatggggc

SEQ ID NO: 34735 - DNA, 18 bp, Homo sapiens
tgccctcgagacccagcc

SEQ ID NO: 34736 - DNA, 20 bp, Homo sapiens
tgcccttggtgtggaagggc

SEQ ID NO: 34737 - DNA, 19 bp, Homo sapiens
gccatcgaggtgtggggcc

SEQ ID NO: 34738 - DNA, 16 bp, Homo sapiens
tgcccttggtgacgcc

SEQ ID NO: 34739 - DNA, 17 bp, Homo sapiens
tgcccctgggctgtggc

SEQ ID NO: 34740 - DNA, 18 bp, Homo sapiens
gctctgagtggtggggcc

SEQ ID NO: 34741 - DNA, 22 bp, Homo sapiens
tgcccctggcccatgtggggcc

SEQ ID NO: 34742 - DNA, 16 bp, Homo sapiens
tgcccctgagcgaacc

SEQ ID NO: 34743 - DNA, 16 bp, Homo sapiens
tgcccttgagaagagc

SEQ ID NO: 34744 - DNA, 19 bp, Homo sapiens
tgcgcctgggtgtggggcc

SEQ ID NO: 34745 - DNA, 18 bp, Homo sapiens
tgcccttaagctggggcc

SEQ ID NO: 34746 - DNA, 16 bp, Homo sapiens
tgcccctgagccaagc

SEQ ID NO: 34747 - DNA, 18 bp, Homo sapiens
tgcccttgaacggaaacc

SEQ ID NO: 34748 - DNA, 18 bp, Homo sapiens
tgcccttgtccgggggcc

SEQ ID NO: 34749 - DNA, 71 bp, Bovine herpesvirus 1
tccggcgcgccaacgcgaagcgcggcgtctagccccgggcccggcaccgcgcttgcgcttggcgcgccggg

SEQ ID NO: 34750 - DNA, 24 bp, Bovine herpesvirus 1
caccgcgcttgcgcttggcgcgcc

SEQ ID NO: 34751 - DNA, 16 bp, Homo sapiens
cgcgcctgcagcccgc

SEQ ID NO: 34752 - DNA, 21 bp, Homo sapiens
caccctgcttgttctcgcgcc

SEQ ID NO: 34753 - DNA, 20 bp, Homo sapiens
caccgcgtctgcgtcgggcg

SEQ ID NO: 34754 - DNA, 16 bp, Homo sapiens
cgcgctgctggcgcgc

SEQ ID NO: 34755 - DNA, 18 bp, Homo sapiens
gcgctgcgctccagcgcc

SEQ ID NO: 34756 - DNA, 19 bp, Homo sapiens
cgctgcgctctgtgcccgc

SEQ ID NO: 34757 - DNA, 19 bp, Homo sapiens
ccgcgctgcgctctgtgcc

SEQ ID NO: 34758 - DNA, 19 bp, Homo sapiens
cactgcgctgcgcttctgg

SEQ ID NO: 34759 - DNA, 21 bp, Homo sapiens
ccgcgctcggcgctgtgcgcc

SEQ ID NO: 34760 - DNA, 21 bp, Homo sapiens
gcgcttgcgcaccgcggtgcc

SEQ ID NO: 34761 - DNA, 19 bp, Homo sapiens
cccgcttcagctggcgcgc

SEQ ID NO: 34762 - DNA, 19 bp, Homo sapiens
cacctgcttgcgcagcgcg

SEQ ID NO: 34763 - DNA, 21 bp, Homo sapiens
caccgcgctggcggccgcgcc

SEQ ID NO: 34764 - DNA, 18 bp, Homo sapiens
ccgccgcgcttgtgccgc

SEQ ID NO: 34765 - DNA, 20 bp, Homo sapiens
cactgcgcctgcgcctgcgc

SEQ ID NO: 34766 - DNA, 22 bp, Homo sapiens
ccgtgcgtgccagcagcgcgcc

SEQ ID NO: 34767 - DNA, 21 bp, Homo sapiens
cactgtgctgtgctcagcacg

SEQ ID NO: 34768 - DNA, 17 bp, Homo sapiens
ccgccgcttgcgcgcgc

SEQ ID NO: 34769 - DNA, 19 bp, Homo sapiens
cactgcgctttcgctttgc

SEQ ID NO: 34770 - DNA, 18 bp, Homo sapiens
gcgctgcgcccgcgcgcc

SEQ ID NO: 34771 - DNA, 21 bp, Homo sapiens
ccgcgtcccgcttggcgcgcc

SEQ ID NO: 34772 - DNA, 17 bp, Homo sapiens
cgcgcttgcgcaagcgc

SEQ ID NO: 34773 - DNA, 17 bp, Homo sapiens
ccgcgcttgtgctgcgc

SEQ ID NO: 34774 - DNA, 17 bp, Homo sapiens
ccggcttgcgcctgcgc

SEQ ID NO: 34775 - DNA, 18 bp, Homo sapiens
cgctgcgcttcgcctcgc

SEQ ID NO: 34776 - DNA, 17 bp, Homo sapiens
cactccgcttggcgggc

SEQ ID NO: 34777 - DNA, 17 bp, Homo sapiens
ccgcgctctgcccgcgc

SEQ ID NO: 34778 - DNA, 17 bp, Homo sapiens
ccgcgcttgcgccagcg

SEQ ID NO: 34779 - DNA, 131 bp, Swinepox virus
tctatttttaaactatttttaattttcttatttaatatattagccacctgtgaaaaatcgaaatcgttaagacacgctttaatcggttcattaaatacgtatgtatatttcttaaatttaatagttatagg

SEQ ID NO: 34780 - DNA, 24 bp, Swinepox virus
tgtgaaaaatcgaaatcgttaaga

SEQ ID NO: 34781 - DNA, 27 bp, Homo sapiens
tgtgaaaaatatggaactcaagtaaga

SEQ ID NO: 34782 - DNA, 23 bp, Homo sapiens
tgtgaaaaatcaaaacatacaga

SEQ ID NO: 34783 - DNA, 19 bp, Homo sapiens
tgtgaaaaatcagtgcaag

SEQ ID NO: 34784 - DNA, 63 bp, Swinepox virus
agttcgtatatttttatatataacaatgatatttgtaaaaaaataaacttaacatattgaact

SEQ ID NO: 34785 - DNA, 24 bp, Swinepox virus
tttgtaaaaaaataaacttaacat

SEQ ID NO: 34786 - DNA, 23 bp, Homo sapiens
taaaaaaatacccaacttaacat

SEQ ID NO: 34787 - DNA, 18 bp, Homo sapiens
cttgtaaaaaaataaacc

SEQ ID NO: 34788 - DNA, 18 bp, Homo sapiens
tttgtaagaaaataaact

SEQ ID NO: 34789 - DNA, 25 bp, Homo sapiens
tttgtaaaaacaaaccatttaacat

SEQ ID NO: 34790 - DNA, 18 bp, Homo sapiens
tttgcagaaaaataaact

SEQ ID NO: 34791 - DNA, 21 bp, Homo sapiens
tttgtagaaaataaacttaac

SEQ ID NO: 34792 - DNA, 69 bp, Swinepox virus
atgaaaatcttgctaatgggaatataattatatttcctctatcgtataaataattagctcttttttcat

SEQ ID NO: 34793 - DNA, 24 bp, Swinepox virus
ttcctctatcgtataaataattag

SEQ ID NO: 34794 - DNA, 17 bp, Homo sapiens
ttcctctatgtataaat

SEQ ID NO: 34795 - DNA, 23 bp, Homo sapiens
ttcttctgtcatataaatattag

SEQ ID NO: 34796 - DNA, 23 bp, Homo sapiens
ttcctcagtgatcaaataattag

SEQ ID NO: 34797 - DNA, 21 bp, Homo sapiens
ctctacaaataaaataattag

SEQ ID NO: 34798 - DNA, 20 bp, Homo sapiens
ttcctctattgttataaata

SEQ ID NO: 34799 - DNA, 64 bp, Equine herpesvirus 2
gtccttcgcggacgcctcggccgcctgcgggtaccagggggtggtggaggtggtcatgagggac

SEQ ID NO: 34800 - DNA, 21 bp, Equine herpesvirus 2
gtggaggtggtcatgagggac

SEQ ID NO: 34801 - DNA, 16 bp, Homo sapiens
gtgaaggtggttgtgg

SEQ ID NO: 34802 - DNA, 21 bp, Homo sapiens
gtggaggtggtccacacaggg

SEQ ID NO: 34803 - DNA, 18 bp, Homo sapiens
gcggggttggcatgaggg

SEQ ID NO: 34804 - DNA, 20 bp, Homo sapiens
gtggaggtaggttatgggac

SEQ ID NO: 34805 - DNA, 19 bp, Homo sapiens
ggactcaagcatgagggac

SEQ ID NO: 34806 - DNA, 18 bp, Homo sapiens
gtggggtgctcccgaggg

SEQ ID NO: 34807 - DNA, 15 bp, Homo sapiens
gtgaaggttgaggga

SEQ ID NO: 34808 - DNA, 16 bp, Homo sapiens
gtggaggtggttgggg

SEQ ID NO: 34809 - DNA, 22 bp, Homo sapiens
gtgggagtggttcaagtcaggg

SEQ ID NO: 34810 - DNA, 16 bp, Homo sapiens
atggaggtcccgaggg

SEQ ID NO: 34811 - DNA, 21 bp, Homo sapiens
gtgggggtgtctgcctcggac

SEQ ID NO: 34812 - DNA, 15 bp, Homo sapiens
gtagaggtggtggga

SEQ ID NO: 34813 - DNA, 18 bp, Homo sapiens
gcggaggtgggcgaaggg

SEQ ID NO: 34814 - DNA, 17 bp, Homo sapiens
gtggaggtggggtgggg

SEQ ID NO: 34815 - DNA, 16 bp, Homo sapiens
gtgggtgggtgaggga

SEQ ID NO: 34816 - DNA, 19 bp, Homo sapiens
gtgagggtgagtgggggac

SEQ ID NO: 34817 - DNA, 15 bp, Homo sapiens
gtggaggtggtgggg

SEQ ID NO: 34818 - DNA, 19 bp, Homo sapiens
gtggtagggtattgaggga

SEQ ID NO: 34819 - DNA, 18 bp, Homo sapiens
gtggggctgggcagggac

SEQ ID NO: 34820 - DNA, 19 bp, Homo sapiens
gtggaggctggggatggga

SEQ ID NO: 34821 - DNA, 16 bp, Homo sapiens
gtggaggtgggtgggg

SEQ ID NO: 34822 - DNA, 18 bp, Homo sapiens
ggaggtgagtggggggac

SEQ ID NO: 34823 - DNA, 18 bp, Homo sapiens
gtgggggtggggtgaggg

SEQ ID NO: 34824 - DNA, 18 bp, Homo sapiens
gtggagatggcgttgggg

SEQ ID NO: 34825 - DNA, 24 bp, Homo sapiens
gtggaggtgctatggatgagggac

SEQ ID NO: 34826 - DNA, 16 bp, Homo sapiens
ggagagtggtgaggga

SEQ ID NO: 34827 - DNA, 19 bp, Homo sapiens
gtggggagtggcaagggac

SEQ ID NO: 34828 - DNA, 21 bp, Homo sapiens
ggaggtggtggccgcagggac

SEQ ID NO: 34829 - DNA, 18 bp, Homo sapiens
gtgaaggtgggattgggg

SEQ ID NO: 34830 - DNA, 19 bp, Homo sapiens
gtgggggtggcctgcagac

SEQ ID NO: 34831 - DNA, 18 bp, Homo sapiens
gtggggatggttaatggg

SEQ ID NO: 34832 - DNA, 20 bp, Homo sapiens
gtagagactacatgagggac

SEQ ID NO: 34833 - DNA, 17 bp, Homo sapiens
atggaggtgctgtgggg

SEQ ID NO: 34834 - DNA, 16 bp, Homo sapiens
gtggaggcggtggggg

SEQ ID NO: 34835 - DNA, 17 bp, Homo sapiens
gtgaaggtggtgtgggg

SEQ ID NO: 34836 - DNA, 23 bp, Homo sapiens
gtggaggtcgggggcgtggggac

SEQ ID NO: 34837 - DNA, 22 bp, Homo sapiens
gtgggggtgcgtcctcccaggg

SEQ ID NO: 34838 - DNA, 20 bp, Homo sapiens
gcggaggtgcggatagggac

SEQ ID NO: 34839 - DNA, 17 bp, Homo sapiens
tggaggtggagaaggga

SEQ ID NO: 34840 - DNA, 19 bp, Homo sapiens
ggaggtggacgggagggac

SEQ ID NO: 34841 - DNA, 17 bp, Homo sapiens
ggaggtggctgcaggga

SEQ ID NO: 34842 - DNA, 15 bp, Homo sapiens
gtagaggtgatgggg

SEQ ID NO: 34843 - DNA, 18 bp, Homo sapiens
gtggaggtggacatttga

SEQ ID NO: 34844 - DNA, 21 bp, Homo sapiens
atgggggtggttcctatggac

SEQ ID NO: 34845 - DNA, 16 bp, Homo sapiens
gtggagatggaaaggg

SEQ ID NO: 34846 - DNA, 20 bp, Homo sapiens
ggaggcctctggtgagggac

SEQ ID NO: 34847 - DNA, 21 bp, Homo sapiens
gtggggttggggagttgaggg

SEQ ID NO: 34848 - DNA, 19 bp, Homo sapiens
gcgggacggcgtgagggac

SEQ ID NO: 34849 - DNA, 20 bp, Homo sapiens
tggggcgacctatgggggac

SEQ ID NO: 34850 - DNA, 15 bp, Homo sapiens
gtggagatgggaggg

SEQ ID NO: 34851 - DNA, 17 bp, Homo sapiens
ggaggtggctgcgggga

SEQ ID NO: 34852 - DNA, 20 bp, Homo sapiens
gtggaggtcgggggggaggg

SEQ ID NO: 34853 - DNA, 16 bp, Homo sapiens
gtgaaggtggggaggg

SEQ ID NO: 34854 - DNA, 18 bp, Homo sapiens
gtgagaggggcatgaggg

SEQ ID NO: 34855 - DNA, 20 bp, Homo sapiens
gtgcatgttgcatgagggac

SEQ ID NO: 34856 - DNA, 15 bp, Homo sapiens
atggagtgtgaggga

SEQ ID NO: 34857 - DNA, 18 bp, Homo sapiens
gtggaggtggtgacaggg

SEQ ID NO: 34858 - DNA, 19 bp, Homo sapiens
gtggcggtggtagctgggg

SEQ ID NO: 34859 - DNA, 18 bp, Homo sapiens
gtggggtggtcagaaagg

SEQ ID NO: 34860 - DNA, 16 bp, Homo sapiens
gtggaggtggctgtgg

SEQ ID NO: 34861 - DNA, 18 bp, Homo sapiens
gtgggggtggataaagac

SEQ ID NO: 34862 - DNA, 17 bp, Homo sapiens
gtggaagtggtgtaggg

SEQ ID NO: 34863 - DNA, 18 bp, Homo sapiens
gtggaggtggtctgtgaa

SEQ ID NO: 34864 - DNA, 17 bp, Homo sapiens
gtggaggcgggtggggg

SEQ ID NO: 34865 - DNA, 20 bp, Homo sapiens
gtggggctgggccaagggac

SEQ ID NO: 34866 - DNA, 16 bp, Homo sapiens
gggaggtggggaggga

SEQ ID NO: 34867 - DNA, 18 bp, Homo sapiens
gggggtggtcatctaaga

SEQ ID NO: 34868 - DNA, 15 bp, Homo sapiens
gtggggggctgaggg

SEQ ID NO: 34869 - DNA, 17 bp, Homo sapiens
gtggagatggcccaggg

SEQ ID NO: 34870 - DNA, 21 bp, Homo sapiens
gtggagctgcgtgagagggac

SEQ ID NO: 34871 - DNA, 18 bp, Homo sapiens
gtggaggctggccagggg

SEQ ID NO: 34872 - DNA, 19 bp, Homo sapiens
gtgaaggtgggtcaggggg

SEQ ID NO: 34873 - DNA, 17 bp, Homo sapiens
gtggaggtaggggaggg

SEQ ID NO: 34874 - DNA, 19 bp, Homo sapiens
gtggaggggctcctgggac

SEQ ID NO: 34875 - DNA, 17 bp, Homo sapiens
ggaggtggtcatgggaa

SEQ ID NO: 34876 - DNA, 22 bp, Homo sapiens
gtgagggcagccagtgagggac

SEQ ID NO: 34877 - DNA, 18 bp, Homo sapiens
tggaggtggcataatggg

SEQ ID NO: 34878 - DNA, 21 bp, Homo sapiens
gagggctcacccatgagggac

SEQ ID NO: 34879 - DNA, 21 bp, Homo sapiens
gtggggatggggttgggggac

SEQ ID NO: 34880 - DNA, 18 bp, Homo sapiens
gtggaggtggggatgggg

SEQ ID NO: 34881 - DNA, 19 bp, Homo sapiens
ggaggtgctggtgagggac

SEQ ID NO: 34882 - DNA, 16 bp, Homo sapiens
gtggaggtgatgggga

SEQ ID NO: 34883 - DNA, 20 bp, Homo sapiens
gcgggggtggagatgaggga

SEQ ID NO: 34884 - DNA, 16 bp, Homo sapiens
gtggaggggtgtgggg

SEQ ID NO: 34885 - DNA, 15 bp, Homo sapiens
tggagatgatgaggg

SEQ ID NO: 34886 - DNA, 22 bp, Homo sapiens
gtggggtgtggtgggaagggac

SEQ ID NO: 34887 - DNA, 17 bp, Homo sapiens
ggaggtggggcggggac

SEQ ID NO: 34888 - DNA, 15 bp, Homo sapiens
gcggaggtggcgggg

SEQ ID NO: 34889 - DNA, 15 bp, Homo sapiens
gtggaggtgacgggg

SEQ ID NO: 34890 - DNA, 19 bp, Homo sapiens
gtggaggagacgcggggac

SEQ ID NO: 34891 - DNA, 18 bp, Homo sapiens
gtggaggtgtcctcaggg

SEQ ID NO: 34892 - DNA, 17 bp, Homo sapiens
ggaggtgagagagggac

SEQ ID NO: 34893 - DNA, 16 bp, Homo sapiens
gtggaggtggggaggg

SEQ ID NO: 34894 - DNA, 20 bp, Homo sapiens
gtgggtgtgaggatggggga

SEQ ID NO: 34895 - DNA, 19 bp, Homo sapiens
tggaggtggggacagggac

SEQ ID NO: 34896 - DNA, 15 bp, Homo sapiens
gtgaaggtggaggga

SEQ ID NO: 34897 - DNA, 19 bp, Homo sapiens
gtgggggtgggccaggggg

SEQ ID NO: 34898 - DNA, 18 bp, Homo sapiens
gtagaggtggccagggac

SEQ ID NO: 34899 - DNA, 18 bp, Homo sapiens
gtgggggtggccatgggg

SEQ ID NO: 34900 - DNA, 16 bp, Homo sapiens
atggaggtgcccaggg

SEQ ID NO: 34901 - DNA, 18 bp, Homo sapiens
gtggcggcggcgtgaggg

SEQ ID NO: 34902 - DNA, 21 bp, Homo sapiens
tgggggttgggggtgagggac

SEQ ID NO: 34903 - DNA, 18 bp, Homo sapiens
gtggaggtaggcggggac

SEQ ID NO: 34904 - DNA, 16 bp, Homo sapiens
gtggagatgagaaggg

SEQ ID NO: 34905 - DNA, 15 bp, Homo sapiens
gggagggatgaggga

SEQ ID NO: 34906 - DNA, 17 bp, Homo sapiens
gtggaggtgggtggggg

SEQ ID NO: 34907 - DNA, 21 bp, Homo sapiens
gtgggaatgtctgtgagggac

SEQ ID NO: 34908 - DNA, 19 bp, Homo sapiens
gtggaggctgggatcgggg

SEQ ID NO: 34909 - DNA, 16 bp, Homo sapiens
gtggaggtagtccagg

SEQ ID NO: 34910 - DNA, 18 bp, Homo sapiens
gtgagggtggtaaaggac

SEQ ID NO: 34911 - DNA, 18 bp, Homo sapiens
gtggggtgtgccagggac

SEQ ID NO: 34912 - DNA, 20 bp, Homo sapiens
gtggaggggcaaagggggac

SEQ ID NO: 34913 - DNA, 19 bp, Homo sapiens
gagggctggtatgagggac

SEQ ID NO: 34914 - DNA, 19 bp, Homo sapiens
gtgaaggtggcaatggggg

SEQ ID NO: 34915 - DNA, 19 bp, Homo sapiens
gtggacactcatgggggac

SEQ ID NO: 34916 - DNA, 17 bp, Homo sapiens
gagggtccctgagggac

SEQ ID NO: 34917 - DNA, 19 bp, Homo sapiens
gtggaagccagtatggggg

SEQ ID NO: 34918 - DNA, 20 bp, Homo sapiens
gtgggggccggctgggggac

SEQ ID NO: 34919 - DNA, 19 bp, Homo sapiens
gtggagtggggccaaaggg

SEQ ID NO: 34920 - DNA, 16 bp, Homo sapiens
gtgggggtggttaagg

SEQ ID NO: 34921 - DNA, 17 bp, Homo sapiens
gtgggggttgtctgaga

SEQ ID NO: 34922 - DNA, 18 bp, Homo sapiens
gtggaagtggggccgggg

SEQ ID NO: 34923 - DNA, 15 bp, Homo sapiens
gtgggtgatgaggga

SEQ ID NO: 34924 - DNA, 20 bp, Homo sapiens
gtggaagtgtggccagggac

SEQ ID NO: 34925 - DNA, 19 bp, Homo sapiens
gcggaggtaggagagggac

SEQ ID NO: 34926 - DNA, 17 bp, Homo sapiens
gtgaaggtcagcggggg

SEQ ID NO: 34927 - DNA, 15 bp, Homo sapiens
gtggaggtggcaggg

SEQ ID NO: 34928 - DNA, 16 bp, Homo sapiens
gtggtaggtgcgggga

SEQ ID NO: 34929 - DNA, 18 bp, Homo sapiens
gtggaggggtcatttcag

SEQ ID NO: 34930 - DNA, 15 bp, Homo sapiens
atggaggtggaaggg

SEQ ID NO: 34931 - DNA, 16 bp, Homo sapiens
gtggaggtggtggagg

SEQ ID NO: 34932 - DNA, 20 bp, Homo sapiens
atgggggcaggatgagggac

SEQ ID NO: 34933 - DNA, 21 bp, Homo sapiens
tggaggtggagcctcagggac

SEQ ID NO: 34934 - DNA, 17 bp, Homo sapiens
gtggaagtggtggaggg

SEQ ID NO: 34935 - DNA, 20 bp, Homo sapiens
atggggtgggtgtgggggac

SEQ ID NO: 34936 - DNA, 16 bp, Homo sapiens
gtggaggaggctgggg

SEQ ID NO: 34937 - DNA, 16 bp, Homo sapiens
gtggaggtgctcggga

SEQ ID NO: 34938 - DNA, 16 bp, Homo sapiens
gcggaggtcccggggg

SEQ ID NO: 34939 - DNA, 19 bp, Homo sapiens
ggagaggtttgtgagggac

SEQ ID NO: 34940 - DNA, 16 bp, Homo sapiens
gtggagggggccggga

SEQ ID NO: 34941 - DNA, 19 bp, Homo sapiens
gtggaggcggtggacgggg

SEQ ID NO: 34942 - DNA, 15 bp, Homo sapiens
gtggggagtgaggga

SEQ ID NO: 34943 - DNA, 16 bp, Homo sapiens
atgggattcatggggg

SEQ ID NO: 34944 - DNA, 17 bp, Homo sapiens
gtgggggtggtcagaga

SEQ ID NO: 34945 - DNA, 17 bp, Homo sapiens
ggagcggcatgagggac

SEQ ID NO: 34946 - DNA, 19 bp, Homo sapiens
gtggaggtggcgcggggac

SEQ ID NO: 34947 - DNA, 16 bp, Homo sapiens
gtggggtgtgagggac

SEQ ID NO: 34948 - DNA, 20 bp, Homo sapiens
gtggaggtggtgttccggac

SEQ ID NO: 34949 - DNA, 19 bp, Homo sapiens
atggaggtgaactggggac

SEQ ID NO: 34950 - DNA, 16 bp, Homo sapiens
gtggaggtggctgggg

SEQ ID NO: 34951 - DNA, 16 bp, Homo sapiens
gtgggggtggatgaga

SEQ ID NO: 34952 - DNA, 15 bp, Homo sapiens
gtggagatgcaaggg

SEQ ID NO: 34953 - DNA, 18 bp, Homo sapiens
gtggaggtgggcgtgggg

SEQ ID NO: 34954 - DNA, 19 bp, Homo sapiens
gaggaggaaaatgagggac

SEQ ID NO: 34955 - DNA, 18 bp, Homo sapiens
gtggaggttgtccaaggg

SEQ ID NO: 34956 - DNA, 19 bp, Homo sapiens
gtggaggtgggcaatgggg

SEQ ID NO: 34957 - DNA, 18 bp, Homo sapiens
gggggtgaccacggggac

SEQ ID NO: 34958 - DNA, 21 bp, Homo sapiens
gtggaggctggaggtgcaggg

SEQ ID NO: 34959 - DNA, 22 bp, Homo sapiens
gtggaggtgtttgccctggggg

SEQ ID NO: 34960 - DNA, 16 bp, Homo sapiens
gtggaggtggcataga

SEQ ID NO: 34961 - DNA, 17 bp, Homo sapiens
ggaggtggggtggggac

SEQ ID NO: 34962 - DNA, 18 bp, Homo sapiens
gtggaggtgtttgtccga

SEQ ID NO: 34963 - DNA, 18 bp, Homo sapiens
gcggaggctgtgagggac

SEQ ID NO: 34964 - DNA, 21 bp, Homo sapiens
gaggtgattaggtcatggggg

SEQ ID NO: 34965 - DNA, 19 bp, Homo sapiens
gtgggacaaaacatgaggg

SEQ ID NO: 34966 - DNA, 19 bp, Homo sapiens
gtggaggtcggtgtgggga

SEQ ID NO: 34967 - DNA, 19 bp, Homo sapiens
gtggcgagcagcatgaggg

SEQ ID NO: 34968 - DNA, 18 bp, Homo sapiens
gtggagggtggcggaggg

SEQ ID NO: 34969 - DNA, 15 bp, Homo sapiens
gtgaaggtggtgggg

SEQ ID NO: 34970 - DNA, 24 bp, Homo sapiens
gtggaggttggggcaggtggggga

SEQ ID NO: 34971 - DNA, 17 bp, Homo sapiens
atggaggcatctgaggg

SEQ ID NO: 34972 - DNA, 20 bp, Homo sapiens
tggaggcctgggtgagggac

SEQ ID NO: 34973 - DNA, 20 bp, Homo sapiens
gtgagggtgggggtgaggga

SEQ ID NO: 34974 - DNA, 18 bp, Homo sapiens
gtggggtggaggagggac

SEQ ID NO: 34975 - DNA, 21 bp, Homo sapiens
gtggagagttgggggtgaggg

SEQ ID NO: 34976 - DNA, 19 bp, Homo sapiens
gtggggaatcttgagggac

SEQ ID NO: 34977 - DNA, 19 bp, Homo sapiens
ggaggtggagcacagggga

SEQ ID NO: 34978 - DNA, 15 bp, Homo sapiens
gtggaggctgaggga

SEQ ID NO: 34979 - DNA, 16 bp, Homo sapiens
gtgggggtagccaggg

SEQ ID NO: 34980 - DNA, 18 bp, Homo sapiens
gtggaggtggcggagagg

SEQ ID NO: 34981 - DNA, 18 bp, Homo sapiens
gtggagatgtcagaggga

SEQ ID NO: 34982 - DNA, 15 bp, Homo sapiens
gtgggatgtgaggga

SEQ ID NO: 34983 - DNA, 15 bp, Homo sapiens
gtgaaggtccgaggg

SEQ ID NO: 34984 - DNA, 17 bp, Homo sapiens
gtagaggtggtgaaggg

SEQ ID NO: 34985 - DNA, 16 bp, Homo sapiens
gtggggatgatgaggg

SEQ ID NO: 34986 - DNA, 19 bp, Homo sapiens
tggggccctagcatgaggg

SEQ ID NO: 34987 - DNA, 18 bp, Homo sapiens
gtggtggtggctacgggg

SEQ ID NO: 34988 - DNA, 18 bp, Homo sapiens
gtggaggctggatgggac

SEQ ID NO: 34989 - DNA, 69 bp, Cowpox virus
ataaaaatatttttgtaaaacttttttatgagaccatcgaagagagaaagagaataaaaatatttttgt

SEQ ID NO: 34990 - DNA, 24 bp, Cowpox virus
gaagagagaaagagaataaaaata

SEQ ID NO: 34991 - DNA, 24 bp, Homo sapiens
agagagaaagtagttgtgaaaata

SEQ ID NO: 34992 - DNA, 22 bp, Homo sapiens
gaagaaagaaaggctgggaata

SEQ ID NO: 34993 - DNA, 18 bp, Homo sapiens
gaagacaggaaaataaaa

SEQ ID NO: 34994 - DNA, 18 bp, Homo sapiens
gaagagagtaacaaaaat

SEQ ID NO: 34995 - DNA, 21 bp, Homo sapiens
agagagaaacaaaagaaaaat

SEQ ID NO: 34996 - DNA, 19 bp, Homo sapiens
gaagagagaaagggggaga

SEQ ID NO: 34997 - DNA, 18 bp, Homo sapiens
aaagagaaataaggaata

SEQ ID NO: 34998 - DNA, 19 bp, Homo sapiens
gaggagagaaaaaggaata

SEQ ID NO: 34999 - DNA, 30 bp, Homo sapiens
gaagagagagtgggggatcagaaaaaatat

SEQ ID NO: 35000 - DNA, 17 bp, Homo sapiens
gaagaaagaataaaata

SEQ ID NO: 35001 - DNA, 18 bp, Homo sapiens
gaagagaggaaaagaaca

SEQ ID NO: 35002 - DNA, 21 bp, Homo sapiens
gagagacataaaaataaaaat

SEQ ID NO: 35003 - DNA, 19 bp, Homo sapiens
aaagagagagggggaacaa

SEQ ID NO: 35004 - DNA, 17 bp, Homo sapiens
gagagagaaggaaaata

SEQ ID NO: 35005 - DNA, 18 bp, Homo sapiens
aagagaaagagaggaaaa

SEQ ID NO: 35006 - DNA, 18 bp, Homo sapiens
aaagagagaagggagaat

SEQ ID NO: 35007 - DNA, 22 bp, Homo sapiens
gaagggagggagagcaaaaata

SEQ ID NO: 35008 - DNA, 18 bp, Homo sapiens
gaagagaggggaagagaa

SEQ ID NO: 35009 - DNA, 18 bp, Homo sapiens
gaaaagagaaataagaga

SEQ ID NO: 35010 - DNA, 23 bp, Homo sapiens
gagagagagagagagaaaaaaaa

SEQ ID NO: 35011 - DNA, 18 bp, Homo sapiens
agagagaaaccaaaaata

SEQ ID NO: 35012 - DNA, 20 bp, Homo sapiens
agagagaaaatgtgaaaata

SEQ ID NO: 35013 - DNA, 19 bp, Homo sapiens
gaagaaagagcagaagata

SEQ ID NO: 35014 - DNA, 18 bp, Homo sapiens
gaatagagaaaaaaaata

SEQ ID NO: 35015 - DNA, 18 bp, Homo sapiens
gagagagagaaaacgaat

SEQ ID NO: 35016 - DNA, 18 bp, Homo sapiens
agggagaaagagagcaaa

SEQ ID NO: 35017 - DNA, 23 bp, Homo sapiens
aaagacttaagagaataaaaata

SEQ ID NO: 35018 - DNA, 24 bp, Homo sapiens
aaagagagaaatttgctaggaata

SEQ ID NO: 35019 - DNA, 22 bp, Homo sapiens
agagagaaagagaaaggaaata

SEQ ID NO: 35020 - DNA, 18 bp, Homo sapiens
gaagagaggcgaacaaaa

SEQ ID NO: 35021 - DNA, 19 bp, Homo sapiens
gaagagagaattaaaaata

SEQ ID NO: 35022 - DNA, 20 bp, Homo sapiens
gaagagaggcaggtaaaata

SEQ ID NO: 35023 - DNA, 18 bp, Homo sapiens
gaagagaggagagggtaa

SEQ ID NO: 35024 - DNA, 21 bp, Homo sapiens
gaagagggggaaaaacaaaaa

SEQ ID NO: 35025 - DNA, 17 bp, Homo sapiens
gaaaagaaagaggaata

SEQ ID NO: 35026 - DNA, 21 bp, Homo sapiens
gaagagaaggttaagaggata

SEQ ID NO: 35027 - DNA, 17 bp, Homo sapiens
gacagagaaaaaaaata

SEQ ID NO: 35028 - DNA, 19 bp, Homo sapiens
gagagaatagattttaaaa

SEQ ID NO: 35029 - DNA, 23 bp, Homo sapiens
gaagagagagagatgtcaaaata

SEQ ID NO: 35030 - DNA, 20 bp, Homo sapiens
aggagatagagataaaaata

SEQ ID NO: 35031 - DNA, 18 bp, Homo sapiens
gaaaggtagaataaaaat

SEQ ID NO: 35032 - DNA, 19 bp, Homo sapiens
gaggagagaaatgaataaa

SEQ ID NO: 35033 - DNA, 20 bp, Homo sapiens
gaagagggagagtaaaaata

SEQ ID NO: 35034 - DNA, 18 bp, Homo sapiens
aaagagagagagagaata

SEQ ID NO: 35035 - DNA, 18 bp, Homo sapiens
gaagagaaagggagagaa

SEQ ID NO: 35036 - DNA, 18 bp, Homo sapiens
aaagaggagacaggaata

SEQ ID NO: 35037 - DNA, 18 bp, Homo sapiens
gaagagagaagtagaata

SEQ ID NO: 35038 - DNA, 19 bp, Homo sapiens
aaggagagaaaataaaaat

SEQ ID NO: 35039 - DNA, 23 bp, Homo sapiens
gaagagagggagaatcagaaata

SEQ ID NO: 35040 - DNA, 18 bp, Homo sapiens
gagaaaaaaaagagaata

SEQ ID NO: 35041 - DNA, 22 bp, Homo sapiens
gaaaagagagagaaaaaaaaat

SEQ ID NO: 35042 - DNA, 22 bp, Homo sapiens
agagagaaaaagtcctcaaaat

SEQ ID NO: 35043 - DNA, 23 bp, Homo sapiens
aaagagaggggaaaataagaata

SEQ ID NO: 35044 - DNA, 19 bp, Homo sapiens
gagagggacaagaacaaaa

SEQ ID NO: 35045 - DNA, 19 bp, Homo sapiens
aaagggagagagaataaaa

SEQ ID NO: 35046 - DNA, 22 bp, Homo sapiens
gaagagaaaagaggctaaaaat

SEQ ID NO: 35047 - DNA, 18 bp, Homo sapiens
gaaaagagggtgaaaata

SEQ ID NO: 35048 - DNA, 18 bp, Homo sapiens
agagagaaagggaaaaaa

SEQ ID NO: 35049 - DNA, 20 bp, Homo sapiens
aaagagaagtaatgagaata

SEQ ID NO: 35050 - DNA, 22 bp, Homo sapiens
gagcagggagaaaataaaaata

SEQ ID NO: 35051 - DNA, 24 bp, Homo sapiens
agagagaaagacttttaaaaaata

SEQ ID NO: 35052 - DNA, 18 bp, Homo sapiens
aaagagagagagagaaca

SEQ ID NO: 35053 - DNA, 18 bp, Homo sapiens
aggagaaagagaagcaaa

SEQ ID NO: 35054 - DNA, 22 bp, Homo sapiens
gaaaagagaaaaacataagaat

SEQ ID NO: 35055 - DNA, 18 bp, Homo sapiens
gagagaaagcaaaaaata

SEQ ID NO: 35056 - DNA, 18 bp, Homo sapiens
gaagagaggaagaggaat

SEQ ID NO: 35057 - DNA, 21 bp, Homo sapiens
gaaaggaagaagacaaaaata

SEQ ID NO: 35058 - DNA, 20 bp, Homo sapiens
agagagaaaggtcagagaat

SEQ ID NO: 35059 - DNA, 17 bp, Homo sapiens
aagcagagaataaaaat

SEQ ID NO: 35060 - DNA, 18 bp, Homo sapiens
aaagggagaagaaaaata

SEQ ID NO: 35061 - DNA, 22 bp, Homo sapiens
gagggtcacaagaataaaaata

SEQ ID NO: 35062 - DNA, 18 bp, Homo sapiens
gaagagagaaaagaaata

SEQ ID NO: 35063 - DNA, 18 bp, Homo sapiens
aaagagaaaacaggaata

SEQ ID NO: 35064 - DNA, 20 bp, Homo sapiens
gaagggggagagagaaaata

SEQ ID NO: 35065 - DNA, 18 bp, Homo sapiens
gaagagaaaaagggaata

SEQ ID NO: 35066 - DNA, 22 bp, Homo sapiens
gaagagaggaggataataaaaa

SEQ ID NO: 35067 - DNA, 19 bp, Homo sapiens
gaggaggaaaagcagaaca

SEQ ID NO: 35068 - DNA, 20 bp, Homo sapiens
aaagagaggaaaagaaaata

SEQ ID NO: 35069 - DNA, 21 bp, Homo sapiens
gaagagaggattgtgaaaata

SEQ ID NO: 35070 - DNA, 24 bp, Homo sapiens
agagagaagaagctgatgaaaata

SEQ ID NO: 35071 - DNA, 19 bp, Homo sapiens
gaagagaaaacctaaaaat

SEQ ID NO: 35072 - DNA, 18 bp, Homo sapiens
gaagggaaaaaaagaata

SEQ ID NO: 35073 - DNA, 24 bp, Homo sapiens
gaagaaagggagagaacagcaata

SEQ ID NO: 35074 - DNA, 20 bp, Homo sapiens
gaagaggagaggatagaata

SEQ ID NO: 35075 - DNA, 19 bp, Homo sapiens
gaagaggaagaaagaataa

SEQ ID NO: 35076 - DNA, 21 bp, Homo sapiens
aaagagagaaggagttaataa

SEQ ID NO: 35077 - DNA, 23 bp, Homo sapiens
gaggaaagaaagagaaaacaaat

SEQ ID NO: 35078 - DNA, 18 bp, Homo sapiens
gaagagagaaggagagaa

SEQ ID NO: 35079 - DNA, 21 bp, Homo sapiens
aaagagaaagatctgaaaaat

SEQ ID NO: 35080 - DNA, 18 bp, Homo sapiens
gaagagaaagaaagaata

SEQ ID NO: 35081 - DNA, 19 bp, Homo sapiens
agagagaaagacaggaata

SEQ ID NO: 35082 - DNA, 18 bp, Homo sapiens
gaggagaaagacagaata

SEQ ID NO: 35083 - DNA, 20 bp, Homo sapiens
gaagaaagagaggcacaaaa

SEQ ID NO: 35084 - DNA, 18 bp, Homo sapiens
gaagagggaaacaaaata

SEQ ID NO: 35085 - DNA, 21 bp, Homo sapiens
aagaggttgaggataaaaata

SEQ ID NO: 35086 - DNA, 22 bp, Homo sapiens
gaaggagaaagagaaacgcaat

SEQ ID NO: 35087 - DNA, 17 bp, Homo sapiens
gagagggaaagaaaata

SEQ ID NO: 35088 - DNA, 21 bp, Homo sapiens
gaaaagagaggggaaaagaat

SEQ ID NO: 35089 - DNA, 22 bp, Homo sapiens
gaagaatcaaagaataaaaata

SEQ ID NO: 35090 - DNA, 19 bp, Homo sapiens
gaagagagataacaaaaat

SEQ ID NO: 35091 - DNA, 24 bp, Homo sapiens
gaagagaggtaggggaagaaaata

SEQ ID NO: 35092 - DNA, 19 bp, Homo sapiens
gaagaaagaaaagaaaata

SEQ ID NO: 35093 - DNA, 18 bp, Homo sapiens
aaagagagaaggtaaaat

SEQ ID NO: 35094 - DNA, 21 bp, Homo sapiens
aagagggaacagcataaaaat

SEQ ID NO: 35095 - DNA, 21 bp, Homo sapiens
gagagagaaacttggaaaata

SEQ ID NO: 35096 - DNA, 20 bp, Homo sapiens
gaagagagaggaaaacgaaa

SEQ ID NO: 35097 - DNA, 20 bp, Homo sapiens
gagacagaggcataaaaata

SEQ ID NO: 35098 - DNA, 83 bp, Swinepox virus
attgcccatgcacaaacgataagttttttctcatctcccttaagattattatataaaaatttaggtattgtatactcggcagt

SEQ ID NO: 35099 - DNA, 24 bp, Swinepox virus
taagttttttctcatctcccttaa

SEQ ID NO: 35100 - DNA, 19 bp, Homo sapiens
taagtctttctctccttta

SEQ ID NO: 35101 - DNA, 19 bp, Homo sapiens
atgtttccccatttccctt

SEQ ID NO: 35102 - DNA, 18 bp, Homo sapiens
taagttttttctttttcc

SEQ ID NO: 35103 - DNA, 20 bp, Homo sapiens
gttttttttttcccccttaa

SEQ ID NO: 35104 - DNA, 23 bp, Homo sapiens
aagtttgtagtcatttcccttaa

SEQ ID NO: 35105 - DNA, 20 bp, Homo sapiens
agttttttctcttgttcctt

SEQ ID NO: 35106 - DNA, 18 bp, Homo sapiens
taagttttcttttcatct

SEQ ID NO: 35107 - DNA, 18 bp, Homo sapiens
aagtttcaagtctccctt

SEQ ID NO: 35108 - DNA, 19 bp, Homo sapiens
taagttttttcccatttcc

SEQ ID NO: 35109 - DNA, 15 bp, Homo sapiens
tttttccctccctta

SEQ ID NO: 35110 - DNA, 19 bp, Homo sapiens
gtcttttcccagatcctta

SEQ ID NO: 35111 - DNA, 19 bp, Homo sapiens
taacctttttctcatttcc

SEQ ID NO: 35112 - DNA, 17 bp, Homo sapiens
aagtttttttgatctcc

SEQ ID NO: 35113 - DNA, 17 bp, Homo sapiens
gcttttttctcctctta

SEQ ID NO: 35114 - DNA, 20 bp, Homo sapiens
gttttttctttatctttctt

SEQ ID NO: 35115 - DNA, 23 bp, Homo sapiens
taagttttttctggtcttcactt

SEQ ID NO: 35116 - DNA, 27 bp, Homo sapiens
caagttttttctaaaaactcttcctta

SEQ ID NO: 35117 - DNA, 75 bp, Tupaia herpesvirus
ctgcaccccgggctcgtgtaccgcctgctgaaccccaccgccacggacctacgcgaacaccgggccgacctgcag

SEQ ID NO: 35118 - DNA, 18 bp, Tupaia herpesvirus
caccgggccgacctgcag

SEQ ID NO: 35119 - DNA, 18 bp, Homo sapiens
cactggcaagacctgcag

SEQ ID NO: 35120 - DNA, 17 bp, Homo sapiens
cacagggccgacctgag

SEQ ID NO: 35121 - DNA, 18 bp, Homo sapiens
caccgggccgaagcgcag

SEQ ID NO: 35122 - DNA, 16 bp, Homo sapiens
catcaaaaacctgcag

SEQ ID NO: 35123 - DNA, 18 bp, Homo sapiens
caccgggcgcacgctcag

SEQ ID NO: 35124 - DNA, 17 bp, Homo sapiens
caccaggcaacctgcag

SEQ ID NO: 35125 - DNA, 16 bp, Homo sapiens
cactggggacctgcag

SEQ ID NO: 35126 - DNA, 15 bp, Homo sapiens
caccaggccccgcag

SEQ ID NO: 35127 - DNA, 16 bp, Homo sapiens
caccagacccctgcag

SEQ ID NO: 35128 - DNA, 18 bp, Homo sapiens
caccggtgccacctgcag

SEQ ID NO: 35129 - DNA, 16 bp, Homo sapiens
cactggccgaccgcag

SEQ ID NO: 35130 - DNA, 18 bp, Homo sapiens
cacccatggaacctgcag

SEQ ID NO: 35131 - DNA, 18 bp, Homo sapiens
cctgggccagacctgcag

SEQ ID NO: 35132 - DNA, 20 bp, Homo sapiens
caccgggcccgtccccagcc

SEQ ID NO: 35133 - DNA, 16 bp, Homo sapiens
caccaggccaccacag

SEQ ID NO: 35134 - DNA, 17 bp, Homo sapiens
cactgagtcacctgcag

SEQ ID NO: 35135 - DNA, 15 bp, Homo sapiens
caccaggccctgcag

SEQ ID NO: 35136 - DNA, 17 bp, Homo sapiens
caccaggccaagagcag

SEQ ID NO: 35137 - DNA, 15 bp, Homo sapiens
caccaggcccctcag

SEQ ID NO: 35138 - DNA, 20 bp, Homo sapiens
caccaggcctccaactgcag

SEQ ID NO: 35139 - DNA, 17 bp, Homo sapiens
caccgggccacctgcag

SEQ ID NO: 35140 - DNA, 20 bp, Homo sapiens
cacagggtcgagccctgcag

SEQ ID NO: 35141 - DNA, 15 bp, Homo sapiens
caccaggccatacag

SEQ ID NO: 35142 - DNA, 16 bp, Homo sapiens
cactggaccgacacag

SEQ ID NO: 35143 - DNA, 17 bp, Homo sapiens
caccaggctgacctcag

SEQ ID NO: 35144 - DNA, 20 bp, Homo sapiens
cacccacagcagatctgcag

SEQ ID NO: 35145 - DNA, 21 bp, Homo sapiens
caccaggccgctgatctgcag

SEQ ID NO: 35146 - DNA, 18 bp, Homo sapiens
accgggcagaacctgcag

SEQ ID NO: 35147 - DNA, 15 bp, Homo sapiens
cacaggaacctgcag

SEQ ID NO: 35148 - DNA, 18 bp, Homo sapiens
caccaggctggatctgag

SEQ ID NO: 35149 - DNA, 16 bp, Homo sapiens
cacctgcgacctgcag

SEQ ID NO: 35150 - DNA, 15 bp, Homo sapiens
caccggaccccgcag

SEQ ID NO: 35151 - DNA, 15 bp, Homo sapiens
caccagcacctgcag

SEQ ID NO: 35152 - DNA, 18 bp, Homo sapiens
accgtccagtacctgcag

SEQ ID NO: 35153 - DNA, 15 bp, Homo sapiens
caccgggcaccccag

SEQ ID NO: 35154 - DNA, 16 bp, Homo sapiens
cacccctaacctgcag

SEQ ID NO: 35155 - DNA, 18 bp, Homo sapiens
caccaggcccgagagcag

SEQ ID NO: 35156 - DNA, 24 bp, Homo sapiens
caccgggctgagggagtctgcagc

SEQ ID NO: 35157 - DNA, 17 bp, Homo sapiens
caccaggcgcaaggcag

SEQ ID NO: 35158 - DNA, 18 bp, Homo sapiens
caccaggcaccagagcag

SEQ ID NO: 35159 - DNA, 16 bp, Homo sapiens
cacagatgacctgcag

SEQ ID NO: 35160 - DNA, 18 bp, Homo sapiens
caccaggctgaagtgcag

SEQ ID NO: 35161 - DNA, 18 bp, Homo sapiens
accagccaagacctgcag

SEQ ID NO: 35162 - DNA, 20 bp, Homo sapiens
caccaggccaggtcctgcag

SEQ ID NO: 35163 - DNA, 18 bp, Homo sapiens
ccgggccggaccgcgcag

SEQ ID NO: 35164 - DNA, 22 bp, Homo sapiens
caccgagcgggcgcgtctgcag

SEQ ID NO: 35165 - DNA, 17 bp, Homo sapiens
caccccgacacctgcag

SEQ ID NO: 35166 - DNA, 20 bp, Homo sapiens
ccgggccaggaggcctgcag

SEQ ID NO: 35167 - DNA, 19 bp, Homo sapiens
accaaaccctggcctgcag

SEQ ID NO: 35168 - DNA, 15 bp, Homo sapiens
caccaggacctgcag

SEQ ID NO: 35169 - DNA, 16 bp, Homo sapiens
cactggccgaccccag

SEQ ID NO: 35170 - DNA, 16 bp, Homo sapiens
cacccaggacctgcag

SEQ ID NO: 35171 - DNA, 18 bp, Homo sapiens
caggttcctgacctgcag

SEQ ID NO: 35172 - DNA, 15 bp, Homo sapiens
caccgagcgatgcag

SEQ ID NO: 35173 - DNA, 15 bp, Homo sapiens
cacaggcacctgcag

SEQ ID NO: 35174 - DNA, 91 bp, Cowpox virus
gagaaagagaataaaaatatttttgtaaaactttttttatgagaccattgaagagagaaagagaataaaaatatttttgtaaaactttttt

SEQ ID NO: 35175 - DNA, 79 bp, Cowpox virus
gagaataaaaatatttttgtaaaactttttttatgagaccattgaagagagaaagagaataaaaatatttttgttactc

SEQ ID NO: 35176 - DNA, 93 bp, Cowpox virus
gagaataaaatattttacgactccatcagaaagaggtttaatatttttgtgagaccattgaagagagaaagagaataaaatattttacgactc

SEQ ID NO: 35177 - DNA, 24 bp, Cowpox virus
tgagaccattgaagagagaaagag

SEQ ID NO: 35178 - DNA, 17 bp, Homo sapiens
tgagaccagtgacagaa

SEQ ID NO: 35179 - DNA, 21 bp, Homo sapiens
gagagagggagagagagagag

SEQ ID NO: 35180 - DNA, 22 bp, Homo sapiens
gagaaagagaagagagagggag

SEQ ID NO: 35181 - DNA, 18 bp, Homo sapiens
tgaggcctgggagaaaga

SEQ ID NO: 35182 - DNA, 22 bp, Homo sapiens
tgagccaagagaagagagaaag

SEQ ID NO: 35183 - DNA, 21 bp, Homo sapiens
gagagagagagagagaaggag

SEQ ID NO: 35184 - DNA, 18 bp, Homo sapiens
tgagggaagagagaaaga

SEQ ID NO: 35185 - DNA, 21 bp, Homo sapiens
gagagagaaagagagaaagag

SEQ ID NO: 35186 - DNA, 21 bp, Homo sapiens
gagagggagagagagaaagag

SEQ ID NO: 35187 - DNA, 21 bp, Homo sapiens
gagagagaaagagagagagag

SEQ ID NO: 35188 - DNA, 15 bp, Homo sapiens
gagagagagagaaag

SEQ ID NO: 35189 - DNA, 21 bp, Homo sapiens
tgagactgtacagagaaagag

SEQ ID NO: 35190 - DNA, 17 bp, Homo sapiens
tgagtcaggagagaaag

SEQ ID NO: 35191 - DNA, 22 bp, Homo sapiens
tgagaccagagatggggagaga

SEQ ID NO: 35192 - DNA, 19 bp, Homo sapiens
gagagagggagagggagag

SEQ ID NO: 35193 - DNA, 19 bp, Homo sapiens
gagagggagagagagagag

SEQ ID NO: 35194 - DNA, 16 bp, Homo sapiens
gagaggagagagaaag

SEQ ID NO: 35195 - DNA, 16 bp, Homo sapiens
gagagaggagagaaag

SEQ ID NO: 35196 - DNA, 25 bp, Homo sapiens
tgagacaaaaaagaagggggagaga

SEQ ID NO: 35197 - DNA, 21 bp, Homo sapiens
gaggaaaagagagagaaagag

SEQ ID NO: 35198 - DNA, 22 bp, Homo sapiens
gagaggagaaagagggagagag

SEQ ID NO: 35199 - DNA, 21 bp, Homo sapiens
gagagaggaagagagagagag

SEQ ID NO: 35200 - DNA, 19 bp, Homo sapiens
gagagagagagagagaaag

SEQ ID NO: 35201 - DNA, 21 bp, Homo sapiens
gagatggaaagagagaaagag

SEQ ID NO: 35202 - DNA, 16 bp, Homo sapiens
gaggaagagaggaaga

SEQ ID NO: 35203 - DNA, 21 bp, Homo sapiens
gagagagagagagagaaagag

SEQ ID NO: 35204 - DNA, 16 bp, Homo sapiens
agaaaagagagagaga

SEQ ID NO: 35205 - DNA, 22 bp, Homo sapiens
cgggactgcaggagagaaagag

SEQ ID NO: 35206 - DNA, 24 bp, Homo sapiens
tgagagaaaatgagggagaaggag

SEQ ID NO: 35207 - DNA, 21 bp, Homo sapiens
tgaaaataaagagagagagag

SEQ ID NO: 35208 - DNA, 21 bp, Homo sapiens
gagaaagaaggggagagagag

SEQ ID NO: 35209 - DNA, 17 bp, Homo sapiens
tgagggccgaagaggaa

SEQ ID NO: 35210 - DNA, 20 bp, Homo sapiens
tgagaccacctaggggaaag

SEQ ID NO: 35211 - DNA, 21 bp, Homo sapiens
tgagggtgagaagagaaagag

SEQ ID NO: 35212 - DNA, 17 bp, Homo sapiens
gagaaggagagagaaag

SEQ ID NO: 35213 - DNA, 16 bp, Homo sapiens
tggacaagagagaaag

SEQ ID NO: 35214 - DNA, 22 bp, Homo sapiens
tgaaaccacaagggagggggag

SEQ ID NO: 35215 - DNA, 19 bp, Homo sapiens
gagagagagagagaaagag

SEQ ID NO: 35216 - DNA, 19 bp, Homo sapiens
gaacatgtagagagagaag

SEQ ID NO: 35217 - DNA, 23 bp, Homo sapiens
tgagacttttgatataaaaagag

SEQ ID NO: 35218 - DNA, 17 bp, Homo sapiens
gagatggagagagagag

SEQ ID NO: 35219 - DNA, 18 bp, Homo sapiens
gaggaaaagggagaaaga

SEQ ID NO: 35220 - DNA, 19 bp, Homo sapiens
gagcagaagagagagggag

SEQ ID NO: 35221 - DNA, 26 bp, Homo sapiens
tgagcccccaaaaaagagagagagag

SEQ ID NO: 35222 - DNA, 16 bp, Homo sapiens
tgagacagagagaaag

SEQ ID NO: 35223 - DNA, 19 bp, Homo sapiens
tgagaccagtggcaaggaa

SEQ ID NO: 35224 - DNA, 15 bp, Homo sapiens
tgagattaaagagaa

SEQ ID NO: 35225 - DNA, 22 bp, Homo sapiens
tgagtttattaaagagagagag

SEQ ID NO: 35226 - DNA, 17 bp, Homo sapiens
tgaactgttgaagagaa

SEQ ID NO: 35227 - DNA, 20 bp, Homo sapiens
gagagagaggagaggaagag

SEQ ID NO: 35228 - DNA, 22 bp, Homo sapiens
gaggaagagaggagaggaagag

SEQ ID NO: 35229 - DNA, 18 bp, Homo sapiens
gagaggaagagagaggag

SEQ ID NO: 35230 - DNA, 20 bp, Homo sapiens
gagacagaggagagaaagag

SEQ ID NO: 35231 - DNA, 22 bp, Homo sapiens
gagagagagaggagaggaagag

SEQ ID NO: 35232 - DNA, 17 bp, Homo sapiens
gagagaggagaggaaga

SEQ ID NO: 35233 - DNA, 17 bp, Homo sapiens
gagagaagagaggaaga

SEQ ID NO: 35234 - DNA, 20 bp, Homo sapiens
gaggcgggagggagaaagag

SEQ ID NO: 35235 - DNA, 22 bp, Homo sapiens
gagagcaaaaggagagggggag

SEQ ID NO: 35236 - DNA, 21 bp, Homo sapiens
tgaggagagagagagaaagag

SEQ ID NO: 35237 - DNA, 22 bp, Homo sapiens
gatccgctgaagagggaaggag

SEQ ID NO: 35238 - DNA, 22 bp, Homo sapiens
gagaaaaaaaagagagagagag

SEQ ID NO: 35239 - DNA, 16 bp, Homo sapiens
gacaagagagaaagag

SEQ ID NO: 35240 - DNA, 21 bp, Homo sapiens
gagaaagaaagagagaaagag

SEQ ID NO: 35241 - DNA, 17 bp, Homo sapiens
gagctgagcagagaaag

SEQ ID NO: 35242 - DNA, 19 bp, Homo sapiens
taagagtaagagagagaga

SEQ ID NO: 35243 - DNA, 16 bp, Homo sapiens
tgaggcacagagaaag

SEQ ID NO: 35244 - DNA, 18 bp, Homo sapiens
tgaaaccatgagggagag

SEQ ID NO: 35245 - DNA, 20 bp, Homo sapiens
gagaagcagaagagagagag

SEQ ID NO: 35246 - DNA, 21 bp, Homo sapiens
gaggaggagggagagaaagag

SEQ ID NO: 35247 - DNA, 16 bp, Homo sapiens
tgagagagagagagag

SEQ ID NO: 35248 - DNA, 20 bp, Homo sapiens
gagacagagaagagagagag

SEQ ID NO: 35249 - DNA, 18 bp, Homo sapiens
gaggagaagagaggaaga

SEQ ID NO: 35250 - DNA, 18 bp, Homo sapiens
gagaaaagagagaaagag

SEQ ID NO: 35251 - DNA, 19 bp, Homo sapiens
gagagagggagagagagag

SEQ ID NO: 35252 - DNA, 23 bp, Homo sapiens
gagggacagggagagggaaagag

SEQ ID NO: 35253 - DNA, 22 bp, Homo sapiens
gaggcacagcggggagaaagag

SEQ ID NO: 35254 - DNA, 21 bp, Homo sapiens
gagagagggagagagagggag

SEQ ID NO: 35255 - DNA, 20 bp, Homo sapiens
gagggtaaagagagagggag

SEQ ID NO: 35256 - DNA, 18 bp, Homo sapiens
gagacgagagagagagag

SEQ ID NO: 35257 - DNA, 18 bp, Homo sapiens
gagagagagagagaaaga

SEQ ID NO: 35258 - DNA, 23 bp, Homo sapiens
tggagcaagaaagagagaaggag

SEQ ID NO: 35259 - DNA, 18 bp, Homo sapiens
tgaaaccgttgaagagaa

SEQ ID NO: 35260 - DNA, 18 bp, Homo sapiens
tgagacgggagagaaaga

SEQ ID NO: 35261 - DNA, 20 bp, Homo sapiens
tgagacctgaagagggagag

SEQ ID NO: 35262 - DNA, 18 bp, Homo sapiens
gagaaggaggagagaaag

SEQ ID NO: 35263 - DNA, 22 bp, Homo sapiens
gagaaaggaaggggagagggag

SEQ ID NO: 35264 - DNA, 18 bp, Homo sapiens
gaatctcagagagaagga

SEQ ID NO: 35265 - DNA, 19 bp, Homo sapiens
tgagcaaaagagaggaaga

SEQ ID NO: 35266 - DNA, 17 bp, Homo sapiens
gagggaggagagaaaga

SEQ ID NO: 35267 - DNA, 23 bp, Homo sapiens
gaggggtttggggggagaaagag

SEQ ID NO: 35268 - DNA, 18 bp, Homo sapiens
gagacagagagagagaga

SEQ ID NO: 35269 - DNA, 18 bp, Homo sapiens
caacgaagagagaaggag

SEQ ID NO: 35270 - DNA, 16 bp, Homo sapiens
tgagacacagagaaag

SEQ ID NO: 35271 - DNA, 22 bp, Homo sapiens
gagagagagaggagagagagag

SEQ ID NO: 35272 - DNA, 21 bp, Homo sapiens
gagacagagagagagaaagag

SEQ ID NO: 35273 - DNA, 21 bp, Homo sapiens
tgagttgaccaagagaaagag

SEQ ID NO: 35274 - DNA, 17 bp, Homo sapiens
gaggagagagagagaga

SEQ ID NO: 35275 - DNA, 17 bp, Homo sapiens
gagaggagagagagaga

SEQ ID NO: 35276 - DNA, 22 bp, Homo sapiens
gagaaagagaggagagagagag

SEQ ID NO: 35277 - DNA, 17 bp, Homo sapiens
gagagagagagagaaag

SEQ ID NO: 35278 - DNA, 21 bp, Homo sapiens
gaggatgaaagagagagagag

SEQ ID NO: 35279 - DNA, 18 bp, Homo sapiens
cactaaggagagagaaag

SEQ ID NO: 35280 - DNA, 20 bp, Homo sapiens
gacggggaggagagaaagag

SEQ ID NO: 35281 - DNA, 22 bp, Homo sapiens
gagagaaagaagagagagagag

SEQ ID NO: 35282 - DNA, 18 bp, Homo sapiens
tgagaaaagagggaggga

SEQ ID NO: 35283 - DNA, 19 bp, Homo sapiens
gagcagaagggagaaagag

SEQ ID NO: 35284 - DNA, 20 bp, Homo sapiens
taagactatgagagagaaag

SEQ ID NO: 35285 - DNA, 21 bp, Homo sapiens
gaggctcaaagagagaaagag

SEQ ID NO: 35286 - DNA, 22 bp, Homo sapiens
gagaaggggaggagagaaagag

SEQ ID NO: 35287 - DNA, 17 bp, Homo sapiens
aagacagaaagagagaa

SEQ ID NO: 35288 - DNA, 20 bp, Homo sapiens
gaggaaaaagagagaaagag

SEQ ID NO: 35289 - DNA, 16 bp, Homo sapiens
gagagagagagaaaga

SEQ ID NO: 35290 - DNA, 16 bp, Homo sapiens
taagaccaccagggag

SEQ ID NO: 35291 - DNA, 23 bp, Homo sapiens
tgagctttggtggagagaaagag

SEQ ID NO: 35292 - DNA, 17 bp, Homo sapiens
gaggaagagagggagaa

SEQ ID NO: 35293 - DNA, 21 bp, Homo sapiens
gaggatctgagggagaaagag

SEQ ID NO: 35294 - DNA, 15 bp, Homo sapiens
tgaaccaagagaaag

SEQ ID NO: 35295 - DNA, 22 bp, Homo sapiens
tgaggcagagaaagagagagag

SEQ ID NO: 35296 - DNA, 19 bp, Homo sapiens
gatacctaaagagagaaag

SEQ ID NO: 35297 - DNA, 19 bp, Homo sapiens
tgagacccacagagaaaga

SEQ ID NO: 35298 - DNA, 22 bp, Homo sapiens
tggaaaattgggagggaaagag

SEQ ID NO: 35299 - DNA, 23 bp, Homo sapiens
tgggaccactgcagctgggggag

SEQ ID NO: 35300 - DNA, 22 bp, Homo sapiens
tgaggtagacagagagaaggag

SEQ ID NO: 35301 - DNA, 21 bp, Homo sapiens
tgaatcatcaaagagaaggag

SEQ ID NO: 35302 - DNA, 18 bp, Homo sapiens
gaatgaaagagaggaaga

SEQ ID NO: 35303 - DNA, 20 bp, Homo sapiens
gacactgaaaagggagagag

SEQ ID NO: 35304 - DNA, 91 bp, Cowpox virus
tttttcttagtacaaaagtcaatgttttaaaatatatggacaagaatttgtctgtataaaaacttgtgtgaaattttgtaccaaagaaaaa

SEQ ID NO: 35305 - DNA, 24 bp, Cowpox virus
tgtgaaattttgtaccaaagaaaa

SEQ ID NO: 35306 - DNA, 24 bp, Homo sapiens
tgtgaaattttagataacagaaaa

SEQ ID NO: 35307 - DNA, 22 bp, Homo sapiens
tgtggagttctgtaccttaaga

SEQ ID NO: 35308 - DNA, 16 bp, Homo sapiens
tgtgtaacaccaaaga

SEQ ID NO: 35309 - DNA, 25 bp, Homo sapiens
tgtgaaatatttgtattgcactgaa

SEQ ID NO: 35310 - DNA, 20 bp, Homo sapiens
tggaaattttgtgctcaaag

SEQ ID NO: 35311 - DNA, 21 bp, Homo sapiens
tggaaatggaagcccaaagaa

SEQ ID NO: 35312 - DNA, 21 bp, Homo sapiens
tgtgaaattttgtttaaaaaa

SEQ ID NO: 35313 - DNA, 21 bp, Homo sapiens
gtgaaattttgtaggtgaaaa

SEQ ID NO: 35314 - DNA, 20 bp, Homo sapiens
tgtgagattttataacaaaa

SEQ ID NO: 35315 - DNA, 21 bp, Homo sapiens
gtggatggaataccaaagaaa

SEQ ID NO: 35316 - DNA, 20 bp, Homo sapiens
tgtgaaattttggccccaaa

SEQ ID NO: 35317 - DNA, 19 bp, Homo sapiens
tgtgaaatttttgccaaaa

SEQ ID NO: 35318 - DNA, 17 bp, Homo sapiens
tgtaaaattttgaaaga

SEQ ID NO: 35319 - DNA, 24 bp, Homo sapiens
tgagaagtgccaccccaaagaaaa

SEQ ID NO: 35320 - DNA, 24 bp, Homo sapiens
tgtgaaatttagtggccaggaaaa

SEQ ID NO: 35321 - DNA, 18 bp, Homo sapiens
tgtgaaattttctgtcca

SEQ ID NO: 35322 - DNA, 20 bp, Homo sapiens
tatgaaattttgtactaaaa

SEQ ID NO: 35323 - DNA, 23 bp, Homo sapiens
tgtgaaatgcactgcagagaaaa

SEQ ID NO: 35324 - DNA, 20 bp, Homo sapiens
tggaacctttgccaaagaaa

SEQ ID NO: 35325 - DNA, 20 bp, Homo sapiens
tgtgaaatattgtggtcaag

SEQ ID NO: 35326 - DNA, 22 bp, Homo sapiens
tgtgaaataaacgtgccaggga

SEQ ID NO: 35327 - DNA, 19 bp, Homo sapiens
tgaagaaaaccaaagaaaa

SEQ ID NO: 35328 - DNA, 24 bp, Homo sapiens
tatgaaattttgttaataagaaaa

SEQ ID NO: 35329 - DNA, 18 bp, Homo sapiens
tgtgaaatcttgtaagaa

SEQ ID NO: 35330 - DNA, 21 bp, Homo sapiens
tgtgaaactttattgagagaa

SEQ ID NO: 35331 - DNA, 19 bp, Homo sapiens
tgcggaatgaccaaagaaa

SEQ ID NO: 35332 - DNA, 23 bp, Homo sapiens
tgtggaactttgtacttttagaa

SEQ ID NO: 35333 - DNA, 23 bp, Homo sapiens
tgtgaaattttgctatgagaaaa

SEQ ID NO: 35334 - DNA, 22 bp, Homo sapiens
tgtaaaattttgtaatgggaga

SEQ ID NO: 35335 - DNA, 73 bp, Tupaia herpesvirus
gtggggcgacctgctcttctcgccgcccgtcgcgacgacgacgacgagcgacgcgcccggcgcggtccccgac

SEQ ID NO: 35336 - DNA, 24 bp, Tupaia herpesvirus
cgacgagcgacgcgcccggcgcgg

SEQ ID NO: 35337 - DNA, 24 bp, Homo sapiens
acggcgggctggggtccggcgcgg

SEQ ID NO: 35338 - DNA, 23 bp, Homo sapiens
cggcggcggtgagtccggcgcgg

SEQ ID NO: 35339 - DNA, 23 bp, Homo sapiens
cggcgggcggagctgcagtgcgg

SEQ ID NO: 35340 - DNA, 17 bp, Homo sapiens
cggcgggcggcggcgcg

SEQ ID NO: 35341 - DNA, 18 bp, Homo sapiens
cggcggcggcgcagacgg

SEQ ID NO: 35342 - DNA, 19 bp, Homo sapiens
cggcggcggcgcagacgcg

SEQ ID NO: 35343 - DNA, 17 bp, Homo sapiens
cgcgagcgacgcgccgg

SEQ ID NO: 35344 - DNA, 21 bp, Homo sapiens
cggcggcggcgcgcggcgcgg

SEQ ID NO: 35345 - DNA, 23 bp, Homo sapiens
gacaggcggcggcggcggcgcgg

SEQ ID NO: 35346 - DNA, 18 bp, Homo sapiens
gagcgacgccgcgcgcgg

SEQ ID NO: 35347 - DNA, 21 bp, Homo sapiens
cgccggccgcgctcggcgcgg

SEQ ID NO: 35348 - DNA, 19 bp, Homo sapiens
cgggcggcgcgacgggcgg

SEQ ID NO: 35349 - DNA, 19 bp, Homo sapiens
cggcggcggcgcgggagcg

SEQ ID NO: 35350 - DNA, 18 bp, Homo sapiens
cggcgcgcgggcggcgcg

SEQ ID NO: 35351 - DNA, 23 bp, Homo sapiens
cggcggcggcggcggcggcgcgg

SEQ ID NO: 35352 - DNA, 20 bp, Homo sapiens
cggcggcggcgcggggcgcg

SEQ ID NO: 35353 - DNA, 19 bp, Homo sapiens
cggcggcggcggcggcgcg

SEQ ID NO: 35354 - DNA, 22 bp, Homo sapiens
cggcgagggtgcgcccggctgg

SEQ ID NO: 35355 - DNA, 16 bp, Homo sapiens
cggcagcgcggcgcgg

SEQ ID NO: 35356 - DNA, 23 bp, Homo sapiens
cggcggcggcagactcggcgcgg

SEQ ID NO: 35357 - DNA, 22 bp, Homo sapiens
cgacagcggcgaggaggtgcgg

SEQ ID NO: 35358 - DNA, 18 bp, Homo sapiens
cggcggcgcagggcgcgg

SEQ ID NO: 35359 - DNA, 21 bp, Homo sapiens
cgcgggcggcgcgggcagcgg

SEQ ID NO: 35360 - DNA, 22 bp, Homo sapiens
cggcgggcggcccccggcgcgg

SEQ ID NO: 35361 - DNA, 18 bp, Homo sapiens
gcggcgcggcagccgcgg

SEQ ID NO: 35362 - DNA, 21 bp, Homo sapiens
cggacaccgcgtccggcgcgg

SEQ ID NO: 35363 - DNA, 22 bp, Homo sapiens
cggcgggcagggcgcggcgcgg

SEQ ID NO: 35364 - DNA, 22 bp, Homo sapiens
cggccgagcagatccggcgcgg

SEQ ID NO: 35365 - DNA, 21 bp, Homo sapiens
gcgtgagcgctatcggcgcgg

SEQ ID NO: 35366 - DNA, 28 bp, Homo sapiens
cgcgagcggcgcggggaggcggcgcggc

SEQ ID NO: 35367 - DNA, 18 bp, Homo sapiens
cggctgggccccggcgcg

SEQ ID NO: 35368 - DNA, 20 bp, Homo sapiens
cgggcgggcgggcggcgcgg

SEQ ID NO: 35369 - DNA, 19 bp, Homo sapiens
cgggcggcgcggggcgcgg

SEQ ID NO: 35370 - DNA, 21 bp, Homo sapiens
cggcgcggcggcgcggcgcgg

SEQ ID NO: 35371 - DNA, 23 bp, Homo sapiens
cggcggcgcggcgcggggcgcgg

SEQ ID NO: 35372 - DNA, 20 bp, Homo sapiens
cgagcgacgcgcagccggcg

SEQ ID NO: 35373 - DNA, 24 bp, Homo sapiens
cggcgagggacgctgcggccgcgc

SEQ ID NO: 35374 - DNA, 18 bp, Homo sapiens
gcggcagcggcggcgcgg

SEQ ID NO: 35375 - DNA, 18 bp, Homo sapiens
cggcgggccggcggcgcg

SEQ ID NO: 35376 - DNA, 17 bp, Homo sapiens
cgggcggcgcgcccacg

SEQ ID NO: 35377 - DNA, 16 bp, Homo sapiens
cgcgggcggcgggcgc

SEQ ID NO: 35378 - DNA, 24 bp, Homo sapiens
cgacaggcggccgaggaggcgcgg

SEQ ID NO: 35379 - DNA, 23 bp, Homo sapiens
cggcggcggcagcggcggcgcgg

SEQ ID NO: 35380 - DNA, 19 bp, Homo sapiens
gagcggcgcagtggcgcgg

SEQ ID NO: 35381 - DNA, 25 bp, Homo sapiens
cggcgagcgacgcgctcggtcccgg

SEQ ID NO: 35382 - DNA, 19 bp, Homo sapiens
cggcggcgacgcgcgggcg

SEQ ID NO: 35383 - DNA, 16 bp, Homo sapiens
cgacggcggcgcggcg

SEQ ID NO: 35384 - DNA, 19 bp, Homo sapiens
gagagcgacggcggcgcgg

SEQ ID NO: 35385 - DNA, 23 bp, Homo sapiens
cggcggcggctgaggcggcgcgg

SEQ ID NO: 35386 - DNA, 16 bp, Homo sapiens
cgacggcggcgcgggc

SEQ ID NO: 35387 - DNA, 22 bp, Homo sapiens
cgggcagcgcggagagccgcgg

SEQ ID NO: 35388 - DNA, 16 bp, Homo sapiens
cggcgcggcccggcgc

SEQ ID NO: 35389 - DNA, 21 bp, Homo sapiens
gagacggcgcgtccggcgcgg

SEQ ID NO: 35390 - DNA, 22 bp, Homo sapiens
gacggcggctggctcggcgcgg

SEQ ID NO: 35391 - DNA, 19 bp, Homo sapiens
cggcaagcggcgcggcgcg

SEQ ID NO: 35392 - DNA, 20 bp, Homo sapiens
gacgggcggcgcggccgcgg

SEQ ID NO: 35393 - DNA, 23 bp, Homo sapiens
cggcgacgacgcggggatggcgg

SEQ ID NO: 35394 - DNA, 17 bp, Homo sapiens
cgacagtgacgcgccgg

SEQ ID NO: 35395 - DNA, 22 bp, Homo sapiens
acgatggccatgctcggcgcgg

SEQ ID NO: 35396 - DNA, 19 bp, Homo sapiens
cggccggcagcccggcgcg

SEQ ID NO: 35397 - DNA, 18 bp, Homo sapiens
gagcggcgcggcccggcg

SEQ ID NO: 35398 - DNA, 21 bp, Homo sapiens
cgacagctcggcccggcgcgg

SEQ ID NO: 35399 - DNA, 23 bp, Homo sapiens
cggcccgcgcgcgcccggcgtgg

SEQ ID NO: 35400 - DNA, 17 bp, Homo sapiens
cggtgaggcccggcgcg

SEQ ID NO: 35401 - DNA, 22 bp, Homo sapiens
cgcggcggcgcgacgactgcgg

SEQ ID NO: 35402 - DNA, 15 bp, Homo sapiens
cgacgagcgcggcgc

SEQ ID NO: 35403 - DNA, 17 bp, Homo sapiens
cgcgggcgacgcgacgg

SEQ ID NO: 35404 - DNA, 21 bp, Homo sapiens
cggccggcggcggcagcgcgg

SEQ ID NO: 35405 - DNA, 86 bp, Cowpox virus
gaaagagaataaaaatatttttgtaaaactttttttatgagaccattgaagagagaaagagaataaaatatttttacgactccatc

SEQ ID NO: 35406 - DNA, 24 bp, Cowpox virus
taaaaatatttttgtaaaactttt

SEQ ID NO: 35407 - DNA, 22 bp, Homo sapiens
taaaaacatttttgcagctttt

SEQ ID NO: 35408 - DNA, 18 bp, Homo sapiens
aaaaatatttttgtaaaa

SEQ ID NO: 35409 - DNA, 22 bp, Homo sapiens
aaaatatttttgcagcactttt

SEQ ID NO: 35410 - DNA, 66 bp, Tupaia herpesvirus
gcgggctgcacgaccggctcgagctgctgcacggcaacctggagcagatgcgccggcgcacccagc

SEQ ID NO: 35411 - DNA, 24 bp, Tupaia herpesvirus
gagcagatgcgccggcgcacccag

SEQ ID NO: 35412 - DNA, 18 bp, Homo sapiens
gagcagatgcggttggcg

SEQ ID NO: 35413 - DNA, 22 bp, Homo sapiens
gggcagatggggtcgcacccag

SEQ ID NO: 35414 - DNA, 17 bp, Homo sapiens
gagggtgcgccaaccca

SEQ ID NO: 35415 - DNA, 20 bp, Homo sapiens
gcagatgctgctgggaccag

SEQ ID NO: 35416 - DNA, 18 bp, Homo sapiens
gagcggggccggcgccca

SEQ ID NO: 35417 - DNA, 18 bp, Homo sapiens
gagcagctgcagcgccca

SEQ ID NO: 35418 - DNA, 21 bp, Homo sapiens
gagcagatgaccaatagcacc

SEQ ID NO: 35419 - DNA, 19 bp, Homo sapiens
gagcagatgggacatccgg

SEQ ID NO: 35420 - DNA, 22 bp, Homo sapiens
gagcagatgctttctcccccag

SEQ ID NO: 35421 - DNA, 22 bp, Homo sapiens
gagcagatggccatgtggctca

SEQ ID NO: 35422 - DNA, 17 bp, Homo sapiens
agcagatgtcagcatcc

SEQ ID NO: 35423 - DNA, 18 bp, Homo sapiens
ggcaggcaggcgcaccca

SEQ ID NO: 35424 - DNA, 17 bp, Homo sapiens
aacggccggcgcactca

SEQ ID NO: 35425 - DNA, 16 bp, Homo sapiens
agatgcgccgggcccc

SEQ ID NO: 35426 - DNA, 19 bp, Homo sapiens
gcaatgctcctgcacccag

SEQ ID NO: 35427 - DNA, 22 bp, Homo sapiens
gcagatgcctccactcacccag

SEQ ID NO: 35428 - DNA, 19 bp, Homo sapiens
gcaggtgcgtcacacccag

SEQ ID NO: 35429 - DNA, 17 bp, Homo sapiens
gatggagctgcacccag

SEQ ID NO: 35430 - DNA, 17 bp, Homo sapiens
gagcagatgccggcccc

SEQ ID NO: 35431 - DNA, 22 bp, Homo sapiens
gagcagatggctcctgccccag

SEQ ID NO: 35432 - DNA, 19 bp, Homo sapiens
acagtggctctggcgcacc

SEQ ID NO: 35433 - DNA, 21 bp, Homo sapiens
gcaggtgcagcgtacacccag

SEQ ID NO: 35434 - DNA, 20 bp, Homo sapiens
agcagatacagtgtgcccag

SEQ ID NO: 35435 - DNA, 24 bp, Homo sapiens
gagcagatctgcaaagtcacccag

SEQ ID NO: 35436 - DNA, 26 bp, Homo sapiens
gagcaggagcgccggcttctccccag

SEQ ID NO: 35437 - DNA, 19 bp, Homo sapiens
gagcagatggttgctacac

SEQ ID NO: 35438 - DNA, 18 bp, Homo sapiens
gagcggagccggtgccca

SEQ ID NO: 35439 - DNA, 16 bp, Homo sapiens
gcagagtgaacgcacc

SEQ ID NO: 35440 - DNA, 23 bp, Homo sapiens
gagcagatggcagctgcgcccag

SEQ ID NO: 35441 - DNA, 22 bp, Homo sapiens
agcagatgggctgtgcgttcag

SEQ ID NO: 35442 - DNA, 18 bp, Homo sapiens
gaccgctcggcgcgccca

SEQ ID NO: 35443 - DNA, 19 bp, Homo sapiens
gaggacctgctggcgcacc

SEQ ID NO: 35444 - DNA, 20 bp, Homo sapiens
gagcagatgggccagtgtcc

SEQ ID NO: 35445 - DNA, 24 bp, Homo sapiens
gagcagatggctgggaacactcag

SEQ ID NO: 35446 - DNA, 18 bp, Homo sapiens
gagcagatcgcctcccca

SEQ ID NO: 35447 - DNA, 20 bp, Homo sapiens
ggctgcacagttgcacccag

SEQ ID NO: 35448 - DNA, 17 bp, Homo sapiens
gcaggtgcgtcacccca

SEQ ID NO: 35449 - DNA, 17 bp, Homo sapiens
gagcaaatgcagggcac

SEQ ID NO: 35450 - DNA, 22 bp, Homo sapiens
gagcagacgcgcagcgacccag

SEQ ID NO: 35451 - DNA, 24 bp, Homo sapiens
gcagacgcgccgaggagcgcccag

SEQ ID NO: 35452 - DNA, 105 bp, Tupaia herpesvirus
gagtgtctggccgaggccaagaagttcgtgcacgcgtcggtcgccctgacgcggccggagccgcccgggcccgacgccgatctgcgcgaaatccggcagacgctc

SEQ ID NO: 35453 - DNA, 24 bp, Tupaia herpesvirus
cgcccgggcccgacgccgatctgc

SEQ ID NO: 35454 - DNA, 21 bp, Homo sapiens
cgcccgggccgcggcgccaac

SEQ ID NO: 35455 - DNA, 20 bp, Homo sapiens
cgcctggcgcccggcgtgac

SEQ ID NO: 35456 - DNA, 18 bp, Homo sapiens
cgcccggggctcggtctg

SEQ ID NO: 35457 - DNA, 19 bp, Homo sapiens
cgcccgggcccgctccctg

SEQ ID NO: 35458 - DNA, 19 bp, Homo sapiens
cgctcgggcccggccgctg

SEQ ID NO: 35459 - DNA, 18 bp, Homo sapiens
gcccgggcgcggcggctg

SEQ ID NO: 35460 - DNA, 21 bp, Homo sapiens
cgttcgggcccggtcccccgc

SEQ ID NO: 35461 - DNA, 19 bp, Homo sapiens
cgcccgggcctggctcccg

SEQ ID NO: 35462 - DNA, 18 bp, Homo sapiens
cgcccgggctacgatctg

SEQ ID NO: 35463 - DNA, 19 bp, Homo sapiens
cgtccgggcccgcggactg

SEQ ID NO: 35464 - DNA, 20 bp, Homo sapiens
gcccaggcctgggcctctgc

SEQ ID NO: 35465 - DNA, 18 bp, Homo sapiens
cccccgggcccggcgccg

SEQ ID NO: 35466 - DNA, 21 bp, Homo sapiens
gcctgggcctgtcaagtctgc

SEQ ID NO: 35467 - DNA, 17 bp, Homo sapiens
cgcccgggcccggctga

SEQ ID NO: 35468 - DNA, 23 bp, Homo sapiens
cccttgggctgcctgtcggtctg

SEQ ID NO: 35469 - DNA, 20 bp, Homo sapiens
cctgggctcaagcgatctgc

SEQ ID NO: 35470 - DNA, 21 bp, Homo sapiens
cgcccgggccctgccgcctgc

SEQ ID NO: 35471 - DNA, 17 bp, Homo sapiens
ccgggcccggcgctccc

SEQ ID NO: 35472 - DNA, 23 bp, Homo sapiens
cgctcgagcccgcgtaacgtctg

SEQ ID NO: 35473 - DNA, 22 bp, Homo sapiens
cgcccgggccgcagaggtctgc

SEQ ID NO: 35474 - DNA, 18 bp, Homo sapiens
cgctcgggccctgctctg

SEQ ID NO: 35475 - DNA, 20 bp, Homo sapiens
gctcaggcccggcggactgc

SEQ ID NO: 35476 - DNA, 22 bp, Homo sapiens
cgcccgggccgcggctcgctgc

SEQ ID NO: 35477 - DNA, 18 bp, Homo sapiens
cccgggcccggcgccctg

SEQ ID NO: 35478 - DNA, 17 bp, Homo sapiens
cccgggccccggatttg

SEQ ID NO: 35479 - DNA, 22 bp, Homo sapiens
cccgggcctgacccgaggtctg

SEQ ID NO: 35480 - DNA, 20 bp, Homo sapiens
gcccgggcgcgacgcgctgc

SEQ ID NO: 35481 - DNA, 20 bp, Homo sapiens
cctgggctcaggcgatctgc

SEQ ID NO: 35482 - DNA, 19 bp, Homo sapiens
cccccgggcccggccactg

SEQ ID NO: 35483 - DNA, 17 bp, Homo sapiens
cgcccgggccccgcgcg

SEQ ID NO: 35484 - DNA, 18 bp, Homo sapiens
gcccgggctcgggctctg

SEQ ID NO: 35485 - DNA, 18 bp, Homo sapiens
cgtccgggcccgccgccg

SEQ ID NO: 35486 - DNA, 61 bp, Myxoma virus
ctatacgtatcgtatagatagggtcgagtatcccgtcgatgttcgtctaacgtacgtaaag

SEQ ID NO: 35487 - DNA, 24 bp, Myxoma virus
tcgtatagatagggtcgagtatcc

SEQ ID NO: 35488 - DNA, 22 bp, Homo sapiens
gtatagatcagaaataaagtat

SEQ ID NO: 35489 - DNA, 19 bp, Homo sapiens
gtagagatagggggcaggt

SEQ ID NO: 35490 - DNA, 20 bp, Homo sapiens
atatagatggggaaaaatcc

SEQ ID NO: 35491 - DNA, 60 bp, Myxoma virus
cattcgtcctccacgtctcgtagcccctctaacaaaaacgttacgtgtcttgacgtagtg

SEQ ID NO: 35492 - DNA, 20 bp, Myxoma virus
ttacgtgtcttgacgtagtg

SEQ ID NO: 35493 - DNA, 16 bp, Homo sapiens
ttacgtgtctgaataa

SEQ ID NO: 35494 - DNA, 22 bp, Homo sapiens
ttacgtatcttctgctttagtg

SEQ ID NO: 35495 - DNA, 19 bp, Homo sapiens
ttacagtgtcttgaaagtg

SEQ ID NO: 35496 - DNA, 19 bp, Homo sapiens
ttacatgtttaatacagtg

SEQ ID NO: 35497 - DNA, 18 bp, Homo sapiens
cgctgtcttgatgtagtg

SEQ ID NO: 35498 - DNA, 82 bp, Tupaia herpesvirus
aaggaccgacgccgcgcggatcggcaccgcggcgccgtttatattcgccgcgaacagccctcccaccgccgcgcgtttcctt

SEQ ID NO: 35499 - DNA, 24 bp, Tupaia herpesvirus
cagccctcccaccgccgcgcgttt

SEQ ID NO: 35500 - DNA, 21 bp, Homo sapiens
gctttcccccgtcacacgttt

SEQ ID NO: 35501 - DNA, 21 bp, Homo sapiens
cagtttctccaccacagcagt

SEQ ID NO: 35502 - DNA, 23 bp, Homo sapiens
cagccccctgcctcatggcgttt

SEQ ID NO: 35503 - DNA, 21 bp, Homo sapiens
gcctgcccgccgcggctgttt

SEQ ID NO: 35504 - DNA, 20 bp, Homo sapiens
gcttctcactgcacacattt

SEQ ID NO: 35505 - DNA, 20 bp, Homo sapiens
agccctcccaccctgggacc

SEQ ID NO: 35506 - DNA, 23 bp, Homo sapiens
gctctctcaccgcgctgcagttt

SEQ ID NO: 35507 - DNA, 19 bp, Homo sapiens
gcccctccgtccgctgttt

SEQ ID NO: 35508 - DNA, 18 bp, Homo sapiens
cagccctcgccgccgccg

SEQ ID NO: 35509 - DNA, 19 bp, Homo sapiens
cagcccttccagctgtcgt

SEQ ID NO: 35510 - DNA, 19 bp, Homo sapiens
gctctcccgccgccgcggt

SEQ ID NO: 35511 - DNA, 19 bp, Homo sapiens
cagccccccactgcagagc

SEQ ID NO: 35512 - DNA, 22 bp, Homo sapiens
cagccgtcccgcatgcgcgttt

SEQ ID NO: 35513 - DNA, 23 bp, Homo sapiens
agcgcttcttgcctgacacgttt

SEQ ID NO: 35514 - DNA, 18 bp, Homo sapiens
gcccctcccactgctgcg

SEQ ID NO: 35515 - DNA, 22 bp, Homo sapiens
cagtcctcccactctgcgtgtt

SEQ ID NO: 35516 - DNA, 18 bp, Homo sapiens
cagcctttccaccgccgc

SEQ ID NO: 35517 - DNA, 80 bp, Visna virus
gtattaggaagagataatatgagagaattgggaataggattaattatggcaaatttagaagaaaagaaaattcccagtac

SEQ ID NO: 35518 - DNA, 24 bp, Visna virus
tggcaaatttagaagaaaagaaaa

SEQ ID NO: 35519 - DNA, 24 bp, Homo sapiens
tagcaaacacaaagggaaaggaaa

SEQ ID NO: 35520 - DNA, 23 bp, Homo sapiens
ggcaggggaaagaggaaagaaaa

SEQ ID NO: 35521 - DNA, 18 bp, Homo sapiens
tggcaaggttagaaaaaa

SEQ ID NO: 35522 - DNA, 20 bp, Homo sapiens
gcaaatttagaaattgaaaa

SEQ ID NO: 35523 - DNA, 24 bp, Homo sapiens
tagcaaataaaacagaaaagaaaa

SEQ ID NO: 35524 - DNA, 18 bp, Homo sapiens
gcagatttcaaagaaaag

SEQ ID NO: 35525 - DNA, 21 bp, Homo sapiens
tggcaaatttctctaaaaaga

SEQ ID NO: 35526 - DNA, 23 bp, Homo sapiens
tgtgcaaaaaggagaaaagaaaa

SEQ ID NO: 35527 - DNA, 20 bp, Homo sapiens
tggcaacattaaaaaagaaa

SEQ ID NO: 35528 - DNA, 21 bp, Homo sapiens
tggcacaactagaagaggaaa

SEQ ID NO: 35529 - DNA, 24 bp, Homo sapiens
tggcagctttagaaacccacagaa

SEQ ID NO: 35530 - DNA, 19 bp, Homo sapiens
gcattactagaagaaagga

SEQ ID NO: 35531 - DNA, 20 bp, Homo sapiens
tggagactcagaagggaaga

SEQ ID NO: 35532 - DNA, 18 bp, Homo sapiens
tggcagcagggaaaagaa

SEQ ID NO: 35533 - DNA, 21 bp, Homo sapiens
gcaagttgaaagaaaagaaaa

SEQ ID NO: 35534 - DNA, 23 bp, Homo sapiens
tggcgccaatagaggaaagaaaa

SEQ ID NO: 35535 - DNA, 21 bp, Homo sapiens
tgggaaacagcagaaaagaaa

SEQ ID NO: 35536 - DNA, 17 bp, Homo sapiens
ggcaaaggagaagaaaa

SEQ ID NO: 35537 - DNA, 15 bp, Homo sapiens
gcaagaagaaaagaa

SEQ ID NO: 35538 - DNA, 21 bp, Homo sapiens
gcaaatttaatagggggagaa

SEQ ID NO: 35539 - DNA, 16 bp, Homo sapiens
agcaaactagaaaaga

SEQ ID NO: 35540 - DNA, 17 bp, Homo sapiens
tgacttcagaagaagag

SEQ ID NO: 35541 - DNA, 21 bp, Homo sapiens
tggctagggtagaaaagaaaa

SEQ ID NO: 35542 - DNA, 21 bp, Homo sapiens
gccaatatgggagaaaagaaa

SEQ ID NO: 35543 - DNA, 18 bp, Homo sapiens
tggcaggcttgaagaaaa

SEQ ID NO: 35544 - DNA, 18 bp, Homo sapiens
ggcaaacagaagaagaga

SEQ ID NO: 35545 - DNA, 22 bp, Homo sapiens
tggctaaaagaagaaaagaaaa

SEQ ID NO: 35546 - DNA, 20 bp, Homo sapiens
gcaaacacatgagaaaagaa

SEQ ID NO: 35547 - DNA, 19 bp, Homo sapiens
gcaaatttagcagaggaga

SEQ ID NO: 35548 - DNA, 22 bp, Homo sapiens
gcaagactgaggagaaaagaaa

SEQ ID NO: 35549 - DNA, 20 bp, Homo sapiens
tgacattaagaagaaaggaa

SEQ ID NO: 35550 - DNA, 17 bp, Homo sapiens
gcctagaggaaaagaaa

SEQ ID NO: 35551 - DNA, 18 bp, Homo sapiens
tggctttagaagaataag

SEQ ID NO: 35552 - DNA, 20 bp, Homo sapiens
ggcaggaccagaagaggaga

SEQ ID NO: 35553 - DNA, 19 bp, Homo sapiens
tggcaatttaagaagaaaa

SEQ ID NO: 35554 - DNA, 20 bp, Homo sapiens
tggggatttagaagcacaga

SEQ ID NO: 35555 - DNA, 23 bp, Homo sapiens
tggggaaaaagaagaaaagaaaa

SEQ ID NO: 35556 - DNA, 16 bp, Homo sapiens
ggcaacaggaaaagaa

SEQ ID NO: 35557 - DNA, 23 bp, Homo sapiens
tggcatatttgagaaaaagaaaa

SEQ ID NO: 35558 - DNA, 20 bp, Homo sapiens
ggcacaagaggaaaagaaaa

SEQ ID NO: 35559 - DNA, 16 bp, Homo sapiens
tagcaaaagaaaagaa

SEQ ID NO: 35560 - DNA, 20 bp, Homo sapiens
tggcaaatcttggccagaag

SEQ ID NO: 35561 - DNA, 19 bp, Homo sapiens
tggccacaaggaaaagaaa

SEQ ID NO: 35562 - DNA, 20 bp, Homo sapiens
ggcaagaaaagaaaagaaaa

SEQ ID NO: 35563 - DNA, 19 bp, Homo sapiens
ggcaaatgtggaaagaaaa

SEQ ID NO: 35564 - DNA, 25 bp, Homo sapiens
gccgaattgttcaaagaaaagaaaa

SEQ ID NO: 35565 - DNA, 18 bp, Homo sapiens
ggcaaagagagaaaggaa

SEQ ID NO: 35566 - DNA, 16 bp, Homo sapiens
ggcttgagaagaaaag

SEQ ID NO: 35567 - DNA, 21 bp, Homo sapiens
tggcaggtttagaaaataaag

SEQ ID NO: 35568 - DNA, 22 bp, Homo sapiens
tggacaatgagagaaaagaaaa

SEQ ID NO: 35569 - DNA, 18 bp, Homo sapiens
tggaaatggagaagaaaa

SEQ ID NO: 35570 - DNA, 18 bp, Homo sapiens
tggtaagttcagaagaaa

SEQ ID NO: 35571 - DNA, 16 bp, Homo sapiens
tggcaaaaaagaaaag

SEQ ID NO: 35572 - DNA, 20 bp, Homo sapiens
tgacaaacagggaaggaaga

SEQ ID NO: 35573 - DNA, 22 bp, Homo sapiens
gcaaatttactcactaagaaaa

SEQ ID NO: 35574 - DNA, 19 bp, Homo sapiens
tggcatggaaggaaaagaa

SEQ ID NO: 35575 - DNA, 19 bp, Homo sapiens
tgccaagttcagaagaaaa

SEQ ID NO: 35576 - DNA, 18 bp, Homo sapiens
ggcaaatttatagagaaa

SEQ ID NO: 35577 - DNA, 17 bp, Homo sapiens
gcaagcaagaaaagaaa

SEQ ID NO: 35578 - DNA, 22 bp, Homo sapiens
tgacaaggtgaaagaaaggaaa

SEQ ID NO: 35579 - DNA, 25 bp, Homo sapiens
tgggaaattcaaaaagaaaagaaaa

SEQ ID NO: 35580 - DNA, 22 bp, Homo sapiens
tggcaaatcccagggaagaaaa

SEQ ID NO: 35581 - DNA, 19 bp, Homo sapiens
gcaaactccagaaaggaag

SEQ ID NO: 35582 - DNA, 22 bp, Homo sapiens
tggggaaaaagaggaaaagaaa

SEQ ID NO: 35583 - DNA, 23 bp, Homo sapiens
ggcaggaaaaaaagggaagaaaa

SEQ ID NO: 35584 - DNA, 20 bp, Homo sapiens
tgtaaatttagaagttaaga

SEQ ID NO: 35585 - DNA, 21 bp, Homo sapiens
tggcaaatcccaaagaggaaa

SEQ ID NO: 35586 - DNA, 17 bp, Homo sapiens
ggcaggaagaaaagaaa

SEQ ID NO: 35587 - DNA, 19 bp, Homo sapiens
ggcaaaagaaggaaagaaa

SEQ ID NO: 35588 - DNA, 20 bp, Homo sapiens
accattggaagaaaagaaaa

SEQ ID NO: 35589 - DNA, 22 bp, Homo sapiens
tagcactaggaggaaaagaaaa

SEQ ID NO: 35590 - DNA, 22 bp, Homo sapiens
ggcttcagggaagaaaagaaaa

SEQ ID NO: 35591 - DNA, 20 bp, Homo sapiens
tggggaacacaagaaaagaa

SEQ ID NO: 35592 - DNA, 19 bp, Homo sapiens
ggcaaatcaggaaggaaag

SEQ ID NO: 35593 - DNA, 19 bp, Homo sapiens
tgggaacaaagaaaagaaa

SEQ ID NO: 35594 - DNA, 22 bp, Homo sapiens
ggcaagatttaaggaaagaaaa

SEQ ID NO: 35595 - DNA, 23 bp, Homo sapiens
tggcaaatatttttaaaaagaaa

SEQ ID NO: 35596 - DNA, 21 bp, Homo sapiens
gcaaatttagaaagttgaaga

SEQ ID NO: 35597 - DNA, 24 bp, Homo sapiens
tggcaaattttttcaggagagaga

SEQ ID NO: 35598 - DNA, 16 bp, Homo sapiens
tggcataagaaaagaa

SEQ ID NO: 35599 - DNA, 16 bp, Homo sapiens
tggcaaatcagaaaag

SEQ ID NO: 35600 - DNA, 23 bp, Homo sapiens
tggcaatttagaaaccagagaaa

SEQ ID NO: 35601 - DNA, 20 bp, Homo sapiens
tggcctttcggaagaaaaga

SEQ ID NO: 35602 - DNA, 24 bp, Homo sapiens
tggcaaatttggaagcctgccaga

SEQ ID NO: 35603 - DNA, 20 bp, Homo sapiens
ggcaaaatccagggaaagaa

SEQ ID NO: 35604 - DNA, 17 bp, Homo sapiens
ggcagaagaaagagaaa

SEQ ID NO: 35605 - DNA, 22 bp, Homo sapiens
tgatgagggaagaagaaaagaa

SEQ ID NO: 35606 - DNA, 18 bp, Homo sapiens
tggcgacaggaaaagaaa

SEQ ID NO: 35607 - DNA, 73 bp, Tupaia herpesvirus
tcgtcgcgggagaccgcggaaaacgacggatgtggccacaatccacgtcgatattcgcgatctgccgcgacga

SEQ ID NO: 35608 - DNA, 24 bp, Tupaia herpesvirus
tcgcgggagaccgcggaaaacgac

SEQ ID NO: 35609 - DNA, 21 bp, Homo sapiens
tctcggggacgggaaaacgac

SEQ ID NO: 35610 - DNA, 19 bp, Homo sapiens
tcgcgggaggccggagcgg

SEQ ID NO: 35611 - DNA, 18 bp, Homo sapiens
tcgagggagcagaaaacg

SEQ ID NO: 35612 - DNA, 21 bp, Homo sapiens
tcgcgggagaaagcgggaacg

SEQ ID NO: 35613 - DNA, 17 bp, Homo sapiens
cgcgggaggcgagacga

SEQ ID NO: 35614 - DNA, 18 bp, Homo sapiens
tcgcggaggccgcggaaa

SEQ ID NO: 35615 - DNA, 24 bp, Homo sapiens
ccgcgggaggatgtgcggggggcg

SEQ ID NO: 35616 - DNA, 87 bp, Tupaia herpesvirus
gcttccgggtacgtagtaggtagcttacctagtacggtatgctggggtagcattccgtacttccgggtatacctacttcccggaagc

SEQ ID NO: 35617 - DNA, 24 bp, Tupaia herpesvirus
tagcttacctagtacggtatgctg

SEQ ID NO: 35618 - DNA, 15 bp, Homo sapiens
ttacctagtactgcc

SEQ ID NO: 35619 - DNA, 17 bp, Homo sapiens
gcctacctgggaatgct

SEQ ID NO: 35620 - DNA, 18 bp, Homo sapiens
tagcttagcaggtatgct

SEQ ID NO: 35621 - DNA, 17 bp, Homo sapiens
agcttacctggtaccct

SEQ ID NO: 35622 - DNA, 17 bp, Homo sapiens
tagcttgcccagtgcac

SEQ ID NO: 35623 - DNA, 18 bp, Homo sapiens
tagtgtacctagtctgct

SEQ ID NO: 35624 - DNA, 98 bp, Visna virus
tatagttcaacaatgtgatgtgtgtcaagaaaataaaatgcctagtacattaagaggcagtaataaaaggggcatagaccattggcaagtagactata

SEQ ID NO: 35625 - DNA, 24 bp, Visna virus
aggcagtaataaaaggggcataga

SEQ ID NO: 35626 - DNA, 21 bp, Homo sapiens
agcagtaataagggaaccaga

SEQ ID NO: 35627 - DNA, 19 bp, Homo sapiens
ggcagtggtggaagcacaa

SEQ ID NO: 35628 - DNA, 22 bp, Homo sapiens
aggcagtaataaaggacctgga

SEQ ID NO: 35629 - DNA, 24 bp, Homo sapiens
agcagtaataggaaactaatatag

SEQ ID NO: 35630 - DNA, 16 bp, Homo sapiens
ggcagtgaggagcatg

SEQ ID NO: 35631 - DNA, 22 bp, Homo sapiens
aggcagaatgaagacacatgga

SEQ ID NO: 35632 - DNA, 23 bp, Homo sapiens
ggcagtcagtgggaggcaaaaga

SEQ ID NO: 35633 - DNA, 18 bp, Homo sapiens
aggcagtggcaagaggag

SEQ ID NO: 35634 - DNA, 22 bp, Homo sapiens
aggaagtgacccagggcatgga

SEQ ID NO: 35635 - DNA, 22 bp, Homo sapiens
aggcagtaatagaaagagtaga

SEQ ID NO: 35636 - DNA, 21 bp, Homo sapiens
aggcagtggaagaaaagacat

SEQ ID NO: 35637 - DNA, 18 bp, Homo sapiens
aggcagaaatggaagggg

SEQ ID NO: 35638 - DNA, 20 bp, Homo sapiens
ggcggtagaaagagcacaga

SEQ ID NO: 35639 - DNA, 16 bp, Homo sapiens
aggcagtagaagggga

SEQ ID NO: 35640 - DNA, 17 bp, Homo sapiens
aggtaggataaaagggg

SEQ ID NO: 35641 - DNA, 19 bp, Homo sapiens
agacagtaatgagttacat

SEQ ID NO: 35642 - DNA, 22 bp, Homo sapiens
aggtgtaccaaaaggggcgtag

SEQ ID NO: 35643 - DNA, 17 bp, Homo sapiens
agggggtaataaaggga

SEQ ID NO: 35644 - DNA, 23 bp, Homo sapiens
aggcagaggtgaaagcacatgga

SEQ ID NO: 35645 - DNA, 18 bp, Homo sapiens
aggcagtaatgaagatgg

SEQ ID NO: 35646 - DNA, 20 bp, Homo sapiens
ggcagaatggaggacacaga

SEQ ID NO: 35647 - DNA, 21 bp, Homo sapiens
aggtggtaacaagagcacaga

SEQ ID NO: 35648 - DNA, 18 bp, Homo sapiens
agacagtggtaagagcac

SEQ ID NO: 35649 - DNA, 20 bp, Homo sapiens
agcagcaaggaggggcgtag

SEQ ID NO: 35650 - DNA, 23 bp, Homo sapiens
aggcagtagagaagtgagatgga

SEQ ID NO: 35651 - DNA, 16 bp, Homo sapiens
ggtaataataaggcat

SEQ ID NO: 35652 - DNA, 17 bp, Homo sapiens
aggcaatgataaaggaa

SEQ ID NO: 35653 - DNA, 18 bp, Homo sapiens
agtcagtaatggaccaca

SEQ ID NO: 35654 - DNA, 16 bp, Homo sapiens
ggtagtaaaaggaaca

SEQ ID NO: 35655 - DNA, 20 bp, Homo sapiens
ggcagtgggtgggggccaga

SEQ ID NO: 35656 - DNA, 15 bp, Homo sapiens
ggcagtaaaaagaca

SEQ ID NO: 35657 - DNA, 18 bp, Homo sapiens
gcagtaatgaggcggcac

SEQ ID NO: 35658 - DNA, 23 bp, Homo sapiens
aggcagtatataagagtcatgga

SEQ ID NO: 35659 - DNA, 19 bp, Homo sapiens
aggcagtagttaggaatag

SEQ ID NO: 35660 - DNA, 19 bp, Homo sapiens
ggcagtgtgggggacacag

SEQ ID NO: 35661 - DNA, 24 bp, Homo sapiens
aggaggaagtaaaaggggtatgga

SEQ ID NO: 35662 - DNA, 21 bp, Homo sapiens
gtggtaaaaggagcaagcaga

SEQ ID NO: 35663 - DNA, 18 bp, Homo sapiens
aggcagtagcggggacag

SEQ ID NO: 35664 - DNA, 16 bp, Homo sapiens
ggcagtaagaaagaac

SEQ ID NO: 35665 - DNA, 20 bp, Homo sapiens
ggcagtaatcaaagcaaaga

SEQ ID NO: 35666 - DNA, 19 bp, Homo sapiens
aggtgtaataaaagtatca

SEQ ID NO: 35667 - DNA, 24 bp, Homo sapiens
agatagtaataaaaacagaatgga

SEQ ID NO: 35668 - DNA, 18 bp, Homo sapiens
aggcagttgtaaaatggg

SEQ ID NO: 35669 - DNA, 20 bp, Homo sapiens
gggggtgataagagacacag

SEQ ID NO: 35670 - DNA, 20 bp, Homo sapiens
ggctgtaataaaggggccag

SEQ ID NO: 35671 - DNA, 22 bp, Homo sapiens
aggcagtaatgcaagctctggg

SEQ ID NO: 35672 - DNA, 82 bp, Visna virus
gaaacatgtaacaatattagatataggagatgcatattttacaataccattatatgagccatatagacaatatacatgcttt

SEQ ID NO: 35673 - DNA, 24 bp, Visna virus
atgagccatatagacaatatacat

SEQ ID NO: 35674 - DNA, 19 bp, Homo sapiens
atgagacacacaatataca

SEQ ID NO: 35675 - DNA, 19 bp, Homo sapiens
gagcagaggcaatatacat

SEQ ID NO: 35676 - DNA, 26 bp, Homo sapiens
atgagccaatatagacattactacat

SEQ ID NO: 35677 - DNA, 22 bp, Homo sapiens
atgtgccatatatataatacat

SEQ ID NO: 35678 - DNA, 18 bp, Homo sapiens
atgagcctgtaacaatat

SEQ ID NO: 35679 - DNA, 81 bp, Tupaia herpesvirus
gaaaaccggacccggaagatcgatacgtacggacgaaaagtgccctttcgccgggctaacggggatcaccgtccggttttc

SEQ ID NO: 35680 - DNA, 24 bp, Tupaia herpesvirus
tcgccgggctaacggggatcaccg

SEQ ID NO: 35681 - DNA, 19 bp, Homo sapiens
gccgggctggggtccaccg

SEQ ID NO: 35682 - DNA, 19 bp, Homo sapiens
gccgggctcggtggcgccg

SEQ ID NO: 35683 - DNA, 19 bp, Homo sapiens
tcgccgggctcgggtcgcc

SEQ ID NO: 35684 - DNA, 17 bp, Homo sapiens
gccgggctggactcacc

SEQ ID NO: 35685 - DNA, 21 bp, Homo sapiens
tcgccgggctgggcgcggccg

SEQ ID NO: 35686 - DNA, 17 bp, Homo sapiens
gccaggctggcaatgcc

SEQ ID NO: 35687 - DNA, 24 bp, Homo sapiens
tcgccagggctgagcctgtcgccg

SEQ ID NO: 35688 - DNA, 18 bp, Homo sapiens
tctgggactcgggatcac

SEQ ID NO: 35689 - DNA, 16 bp, Homo sapiens
tcccgggctagatcac

SEQ ID NO: 35690 - DNA, 24 bp, Homo sapiens
tcgccgggctgcggccgcggtgac

SEQ ID NO: 35691 - DNA, 20 bp, Homo sapiens
caggctctggcggggatcac

SEQ ID NO: 35692 - DNA, 18 bp, Homo sapiens
tcgccgggctgggcgccg

SEQ ID NO: 35693 - DNA, 60 bp, Melanoplus sanguinipes entomopoxvirus
taatgtatcaaaaatatcaatatccaatgtccaattaatgtttttatatctgatatgtta

SEQ ID NO: 35694 - DNA, 24 bp, Melanoplus sanguinipes entomopoxvirus
tgtatcaaaaatatcaatatccaa

SEQ ID NO: 35695 - DNA, 21 bp, Homo sapiens
tgatcaaaaatatacaacttc

SEQ ID NO: 35696 - DNA, 21 bp, Homo sapiens
tgtatcatgaaatatccatac

SEQ ID NO: 35697 - DNA, 19 bp, Homo sapiens
tgtatcaaaaatgtttcaa

SEQ ID NO: 35698 - DNA, 19 bp, Homo sapiens
tgtaccaaggcctaccaat

SEQ ID NO: 35699 - DNA, 21 bp, Homo sapiens
tgtatcaaaaattttattatc

SEQ ID NO: 35700 - DNA, 15 bp, Homo sapiens
gtatcatcaatatcc

SEQ ID NO: 35701 - DNA, 17 bp, Homo sapiens
tgtataaaaatatcaat

SEQ ID NO: 35702 - DNA, 26 bp, Homo sapiens
tatatcaaaggtgaaaatctatccaa

SEQ ID NO: 35703 - DNA, 21 bp, Homo sapiens
tgtatcaagagagtcaatatc

SEQ ID NO: 35704 - DNA, 23 bp, Homo sapiens
tgcatcaggaaccacatatccaa

SEQ ID NO: 35705 - DNA, 20 bp, Homo sapiens
tatcaaaaatgacaaatcca

SEQ ID NO: 35706 - DNA, 110 bp, Sheeppox virus
aagaagttaatatagatagtaaagatatttttttagattatagattttttatacacatgttaatagaagatcttctaacaaataggttttatgaaaatatattatttttt

SEQ ID NO: 35707 - DNA, 24 bp, Sheeppox virus
agtaaagatatttttttagattat

SEQ ID NO: 35708 - DNA, 22 bp, Homo sapiens
aataaacatcattttttagatt

SEQ ID NO: 35709 - DNA, 19 bp, Homo sapiens
agtggagatatttttctag

SEQ ID NO: 35710 - DNA, 19 bp, Homo sapiens
agtaaaggtatttttttaa

SEQ ID NO: 35711 - DNA, 18 bp, Homo sapiens
agtaagaatatttttcta

SEQ ID NO: 35712 - DNA, 76 bp, Ovine lentivirus
aggatggaagttgagtccctcagtgtatcaatttacaatgcaagaaatattaagggattggatagcgaaacatcct

SEQ ID NO: 35713 - DNA, 24 bp, Ovine lentivirus
ttaagggattggatagcgaaacat

SEQ ID NO: 35714 - DNA, 18 bp, Homo sapiens
ttagggggttggtaggga

SEQ ID NO: 35715 - DNA, 26 bp, Homo sapiens
ttaagagattgaaaagagcgaggcat

SEQ ID NO: 35716 - DNA, 19 bp, Homo sapiens
agggatcacaacgaagcat

SEQ ID NO: 35717 - DNA, 25 bp, Homo sapiens
ttaagggattgggtataaattagcg

SEQ ID NO: 35718 - DNA, 19 bp, Homo sapiens
taagggattggataaggaa

SEQ ID NO: 35719 - DNA, 19 bp, Homo sapiens
ctaagggatcaacaggtga

SEQ ID NO: 35720 - DNA, 17 bp, Homo sapiens
gggattggcaaaaacat

SEQ ID NO: 35721 - DNA, 90 bp, Melanoplus sanguinipes entomopoxvirus
atgtttttatatctaatgtccaattaatgtttttatatctaatgtccaattaatgtttttatatctaatgtccaattaatgtttttatat

SEQ ID NO: 35722 - DNA, 24 bp, Melanoplus sanguinipes entomopoxvirus
tctaatgtccaattaatgttttta

SEQ ID NO: 35723 - DNA, 24 bp, Homo sapiens
tctaatattgcatgaaatgttttt

SEQ ID NO: 35724 - DNA, 19 bp, Homo sapiens
aatgtccaatttattttta

SEQ ID NO: 35725 - DNA, 24 bp, Homo sapiens
tctagtttcccaataatgttttta

SEQ ID NO: 35726 - DNA, 27 bp, Homo sapiens
ctaatgtctaattagattaatgttttt

SEQ ID NO: 35727 - DNA, 21 bp, Homo sapiens
tctaatgtcaattaaagcttt

SEQ ID NO: 35728 - DNA, 15 bp, Homo sapiens
ctaatgtcctgtttt

SEQ ID NO: 35729 - DNA, 25 bp, Homo sapiens
tccaatgttcaatatacaattttta

SEQ ID NO: 35730 - DNA, 24 bp, Homo sapiens
cctaatactgcattaatgttttta

SEQ ID NO: 35731 - DNA, 19 bp, Homo sapiens
tctgatgtccaataagatg

SEQ ID NO: 35732 - DNA, 20 bp, Homo sapiens
tctaatgtctaaatgccatt

SEQ ID NO: 35733 - DNA, 23 bp, Homo sapiens
tctaatatccaatgtcaagtttt

SEQ ID NO: 35734 - DNA, 20 bp, Homo sapiens
tctaatgtcaaagagttttt

SEQ ID NO: 35735 - DNA, 18 bp, Homo sapiens
taatgtcaattaaggctt

SEQ ID NO: 35736 - DNA, 17 bp, Homo sapiens
taatgtccagttgcttt

SEQ ID NO: 35737 - DNA, 18 bp, Homo sapiens
atgtccaattccttttta

SEQ ID NO: 35738 - DNA, 19 bp, Homo sapiens
tgctcaacttaatgttttt

SEQ ID NO: 35739 - DNA, 22 bp, Homo sapiens
caatgtccccttggtgttttta

SEQ ID NO: 35740 - DNA, 25 bp, Homo sapiens
tctggtgtccgcttctatgctttta

SEQ ID NO: 35741 - DNA, 20 bp, Homo sapiens
tctaatgtcaattaatgctt

SEQ ID NO: 35742 - DNA, 18 bp, Homo sapiens
taatgtcaattaatgctt

SEQ ID NO: 35743 - DNA, 20 bp, Homo sapiens
tctaatgccaattaatgctt

SEQ ID NO: 35744 - DNA, 86 bp, Sheeppox virus
gtaaaaaaggtttctatttctatagtaatgttaacaagtgataacaaatttttagcatgttctagaagacatagttttttatttac

SEQ ID NO: 35745 - DNA, 86 bp, Sheeppox virus; identical to SEQ ID NO: 35744

SEQ ID NO: 35746 - DNA, 22 bp, Homo sapiens
ctagtctcctggaagacatggt

SEQ ID NO: 35747 - DNA, 21 bp, Homo sapiens
ttagcatgtttcaggaaatac

SEQ ID NO: 35748 - DNA, 19 bp, Homo sapiens
tgtactaagaagacatagt

SEQ ID NO: 35749 - DNA, 21 bp, Homo sapiens
ttagcatgttttggcctgaag

SEQ ID NO: 35750 - DNA, 22 bp, Homo sapiens
gcgtgttctaggggaaggcagt

SEQ ID NO: 35751 - DNA, 19 bp, Homo sapiens
ttagcatgttttgaaacag

SEQ ID NO: 35752 - DNA, 18 bp, Homo sapiens
tgccccaggagatgtagt

SEQ ID NO: 35753 - DNA, 60 bp, Melanoplus sanguinipes entomopoxvirus
taatgtatcaaaaatatcaatatctaatacccaattaatgtttttatatctgatatgtta

SEQ ID NO: 35754 - DNA, 24 bp, Melanoplus sanguinipes entomopoxvirus
tgtatcaaaaatatcaatatctaa

SEQ ID NO: 35755 - DNA, 18 bp, Homo sapiens
tatatcaaaaatatatct

SEQ ID NO: 35756 - DNA, 24 bp, Homo sapiens
tgtgcaaaaacaagtcgatatcta

SEQ ID NO: 35757 - DNA, 22 bp, Homo sapiens
tgtataaaaatatcaattttct

SEQ ID NO: 35758 - DNA, 129 bp, Melanoplus sanguinipes entomopoxvirus
taatgtatcaaaaatatcaatatccaatgtccaattaatgtttttatatctgatatgttaaaatatcaataatgtatcaaaaatatcaatatctaatacccaatcaatgtttttatatctgatatgtta

SEQ ID NO: 35759 - DNA, 24 bp, Melanoplus sanguinipes entomopoxvirus
tcaatatccaatgtccaattaatg

SEQ ID NO: 35760 - DNA, 19 bp, Homo sapiens
tcaacatcctatggttaat

SEQ ID NO: 35761 - DNA, 25 bp, Homo sapiens
tcaatacctttctttctaattaatg

SEQ ID NO: 35762 - DNA, 22 bp, Homo sapiens
tcaatatcacagtcctttaatg

SEQ ID NO: 35763 - DNA, 85 bp, Ovine lentivirus
tatgcatatgaatttatgagaagaaattgggatgaagaagttataaagaacccaatacaggctagaattatgaaattagtgcatg

SEQ ID NO: 35764 - DNA, 24 bp, Ovine lentivirus
caatacaggctagaattatgaaat

SEQ ID NO: 35765 - DNA, 20 bp, Homo sapiens
caatgcaggctagaatagaa

SEQ ID NO: 35766 - DNA, 20 bp, Homo sapiens
caacacagcactttattatg

SEQ ID NO: 35767 - DNA, 21 bp, Homo sapiens
cagtccactcagaattatgaa

SEQ ID NO: 35768 - DNA, 21 bp, Homo sapiens
caatacaggtagaacaaaaga

SEQ ID NO: 35769 - DNA, 20 bp, Homo sapiens
acaggctagaatccttagaa

SEQ ID NO: 35770 - DNA, 21 bp, Homo sapiens
taaaaactggaattatgaaat

SEQ ID NO: 35771 - DNA, 20 bp, Homo sapiens
tgacacaggctaaaagtatg

SEQ ID NO: 35772 - DNA, 19 bp, Homo sapiens
ggctggaggattatgaaat

SEQ ID NO: 35773 - DNA, 18 bp, Homo sapiens
atacaggctagaaaaaga

SEQ ID NO: 35774 - DNA, 18 bp, Homo sapiens
caatagaggctagaaatg

SEQ ID NO: 35775 - DNA, 26 bp, Homo sapiens
aatataagctagatataaaatgaaat

SEQ ID NO: 35776 - DNA, 21 bp, Homo sapiens
cagtagaggctagaactggaa

SEQ ID NO: 35777 - DNA, 20 bp, Homo sapiens
atacaggctggagtccaaga

SEQ ID NO: 35778 - DNA, 115 bp, Carnation mottle virus
agccgttttcccccaactctcgctgctggcgaccaacttcaataagtaccgcatcactgcgcttactgtgaagtactcaccagcgtgtagcttcgagaccaatgggagggtggct

SEQ ID NO: 35779 - DNA, 24 bp, Carnation mottle virus
tcgctgctggcgaccaacttcaat

SEQ ID NO: 35780 - DNA, 17 bp, Homo sapiens
tcgctgctgggactcca

SEQ ID NO: 35781 - DNA, 21 bp, Homo sapiens
tcgctgctgtgaccaggcctc

SEQ ID NO: 35782 - DNA, 21 bp, Homo sapiens
ccgctgctgagaggcttcaat

SEQ ID NO: 35783 - DNA, 26 bp, Homo sapiens
tccttgctggcgatcctgccttcaat

SEQ ID NO: 35784 - DNA, 19 bp, Homo sapiens
gctgctggccacttccaat

SEQ ID NO: 35785 - DNA, 17 bp, Homo sapiens
gctgctagccgatttca

SEQ ID NO: 35786 - DNA, 74 bp, Carnation mottle virus
ctgtggtgggcgagttgtttatacagtacacgattgtgctgagtgacccaaccaagacggccaaaatttcacag

SEQ ID NO: 35787 - DNA, 24 bp, Carnation mottle virus
agttgtttatacagtacacgattg

SEQ ID NO: 35788 - DNA, 19 bp, Homo sapiens
agttgtttaatatagtaca

SEQ ID NO: 35789 - DNA, 22 bp, Homo sapiens
gtctatatacagtatgtgattg

SEQ ID NO: 35790 - DNA, 26 bp, Homo sapiens
agtttttatacagttactaacgattg

SEQ ID NO: 35791 - DNA, 25 bp, Homo sapiens
agttgtttatttagaaacctgattg

SEQ ID NO: 35792 - DNA, 61 bp, Carnation mottle virus
ggtgcattatagtgcggggcacggttgaaggtggcttcaccaaacccacacttattggacc

SEQ ID NO: 35793 - DNA, 24 bp, Carnation mottle virus
tatagtgcggggcacggttgaagg

SEQ ID NO: 35794 - DNA, 24 bp, Homo sapiens
tgagtgcggggcactctgagaagg

SEQ ID NO: 35795 - DNA, 19 bp, Homo sapiens
tagtgcagggcatgaacgg

SEQ ID NO: 35796 - DNA, 16 bp, Homo sapiens
gtgcggggagctggag

SEQ ID NO: 35797 - DNA, 20 bp, Homo sapiens
tagtccggggcacggcaagg

SEQ ID NO: 35798 - DNA, 19 bp, Homo sapiens
gtgcggggcaaggagaagg

SEQ ID NO: 35799 - DNA, 24 bp, Homo sapiens
cacaaccaggggtatggttggggg

SEQ ID NO: 35800 - DNA, 18 bp, Homo sapiens
gtgcggggcggtctgagg

SEQ ID NO: 35801 - DNA, 18 bp, Homo sapiens
gtgtggggcagatgaagg

SEQ ID NO: 35802 - DNA, 81 bp, Caprine arthritis-encephalitis virus
gtcataccccaagggagaaaatttgcacaattaatattaatggataaaaagcatggaaaattggaaccctggggggaaagc

SEQ ID NO: 35803 - DNA, 24 bp, Caprine arthritis-encephalitis virus
taaaaagcatggaaaattggaacc

SEQ ID NO: 35804 - DNA, 22 bp, Homo sapiens
caaaaagcatgggaacctggaa

SEQ ID NO: 35805 - DNA, 18 bp, Homo sapiens
aaaagcatggaatagtgg

SEQ ID NO: 35806 - DNA, 18 bp, Homo sapiens
aagcagaaaagttggaac

SEQ ID NO: 35807 - DNA, 17 bp, Homo sapiens
taaaaagcaggaaggga

SEQ ID NO: 35808 - DNA, 24 bp, Homo sapiens
aaaaagtaaactctaattggaacc

SEQ ID NO: 35809 - DNA, 17 bp, Homo sapiens
agcagggcaattggaac

SEQ ID NO: 35810 - DNA, 23 bp, Homo sapiens
taaaaagcctggaaaagtgcaac

SEQ ID NO: 35811 - DNA, 19 bp, Homo sapiens
aaaagcatgaaaatacagg

SEQ ID NO: 35812 - DNA, 20 bp, Homo sapiens
caaaaagcatggagaaatgg

SEQ ID NO: 35813 - DNA, 20 bp, Homo sapiens
tgaaagcatggaagaaaaac

SEQ ID NO: 35814 - DNA, 18 bp, Homo sapiens
taaaaagcaaggaaaact

SEQ ID NO: 35815 - DNA, 20 bp, Homo sapiens
taaaaattatggaggggaac

SEQ ID NO: 35816 - DNA, 19 bp, Homo sapiens
gcagacggatgaaattgga

SEQ ID NO: 35817 - DNA, 18 bp, Homo sapiens
taaaaagggaattggaac

SEQ ID NO: 35818 - DNA, 21 bp, Homo sapiens
aaaagccataaaaattggaac

SEQ ID NO: 35819 - DNA, 17 bp, Homo sapiens
aagagcatggatactga

SEQ ID NO: 35820 - DNA, 19 bp, Homo sapiens
aaagcgaggtcctggaacc

SEQ ID NO: 35821 - DNA, 18 bp, Homo sapiens
tgaaaacatggaaacatg

SEQ ID NO: 35822 - DNA, 22 bp, Homo sapiens
taaaaagcaagggaacagtgaa

SEQ ID NO: 35823 - DNA, 18 bp, Homo sapiens
aaaaagtgcaaaattgga

SEQ ID NO: 35824 - DNA, 20 bp, Homo sapiens
taaaaagctgtggagagtgg

SEQ ID NO: 35825 - DNA, 16 bp, Homo sapiens
taaaaagcaggaggga

SEQ ID NO: 35826 - DNA, 18 bp, Homo sapiens
aaaagcatggacaccaaa

SEQ ID NO: 35827 - DNA, 19 bp, Homo sapiens
aaggatgggaattgaaacc

SEQ ID NO: 35828 - DNA, 16 bp, Homo sapiens
caaaaagcaattggaa

SEQ ID NO: 35829 - DNA, 20 bp, Homo sapiens
aaaaagccagagttggaacc

SEQ ID NO: 35830 - DNA, 20 bp, Homo sapiens
aaaccatggaaaaagaaacc

SEQ ID NO: 35831 - DNA, 19 bp, Homo sapiens
tgaacaggcacattggaac

SEQ ID NO: 35832 - DNA, 21 bp, Homo sapiens
aaagcactgaaaaattggaac

SEQ ID NO: 35833 - DNA, 18 bp, Homo sapiens
aaaaagcatgggaaaaga

SEQ ID NO: 35834 - DNA, 19 bp, Homo sapiens
agcatggaaaatgacaaga

SEQ ID NO: 35835 - DNA, 22 bp, Homo sapiens
taaaaagcaaggagagaggacc

SEQ ID NO: 35836 - DNA, 19 bp, Homo sapiens
aagcatggatggatgaaac

SEQ ID NO: 35837 - DNA, 20 bp, Homo sapiens
aaaggccatggaaagaaacc

SEQ ID NO: 35838 - DNA, 24 bp, Homo sapiens
taaaaagcaatatacagattggaa

SEQ ID NO: 35839 - DNA, 19 bp, Homo sapiens
taaaaagtgggaccagaac

SEQ ID NO: 35840 - DNA, 18 bp, Homo sapiens
acaaatggaaaattggaa

SEQ ID NO: 35841 - DNA, 21 bp, Homo sapiens
aaaaagcatggaacgtgtgga

SEQ ID NO: 35842 - DNA, 19 bp, Homo sapiens
taaggagcatgaaagaaac

SEQ ID NO: 35843 - DNA, 17 bp, Homo sapiens
aacaggaaattggaacc

SEQ ID NO: 35844 - DNA, 21 bp, Homo sapiens
taagaagcatgagaaaaggaa

SEQ ID NO: 35845 - DNA, 19 bp, Homo sapiens
tgaacacaaagattggaac

SEQ ID NO: 35846 - DNA, 23 bp, Homo sapiens
aaaaaaaaaaaaaaattggagcc

SEQ ID NO: 35847 - DNA, 19 bp, Homo sapiens
tgaacacgaagattggaac

SEQ ID NO: 35848 - DNA, 15 bp, Homo sapiens
aagcatggatagaac

SEQ ID NO: 35849 - DNA, 20 bp, Homo sapiens
aaagatatagccaattggaa

SEQ ID NO: 35850 - DNA, 18 bp, Homo sapiens
taaaaagcaagggactag

SEQ ID NO: 35851 - DNA, 19 bp, Homo sapiens
agatagcaaaattgggacc

SEQ ID NO: 35852 - DNA, 19 bp, Homo sapiens
taaaaagcatggcagcctg

SEQ ID NO: 35853 - DNA, 22 bp, Homo sapiens
acaaggaattggaattgggacc

SEQ ID NO: 35854 - DNA, 68 bp, Caprine arthritis-encephalitis virus
atggttcaggtccgcataggttcccagcagaggaacttgttatttgataccggggcggaccgaactat

SEQ ID NO: 35855 - DNA, 24 bp, Caprine arthritis-encephalitis virus
gttcaggtccgcataggttcccag

SEQ ID NO: 35856 - DNA, 20 bp, Homo sapiens
gtccagggtaggtaggttcc

SEQ ID NO: 35857 - DNA, 19 bp, Homo sapiens
gtttgggtccccaggccca

SEQ ID NO: 35858 - DNA, 26 bp, Homo sapiens
gttcagatccgcgtgtttccttccag

SEQ ID NO: 35859 - DNA, 17 bp, Homo sapiens
gttcaggtccgacccaa

SEQ ID NO: 35860 - DNA, 19 bp, Homo sapiens
gttcaggtccccagaccca

SEQ ID NO: 35861 - DNA, 22 bp, Homo sapiens
gttcaggttcccaccagtccag

SEQ ID NO: 35862 - DNA, 18 bp, Homo sapiens
gttcaggtctgaaattcc

SEQ ID NO: 35863 - DNA, 17 bp, Homo sapiens
gttcaggcctcagttcc

SEQ ID NO: 35864 - DNA, 21 bp, Homo sapiens
gctcaggtctgtggcatccag

SEQ ID NO: 35865 - DNA, 18 bp, Homo sapiens
gctcaggttcgcactcgg

SEQ ID NO: 35866 - DNA, 19 bp, Homo sapiens
gttcaggtctgggatccca

SEQ ID NO: 35867 - DNA, 17 bp, Homo sapiens
gttcaggtcctggctcc

SEQ ID NO: 35868 - DNA, 20 bp, Homo sapiens
gttcaggcccgcttctttcc

SEQ ID NO: 35869 - DNA, 23 bp, Homo sapiens
attcaggtgtgctaggttcccag

SEQ ID NO: 35870 - DNA, 23 bp, Homo sapiens
attcaggtttgtaaagttttcag

SEQ ID NO: 35871 - DNA, 21 bp, Homo sapiens
gtctgggtcagtggttcccag

SEQ ID NO: 35872 - DNA, 19 bp, Homo sapiens
gttcaggtccgcggccccc

SEQ ID NO: 35873 - DNA, 19 bp, Homo sapiens
gtttaggtcctcataagcc

SEQ ID NO: 35874 - DNA, 21 bp, Homo sapiens
gttcgggtcccacaggcccag

SEQ ID NO: 35875 - DNA, 16 bp, Homo sapiens
gttcaggtcctgctcc

SEQ ID NO: 35876 - DNA, 23 bp, Homo sapiens
ttcaggaagaggtgggttcccag

SEQ ID NO: 35877 - DNA, 66 bp, Caprine arthritis-encephalitis virus
tcaaacaatgaatttagtaacagatagtagatatgcatttgaatttttattaagaaattgggatga

SEQ ID NO: 35878 - DNA, 24 bp, Caprine arthritis-encephalitis virus
atgaatttagtaacagatagtaga

SEQ ID NO: 35879 - DNA, 19 bp, Homo sapiens
aatttagtaacttactaga

SEQ ID NO: 35880 - DNA, 21 bp, Homo sapiens
atgaatttggtagtgcagtag

SEQ ID NO: 35881 - DNA, 19 bp, Homo sapiens
atgaattcagtggtgatag

SEQ ID NO: 35882 - DNA, 21 bp, Homo sapiens
tgaatagcagcaggtagtaga

SEQ ID NO: 35883 - DNA, 22 bp, Homo sapiens
atgacatttagtacatagtaga

SEQ ID NO: 35884 - DNA, 26 bp, Homo sapiens
atggattttgtaacagaatccctaga

SEQ ID NO: 35885 - DNA, 20 bp, Homo sapiens
atggatttagtaataaatag

SEQ ID NO: 35886 - DNA, 21 bp, Homo sapiens
tgagttagtaacatacaaaga

SEQ ID NO: 35887 - DNA, 23 bp, Homo sapiens
tggatttagtatcagaccacaga

SEQ ID NO: 35888 - DNA, 23 bp, Homo sapiens
atgaatttactatctcaggtaga

SEQ ID NO: 35889 - DNA, 114 bp, Cardamine chlorotic fleck virus
gtgacgaagcagcctaccccgaaggtggttcgtgtgagtgctcccgccgcggtttcataccgtgaggtcacgggagctccacgagtcactacggctggtaaggtgctgacacac

SEQ ID NO: 35890 - DNA, 24 bp, Cardamine chlorotic fleck virus
aagcagcctaccccgaaggtggtt

SEQ ID NO: 35891 - DNA, 19 bp, Homo sapiens
aagtagcctattccagggt

SEQ ID NO: 35892 - DNA, 20 bp, Homo sapiens
acagcctttgggaggtggtt

SEQ ID NO: 35893 - DNA, 16 bp, Homo sapiens
agcagccaccccgggc

SEQ ID NO: 35894 - DNA, 23 bp, Homo sapiens
aagcagtgtaccttatcctggtt

SEQ ID NO: 35895 - DNA, 16 bp, Homo sapiens
gcagccaccctggggc

SEQ ID NO: 35896 - DNA, 20 bp, Homo sapiens
aagcggccgaccctgagggc

SEQ ID NO: 35897 - DNA, 22 bp, Homo sapiens
gcagccctgggtcggggtggtt

SEQ ID NO: 35898 - DNA, 20 bp, Homo sapiens
aagtagcctggtcctggggt

SEQ ID NO: 35899 - DNA, 20 bp, Homo sapiens
agcagcctaccccagagccg

SEQ ID NO: 35900 - DNA, 23 bp, Homo sapiens
agctggcctccagggaggtggtt

SEQ ID NO: 35901 - DNA, 20 bp, Homo sapiens
agccggctgcgaaggtggtt

SEQ ID NO: 35902 - DNA, 19 bp, Homo sapiens
agctggcctaccctggaga

SEQ ID NO: 35903 - DNA, 17 bp, Homo sapiens
gcagcctaaaaggtggt

SEQ ID NO: 35904 - DNA, 19 bp, Homo sapiens
aagcagccgtgtcccgagg

SEQ ID NO: 35905 - DNA, 23 bp, Homo sapiens
aagcagtcaatttcctggtggtt

SEQ ID NO: 35906 - DNA, 21 bp, Homo sapiens
gcagcctgctgcggaggggtt

SEQ ID NO: 35907 - DNA, 19 bp, Homo sapiens
aagcagccatcccgggggt

SEQ ID NO: 35908 - DNA, 22 bp, Homo sapiens
aagcagtctactctggtcagtt

SEQ ID NO: 35909 - DNA, 20 bp, Homo sapiens
gcagctctgccctgaagcgt

SEQ ID NO: 35910 - DNA, 24 bp, Homo sapiens
aagcagctggcccccgttgtggtt

SEQ ID NO: 35911 - DNA, 24 bp, Homo sapiens
agcagcctgcatcacttaatggtt

SEQ ID NO: 35912 - DNA, 16 bp, Homo sapiens
gcagcctcctcgaggc

SEQ ID NO: 35913 - DNA, 18 bp, Homo sapiens
aagcatctaccccgaggg

SEQ ID NO: 35914 - DNA, 20 bp, Homo sapiens
agctcacccactcagtggtt

SEQ ID NO: 35915 - DNA, 21 bp, Homo sapiens
aagcagctgttccctatggtt

SEQ ID NO: 35916 - DNA, 21 bp, Homo sapiens
agtagcttactagaagtggtt

SEQ ID NO: 35917 - DNA, 18 bp, Homo sapiens
agcagcccatcctggagg

SEQ ID NO: 35918 - DNA, 20 bp, Homo sapiens
agccagcctgtcctggggcc

SEQ ID NO: 35919 - DNA, 22 bp, Homo sapiens
gcagcctactctgtagctgatt

SEQ ID NO: 35920 - DNA, 19 bp, Homo sapiens
aggagcctgctccgaaggt

SEQ ID NO: 35921 - DNA, 19 bp, Homo sapiens
aagcagcctacttgaacat

SEQ ID NO: 35922 - DNA, 18 bp, Homo sapiens
aagcggcctcacctcgaa

SEQ ID NO: 35923 - DNA, 21 bp, Homo sapiens
gcagtcgtccccttgatggtt

SEQ ID NO: 35924 - DNA, 24 bp, Homo sapiens
aagcagtttgactacttaatggtt

SEQ ID NO: 35925 - DNA, 20 bp, Homo sapiens
agcagtttatgaaggtggtt

SEQ ID NO: 35926 - DNA, 83 bp, Equine herpesvirus 1
ggaagtgtcatggcgtccaggggcgttcgtctttatgcatatgagcggcgcgatcacgaaccccgttggcgcgacgcgcttcc

SEQ ID NO: 35927 - DNA, 24 bp, Equine herpesvirus 1
aaccccgttggcgcgacgcgcttc

SEQ ID NO: 35928 - DNA, 21 bp, Homo sapiens
ccccgtcggcgcgggatgctc

SEQ ID NO: 35929 - DNA, 16 bp, Homo sapiens
cgttcgggcgcgcttc

SEQ ID NO: 35930 - DNA, 21 bp, Homo sapiens
cgctagccaggcgacgcgctt

SEQ ID NO: 35931 - DNA, 19 bp, Homo sapiens
cccgttggcgcagaccttc

SEQ ID NO: 35932 - DNA, 19 bp, Homo sapiens
ccccgttggccggcggggc

SEQ ID NO: 35933 - DNA, 74 bp, Bovine herpesvirus 1
gttcagccgcctggccacgtcctggtgcctgctgcagaacaaggagcgcgccctgtgggccgaggcggctaagc

SEQ ID NO: 35934 - DNA, 24 bp, Bovine herpesvirus 1
cagccgcctggccacgtcctggtg

SEQ ID NO: 35935 - DNA, 18 bp, Homo sapiens
gccgcttggccgccgctg

SEQ ID NO: 35936 - DNA, 19 bp, Homo sapiens
gcttcctgggaccctggtg

SEQ ID NO: 35937 - DNA, 21 bp, Homo sapiens
cagcctctggccgcccaggtg

SEQ ID NO: 35938 - DNA, 19 bp, Homo sapiens
gccacctggccatgccctg

SEQ ID NO: 35939 - DNA, 16 bp, Homo sapiens
cagccgcctgtccggg

SEQ ID NO: 35940 - DNA, 19 bp, Homo sapiens
gctctctgccatcctggtg

SEQ ID NO: 35941 - DNA, 19 bp, Homo sapiens
gccgcctggctgcgacctg

SEQ ID NO: 35942 - DNA, 21 bp, Homo sapiens
cagccgccggctttgctggtg

SEQ ID NO: 35943 - DNA, 19 bp, Homo sapiens
cagctcctggtaccctggt

SEQ ID NO: 35944 - DNA, 21 bp, Homo sapiens
cacactggctgcgtcctggtg

SEQ ID NO: 35945 - DNA, 18 bp, Homo sapiens
gcctgcctggccagaggt

SEQ ID NO: 35946 - DNA, 21 bp, Homo sapiens
cagcctcctctggtcctggtg

SEQ ID NO: 35947 - DNA, 22 bp, Homo sapiens
cagcctgccttgggtcctggtg

SEQ ID NO: 35948 - DNA, 23 bp, Homo sapiens
cagcttctggccactgggaggtg

SEQ ID NO: 35949 - DNA, 19 bp, Homo sapiens
cagcccctggcagtttggt

SEQ ID NO: 35950 - DNA, 21 bp, Homo sapiens
ccgcctggccatgtttctctg

SEQ ID NO: 35951 - DNA, 16 bp, Homo sapiens
gctcctgggccctggt

SEQ ID NO: 35952 - DNA, 24 bp, Homo sapiens
cagctgtcctggttgccctcggtg

SEQ ID NO: 35953 - DNA, 21 bp, Homo sapiens
cagtctctggccactaaggtg

SEQ ID NO: 35954 - DNA, 20 bp, Homo sapiens
accgcctggtggggctggtg

SEQ ID NO: 35955 - DNA, 20 bp, Homo sapiens
gccacctggtcccattggtg

SEQ ID NO: 35956 - DNA, 21 bp, Homo sapiens
cagctgcctagtgcactggtg

SEQ ID NO: 35957 - DNA, 21 bp, Homo sapiens
cagctgtgttggccattggtg

SEQ ID NO: 35958 - DNA, 21 bp, Homo sapiens
gccacctggggccctttggtg

SEQ ID NO: 35959 - DNA, 20 bp, Homo sapiens
gccgcctggcgtgcttggtg

SEQ ID NO: 35960 - DNA, 19 bp, Homo sapiens
gcggcctttagtcctggtg

SEQ ID NO: 35961 - DNA, 22 bp, Homo sapiens
cagcctctcttgtgtcttggtg

SEQ ID NO: 35962 - DNA, 18 bp, Homo sapiens
tgaccgcctggtgctggt

SEQ ID NO: 35963 - DNA, 18 bp, Homo sapiens
cagtcgcatgctcctggt

SEQ ID NO: 35964 - DNA, 22 bp, Homo sapiens
cagcagtctggagatcctggtg

SEQ ID NO: 35965 - DNA, 21 bp, Homo sapiens
agccgcctggctgttcacctg

SEQ ID NO: 35966 - DNA, 19 bp, Homo sapiens
gccgcagcacgtcctggtg

SEQ ID NO: 35967 - DNA, 18 bp, Homo sapiens
agctgctggccacgtact

SEQ ID NO: 35968 - DNA, 101 bp, Bovine herpesvirus 1
gcttcttcgtgtgcccgccgccctcgggcgccacggtggtccggctcgcgcccgcgcggccgtgccctgagtacgggctcgggcggaactacacggagggc

SEQ ID NO: 35969 - DNA, 24 bp, Bovine herpesvirus 1
ccgtgccctgagtacgggctcggg

SEQ ID NO: 35970 - DNA, 21 bp, Homo sapiens
gtgccctggctgtgccttggg

SEQ ID NO: 35971 - DNA, 17 bp, Homo sapiens
gccctgaggggcttggg

SEQ ID NO: 35972 - DNA, 19 bp, Homo sapiens
gtgccctgactaggctggg

SEQ ID NO: 35973 - DNA, 16 bp, Homo sapiens
gccctgagaggctcgg

SEQ ID NO: 35974 - DNA, 20 bp, Homo sapiens
gtgctcttccagggctcggg

SEQ ID NO: 35975 - DNA, 19 bp, Homo sapiens
gctctggctgcggctcggg

SEQ ID NO: 35976 - DNA, 22 bp, Homo sapiens
gtccctgagtattcagcctggg

SEQ ID NO: 35977 - DNA, 19 bp, Homo sapiens
gccctgaggcaagctcggg

SEQ ID NO: 35978 - DNA, 20 bp, Homo sapiens
cggccctcgcagggctcggg

SEQ ID NO: 35979 - DNA, 20 bp, Homo sapiens
cgtgccccgggggtctcggg

SEQ ID NO: 35980 - DNA, 17 bp, Homo sapiens
gtgccctggggctttgg

SEQ ID NO: 35981 - DNA, 18 bp, Homo sapiens
ccggcctggtgggctcgg

SEQ ID NO: 35982 - DNA, 18 bp, Homo sapiens
cctgcaacagggctcggg

SEQ ID NO: 35983 - DNA, 17 bp, Homo sapiens
cgtgcccacgggctcgg

SEQ ID NO: 35984 - DNA, 19 bp, Homo sapiens
gtgcgctgggtgggctggg

SEQ ID NO: 35985 - DNA, 18 bp, Homo sapiens
ccggctctgtaggctcgg

SEQ ID NO: 35986 - DNA, 29 bp, Homo sapiens
cgtgccctgttgcccgtacgggcttgggc

SEQ ID NO: 35987 - DNA, 19 bp, Homo sapiens
gtgccctgggagctctggg

SEQ ID NO: 35988 - DNA, 16 bp, Homo sapiens
gtgctctggggctcgg

SEQ ID NO: 35989 - DNA, 18 bp, Homo sapiens
gtgccctgagatggctgg

SEQ ID NO: 35990 - DNA, 74 bp, Cardamine chlorotic fleck virus
caaccgcctaggttccgcccagagaagccaaatcggctctctcgacggcaagttcttgggaccgaggctggttg

SEQ ID NO: 35991 - DNA, 24 bp, Cardamine chlorotic fleck virus
ctctctcgacggcaagttcttggg

SEQ ID NO: 35992 - DNA, 21 bp, Homo sapiens
tctggtgggcaagtttttggg

SEQ ID NO: 35993 - DNA, 20 bp, Homo sapiens
ctctctcggtggtgcagtgg

SEQ ID NO: 35994 - DNA, 22 bp, Homo sapiens
ctctctcggggcgagcggaggg

SEQ ID NO: 35995 - DNA, 19 bp, Homo sapiens
ctttcttgaggagtcttgg

SEQ ID NO: 35996 - DNA, 18 bp, Homo sapiens
ctcttttgacagcaaagg

SEQ ID NO: 35997 - DNA, 23 bp, Homo sapiens
ctccttggccatgggttcttggg

SEQ ID NO: 35998 - DNA, 22 bp, Homo sapiens
ctctcctggcccctttcttggg

SEQ ID NO: 35999 - DNA, 23 bp, Homo sapiens
tctctcgatggcgagggtttggg

SEQ ID NO: 36000 - DNA, 19 bp, Homo sapiens
ctgtcctgaggttcttggg

SEQ ID NO: 36001 - DNA, 18 bp, Homo sapiens
tctcactttgttcttggg

SEQ ID NO: 36002 - DNA, 22 bp, Homo sapiens
ctctctcggtggtcactgtggg

SEQ ID NO: 36003 - DNA, 22 bp, Homo sapiens
ctctctggacggtgttggtggg

SEQ ID NO: 36004 - DNA, 19 bp, Homo sapiens
tcttggattgcttcttggg

SEQ ID NO: 36005 - DNA, 21 bp, Homo sapiens
tctcttgaggtagtttttggg

SEQ ID NO: 36006 - DNA, 115 bp, Bovine herpesvirus 1
tttacaaaaacgtgatcgtgaccacgacctgggcgggcagcacgtacgcggccattacaaaccagtacacggaccgcgtgcccgtgggcatgggcgagatcacggacctggtgga

SEQ ID NO: 36007 - DNA, 24 bp, Bovine herpesvirus 1
acggaccgcgtgcccgtgggcatg

SEQ ID NO: 36008 - DNA, 20 bp, Homo sapiens
gggccctcgctgtgggcatg

SEQ ID NO: 36009 - DNA, 21 bp, Homo sapiens
acgggtcctggcctgggcatg

SEQ ID NO: 36010 - DNA, 16 bp, Homo sapiens
gggctgcagtgggcat

SEQ ID NO: 36011 - DNA, 20 bp, Homo sapiens
ggactgttgcttgtgggcac

SEQ ID NO: 36012 - DNA, 20 bp, Homo sapiens
ggccgcgggttgtgggcatg

SEQ ID NO: 36013 - DNA, 18 bp, Homo sapiens
gcagaacccgtgggcatg

SEQ ID NO: 36014 - DNA, 20 bp, Homo sapiens
gggcctggcctgtgggcatg

SEQ ID NO: 36015 - DNA, 19 bp, Homo sapiens
ggggtgcggcctgggcatg

SEQ ID NO: 36016 - DNA, 16 bp, Homo sapiens
ggatccggcccgtggg

SEQ ID NO: 36017 - DNA, 18 bp, Homo sapiens
cggaccgcgagcgcgagc

SEQ ID NO: 36018 - DNA, 17 bp, Homo sapiens
cagactgtgctgggcat

SEQ ID NO: 36019 - DNA, 18 bp, Homo sapiens
acgggctggtgctcgtag

SEQ ID NO: 36020 - DNA, 19 bp, Homo sapiens
ggaccgcgtcctcgttagc

SEQ ID NO: 36021 - DNA, 20 bp, Homo sapiens
cggaccgcggtcgaggcatg

SEQ ID NO: 36022 - DNA, 65 bp, Bovine herpesvirus 1
gctgctggcgacccggctgacgcagctcgcgcttcggcggcgagcgccgccggagtaccagcagc

SEQ ID NO: 36023 - DNA, 24 bp, Bovine herpesvirus 1
cgagcgccgccggagtaccagcag

SEQ ID NO: 36024 - DNA, 17 bp, Homo sapiens
gagcgccgtggccggca

SEQ ID NO: 36025 - DNA, 19 bp, Homo sapiens
gcgccgccgctcacttcag

SEQ ID NO: 36026 - DNA, 20 bp, Homo sapiens
cggcgccgccgggggcccag

SEQ ID NO: 36027 - DNA, 18 bp, Homo sapiens
cggacgcaggtaccagca

SEQ ID NO: 36028 - DNA, 19 bp, Homo sapiens
cggcgccgccggggtatgc

SEQ ID NO: 36029 - DNA, 19 bp, Homo sapiens
gccgccgggagccgggcag

SEQ ID NO: 36030 - DNA, 22 bp, Homo sapiens
cggcgccgccggggaacatggc

SEQ ID NO: 36031 - DNA, 16 bp, Homo sapiens
cgggcgccgcagcagc

SEQ ID NO: 36032 - DNA, 21 bp, Homo sapiens
cgagcgccgctgcgagggcag

SEQ ID NO: 36033 - DNA, 20 bp, Homo sapiens
cgggcgccgccgcgtcctgc

SEQ ID NO: 36034 - DNA, 19 bp, Homo sapiens
cgagcgcgccgggtcggca

SEQ ID NO: 36035 - DNA, 23 bp, Homo sapiens
cgggcgcggccgaagtcgtcagc

SEQ ID NO: 36036 - DNA, 20 bp, Homo sapiens
cgggcgccgccggggctcag

SEQ ID NO: 36037 - DNA, 19 bp, Homo sapiens
gagcgccgacgccaccggc

SEQ ID NO: 36038 - DNA, 19 bp, Homo sapiens
cgacgccgccggacccgca

SEQ ID NO: 36039 - DNA, 17 bp, Homo sapiens
cgagcgccccggggccc

SEQ ID NO: 36040 - DNA, 21 bp, Homo sapiens
gagcaccgtgccagccggcag

SEQ ID NO: 36041 - DNA, 22 bp, Homo sapiens
cgagccccgccggaggcgacgc

SEQ ID NO: 36042 - DNA, 21 bp, Homo sapiens
cggcgccgccccaggatcggc

SEQ ID NO: 36043 - DNA, 19 bp, Homo sapiens
gcgtgccgccgattcacag

SEQ ID NO: 36044 - DNA, 18 bp, Homo sapiens
gcgggcgtgaagtaccag

SEQ ID NO: 36045 - DNA, 18 bp, Homo sapiens
cgggcggcgccggagaca

SEQ ID NO: 36046 - DNA, 19 bp, Homo sapiens
ccagcgccgctgccccagc

SEQ ID NO: 36047 - DNA, 19 bp, Homo sapiens
agcgccgcgcagccagcag

SEQ ID NO: 36048 - DNA, 19 bp, Homo sapiens
cgagcgccgtccgagcgca

SEQ ID NO: 36049 - DNA, 17 bp, Homo sapiens
gacgctgccggagtcag

SEQ ID NO: 36050 - DNA, 23 bp, Homo sapiens
cgagagccgccggggtgtgtcgc

SEQ ID NO: 36051 - DNA, 21 bp, Homo sapiens
cacagcccggagtactagcag

SEQ ID NO: 36052 - DNA, 16 bp, Homo sapiens
gcgccgccgggaccgc

SEQ ID NO: 36053 - DNA, 21 bp, Homo sapiens
ccagcgccgccgccgcagcag

SEQ ID NO: 36054 - DNA, 21 bp, Homo sapiens
cgagcgcccgaccgccagcag

SEQ ID NO: 36055 - DNA, 17 bp, Homo sapiens
agcgccgcgaggccggc

SEQ ID NO: 36056 - DNA, 23 bp, Homo sapiens
cgggcgctgacctcaaccagcag

SEQ ID NO: 36057 - DNA, 18 bp, Homo sapiens
cgagtgccgccagcagca

SEQ ID NO: 36058 - DNA, 18 bp, Homo sapiens
cgggcgccacctcccagc

SEQ ID NO: 36059 - DNA, 28 bp, Homo sapiens
cgagcgccctcggaagatgggccggcag

SEQ ID NO: 36060 - DNA, 18 bp, Homo sapiens
cgggcgccgcgcggggca

SEQ ID NO: 36061 - DNA, 22 bp, Homo sapiens
cgggcgcggctgtgcccggcag

SEQ ID NO: 36062 - DNA, 65 bp, Equine herpesvirus 1
tcttggaaagcttacccgctcttggcactccttcttcggcttgcggaggtaagagctccccgggg

SEQ ID NO: 36063 - DNA, 24 bp, Equine herpesvirus 1
aagcttacccgctcttggcactcc

SEQ ID NO: 36064 - DNA, 20 bp, Homo sapiens
agcttacctttcactgtctt

SEQ ID NO: 36065 - DNA, 18 bp, Homo sapiens
aagcttgctgccaacacc

SEQ ID NO: 36066 - DNA, 17 bp, Homo sapiens
gcctacctcaggcactc

SEQ ID NO: 36067 - DNA, 18 bp, Homo sapiens
agcttgctcctggagccc

SEQ ID NO: 36068 - DNA, 16 bp, Homo sapiens
gctgcccgcagcactc

SEQ ID NO: 36069 - DNA, 26 bp, Homo sapiens
aagcttgtctgctcttaatgcattcc

SEQ ID NO: 36070 - DNA, 21 bp, Homo sapiens
agcttgctcgctcccagctcc

SEQ ID NO: 36071 - DNA, 18 bp, Homo sapiens
aagctagctcctggtact

SEQ ID NO: 36072 - DNA, 21 bp, Homo sapiens
gcttacccagctcttggctcc

SEQ ID NO: 36073 - DNA, 22 bp, Homo sapiens
aacttacctgctctgggcctcc

SEQ ID NO: 36074 - DNA, 21 bp, Homo sapiens
aagcttacctgccttccctcc

SEQ ID NO: 36075 - DNA, 18 bp, Homo sapiens
agcttatctgttagcact

SEQ ID NO: 36076 - DNA, 21 bp, Homo sapiens
gcttgctcctgcgtaacactc

SEQ ID NO: 36077 - DNA, 21 bp, Homo sapiens
gctgcctgcggccagcactcc

SEQ ID NO: 36078 - DNA, 17 bp, Homo sapiens
aagctgcctgctgcact

SEQ ID NO: 36079 - DNA, 24 bp, Homo sapiens
gcttcccgctctccccgctactcc

SEQ ID NO: 36080 - DNA, 21 bp, Homo sapiens
aagctagcctgctcctggact

SEQ ID NO: 36081 - DNA, 19 bp, Homo sapiens
gctcatggcccttggcact

SEQ ID NO: 36082 - DNA, 21 bp, Homo sapiens
gccttctgctcttggcgctcc

SEQ ID NO: 36083 - DNA, 17 bp, Homo sapiens
gcttatcggtagcactc

SEQ ID NO: 36084 - DNA, 17 bp, Homo sapiens
gcttcccgctcccattc

SEQ ID NO: 36085 - DNA, 63 bp, Bovine herpesvirus 1
cgggtgccaataataaattttgcgcgaatcttatttaagtgcacaccgtgttatttgcggctg

SEQ ID NO: 36086 - DNA, 24 bp, Bovine herpesvirus 1
tgccaataataaattttgcgcgaa

SEQ ID NO: 36087 - DNA, 23 bp, Homo sapiens
tgccaataatgatgattggcgaa

SEQ ID NO: 36088 - DNA, 18 bp, Homo sapiens
tggcaataataaattctg

SEQ ID NO: 36089 - DNA, 18 bp, Homo sapiens
tgccaataacaaattctg

SEQ ID NO: 36090 - DNA, 17 bp, Homo sapiens
ataatattgtgcgcgaa

SEQ ID NO: 36091 - DNA, 64 bp, Melanoplus sanguinipes entomopoxvirus
ttattgatattggcaatttacattcagatatatttgaatatgtattatatgatatatctaataa

SEQ ID NO: 36092 - DNA, 17 bp, Melanoplus sanguinipes entomopoxvirus
tatgatatatctaataa

SEQ ID NO: 36093 - DNA, 19 bp, Homo sapiens
catgtatatatctaataat

SEQ ID NO: 36094 - DNA, 73 bp, Rana tigrina ranavirus
tgtctcctatagtacccctaaactttatagaatccgaggatctggacaaagagttggactaaagcgtacgaca

SEQ ID NO: 36095 - DNA, 24 bp, Rana tigrina ranavirus
tagtacccctaaactttatagaat

SEQ ID NO: 36096 - DNA, 18 bp, Homo sapiens
tagtacccctgagcttta

SEQ ID NO: 36097 - DNA, 19 bp, Homo sapiens
tagtacttccaaacttaca

SEQ ID NO: 36098 - DNA, 20 bp, Homo sapiens
tagcgcccctaaatttaaag

SEQ ID NO: 36099 - DNA, 25 bp, Homo sapiens
gtgccctaaactggttttatggaat

SEQ ID NO: 36100 - DNA, 19 bp, Homo sapiens
tagtacccctaaaattaca

SEQ ID NO: 36101 - DNA, 63 bp, Rana tigrina ranavirus
gcttctcgacggcagactctttctcctctgctgtgaggggaggagagtctgcgttgacggggc

SEQ ID NO: 36102 - DNA, 24 bp, Rana tigrina ranavirus
ggaggagagtctgcgttgacgggg

SEQ ID NO: 36103 - DNA, 24 bp, Homo sapiens
ggaggagaagtccatctggtgggg

SEQ ID NO: 36104 - DNA, 22 bp, Homo sapiens
ggaggagacttcggaggtgggg

SEQ ID NO: 36105 - DNA, 18 bp, Homo sapiens
ggtggggtctgcaagggg

SEQ ID NO: 36106 - DNA, 26 bp, Homo sapiens
gagaggagtccaaggcgttggtgggg

SEQ ID NO: 36107 - DNA, 18 bp, Homo sapiens
ggggcctgcgttggtggg

SEQ ID NO: 36108 - DNA, 18 bp, Homo sapiens
ggagggggtgttggcggg

SEQ ID NO: 36109 - DNA, 23 bp, Homo sapiens
ggtggagagtctgccaaaagggg

SEQ ID NO: 36110 - DNA, 20 bp, Homo sapiens
ggaggagagtctgtgtgagg

SEQ ID NO: 36111 - DNA, 23 bp, Homo sapiens
agaggagagttttcgaagtgggg

SEQ ID NO: 36112 - DNA, 23 bp, Homo sapiens
ggggagagactctagagacgggg

SEQ ID NO: 36113 - DNA, 21 bp, Homo sapiens
ggaggagaggttgtggcgggg

SEQ ID NO: 36114 - DNA, 22 bp, Homo sapiens
ggggagagtcaaggggatgggg

SEQ ID NO: 36115 - DNA, 23 bp, Homo sapiens
ggaggagactctgggtggtgggg

SEQ ID NO: 36116 - DNA, 17 bp, Homo sapiens
ggaggacagtctgcggg

SEQ ID NO: 36117 - DNA, 61 bp, Rana tigrina ranavirus
actgggtataaagagtatatctttgggtatagatacaaagaaatagtctgaaagatttagt

SEQ ID NO: 36118 - DNA, 24 bp, Rana tigrina ranavirus
aagagtatatctttgggtatagat

SEQ ID NO: 36119 - DNA, 20 bp, Homo sapiens
gagggaacatttgggtatag

SEQ ID NO: 36120 - DNA, 23 bp, Homo sapiens
aaagtatatttatatatatagat

SEQ ID NO: 36121 - DNA, 19 bp, Homo sapiens
aagaatatattctatggat

SEQ ID NO: 36122 - DNA, 18 bp, Homo sapiens
aagagggtatctttggac

SEQ ID NO: 36123 - DNA, 19 bp, Homo sapiens
gagtgttttagatatagat

SEQ ID NO: 36124 - DNA, 24 bp, Homo sapiens
aagagtatttttcctaaaataggt

SEQ ID NO: 36125 - DNA, 24 bp, Homo sapiens
aagggtatttttttgtgtacagat

SEQ ID NO: 36126 - DNA, 20 bp, Homo sapiens
aagagtatgtcttcaaagta

SEQ ID NO: 36127 - DNA, 20 bp, Homo sapiens
gagaatgtctttgaatagat

SEQ ID NO: 36128 - DNA, 24 bp, Homo sapiens
agaatatatttggcccctatagat

SEQ ID NO: 36129 - DNA, 19 bp, Homo sapiens
aagagtgagtcttatggat

SEQ ID NO: 36130 - DNA, 17 bp, Homo sapiens
aagagtagtctttaagt

SEQ ID NO: 36131 - DNA, 102 bp, Gallid herpesvirus 2
tctcttgatgtcacattttgggtactcggagatgagttcgtaccatatagaataactataaggaaaaaaatgcaattccgcctaaaatagtgcatagtgaga

SEQ ID NO: 36132 - DNA, 24 bp, Gallid herpesvirus 2
taaggaaaaaaatgcaattccgcc

SEQ ID NO: 36133 - DNA, 23 bp, Homo sapiens
aggaagagaaatgcaaaagcagc

SEQ ID NO: 36134 - DNA, 18 bp, Homo sapiens
aaggaaaagaatgcaact

SEQ ID NO: 36135 - DNA, 19 bp, Homo sapiens
aaggaaaaaaatgcagttc

SEQ ID NO: 36136 - DNA, 21 bp, Homo sapiens
aagaaggaaatgcaaggggcc

SEQ ID NO: 36137 - DNA, 20 bp, Homo sapiens
caaggggaaaaatgcattcc

SEQ ID NO: 36138 - DNA, 18 bp, Homo sapiens
aggaaaagaaatgcaagc

SEQ ID NO: 36139 - DNA, 18 bp, Homo sapiens
aaggaagaaaatgcaatt

SEQ ID NO: 36140 - DNA, 20 bp, Homo sapiens
aggcacaagtgcaattctgc

SEQ ID NO: 36141 - DNA, 26 bp, Homo sapiens
taagaaaaaagtatatcaattttgcc

SEQ ID NO: 36142 - DNA, 22 bp, Homo sapiens
taaggaaaataaacattttgcc

SEQ ID NO: 36143 - DNA, 21 bp, Homo sapiens
aaggaaaaaaatcagtttgcc

SEQ ID NO: 36144 - DNA, 18 bp, Homo sapiens
ggaaaaaaatctgcagcc

SEQ ID NO: 36145 - DNA, 23 bp, Homo sapiens
aagagaaaaatgcccttcttgcc

SEQ ID NO: 36146 - DNA, 18 bp, Homo sapiens
ggaaaaaaaagcttctac

SEQ ID NO: 36147 - DNA, 22 bp, Homo sapiens
aggacataaaatgcagttttgc

SEQ ID NO: 36148 - DNA, 16 bp, Homo sapiens
taaggaaaagaatcca

SEQ ID NO: 36149 - DNA, 18 bp, Homo sapiens
aggaaaaaaatgaattgc

SEQ ID NO: 36150 - DNA, 19 bp, Homo sapiens
taagcaaagaaatgcaacc

SEQ ID NO: 36151 - DNA, 21 bp, Homo sapiens
ggaaaaaaatgaattaattgc

SEQ ID NO: 36152 - DNA, 27 bp, Homo sapiens
taaggaaatggagtgagcacattctgc

SEQ ID NO: 36153 - DNA, 22 bp, Homo sapiens
aaggggggaaaatgcaatttcc

SEQ ID NO: 36154 - DNA, 18 bp, Homo sapiens
aagagatgcaattctgcc

SEQ ID NO: 36155 - DNA, 23 bp, Homo sapiens
caagggaaaaaatggaatttgcc

SEQ ID NO: 36156 - DNA, 21 bp, Homo sapiens
taagggaaaaatgcttccagc

SEQ ID NO: 36157 - DNA, 18 bp, Homo sapiens
taaggaaaaaagctttgc

SEQ ID NO: 36158 - DNA, 21 bp, Homo sapiens
caaggaaaaaaatgcaaaagc

SEQ ID NO: 36159 - DNA, 23 bp, Homo sapiens
caaggggaaaaatgcttagtgcc

SEQ ID NO: 36160 - DNA, 21 bp, Homo sapiens
taaggaaagggtgtgtttccg

SEQ ID NO: 36161 - DNA, 20 bp, Homo sapiens
taaggaaaaagagcatcacg

SEQ ID NO: 36162 - DNA, 17 bp, Homo sapiens
aggaaaatgcaccctgc

SEQ ID NO: 36163 - DNA, 76 bp, Rana tigrina ranavirus
caaagtccataacagagttttgtgtgtttgccatagttttggttgctgcacaaatgctgtggtgatttggattttg

SEQ ID NO: 36164 - DNA, 24 bp, Rana tigrina ranavirus
tgcacaaatgctgtggtgatttgg

SEQ ID NO: 36165 - DNA, 16 bp, Homo sapiens
aaatgctgtgatgtgg

SEQ ID NO: 36166 - DNA, 17 bp, Homo sapiens
gcacctgtggtggtttg

SEQ ID NO: 36167 - DNA, 18 bp, Homo sapiens
tgcagcgagtgctgtttg

SEQ ID NO: 36168 - DNA, 18 bp, Homo sapiens
tacacagatgcttatttg

SEQ ID NO: 36169 - DNA, 22 bp, Homo sapiens
gcacaaatgctgatgtctttgg

SEQ ID NO: 36170 - DNA, 23 bp, Homo sapiens
tgtacaaatgcaactgggtttgg

SEQ ID NO: 36171 - DNA, 21 bp, Homo sapiens
tgccaggtgctgtgggaacgg

SEQ ID NO: 36172 - DNA, 21 bp, Homo sapiens
gcaggtgctgtgaagaattgg

SEQ ID NO: 36173 - DNA, 18 bp, Homo sapiens
tgacaagtgctgtccttg

SEQ ID NO: 36174 - DNA, 18 bp, Homo sapiens
acaaatgctgtttgttgg

SEQ ID NO: 36175 - DNA, 23 bp, Homo sapiens
tgacagagactgtggtggtttgg

SEQ ID NO: 36176 - DNA, 23 bp, Homo sapiens
tgcacagtgctgtggatgagtgg

SEQ ID NO: 36177 - DNA, 22 bp, Homo sapiens
tgcacaaagaactctgatttgg

SEQ ID NO: 36178 - DNA, 22 bp, Homo sapiens
tggacaggtgctatggatttgg

SEQ ID NO: 36179 - DNA, 22 bp, Homo sapiens
tgctagatgctgtgtgatgtgg

SEQ ID NO: 36180 - DNA, 84 bp, Melanoplus sanguinipes entomopoxvirus
gatagagttaatatttgtaagtttattaatgattctaaaaaattaaatttttctattttatcacctctacatattaattctatt

SEQ ID NO: 36181 - DNA, 24 bp, Melanoplus sanguinipes entomopoxvirus
ttaatatttgtaagtttattaatg

SEQ ID NO: 36182 - DNA, 18 bp, Homo sapiens
tttgtatatctattaatg

SEQ ID NO: 36183 - DNA, 74 bp, Rana tigrina ranavirus
gaaaggtcttccgacgtggcaagtctggactacgtggacagagtcgtagtcccccacgagcttgtcggcctttt

SEQ ID NO: 36184 - DNA, 24 bp, Rana tigrina ranavirus
aaggtcttccgacgtggcaagtct

SEQ ID NO: 36185 - DNA, 21 bp, Homo sapiens
aagatcttctggccttgaagt

SEQ ID NO: 36186 - DNA, 19 bp, Homo sapiens
ggtcttcccgcagaggtct

SEQ ID NO: 36187 - DNA, 19 bp, Homo sapiens
aaggtcttccactagagtc

SEQ ID NO: 36188 - DNA, 17 bp, Homo sapiens
ggctcttggtggcaagt

SEQ ID NO: 36189 - DNA, 18 bp, Homo sapiens
aggtcttctgaacaatgg

SEQ ID NO: 36190 - DNA, 17 bp, Homo sapiens
aaggtcttcggtgtgtc

SEQ ID NO: 36191 - DNA, 22 bp, Homo sapiens
ggcagaacaacgtggcaagtct

SEQ ID NO: 36192 - DNA, 20 bp, Homo sapiens
ggctcttcccgccagcaagt

SEQ ID NO: 36193 - DNA, 18 bp, Homo sapiens
aaggttttatagcaagtc

SEQ ID NO: 36194 - DNA, 21 bp, Homo sapiens
agatcttctgcacgcgtgagt

SEQ ID NO: 36195 - DNA, 19 bp, Homo sapiens
aaggtcttctggatgtgac

SEQ ID NO: 36196 - DNA, 23 bp, Homo sapiens
aaggttttcagagtggcaagtct

SEQ ID NO: 36197 - DNA, 19 bp, Homo sapiens
aaggtcctttgagtgggtc

SEQ ID NO: 36198 - DNA, 22 bp, Homo sapiens
aaggtctttgtgacgtgtatct

SEQ ID NO: 36199 - DNA, 21 bp, Homo sapiens
aaggtctcctgggatgggtct

SEQ ID NO: 36200 - DNA, 20 bp, Homo sapiens
aggttttccgagtggcaagt

SEQ ID NO: 36201 - DNA, 26 bp, Homo sapiens
aaggccttctgacctcctccgggtct

SEQ ID NO: 36202 - DNA, 20 bp, Homo sapiens
gtcctccgtgtggtaggtct

SEQ ID NO: 36203 - DNA, 19 bp, Homo sapiens
aaggtctcttgacttcaag

SEQ ID NO: 36204 - DNA, 67 bp, Human adenovirus E
cgggggggtcccccgttgggcagggagagggcgctgacgatgcatcttatcaattgccccgtaggga

SEQ ID NO: 36205 - DNA, 24 bp, Human adenovirus E
atgcatcttatcaattgccccgta

SEQ ID NO: 36206 - DNA, 21 bp, Homo sapiens
atgcacttatcaaggcatgta

SEQ ID NO: 36207 - DNA, 18 bp, Homo sapiens
gcatttcaattgccttgt

SEQ ID NO: 36208 - DNA, 19 bp, Homo sapiens
tgcaccttaggagccctgt

SEQ ID NO: 36209 - DNA, 23 bp, Homo sapiens
atgtgtcctgctgtctgccccgt

SEQ ID NO: 36210 - DNA, 19 bp, Homo sapiens
atgcatcctcttgccttgt

SEQ ID NO: 36211 - DNA, 22 bp, Homo sapiens
tgcatcctgactcctgcctcgt

SEQ ID NO: 36212 - DNA, 24 bp, Homo sapiens
atgcatctcgttatgataacccgt

SEQ ID NO: 36213 - DNA, 19 bp, Homo sapiens
gcatcttattgggctccgt

SEQ ID NO: 36214 - DNA, 79 bp, Human herpesvirus 6B
agatttattggaggggggggggatgtataatatccatgtttttaagatatggtaatatttatcaattatctaattgtct

SEQ ID NO: 36215 - DNA, 24 bp, Human herpesvirus 6B
tatggtaatatttatcaattatct

SEQ ID NO: 36216 - DNA, 18 bp, Homo sapiens
tatggtaatatttgcaat

SEQ ID NO: 36217 - DNA, 130 bp, Human herpesvirus 5
ccgaccgaccagccggccgattcgcccgccggggcttctggagaacgccggggcagcagcgatctggggaagctgctaaacccctgcgtttttatatggtagctctgccgagcgcgggctgacgcgttgg

SEQ ID NO: 36218 - DNA, 24 bp, Human herpesvirus 5
tatggtagctctgccgagcgcggg

SEQ ID NO: 36219 - DNA, 19 bp, Homo sapiens
tatggtaggctgggcgtgg

SEQ ID NO: 36220 - DNA, 67 bp, Human adenovirus E
gaagtcgttggagatgcggcccatgagctgcgagaaggcgttcatgcccgcctcgttccagacgcgg

SEQ ID NO: 36221 - DNA, 24 bp, Human adenovirus E
cgttcatgcccgcctcgttccaga

SEQ ID NO: 36222 - DNA, 20 bp, Homo sapiens
ttcatgcctgtagtcccaga

SEQ ID NO: 36223 - DNA, 20 bp, Homo sapiens
cgtcatgcccgccgtctccc

SEQ ID NO: 36224 - DNA, 16 bp, Homo sapiens
cgttcatgtcttctca

SEQ ID NO: 36225 - DNA, 21 bp, Homo sapiens
ttcatgcctgcaaaacctaga

SEQ ID NO: 36226 - DNA, 23 bp, Homo sapiens
gttcattctagagctgttccaga

SEQ ID NO: 36227 - DNA, 25 bp, Homo sapiens
gttcatgctggtgcctggttttaga

SEQ ID NO: 36228 - DNA, 23 bp, Homo sapiens
cgtttatgtccccagaggccaga

SEQ ID NO: 36229 - DNA, 20 bp, Homo sapiens
gttcaagccccacattccag

SEQ ID NO: 36230 - DNA, 23 bp, Homo sapiens
atttgtacctgccttgttccaga

SEQ ID NO: 36231 - DNA, 18 bp, Homo sapiens
gttcatgctcggctgcag

SEQ ID NO: 36232 - DNA, 20 bp, Homo sapiens
gttcgtgccccacccccaga

SEQ ID NO: 36233 - DNA, 18 bp, Homo sapiens
gctcatgtcccactgttc

SEQ ID NO: 36234 - DNA, 25 bp, Homo sapiens
gtccatgcttgcctggcctcctaga

SEQ ID NO: 36235 - DNA, 24 bp, Homo sapiens
gttcagtccgccccatctttccag

SEQ ID NO: 36236 - DNA, 20 bp, Homo sapiens
gtgcatgcccgccgaacaga

SEQ ID NO: 36237 - DNA, 19 bp, Homo sapiens
cgttcatatttgccccgtc

SEQ ID NO: 36238 - DNA, 20 bp, Homo sapiens
cgctcatgctttacatttcc

SEQ ID NO: 36239 - DNA, 20 bp, Homo sapiens
gttcatgaaatcgttccaga

SEQ ID NO: 36240 - DNA, 70 bp, Human herpesvirus 5
agtccagtgaccggtaaccacgtccagcccctgcgtatgtaccagtccaagcacgtccggtcattgttct

SEQ ID NO: 36241 - DNA, 24 bp, Human herpesvirus 5
tccaagcacgtccggtcattgttc

SEQ ID NO: 36242 - DNA, 21 bp, Homo sapiens
tccaggtctcaattcattgtt

SEQ ID NO: 36243 - DNA, 23 bp, Homo sapiens
tccaagcagtccctgatatgttc

SEQ ID NO: 36244 - DNA, 21 bp, Homo sapiens
caatcacatcagtcattgttc

SEQ ID NO: 36245 - DNA, 16 bp, Homo sapiens
aacacatttcattgtt

SEQ ID NO: 36246 - DNA, 23 bp, Homo sapiens
ccaagcaatacttggtcattgtt

SEQ ID NO: 36247 - DNA, 21 bp, Homo sapiens
tccaggcactgttccctgttc

SEQ ID NO: 36248 - DNA, 20 bp, Homo sapiens
tccaagtgttctcattgttc

SEQ ID NO: 36249 - DNA, 19 bp, Homo sapiens
tccaggcatgtccagtcac

SEQ ID NO: 36250 - DNA, 16 bp, Homo sapiens
caaacatgtcactgtt

SEQ ID NO: 36251 - DNA, 18 bp, Homo sapiens
tccaagcacgcctgtgtt

SEQ ID NO: 36252 - DNA, 18 bp, Homo sapiens
aagcacgtttgatctgtt

SEQ ID NO: 36253 - DNA, 18 bp, Homo sapiens
aagcacatcccagtgttc

SEQ ID NO: 36254 - DNA, 18 bp, Homo sapiens
tctcagcacgtctctgtt

SEQ ID NO: 36255 - DNA, 22 bp, Homo sapiens
tctaagcatattcctcactgtt

SEQ ID NO: 36256 - DNA, 18 bp, Homo sapiens
gccatgtggtcattgttc

SEQ ID NO: 36257 - DNA, 86 bp, Lumpy skin disease virus
gtaaaaaaagtttctatttctatagtaatgttaacaagtgataacaaatttttagcatgttctagaagacatagttttttatttac

SEQ ID NO: 36258 - DNA, 89 bp, Human herpesvirus 5
gtctccatgtgtgtataaaaagcaaggcacgttcataatgtaaaaaagaacacgttgtaaacaagctattgctgtatcattcggctgac

SEQ ID NO: 36259 - DNA, 24 bp, Human herpesvirus 5
tccatgtgtgtataaaaagcaagg

SEQ ID NO: 36260 - DNA, 20 bp, Homo sapiens
tgtttactcagaaagcaagg

SEQ ID NO: 36261 - DNA, 21 bp, Homo sapiens
atatatatataaaaagtaagg

SEQ ID NO: 36262 - DNA, 21 bp, Homo sapiens
tgtgtgtatggggaggaaagg

SEQ ID NO: 36263 - DNA, 19 bp, Homo sapiens
tccaagtgagaaaagcaag

SEQ ID NO: 36264 - DNA, 20 bp, Homo sapiens
tgtgtgaaataaaagtaagg

SEQ ID NO: 36265 - DNA, 18 bp, Homo sapiens
tgcatataaaaagcaagg

SEQ ID NO: 36266 - DNA, 24 bp, Homo sapiens
tccttgtctaactgaaaagcaagg

SEQ ID NO: 36267 - DNA, 21 bp, Homo sapiens
tgttcatgtcaaaaagcaggg

SEQ ID NO: 36268 - DNA, 19 bp, Homo sapiens
caggtgtgtataagaaagg

SEQ ID NO: 36269 - DNA, 24 bp, Homo sapiens
tccagtgggtgatgagaagcaagg

SEQ ID NO: 36270 - DNA, 18 bp, Homo sapiens
tctacgtgtgcagggcag

SEQ ID NO: 36271 - DNA, 20 bp, Homo sapiens
catgtgtgtatcctttaagg

SEQ ID NO: 36272 - DNA, 21 bp, Homo sapiens
tatgttgtcaaaaaagcaggg

SEQ ID NO: 36273 - DNA, 22 bp, Homo sapiens
tccaagtgtgtatgtgtcaggg

SEQ ID NO: 36274 - DNA, 17 bp, Homo sapiens
catgtgtgcacacaagg

SEQ ID NO: 36275 - DNA, 21 bp, Homo sapiens
tcctgtgccagaaaagcaagg

SEQ ID NO: 36276 - DNA, 24 bp, Homo sapiens
tccatgggtgttctaaaagcaagg

SEQ ID NO: 36277 - DNA, 22 bp, Homo sapiens
catggtgaaacaagaggcaagg

SEQ ID NO: 36278 - DNA, 20 bp, Homo sapiens
tgtgtgtatatggcacaagg

SEQ ID NO: 36279 - DNA, 25 bp, Homo sapiens
ccatgtgtgtgtggtgtttgcaggg

SEQ ID NO: 36280 - DNA, 24 bp, Homo sapiens
catgtgtgtgggtgtcgagcaggg

SEQ ID NO: 36281 - DNA, 22 bp, Homo sapiens
tccaagtggtcgaaaagcaagg

SEQ ID NO: 36282 - DNA, 21 bp, Homo sapiens
catgctctatagaaagcaagg

SEQ ID NO: 36283 - DNA, 22 bp, Homo sapiens
tccatgtggtatgtaaagaaag

SEQ ID NO: 36284 - DNA, 20 bp, Homo sapiens
cacatgtgtctggagcaggg

SEQ ID NO: 36285 - DNA, 20 bp, Homo sapiens
catgtgtgacacaggcaagg

SEQ ID NO: 36286 - DNA, 18 bp, Homo sapiens
tccactcataaaaagcag

SEQ ID NO: 36287 - DNA, 20 bp, Homo sapiens
cagtcatttaaaaagcaagg

SEQ ID NO: 36288 - DNA, 23 bp, Homo sapiens
atgtgctcccttaaaaagcaggg

SEQ ID NO: 36289 - DNA, 18 bp, Homo sapiens
gtgtgtataaaataccag

SEQ ID NO: 36290 - DNA, 18 bp, Homo sapiens
tccatgtgtgataaaaag

SEQ ID NO: 36291 - DNA, 67 bp, Human adenovirus E
cctgcgtcgccggcggcgcacgggcagacggtcgatgaagcgctcgatggtctcgccgcgccggcgt

SEQ ID NO: 36292 - DNA, 24 bp, Human adenovirus E
ctcgatggtctcgccgcgccggcg

SEQ ID NO: 36293 - DNA, 21 bp, Homo sapiens
cgggctcgtgctgcgccggcg

SEQ ID NO: 36294 - DNA, 27 bp, Homo sapiens
ctcgctggtctcggttcgctgccggcg

SEQ ID NO: 36295 - DNA, 17 bp, Homo sapiens
tccatggtctcgtcggc

SEQ ID NO: 36296 - DNA, 20 bp, Homo sapiens
tcggtgacctcgcgctggcg

SEQ ID NO: 36297 - DNA, 16 bp, Homo sapiens
cggtgtcgacgccggc

SEQ ID NO: 36298 - DNA, 16 bp, Homo sapiens
ctcatggctgcgtcgg

SEQ ID NO: 36299 - DNA, 18 bp, Homo sapiens
gatggtctgctgcttccg

SEQ ID NO: 36300 - DNA, 65 bp, Human adenovirus E
agaagaatcgccagggttgcgttgcggtgtgccccggttcgaggccggccggattccgcggctaa

SEQ ID NO: 36301 - DNA, 24 bp, Human adenovirus E
cagggttgcgttgcggtgtgcccc

SEQ ID NO: 36302 - DNA, 18 bp, Homo sapiens
caggcttgcgttgcctcc

SEQ ID NO: 36303 - DNA, 17 bp, Homo sapiens
gggtctgtgctgtgccc

SEQ ID NO: 36304 - DNA, 20 bp, Homo sapiens
cagtgttaaccccggtgtgc

SEQ ID NO: 36305 - DNA, 16 bp, Homo sapiens
cagggttgtttagtgt

SEQ ID NO: 36306 - DNA, 15 bp, Homo sapiens
gggtttggatgtgcc

SEQ ID NO: 36307 - DNA, 19 bp, Homo sapiens
tgaggttgcggtgggtgtg

SEQ ID NO: 36308 - DNA, 15 bp, Homo sapiens
aggttgcgttgtccc

SEQ ID NO: 36309 - DNA, 20 bp, Homo sapiens
cagtggccagtgtggtgtgc

SEQ ID NO: 36310 - DNA, 19 bp, Homo sapiens
caggggtgggtggtgtgcc

SEQ ID NO: 36311 - DNA, 17 bp, Homo sapiens
gggctggcggtgtgccc

SEQ ID NO: 36312 - DNA, 19 bp, Homo sapiens
tgaggtatggtggtgtgcc

SEQ ID NO: 36313 - DNA, 19 bp, Homo sapiens
cagggttgtgtgtgcatcc

SEQ ID NO: 36314 - DNA, 16 bp, Homo sapiens
cagggtggcggtgtgc

SEQ ID NO: 36315 - DNA, 23 bp, Homo sapiens
gggagttgtgggaaatgtgcccc

SEQ ID NO: 36316 - DNA, 22 bp, Homo sapiens
cagggttgtgctgcgcaactcc

SEQ ID NO: 36317 - DNA, 17 bp, Homo sapiens
cagggttggtttaatgt

SEQ ID NO: 36318 - DNA, 20 bp, Homo sapiens
gggttgcgtttacttgttcc

SEQ ID NO: 36319 - DNA, 22 bp, Homo sapiens
cagggctgtgccattgtgctcc

SEQ ID NO: 36320 - DNA, 62 bp, Japanese iris necrotic ring virus
gctgggaatgactcaagtgcccatagcccaaactgggttgcgggtaaatcgtgtgtcccagc

SEQ ID NO: 36321 - DNA, 24 bp, Japanese iris necrotic ring virus
tgactcaagtgcccatagcccaaa

SEQ ID NO: 36322 - DNA, 19 bp, Homo sapiens
ctcagccgcaccatggccc

SEQ ID NO: 36323 - DNA, 20 bp, Homo sapiens
tgattcagtgcccagttgcc

SEQ ID NO: 36324 - DNA, 18 bp, Homo sapiens
tgctcaagtgccctcagc

SEQ ID NO: 36325 - DNA, 22 bp, Homo sapiens
tgattcaagtgcttattcataa

SEQ ID NO: 36326 - DNA, 19 bp, Homo sapiens
accctgtgtccatagccca

SEQ ID NO: 36327 - DNA, 18 bp, Homo sapiens
tgactcaaggtcccatag

SEQ ID NO: 36328 - DNA, 18 bp, Homo sapiens
tggatcaagtgccctgcc

SEQ ID NO: 36329 - DNA, 16 bp, Homo sapiens
gacgaggcccatagcc

SEQ ID NO: 36330 - DNA, 16 bp, Homo sapiens
actcaagtacagccca

SEQ ID NO: 36331 - DNA, 23 bp, Homo sapiens
tgagtcaagtgctagctttcaaa

SEQ ID NO: 36332 - DNA, 16 bp, Homo sapiens
tgctcaagtgcactca

SEQ ID NO: 36333 - DNA, 21 bp, Homo sapiens
tgactcaagagctctcacacc

SEQ ID NO: 36334 - DNA, 17 bp, Homo sapiens
cccaagctatagcccaa

SEQ ID NO: 36335 - DNA, 20 bp, Homo sapiens
tgactcaaggtacacctgcc

SEQ ID NO: 36336 - DNA, 20 bp, Homo sapiens
tgaccaggtgcccaccccaa

SEQ ID NO: 36337 - DNA, 26 bp, Homo sapiens
tgattccagtgcccatactctcccaa

SEQ ID NO: 36338 - DNA, 18 bp, Homo sapiens
cggctcaggtctagccca

SEQ ID NO: 36339 - DNA, 18 bp, Homo sapiens
agtgcccatggctccaaa

SEQ ID NO: 36340 - DNA, 17 bp, Homo sapiens
ctcttaaccatagccca

SEQ ID NO: 36341 - DNA, 15 bp, Homo sapiens
tcaagtgccccccaa

SEQ ID NO: 36342 - DNA, 22 bp, Homo sapiens
tgaccacaagtctcatagccca

SEQ ID NO: 36343 - DNA, 18 bp, Homo sapiens
tggctggagtgcccaagc

SEQ ID NO: 36344 - DNA, 18 bp, Homo sapiens
tgactcaatgccaaggcc

SEQ ID NO: 36345 - DNA, 18 bp, Homo sapiens
tgctcaagtgtggcccaa

SEQ ID NO: 36346 - DNA, 61 bp, Japanese iris necrotic ring virus
cgagtatactgttgtgcttattgatcggcagccatctgcattgagtacacagacattatcg

SEQ ID NO: 36347 - DNA, 20 bp, Japanese iris necrotic ring virus
tgagtacacagacattatcg

SEQ ID NO: 36348 - DNA, 16 bp, Homo sapiens
tgagtacatgaccatc

SEQ ID NO: 36349 - DNA, 18 bp, Homo sapiens
tgggcacacagatcctat

SEQ ID NO: 36350 - DNA, 20 bp, Homo sapiens
tgggtacacagacttcacca

SEQ ID NO: 36351 - DNA, 22 bp, Homo sapiens
tgagtacacacacttaggctcg

SEQ ID NO: 36352 - DNA, 20 bp, Homo sapiens
tggctgcacagacacttccg

SEQ ID NO: 36353 - DNA, 20 bp, Homo sapiens
tgaatacatggagaccatcg

SEQ ID NO: 36354 - DNA, 17 bp, Homo sapiens
taagtacacagaccacc

SEQ ID NO: 36355 - DNA, 18 bp, Homo sapiens
tgagttacaggacaccat

SEQ ID NO: 36356 - DNA, 17 bp, Homo sapiens
tgagtacagggacaatc

SEQ ID NO: 36357 - DNA, 61 bp, Saimiriine herpesvirus 2
ggagtgtgacaacatattatcatttattattggaaacaaagttgtctctgagtacatctcc

SEQ ID NO: 36358 - DNA, 24 bp, Saimiriine herpesvirus 2
ttattggaaacaaagttgtctctg

SEQ ID NO: 36359 - DNA, 19 bp, Homo sapiens
ttattgaaataaattatct

SEQ ID NO: 36360 - DNA, 21 bp, Homo sapiens
ttgtgaaaaaagttgtttctg

SEQ ID NO: 36361 - DNA, 25 bp, Homo sapiens
ttattggaaaaggagtgaaacgtct

SEQ ID NO: 36362 - DNA, 19 bp, Homo sapiens
ttattggaacatggcctct

SEQ ID NO: 36363 - DNA, 22 bp, Homo sapiens
tattggaagcaagttgtttctg

SEQ ID NO: 36364 - DNA, 19 bp, Homo sapiens
ttattagaaacaatcctct

SEQ ID NO: 36365 - DNA, 18 bp, Homo sapiens
ggaaaaaagttgtctctg

SEQ ID NO: 36366 - DNA, 23 bp, Homo sapiens
ttagtggaaacagggtttcaccg

SEQ ID NO: 36367 - DNA, 17 bp, Homo sapiens
ttgaatactagttgtct

SEQ ID NO: 36368 - DNA, 26 bp, Homo sapiens
ttattggagactaggcctcttctctg

SEQ ID NO: 36369 - DNA, 19 bp, Homo sapiens
ttattggaaaccaaaatct

SEQ ID NO: 36370 - DNA, 21 bp, Homo sapiens
ttattggagaaaaggcccctg

SEQ ID NO: 36371 - DNA, 22 bp, Homo sapiens
ttggaaacagagtccagtcctg

SEQ ID NO: 36372 - DNA, 19 bp, Homo sapiens
ttattggaagaaagtgcct

SEQ ID NO: 36373 - DNA, 60 bp, Murid herpesvirus 4
aggctcctgatgtgcctgctcttttgtctgaaaaattggggagcgcaaggcctggagcct

SEQ ID NO: 36374 - DNA, 23 bp, Murid herpesvirus 4
ggggagcgcaaggcctggagcct

SEQ ID NO: 36375 - DNA, 22 bp, Homo sapiens
agggagtgcaggcagagggcct

SEQ ID NO: 36376 - DNA, 16 bp, Homo sapiens
ggggtgccctggagcc

SEQ ID NO: 36377 - DNA, 16 bp, Homo sapiens
ggggaggcaggggagc

SEQ ID NO: 36378 - DNA, 23 bp, Homo sapiens
gggggtgcaaggcctcagagtct

SEQ ID NO: 36379 - DNA, 17 bp, Homo sapiens
agggagcgcagcgagcc

SEQ ID NO: 36380 - DNA, 18 bp, Homo sapiens
ggagagcgcggggcgcgg

SEQ ID NO: 36381 - DNA, 22 bp, Homo sapiens
gaggaggtggggcctggagcct

SEQ ID NO: 36382 - DNA, 24 bp, Homo sapiens
ggggagcgcggggcctggagcgct

SEQ ID NO: 36383 - DNA, 20 bp, Homo sapiens
ggggcgcgcggccggagcct

SEQ ID NO: 36384 - DNA, 21 bp, Homo sapiens
ggagagcgtgagggcaggcct

SEQ ID NO: 36385 - DNA, 22 bp, Homo sapiens
ggggagcgcaagaccggccccc

SEQ ID NO: 36386 - DNA, 23 bp, Homo sapiens
gaggtgctgcttgcctggggcct

SEQ ID NO: 36387 - DNA, 23 bp, Homo sapiens
ggagagtgcgagtttaggagtct

SEQ ID NO: 36388 - DNA, 18 bp, Homo sapiens
gggaggccacctggagcc

SEQ ID NO: 36389 - DNA, 20 bp, Homo sapiens
ggggagcggggagagagagc

SEQ ID NO: 36390 - DNA, 23 bp, Homo sapiens
ggggagcgtggagtatgaagcct

SEQ ID NO: 36391 - DNA, 20 bp, Homo sapiens
ggcgggcggtcctggagcct

SEQ ID NO: 36392 - DNA, 23 bp, Homo sapiens
gggaagcgcagacgccggagcct

SEQ ID NO: 36393 - DNA, 16 bp, Homo sapiens
ggggaggcctggagcc

SEQ ID NO: 36394 - DNA, 21 bp, Homo sapiens
ggggaacatggcttggggcct

SEQ ID NO: 36395 - DNA, 18 bp, Homo sapiens
gggagcgcaacagagagc

SEQ ID NO: 36396 - DNA, 22 bp, Homo sapiens
ggggaggcaaggcctggactct

SEQ ID NO: 36397 - DNA, 20 bp, Homo sapiens
ggcgtgcgggtctggagcct

SEQ ID NO: 36398 - DNA, 16 bp, Homo sapiens
ggggaacgcggcgggc

SEQ ID NO: 36399 - DNA, 21 bp, Homo sapiens
gggcagcgcgaggcctggggc

SEQ ID NO: 36400 - DNA, 23 bp, Homo sapiens
gggcactttgaggcttggagcct

SEQ ID NO: 36401 - DNA, 19 bp, Homo sapiens
ggggagaggcctggagcct

SEQ ID NO: 36402 - DNA, 19 bp, Homo sapiens
ggggtgcaaggccctgcct

SEQ ID NO: 36403 - DNA, 21 bp, Homo sapiens
gggagtcgatgcttggagcct

SEQ ID NO: 36404 - DNA, 19 bp, Homo sapiens
ggggagtgcatggctgccc

SEQ ID NO: 36405 - DNA, 18 bp, Homo sapiens
gaggagcgcggggcctgg

SEQ ID NO: 36406 - DNA, 18 bp, Homo sapiens
aggcccagggcctggagc

SEQ ID NO: 36407 - DNA, 21 bp, Homo sapiens
ggggaggcaggcccagggcct

SEQ ID NO: 36408 - DNA, 23 bp, Homo sapiens
gaggagtgcaggcagaggggcct

SEQ ID NO: 36409 - DNA, 21 bp, Homo sapiens
ggggagcacagggtctcacct

SEQ ID NO: 36410 - DNA, 24 bp, Homo sapiens
ggagagcgcggggctcgctggcct

SEQ ID NO: 36411 - DNA, 16 bp, Homo sapiens
ggagcgcagggcagcc

SEQ ID NO: 36412 - DNA, 24 bp, Homo sapiens
ggggatgtggggcctgaagagcct

SEQ ID NO: 36413 - DNA, 17 bp, Homo sapiens
gggagcgcggttgggcc

SEQ ID NO: 36414 - DNA, 21 bp, Homo sapiens
gggagggtgtccttggagcct

SEQ ID NO: 36415 - DNA, 18 bp, Homo sapiens
gggaagtgggctggagcc

SEQ ID NO: 36416 - DNA, 22 bp, Homo sapiens
ggggagcgcaagcgctgtcagc

SEQ ID NO: 36417 - DNA, 16 bp, Homo sapiens
agggagcacctggggc

SEQ ID NO: 36418 - DNA, 22 bp, Homo sapiens
gctttgtcagggcctggagtct

SEQ ID NO: 36419 - DNA, 17 bp, Homo sapiens
ggggccggcctggagcc

SEQ ID NO: 36420 - DNA, 19 bp, Homo sapiens
ggggagagcacacctggag

SEQ ID NO: 36421 - DNA, 22 bp, Homo sapiens
gggcggcgctaaaatggagcct

SEQ ID NO: 36422 - DNA, 16 bp, Homo sapiens
aggaggggcctggagc

SEQ ID NO: 36423 - DNA, 20 bp, Homo sapiens
gaggagcgcaagcctggcct

SEQ ID NO: 36424 - DNA, 19 bp, Homo sapiens
ggggtgcagcacagagcct

SEQ ID NO: 36425 - DNA, 20 bp, Homo sapiens
ggagggcgcgggtgaagcct

SEQ ID NO: 36426 - DNA, 22 bp, Homo sapiens
ggggagcagtgctgcttggagc

SEQ ID NO: 36427 - DNA, 20 bp, Homo sapiens
ggggagcgcgggacctcagc

SEQ ID NO: 36428 - DNA, 20 bp, Homo sapiens
ggggtgccgctgcagagcct

SEQ ID NO: 36429 - DNA, 21 bp, Homo sapiens
ggagaagtgggtctggagtct

SEQ ID NO: 36430 - DNA, 20 bp, Homo sapiens
ggggagcggagccccagcct

SEQ ID NO: 36431 - DNA, 19 bp, Homo sapiens
gggggcgcaggctgggcct

SEQ ID NO: 36432 - DNA, 16 bp, Homo sapiens
ggggagcgtaggctga

SEQ ID NO: 36433 - DNA, 22 bp, Homo sapiens
ggggagcgcgggacccgggcct

SEQ ID NO: 36434 - DNA, 21 bp, Homo sapiens
ggggaggtggatggagagcct

SEQ ID NO: 36435 - DNA, 21 bp, Homo sapiens
gaggagtgggcagcctggagc

SEQ ID NO: 36436 - DNA, 18 bp, Homo sapiens
ggagagtgtgacggagcc

SEQ ID NO: 36437 - DNA, 23 bp, Homo sapiens
ggggaggcgaggcctaagtgcct

SEQ ID NO: 36438 - DNA, 22 bp, Homo sapiens
gggtggcgagaatctggagcct

SEQ ID NO: 36439 - DNA, 18 bp, Homo sapiens
ggggagcgcaggacgccg

SEQ ID NO: 36440 - DNA, 18 bp, Homo sapiens
gggaggagcctggagtct

SEQ ID NO: 36441 - DNA, 22 bp, Homo sapiens
ggggagcgggggtcctcagcct

SEQ ID NO: 36442 - DNA, 18 bp, Homo sapiens
ggggagcctgaggcctgg

SEQ ID NO: 36443 - DNA, 21 bp, Homo sapiens
gggggtgaaggggcggagcct

SEQ ID NO: 36444 - DNA, 18 bp, Homo sapiens
ggggaaccctctggagcc

SEQ ID NO: 36445 - DNA, 22 bp, Homo sapiens
gggggcgtggcctctggagcct

SEQ ID NO: 36446 - DNA, 21 bp, Homo sapiens
gggcttatgggcctggagcct

SEQ ID NO: 36447 - DNA, 76 bp, Saimiriine herpesvirus 2
gggctttattcataaacaataaaaggtgtactgaccctgaatttggtcacttacttaaaacacttgaatatagcct

SEQ ID NO: 36448 - DNA, 24 bp, Saimiriine herpesvirus 2
acttacttaaaacacttgaatata

SEQ ID NO: 36449 - DNA, 20 bp, Homo sapiens
ttacttatatcttgaatata

SEQ ID NO: 36450 - DNA, 23 bp, Homo sapiens
acctgcttaaaactgaaaatata

SEQ ID NO: 36451 - DNA, 18 bp, Homo sapiens
acttactgaaaacactga

SEQ ID NO: 36452 - DNA, 20 bp, Homo sapiens
actcacttaaaatataaata

SEQ ID NO: 36453 - DNA, 19 bp, Homo sapiens
ttacttaaaaccttgtata

SEQ ID NO: 36454 - DNA, 19 bp, Homo sapiens
acttactcaaaatgtgaat

SEQ ID NO: 36455 - DNA, 61 bp, Japanese iris necrotic ring virus
gcagaggcggagacttcacccttggactgaatagtccaggtgacatacccaccgcctttgt

SEQ ID NO: 36456 - DNA, 24 bp, Japanese iris necrotic ring virus
tccaggtgacatacccaccgcctt

SEQ ID NO: 36457 - DNA, 18 bp, Homo sapiens
ggtcacacccactgcctt

SEQ ID NO: 36458 - DNA, 22 bp, Homo sapiens
tccaggtggcataacggacctt

SEQ ID NO: 36459 - DNA, 18 bp, Homo sapiens
tccaggtgacatacctcc

SEQ ID NO: 36460 - DNA, 18 bp, Homo sapiens
tccaggtgacatcctgcc

SEQ ID NO: 36461 - DNA, 18 bp, Homo sapiens
tccaggtgatgcacctgc

SEQ ID NO: 36462 - DNA, 17 bp, Homo sapiens
tccaggctgatatgcct

SEQ ID NO: 36463 - DNA, 21 bp, Homo sapiens
agttgacatacctctggccct

SEQ ID NO: 36464 - DNA, 19 bp, Homo sapiens
tccaggtgatctatccacc

SEQ ID NO: 36465 - DNA, 22 bp, Homo sapiens
cccaggtagccttcactgcctt

SEQ ID NO: 36466 - DNA, 22 bp, Homo sapiens
tctgggtcgcattgaccgcctt

SEQ ID NO: 36467 - DNA, 23 bp, Homo sapiens
ccaggtgatctcagcaccgtctt

SEQ ID NO: 36468 - DNA, 65 bp, Rubella virus
ccactgatgtctcgtgcgagggcttgggggcctgggtacccgcagccccttgcgcgcgcatctgg

SEQ ID NO: 36469 - DNA, 24 bp, Rubella virus
actgatgtctcgtgcgagggcttg

SEQ ID NO: 36470 - DNA, 21 bp, Homo sapiens
actaatgtttgacagggtttg

SEQ ID NO: 36471 - DNA, 25 bp, Homo sapiens
actgatgctttgtgtttagggtttg

SEQ ID NO: 36472 - DNA, 17 bp, Homo sapiens
ctgggtctcgtgcggag

SEQ ID NO: 36473 - DNA, 25 bp, Homo sapiens
actgatgcctcgtgcccctagcttg

SEQ ID NO: 36474 - DNA, 24 bp, Homo sapiens
actgggttttgtcatcagggcttg

SEQ ID NO: 36475 - DNA, 22 bp, Homo sapiens
ctgatctcttggtcagggcttg

SEQ ID NO: 36476 - DNA, 19 bp, Homo sapiens
ctgatgtcttgtgtgggct

SEQ ID NO: 36477 - DNA, 16 bp, Homo sapiens
ctggtgctcgtgcggc

SEQ ID NO: 36478 - DNA, 60 bp, Tobacco mild green mosaic virus
acaggatgagatacttccggcattcatgactaaggtcaagagtgttagaatatcgactgt

SEQ ID NO: 36479 - DNA, 24 bp, Tobacco mild green mosaic virus
tgagatacttccggcattcatgac

SEQ ID NO: 36480 - DNA, 17 bp, Homo sapiens
tgagatatttttcatga

SEQ ID NO: 36481 - DNA, 24 bp, Homo sapiens
tgagactgtttatgtattcatgac

SEQ ID NO: 36482 - DNA, 17 bp, Homo sapiens
gatgactggcattcatg

SEQ ID NO: 36483 - DNA, 19 bp, Homo sapiens
tggatactggacattcatg

SEQ ID NO: 36484 - DNA, 22 bp, Homo sapiens
tgagatactctcggccctcttg

SEQ ID NO: 36485 - DNA, 18 bp, Homo sapiens
tgagatactctggtatca

SEQ ID NO: 36486 - DNA, 67 bp, Human papillomavirus type 89
ctgtgtccaaagttttaagtacggaccgctatgtccagcgtaccaacctgtactattatggaggcag

SEQ ID NO: 36487 - DNA, 24 bp, Human papillomavirus type 89
tccaaagttttaagtacggaccgc

SEQ ID NO: 36488 - DNA, 17 bp, Homo sapiens
aaagctttaagcattcc

SEQ ID NO: 36489 - DNA, 17 bp, Homo sapiens
tccacagttttaagtcg

SEQ ID NO: 36490 - DNA, 21 bp, Homo sapiens
cctaagaacggtacggactgc

SEQ ID NO: 36491 - DNA, 18 bp, Homo sapiens
gttctgagtacggatcgc

SEQ ID NO: 36492 - DNA, 18 bp, Homo sapiens
caaaattttaggtatgga

SEQ ID NO: 36493 - DNA, 20 bp, Homo sapiens
tccagtgttttaagcccccg

SEQ ID NO: 36494 - DNA, 18 bp, Homo sapiens
tccagagttttaaggaca

SEQ ID NO: 36495 - DNA, 23 bp, Homo sapiens
tccaaagttttcaaattaactgc

SEQ ID NO: 36496 - DNA, 22 bp, Homo sapiens
tccgaagtttaagtactaacgc

SEQ ID NO: 36497 - DNA, 18 bp, Homo sapiens
tccaaggttttaagacaa

SEQ ID NO: 36498 - DNA, 22 bp, Homo sapiens
tccaaatttttggaggtaccgc

SEQ ID NO: 36499 - DNA, 19 bp, Homo sapiens
tccagagtttcaacaccac

SEQ ID NO: 36500 - DNA, 23 bp, Homo sapiens
tccaaaattttgatagcagctgc

SEQ ID NO: 36501 - DNA, 64 bp, Human papillomavirus type 89
cctcctattggggagcactgggccaagggtactgtgtgctctagtgttgtgcctcagcaggggg

SEQ ID NO: 36502 - DNA, 24 bp, Human papillomavirus type 89
tattggggagcactgggccaaggg

SEQ ID NO: 36503 - DNA, 19 bp, Homo sapiens
ttggggggcaggccaaggg

SEQ ID NO: 36504 - DNA, 24 bp, Homo sapiens
caccagggggcactgggccggggg

SEQ ID NO: 36505 - DNA, 20 bp, Homo sapiens
ttggggagcagagttggggg

SEQ ID NO: 36506 - DNA, 20 bp, Homo sapiens
tggggaggctgggccaaggg

SEQ ID NO: 36507 - DNA, 19 bp, Homo sapiens
ttggggaatgaggttaggg

SEQ ID NO: 36508 - DNA, 25 bp, Homo sapiens
tattgggggtcgtcataacccgggg

SEQ ID NO: 36509 - DNA, 22 bp, Homo sapiens
ttggtcccagctgggccaaggg

SEQ ID NO: 36510 - DNA, 18 bp, Homo sapiens
ttggggagaggctggggg

SEQ ID NO: 36511 - DNA, 17 bp, Homo sapiens
ttggtgggcactgaagg

SEQ ID NO: 36512 - DNA, 21 bp, Homo sapiens
ttggggagtgtgtgctggggg

SEQ ID NO: 36513 - DNA, 16 bp, Homo sapiens
tggggagccctggggg

SEQ ID NO: 36514 - DNA, 18 bp, Homo sapiens
ggaagcctgggtcgaggg

SEQ ID NO: 36515 - DNA, 15 bp, Homo sapiens
tggggagcacagagg

SEQ ID NO: 36516 - DNA, 15 bp, Homo sapiens
ttggggagcccgggg

SEQ ID NO: 36517 - DNA, 19 bp, Homo sapiens
tattggagagtgagtgagg

SEQ ID NO: 36518 - DNA, 18 bp, Homo sapiens
tattggggagtctcaagg

SEQ ID NO: 36519 - DNA, 24 bp, Homo sapiens
ttggggagcgttaggagctcaggg

SEQ ID NO: 36520 - DNA, 20 bp, Homo sapiens
tactggggatgcggtcaggg

SEQ ID NO: 36521 - DNA, 21 bp, Homo sapiens
ttggtgtcattgggtcaaggg

SEQ ID NO: 36522 - DNA, 16 bp, Homo sapiens
tattgggacggccaag

SEQ ID NO: 36523 - DNA, 16 bp, Homo sapiens
ttggggagtagtaagg

SEQ ID NO: 36524 - DNA, 17 bp, Homo sapiens
ttggggaggcaaggagg

SEQ ID NO: 36525 - DNA, 20 bp, Homo sapiens
attggggagtgaggtggggg

SEQ ID NO: 36526 - DNA, 21 bp, Homo sapiens
ggggagcacgcagtcccaggg

SEQ ID NO: 36527 - DNA, 20 bp, Homo sapiens
tgtcaggcactgggctaggg

SEQ ID NO: 36528 - DNA, 25 bp, Homo sapiens
ctggggagtacgtgacagttaaggg

SEQ ID NO: 36529 - DNA, 17 bp, Homo sapiens
tggggagcacttggggg

SEQ ID NO: 36530 - DNA, 21 bp, Homo sapiens
tattgggaagtactgggtaag

SEQ ID NO: 36531 - DNA, 17 bp, Homo sapiens
aggcactgggctaaggg

SEQ ID NO: 36532 - DNA, 20 bp, Homo sapiens
tggggagagagggtcagggg

SEQ ID NO: 36533 - DNA, 17 bp, Homo sapiens
ctggggctgggccaggg

SEQ ID NO: 36534 - DNA, 21 bp, Homo sapiens
tactggggaagtggttgaggg

SEQ ID NO: 36535 - DNA, 16 bp, Homo sapiens
tggggttgggccaagg

SEQ ID NO: 36536 - DNA, 20 bp, Homo sapiens
ttggggaggccggccggggg

SEQ ID NO: 36537 - DNA, 63 bp, Human adenovirus D
tttattgtcaagcttggtggcaaaggagccatagagggcgttggagagaagcttggcgatgga

SEQ ID NO: 36538 - DNA, 24 bp, Human adenovirus D
cgttggagagaagcttggcgatgg

SEQ ID NO: 36539 - DNA, 20 bp, Homo sapiens
gtgggagagaagaggggtgg

SEQ ID NO: 36540 - DNA, 21 bp, Homo sapiens
cgctggagggaacggtggtgg

SEQ ID NO: 36541 - DNA, 18 bp, Homo sapiens
gttggagggaggccttcg

SEQ ID NO: 36542 - DNA, 21 bp, Homo sapiens
gtggagagaggggacagatgg

SEQ ID NO: 36543 - DNA, 20 bp, Homo sapiens
ttggagagagggagagatgg

SEQ ID NO: 36544 - DNA, 22 bp, Homo sapiens
gttgggagagaggctgctatgg

SEQ ID NO: 36545 - DNA, 20 bp, Homo sapiens
ttggaggaaggtggcgatgg

SEQ ID NO: 36546 - DNA, 20 bp, Homo sapiens
gctggagagaggcctgatgg

SEQ ID NO: 36547 - DNA, 25 bp, Homo sapiens
cgtggagagagggacgcggcggtgg

SEQ ID NO: 36548 - DNA, 24 bp, Homo sapiens
gctggagaggggtccagttggtgg

SEQ ID NO: 36549 - DNA, 20 bp, Homo sapiens
gctggagaggagcaggatgg

SEQ ID NO: 36550 - DNA, 21 bp, Homo sapiens
ccttggagagggaagtgatgg

SEQ ID NO: 36551 - DNA, 19 bp, Homo sapiens
cgtggaggagatggtggtg

SEQ ID NO: 36552 - DNA, 21 bp, Homo sapiens
gctggagaggaggctgggtgg

SEQ ID NO: 36553 - DNA, 17 bp, Homo sapiens
cattggaggggcagtgg

SEQ ID NO: 36554 - DNA, 19 bp, Homo sapiens
cgctggagagctggtgatg

SEQ ID NO: 36555 - DNA, 23 bp, Homo sapiens
gttggaggggctgggggcgatgg

SEQ ID NO: 36556 - DNA, 72 bp, Human papillomavirus type 89
aatggtatttgttggtttaatgagttgtttgttactgtggtggataccacccgtagtaccaaccttaccatt

SEQ ID NO: 36557 - DNA, 24 bp, Human papillomavirus type 89
tttgttggtttaatgagttgtttg

SEQ ID NO: 36558 - DNA, 18 bp, Homo sapiens
tttgttggttttttgttt

SEQ ID NO: 36559 - DNA, 19 bp, Homo sapiens
tttgttagtttgtctgttt

SEQ ID NO: 36560 - DNA, 19 bp, Homo sapiens
tttgttggttcaataaatt

SEQ ID NO: 36561 - DNA, 23 bp, Homo sapiens
tttgttgttactgttgttgtttg

SEQ ID NO: 36562 - DNA, 20 bp, Homo sapiens
tttgttgttttaatggattg

SEQ ID NO: 36563 - DNA, 17 bp, Homo sapiens
tttgttggtttgagagc

SEQ ID NO: 36564 - DNA, 19 bp, Homo sapiens
gttggtttggtgggttcct

SEQ ID NO: 36565 - DNA, 21 bp, Homo sapiens
tttgttggttgatttaatttg

SEQ ID NO: 36566 - DNA, 17 bp, Homo sapiens
tttcttggtttagagtt

SEQ ID NO: 36567 - DNA, 18 bp, Homo sapiens
tttgctggtttggtgggc

SEQ ID NO: 36568 - DNA, 87 bp, Human papillomavirus type 34
accatgcaatatgtggtatggacatttgtgtattattggttggaaggcaagtggtataaagtgagtagccatgtagattataatggt

SEQ ID NO: 36569 - DNA, 24 bp, Human papillomavirus type 34
tataaagtgagtagccatgtagat

SEQ ID NO: 36570 - DNA, 16 bp, Homo sapiens
taaagtgagtaggtgt

SEQ ID NO: 36571 - DNA, 16 bp, Homo sapiens
tataaagtggtggcag

SEQ ID NO: 36572 - DNA, 19 bp, Homo sapiens
tacaaagtgagtggccaca

SEQ ID NO: 36573 - DNA, 18 bp, Homo sapiens
aagtgagtggctgaagac

SEQ ID NO: 36574 - DNA, 15 bp, Homo sapiens
aaagtgagtatatag

SEQ ID NO: 36575 - DNA, 24 bp, Homo sapiens
taaggtgagcagcttaggaaagat

SEQ ID NO: 36576 - DNA, 21 bp, Homo sapiens
taaagcgagtagcccccaaat

SEQ ID NO: 36577 - DNA, 20 bp, Homo sapiens
gtagcagtttttatgtagat

SEQ ID NO: 36578 - DNA, 19 bp, Homo sapiens
aagtgagtctcttgtagat

SEQ ID NO: 36579 - DNA, 18 bp, Homo sapiens
aaagtgagtggctacaga

SEQ ID NO: 36580 - DNA, 80 bp, Duck adenovirus A
cgtggccagcgccctctataaaagatttaggattaatatcatttccttcattttcagttgacggagcgactggtaaagcg

SEQ ID NO: 36581 - DNA, 24 bp, Duck adenovirus A
ttcattttcagttgacggagcgac

SEQ ID NO: 36582 - DNA, 19 bp, Homo sapiens
ttcattttagttggcaaaa

SEQ ID NO: 36583 - DNA, 19 bp, Homo sapiens
ttcttttcagttgaaatga

SEQ ID NO: 36584 - DNA, 18 bp, Homo sapiens
ttcattttcagttattgc

SEQ ID NO: 36585 - DNA, 19 bp, Homo sapiens
ttcgttttcagtagaccaa

SEQ ID NO: 36586 - DNA, 19 bp, Homo sapiens
ttcatgttcagttgataga

SEQ ID NO: 36587 - DNA, 18 bp, Homo sapiens
ttcattttcagttgctgc

SEQ ID NO: 36588 - DNA, 20 bp, Homo sapiens
ttttgcagctgcggagcgac

SEQ ID NO: 36589 - DNA, 17 bp, Homo sapiens
ttttcagttgggaggac

SEQ ID NO: 36590 - DNA, 17 bp, Homo sapiens
ttcaatttcagttgagg

SEQ ID NO: 36591 - DNA, 22 bp, Homo sapiens
ttcacttttcagttgactttag

SEQ ID NO: 36592 - DNA, 131 bp, Rana tigrina ranavirus
ttacgatcccgcgtcgtgggccggggtcggggactctgcacctccctttaggatctttcccggcctctaccagggcaagggagatccgggggcgagacccagggccgcgtacggctatgcgggccccgtgg

SEQ ID NO: 36593 - DNA, 24 bp, Rana tigrina ranavirus
taggatctttcccggcctctacca

SEQ ID NO: 36594 - DNA, 21 bp, Homo sapiens
ggctttttcccggcctggcca

SEQ ID NO: 36595 - DNA, 24 bp, Homo sapiens
taggctctttcccacagtcctgct

SEQ ID NO: 36596 - DNA, 18 bp, Homo sapiens
taggatctttgcatgtct

SEQ ID NO: 36597 - DNA, 22 bp, Homo sapiens
taggatcttttcaggaacacca

SEQ ID NO: 36598 - DNA, 20 bp, Homo sapiens
taggatgtttcctggggacc

SEQ ID NO: 36599 - DNA, 20 bp, Homo sapiens
tagcatctttcccatgtact

SEQ ID NO: 36600 - DNA, 20 bp, Homo sapiens
taggtcttggcccttctgcc

SEQ ID NO: 36601 - DNA, 22 bp, Homo sapiens
taggctttgaaggcctctatca

SEQ ID NO: 36602 - DNA, 18 bp, Homo sapiens
taggatctttctccatgc

SEQ ID NO: 36603 - DNA, 23 bp, Homo sapiens
taggcatctttcccagcactgct

SEQ ID NO: 36604 - DNA, 18 bp, Homo sapiens
taagatctttcctctgcc

SEQ ID NO: 36605 - DNA, 62 bp, Duck adenovirus A
cctctccgaataattgaaacactagtaaataaggtactagttgtttcccatatttggagtgg

SEQ ID NO: 36606 - DNA, 24 bp, Duck adenovirus A
ctagttgtttcccatatttggagt

SEQ ID NO: 36607 - DNA, 18 bp, Homo sapiens
ctggttgcttcctgaagt

SEQ ID NO: 36608 - DNA, 22 bp, Homo sapiens
ctagtttcagattatttggagt

SEQ ID NO: 36609 - DNA, 20 bp, Homo sapiens
tagtggttttgatttggagt

SEQ ID NO: 36610 - DNA, 18 bp, Homo sapiens
gttcagcatatttggagt

SEQ ID NO: 36611 - DNA, 20 bp, Homo sapiens
gttagtttttaatctggagt

SEQ ID NO: 36612 - DNA, 18 bp, Homo sapiens
cagttgttcatatttggg

SEQ ID NO: 36613 - DNA, 22 bp, Homo sapiens
gttgtggaggagtatttggagt

SEQ ID NO: 36614 - DNA, 63 bp, Rana tigrina ranavirus
ggcgacgtgagggtgacggacgtaaagtttaaccagtttgcaaacatcctcagttcgtgcgcc

SEQ ID NO: 36615 - DNA, 24 bp, Rana tigrina ranavirus
ttgcaaacatcctcagttcgtgcg

SEQ ID NO: 36616 - DNA, 17 bp, Homo sapiens
ttgcagactcctcagtt

SEQ ID NO: 36617 - DNA, 19 bp, Homo sapiens
ttgcagagtcctcagctcg

SEQ ID NO: 36618 - DNA, 22 bp, Homo sapiens
ttgcaaacagtcctcagttaca

SEQ ID NO: 36619 - DNA, 18 bp, Homo sapiens
ttacaagtatcttcatgc

SEQ ID NO: 36620 - DNA, 21 bp, Homo sapiens
ttgcaaataatctcacacgtg

SEQ ID NO: 36621 - DNA, 22 bp, Homo sapiens
ttgcgcacatcctcagactgtg

SEQ ID NO: 36622 - DNA, 22 bp, Homo sapiens
ttgcaaacattcatatccactg

SEQ ID NO: 36623 - DNA, 19 bp, Homo sapiens
ttgcaggcataactcgtgc

SEQ ID NO: 36624 - DNA, 96 bp, Human papillomavirus type 34
gtatatatattatatgtgtgtgtgttttatattcctatggcactggtacattaccatgctaccttgcaagtaacataaatattttcatatatatac

SEQ ID NO: 36625 - DNA, 24 bp, Human papillomavirus type 34
tatatattatatgtgtgtgtgttt

SEQ ID NO: 36626 - DNA, 23 bp, Homo sapiens
tatatatatatatgtgtgtgtgt

SEQ ID NO: 36627 - DNA, 19 bp, Homo sapiens
tatatgtctgtgtgtgtgt

SEQ ID NO: 36628 - DNA, 26 bp, Homo sapiens
tatatatatatatgtgtgtgtgttta

SEQ ID NO: 36629 - DNA, 22 bp, Homo sapiens
catatatagattgtgtgtgttt

SEQ ID NO: 36630 - DNA, 17 bp, Homo sapiens
tatatttgtgtgtgtgt

SEQ ID NO: 36631 - DNA, 25 bp, Homo sapiens
tatattatctggtgtgtgtgtgttt

SEQ ID NO: 36632 - DNA, 19 bp, Homo sapiens
tatatatatgtgtgtgtgt

SEQ ID NO: 36633 - DNA, 19 bp, Homo sapiens
tatatatttgtgtgtgtgt

SEQ ID NO: 36634 - DNA, 21 bp, Homo sapiens
tactagtgtgtgtgtgtgttt

SEQ ID NO: 36635 - DNA, 18 bp, Homo sapiens
tatatattacatgtatgt

SEQ ID NO: 36636 - DNA, 23 bp, Homo sapiens
tatattgtagcccatgtgtgttt

SEQ ID NO: 36637 - DNA, 20 bp, Homo sapiens
tatatagtgtgtgtgtgtgt

SEQ ID NO: 36638 - DNA, 20 bp, Homo sapiens
catatattgtgtgtgtgtgt

SEQ ID NO: 36639 - DNA, 18 bp, Homo sapiens
tatatattatgtgtgtgt

SEQ ID NO: 36640 - DNA, 19 bp, Homo sapiens
tatatatatgtatgtgtgt

SEQ ID NO: 36641 - DNA, 18 bp, Homo sapiens
atatatttctgtgtgtgt

SEQ ID NO: 36642 - DNA, 16 bp, Homo sapiens
catgtgtgtgtgttta

SEQ ID NO: 36643 - DNA, 24 bp, Homo sapiens
tatatattatatgtgtgtctattt

SEQ ID NO: 36644 - DNA, 23 bp, Homo sapiens
tacatattatgcttcgtgtgttt

SEQ ID NO: 36645 - DNA, 25 bp, Homo sapiens
tatatatatatatgtgtgtgtgttt

SEQ ID NO: 36646 - DNA, 23 bp, Homo sapiens
tatatgtatatatgtgtgtgtgt

SEQ ID NO: 36647 - DNA, 25 bp, Homo sapiens
tatatatagtatatatactgtgttt

SEQ ID NO: 36648 - DNA, 19 bp, Homo sapiens
catctccgtgtgtgtgttt

SEQ ID NO: 36649 - DNA, 18 bp, Homo sapiens
tatatataatgtgtgtgt

SEQ ID NO: 36650 - DNA, 19 bp, Homo sapiens
taccaaggtgtgtgtgttt

SEQ ID NO: 36651 - DNA, 19 bp, Homo sapiens
tatatatatatatgtgtgt

SEQ ID NO: 36652 - DNA, 24 bp, Homo sapiens
tatatactctgtgtgtgtgtgttt

SEQ ID NO: 36653 - DNA, 23 bp, Homo sapiens
tatatatgtatatgtgtgtgtgt

SEQ ID NO: 36654 - DNA, 18 bp, Homo sapiens
tatatattatatgtagta

SEQ ID NO: 36655 - DNA, 21 bp, Homo sapiens
tatatatgtatgtgtgtgtgt

SEQ ID NO: 36656 - DNA, 19 bp, Homo sapiens
tattatatggtaaatgttt

SEQ ID NO: 36657 - DNA, 21 bp, Homo sapiens
tatatataagtgtgtgtgttt

SEQ ID NO: 36658 - DNA, 85 bp, Duck adenovirus A
aaaatatttcttcggttttaatcaggcctttctctagtttgtataaagttatatgggtaggttgtttgttctgtggaaatatttt

SEQ ID NO: 36659 - DNA, 24 bp, Duck adenovirus A
tgggtaggttgtttgttctgtgga

SEQ ID NO: 36660 - DNA, 19 bp, Homo sapiens
tgggaggacggttctgtgg

SEQ ID NO: 36661 - DNA, 22 bp, Homo sapiens
ggctgggttgtgcttctgtgga

SEQ ID NO: 36662 - DNA, 23 bp, Homo sapiens
tgggtggccttctgttctgtgga

SEQ ID NO: 36663 - DNA, 26 bp, Homo sapiens
tgggtggtttggatgctttctgtgga

SEQ ID NO: 36664 - DNA, 18 bp, Homo sapiens
gggtggggggttctgtgg

SEQ ID NO: 36665 - DNA, 18 bp, Homo sapiens
tgggaggttgttgagtgg

SEQ ID NO: 36666 - DNA, 19 bp, Homo sapiens
ggtaggtgggtttctgtgg

SEQ ID NO: 36667 - DNA, 20 bp, Homo sapiens
tgggtggtttgtttgttttg

SEQ ID NO: 36668 - DNA, 103 bp, Duck adenovirus A
gaagttttcctgctctcggtaagaagttcctggtgatgttaaacataacaaaatagtctttgtctttgacgttgtcaaggatgtggcttgcaagcacgatttc

SEQ ID NO: 36669 - DNA, 24 bp, Duck adenovirus A
tgtcaaggatgtggcttgcaagca

SEQ ID NO: 36670 - DNA, 19 bp, Homo sapiens
tgtagggggtggagtgagc

SEQ ID NO: 36671 - DNA, 26 bp, Homo sapiens
tgttagggatgtggatagaataagca

SEQ ID NO: 36672 - DNA, 16 bp, Homo sapiens
tgtcaaggatggcaag

SEQ ID NO: 36673 - DNA, 19 bp, Homo sapiens
tgtcaaggtgtgtggcaca

SEQ ID NO: 36674 - DNA, 18 bp, Homo sapiens
tgtcagggtgtggctagc

SEQ ID NO: 36675 - DNA, 17 bp, Homo sapiens
tgtcaaggggtaacaag

SEQ ID NO: 36676 - DNA, 18 bp, Homo sapiens
tgcaaggatgtgaacaag

SEQ ID NO: 36677 - DNA, 20 bp, Homo sapiens
tgtgaaggatgtgggtggca

SEQ ID NO: 36678 - DNA, 18 bp, Homo sapiens
tcaaggatgtgggaagca

SEQ ID NO: 36679 - DNA, 23 bp, Homo sapiens
tgttgagggtggtggccccggca

SEQ ID NO: 36680 - DNA, 106 bp, Ectromelia virus
cctccagaagttgtgtatctagtaaacgcgataatagatagtgctaaacgaattactgaatctattactgactttaatattgatacatacattaatgacctggtgg

SEQ ID NO: 36681 - DNA, 24 bp, Ectromelia virus
agtaaacgcgataatagatagtgc

SEQ ID NO: 36682 - DNA, 20 bp, Homo sapiens
gtaaaggcagatagatagtg

SEQ ID NO: 36683 - DNA, 21 bp, Homo sapiens
aaacgtgacacatgatagtgc

SEQ ID NO: 36684 - DNA, 22 bp, Homo sapiens
gtagagcgataattccacatgc

SEQ ID NO: 36685 - DNA, 21 bp, Homo sapiens
gtaggtgctcaatagatggtg

SEQ ID NO: 36686 - DNA, 90 bp, Ectromelia virus
tatatgatatctttactaagaaagtttctctactgtatctaccacacttctagatatccagatagagattcgatggtttgtcatcgtata

SEQ ID NO: 36687 - DNA, 24 bp, Ectromelia virus
tatgatatctttactaagaaagtt

SEQ ID NO: 36688 - DNA, 20 bp, Homo sapiens
catggtatctttactgggaa

SEQ ID NO: 36689 - DNA, 24 bp, Homo sapiens
atgatgattattactaagagagtt

SEQ ID NO: 36690 - DNA, 21 bp, Homo sapiens
tggtatcttctacagaaagtt

SEQ ID NO: 36691 - DNA, 76 bp, Murid herpesvirus 4
gagcttcgctatcaccgacacgccccagctgcaggagatccgcagaccgctgggcatgttctactttgagctgctc

SEQ ID NO: 36692 - DNA, 24 bp, Murid herpesvirus 4
gcagaccgctgggcatgttctact

SEQ ID NO: 36693 - DNA, 19 bp, Homo sapiens
gcacgtcgctgggcgcgct

SEQ ID NO: 36694 - DNA, 21 bp, Homo sapiens
acaggttgctgggcagatgct

SEQ ID NO: 36695 - DNA, 18 bp, Homo sapiens
gcggacgctgggcgagct

SEQ ID NO: 36696 - DNA, 17 bp, Homo sapiens
gcaactgatatgttcta

SEQ ID NO: 36697 - DNA, 23 bp, Homo sapiens
gcgggccgccgggggaccctgct

SEQ ID NO: 36698 - DNA, 20 bp, Homo sapiens
gcatgttgctgggtcgtcct

SEQ ID NO: 36699 - DNA, 19 bp, Homo sapiens
gaccctgggcatgagaacc

SEQ ID NO: 36700 - DNA, 18 bp, Homo sapiens
gcagcttgctgggcagtt

SEQ ID NO: 36701 - DNA, 16 bp, Homo sapiens
acagaccaaacgtgtt

SEQ ID NO: 36702 - DNA, 20 bp, Homo sapiens
gcaggccgctgggctaagtc

SEQ ID NO: 36703 - DNA, 16 bp, Homo sapiens
gcgaccgctgggcagc

SEQ ID NO: 36704 - DNA, 21 bp, Homo sapiens
gcaggccactgggcacgcgct

SEQ ID NO: 36705 - DNA, 16 bp, Homo sapiens
gcaggcgctgggcagc

SEQ ID NO: 36706 - DNA, 17 bp, Homo sapiens
gaaccgaacaatgttct

SEQ ID NO: 36707 - DNA, 19 bp, Homo sapiens
gcaagttgctgggcaagct

SEQ ID NO: 36708 - DNA, 77 bp, Ectromelia virus
tatcaagacgtatacatttgtgaaaactgtggagatatagcagcacaaattaaaggtattaatacatgtcttcgatg

SEQ ID NO: 36709 - DNA, 24 bp, Ectromelia virus
tagcagcacaaattaaaggtatta

SEQ ID NO: 36710 - DNA, 23 bp, Homo sapiens
tagcagcataatttctaatatta

SEQ ID NO: 36711 - DNA, 22 bp, Homo sapiens
tagcagtacaaattatccagat

SEQ ID NO: 36712 - DNA, 20 bp, Homo sapiens
tagcagcactggtaggtatt

SEQ ID NO: 36713 - DNA, 19 bp, Homo sapiens
tagtagcacaaaataagat

SEQ ID NO: 36714 - DNA, 17 bp, Homo sapiens
tagcagcaataagtatt

SEQ ID NO: 36715 - DNA, 19 bp, Homo sapiens
gcagcacaaagcagtatta

SEQ ID NO: 36716 - DNA, 24 bp, Homo sapiens
gcagcacagggttaatgcgtatta

SEQ ID NO: 36717 - DNA, 23 bp, Homo sapiens
agctagtgaggttaaaggtatta

SEQ ID NO: 36718 - DNA, 20 bp, Homo sapiens
acagcacaggttaaggatta

SEQ ID NO: 36719 - DNA, 16 bp, Homo sapiens
acagcactaaggtatt

SEQ ID NO: 36720 - DNA, 26 bp, Homo sapiens
tagcaacataaagatacaaggtatta

SEQ ID NO: 36721 - DNA, 19 bp, Homo sapiens
tagcagcacaagtgtagat

SEQ ID NO: 36722 - DNA, 64 bp, Camelpox virus
tgtgactttcctgccgaatttagagatggatatgtagcatcttcactagtgggaatcaatcaca

SEQ ID NO: 36723 - DNA, 24 bp, Camelpox virus
ttcctgccgaatttagagatggat

SEQ ID NO: 36724 - DNA, 19 bp, Homo sapiens
ttcctgccaggatttggag

SEQ ID NO: 36725 - DNA, 22 bp, Homo sapiens
ctcctgcctcccagaggtggat

SEQ ID NO: 36726 - DNA, 20 bp, Homo sapiens
ctgctcggctccagatggat

SEQ ID NO: 36727 - DNA, 18 bp, Homo sapiens
ctgtcgaatcagatggat

SEQ ID NO: 36728 - DNA, 17 bp, Homo sapiens
tcctgccttagagatgg

SEQ ID NO: 36729 - DNA, 130 bp, Chayote mosaic tymovirus
gttaaaatctttgccaagtcccaacacaaggtcaatgatggttccatcttcggctcctggaaggcctgccaaacattagccctgatgcacgactacgtgatccttgtgctcggacctgtcaagaagtacc

SEQ ID NO: 36730 - DNA, 24 bp, Chayote mosaic tymovirus
aaacattagccctgatgcacgact

SEQ ID NO: 36731 - DNA, 20 bp, Homo sapiens
aaacattagcttatacacga

SEQ ID NO: 36732 - DNA, 20 bp, Homo sapiens
aaacaatagccctggtcagc

SEQ ID NO: 36733 - DNA, 18 bp, Homo sapiens
aaacactagccctgtggc

SEQ ID NO: 36734 - DNA, 22 bp, Homo sapiens
atcagccctggtactggtgact

SEQ ID NO: 36735 - DNA, 22 bp, Homo sapiens
aacattagcactgatggtaact

SEQ ID NO: 36736 - DNA, 20 bp, Homo sapiens
aaacattagcctgggagccg

SEQ ID NO: 36737 - DNA, 18 bp, Homo sapiens
attagccctcatagaact

SEQ ID NO: 36738 - DNA, 15 bp, Homo sapiens
aaacattagcctggc

SEQ ID NO: 36739 - DNA, 21 bp, Homo sapiens
aaacattaaccctctaatgac

SEQ ID NO: 36740 - DNA, 23 bp, Homo sapiens
aaacactagttcatccctgtggc

SEQ ID NO: 36741 - DNA, 17 bp, Homo sapiens
ttagcaaaggcacgact

SEQ ID NO: 36742 - DNA, 18 bp, Homo sapiens
ggacataagccctgaggc

SEQ ID NO: 36743 - DNA, 79 bp, Chayote mosaic tymovirus
ctgatgatctgcgttgacgacggaagtgtcaaagacaagattctgtcctacatttccgagttctccgtcggtcactcag

SEQ ID NO: 36744 - DNA, 24 bp, Chayote mosaic tymovirus
tgcgttgacgacggaagtgtcaaa

SEQ ID NO: 36745 - DNA, 18 bp, Homo sapiens
tgcgctggcgaatgtcaa

SEQ ID NO: 36746 - DNA, 23 bp, Homo sapiens
tgcgttattaacagggtgtcaaa

SEQ ID NO: 36747 - DNA, 19 bp, Homo sapiens
gttgatgattcatgtcaaa

SEQ ID NO: 36748 - DNA, 79 bp, Sulfolobus virus SIRV-1
ggaataaaaagtggcctctttaaaatatttggagtggaaaaaattgtttttttcacttttgtaaaaaaaagtggccttt

SEQ ID NO: 36749 - DNA, 24 bp, Sulfolobus virus SIRV-1
ttaaaatatttggagtggaaaaaa

SEQ ID NO: 36750 - DNA, 23 bp, Homo sapiens
ttaaaatgggaaaggagtggaaa

SEQ ID NO: 36751 - DNA, 18 bp, Homo sapiens
atatttggaattcaaaaa

SEQ ID NO: 36752 - DNA, 22 bp, Homo sapiens
taaaatattttattggaaaaaa

SEQ ID NO: 36753 - DNA, 19 bp, Homo sapiens
ttagaatacttggagcaaa

SEQ ID NO: 36754 - DNA, 24 bp, Homo sapiens
tcaaaatatttttaaaggagaaaa

SEQ ID NO: 36755 - DNA, 16 bp, Homo sapiens
aaatacagagtggaaa

SEQ ID NO: 36756 - DNA, 24 bp, Homo sapiens
taaaatacaatgtggtgggaaaaa

SEQ ID NO: 36757 - DNA, 20 bp, Homo sapiens
ttaaaatgaagtggaaaaaa

SEQ ID NO: 36758 - DNA, 18 bp, Homo sapiens
aaatacaaaaggtggaaa

SEQ ID NO: 36759 - DNA, 19 bp, Homo sapiens
ctagaatgtctggagggga

SEQ ID NO: 36760 - DNA, 18 bp, Homo sapiens
aaatattttgaatggaaa

SEQ ID NO: 36761 - DNA, 19 bp, Homo sapiens
ttaaaatgatgcaatggaa

SEQ ID NO: 36762 - DNA, 21 bp, Homo sapiens
taaaatatttgtagcagaaaa

SEQ ID NO: 36763 - DNA, 19 bp, Homo sapiens
taaaatatttgcataggaa

SEQ ID NO: 36764 - DNA, 24 bp, Homo sapiens
ttagaatatttggtcaactggaaa

SEQ ID NO: 36765 - DNA, 19 bp, Homo sapiens
taaaatatgttggagagaa

SEQ ID NO: 36766 - DNA, 23 bp, Homo sapiens
ctaaaatatttgtcaggagggaa

SEQ ID NO: 36767 - DNA, 18 bp, Homo sapiens
aaaatatttgcagtagga

SEQ ID NO: 36768 - DNA, 20 bp, Homo sapiens
ttaaattatttggatagaaa

SEQ ID NO: 36769 - DNA, 20 bp, Homo sapiens
aatacatggagtgggaaaaa

SEQ ID NO: 36770 - DNA, 22 bp, Homo sapiens
ttaggatatctggagttaaaaa

SEQ ID NO: 36771 - DNA, 19 bp, Homo sapiens
ttaacatatttggaaatga

SEQ ID NO: 36772 - DNA, 19 bp, Homo sapiens
aaaatatttggggtatgaa

SEQ ID NO: 36773 - DNA, 23 bp, Homo sapiens
ttaaaaagtggaggtggaaaaaa

SEQ ID NO: 36774 - DNA, 20 bp, Homo sapiens
ttaaaatgctttgcagagga

SEQ ID NO: 36775 - DNA, 21 bp, Homo sapiens
tcaaaatattccaggagagaa

SEQ ID NO: 36776 - DNA, 22 bp, Homo sapiens
aaaatattttctttggaaaaaa

SEQ ID NO: 36777 - DNA, 21 bp, Homo sapiens
aaaatatttatttagaaaaaa

SEQ ID NO: 36778 - DNA, 22 bp, Homo sapiens
taaaatatttaaaaagagaaaa

SEQ ID NO: 36779 - DNA, 19 bp, Homo sapiens
ttaaaatatttcaaggaaa

SEQ ID NO: 36780 - DNA, 19 bp, Homo sapiens
ttaaagctatttggaggag

SEQ ID NO: 36781 - DNA, 21 bp, Homo sapiens
taaaatatttcaaagaggaaa

SEQ ID NO: 36782 - DNA, 21 bp, Homo sapiens
ctaaaatatttggaactagaa

SEQ ID NO: 36783 - DNA, 24 bp, Homo sapiens
ctaaaatatgctgctgtgggaaaa

SEQ ID NO: 36784 - DNA, 20 bp, Homo sapiens
ttaaaatacttgggttgaaa

SEQ ID NO: 36785 - DNA, 27 bp, Homo sapiens
ttaaaatattgttccttgtggaaaaaa

SEQ ID NO: 36786 - DNA, 18 bp, Homo sapiens
ttaaaatgtctggaacaa

SEQ ID NO: 36787 - DNA, 21 bp, Homo sapiens
tcaaaatatgcttggaaaaga

SEQ ID NO: 36788 - DNA, 17 bp, Homo sapiens
taaaatatttgagggaa

SEQ ID NO: 36789 - DNA, 20 bp, Homo sapiens
ttaaaatacttggtggccaa

SEQ ID NO: 36790 - DNA, 21 bp, Homo sapiens
ctaaaatatttggagatggaa

SEQ ID NO: 36791 - DNA, 20 bp, Homo sapiens
tcaaaatattttggagaaga

SEQ ID NO: 36792 - DNA, 76 bp, Chayote mosaic tymovirus
gcttaaggtttcgcccttccgagaatccatactccatcaccccaatggatcagcttctcggcgagcaccttttcgc

SEQ ID NO: 36793 - DNA, 24 bp, Chayote mosaic tymovirus
atcagcttctcggcgagcaccttt

SEQ ID NO: 36794 - DNA, 22 bp, Homo sapiens
atcagcttcgataagtgccttt

SEQ ID NO: 36795 - DNA, 20 bp, Homo sapiens
agcttagcaagagcaccttt

SEQ ID NO: 36796 - DNA, 21 bp, Homo sapiens
ccagcttcttatgatgccttt

SEQ ID NO: 36797 - DNA, 20 bp, Homo sapiens
ccggctctctgagcaccttt

SEQ ID NO: 36798 - DNA, 20 bp, Homo sapiens
tcagcttctttgtcaccttt

SEQ ID NO: 36799 - DNA, 18 bp, Homo sapiens
gcttccaaaagcaccttt

SEQ ID NO: 36800 - DNA, 19 bp, Homo sapiens
cagcttctttctcgccttt

SEQ ID NO: 36801 - DNA, 15 bp, Homo sapiens
tcagcttccccacct

SEQ ID NO: 36802 - DNA, 16 bp, Homo sapiens
accagctcgagcgcct

SEQ ID NO: 36803 - DNA, 131 bp, Sulfolobus virus SIRV-1
aaggtattgggagtttttttcattttttgcgtaaatttcgcaactaatgagataaattggaaattccaatttttttcgtttttttcgtttttttcgcaccaaagttaataaattgaaaattcctaaattcc

SEQ ID NO: 36804 - DNA, 24 bp, Sulfolobus virus SIRV-1
ttcgtttttttcgtttttttcgca

SEQ ID NO: 36805 - DNA, 18 bp, Homo sapiens
ttcgttttttttgttttt

SEQ ID NO: 36806 - DNA, 20 bp, Homo sapiens
ttttttttttttttttcgca

SEQ ID NO: 36807 - DNA, 19 bp, Homo sapiens
gttttttttttttttttca

SEQ ID NO: 36808 - DNA, 20 bp, Homo sapiens
ttcgtttttatttttttgca

SEQ ID NO: 36809 - DNA, 19 bp, Homo sapiens
tttttttcgtgcctttgca

SEQ ID NO: 36810 - DNA, 19 bp, Homo sapiens
ttttttttttttttttcgc

SEQ ID NO: 36811 - DNA, 19 bp, Homo sapiens
tccgttttttttgtttttt

SEQ ID NO: 36812 - DNA, 20 bp, Homo sapiens
gttttttttttttttttgca

SEQ ID NO: 36813 - DNA, 20 bp, Homo sapiens
ttcattttttttgttttttc

SEQ ID NO: 36814 - DNA, 18 bp, Homo sapiens
ttcgtttttttgtttttt

SEQ ID NO: 36815 - DNA, 19 bp, Homo sapiens
ttcgtttttttgttttttt

SEQ ID NO: 36816 - DNA, 22 bp, Homo sapiens
ttcgtttgttttgttttcctcg

SEQ ID NO: 36817 - DNA, 18 bp, Homo sapiens
ttcgttttctttgtttct

SEQ ID NO: 36818 - DNA, 19 bp, Homo sapiens
gttttttttgctttttcca

SEQ ID NO: 36819 - DNA, 77 bp, Sulfolobus virus SIRV-1
attgtaaattccaaaattccaattaattgtacatcttggaaaattattccaattagttatgtaaattggaaattaca

SEQ ID NO: 36820 - DNA, 24 bp, Sulfolobus virus SIRV-1
tccaaaattccaattaattgtaca

SEQ ID NO: 36821 - DNA, 19 bp, Homo sapiens
tccaaaatccagttaagtg

SEQ ID NO: 36822 - DNA, 19 bp, Homo sapiens
caaaatatccaattacttg

SEQ ID NO: 36823 - DNA, 22 bp, Homo sapiens
tccaaaatttatccacagttgt

SEQ ID NO: 36824 - DNA, 21 bp, Homo sapiens
aattcttcagttaattgtaca

SEQ ID NO: 36825 - DNA, 25 bp, Homo sapiens
tccaaaatatcactattaattgtac

SEQ ID NO: 36826 - DNA, 17 bp, Homo sapiens
tccaaattccaattaat

SEQ ID NO: 36827 - DNA, 22 bp, Homo sapiens
tccaaaatttgacatttgtaca

SEQ ID NO: 36828 - DNA, 20 bp, Homo sapiens
aaaattccaatataaatgta

SEQ ID NO: 36829 - DNA, 22 bp, Homo sapiens
caaagctgtcattaattgtaca

SEQ ID NO: 36830 - DNA, 22 bp, Homo sapiens
tccaaaattcaatactgataca

SEQ ID NO: 36831 - DNA, 21 bp, Homo sapiens
tccacaaaccactttaattgt

SEQ ID NO: 36832 - DNA, 21 bp, Homo sapiens
aaaatcttaattaattgtaca

SEQ ID NO: 36833 - DNA, 17 bp, Homo sapiens
ccaaaatgtaattgtac

SEQ ID NO: 36834 - DNA, 22 bp, Homo sapiens
ccagaattccaaattcagtgca

SEQ ID NO: 36835 - DNA, 23 bp, Homo sapiens
aaaattccatttagaagagtaca

SEQ ID NO: 36836 - DNA, 23 bp, Homo sapiens
cccaaagttctgacttctgtaca

SEQ ID NO: 36837 - DNA, 17 bp, Homo sapiens
caaaattccaatggtgt

SEQ ID NO: 36838 - DNA, 16 bp, Homo sapiens
tccaaaattctgtaca

SEQ ID NO: 36839 - DNA, 18 bp, Homo sapiens
tccaaaattttaatgtac

SEQ ID NO: 36840 - DNA, 21 bp, Homo sapiens
tcctgaattccaattaactac

SEQ ID NO: 36841 - DNA, 20 bp, Homo sapiens
caaacattccaattattaca

SEQ ID NO: 36842 - DNA, 60 bp, Chayote mosaic tymovirus
gtcatcgacgaggtttacaaactccctagcgggtacctagacctctccatcctctctgac

SEQ ID NO: 36843 - DNA, 24 bp, Chayote mosaic tymovirus
tacctagacctctccatcctctct

SEQ ID NO: 36844 - DNA, 19 bp, Homo sapiens
cacctcctctccgttctct

SEQ ID NO: 36845 - DNA, 21 bp, Homo sapiens
agcctgggtccattcctctct

SEQ ID NO: 36846 - DNA, 18 bp, Homo sapiens
cctgaacctctccatact

SEQ ID NO: 36847 - DNA, 21 bp, Homo sapiens
gacttgctctctgtcctctct

SEQ ID NO: 36848 - DNA, 21 bp, Homo sapiens
cctggccctctctccctttct

SEQ ID NO: 36849 - DNA, 18 bp, Homo sapiens
taccagatcttccctctc

SEQ ID NO: 36850 - DNA, 17 bp, Homo sapiens
tagactctccatcttct

SEQ ID NO: 36851 - DNA, 22 bp, Homo sapiens
cctggaccatcccctattttct

SEQ ID NO: 36852 - DNA, 17 bp, Homo sapiens
cccagacctgccttctc

SEQ ID NO: 36853 - DNA, 18 bp, Homo sapiens
cacctgggcctccctctc

SEQ ID NO: 36854 - DNA, 21 bp, Homo sapiens
ctggattagctcatcctctct

SEQ ID NO: 36855 - DNA, 21 bp, Homo sapiens
tacctagatcctcagggctct

SEQ ID NO: 36856 - DNA, 24 bp, Homo sapiens
tacttaagccattccatcctttct

SEQ ID NO: 36857 - DNA, 19 bp, Homo sapiens
tagaggttctgtcctctct

SEQ ID NO: 36858 - DNA, 19 bp, Homo sapiens
ctgagacctgatcctctct

SEQ ID NO: 36859 - DNA, 18 bp, Homo sapiens
tagacctctttcttctct

SEQ ID NO: 36860 - DNA, 21 bp, Homo sapiens
taccagacctttagtctctct

SEQ ID NO: 36861 - DNA, 21 bp, Homo sapiens
cctaggtccagagtcctctct

SEQ ID NO: 36862 - DNA, 21 bp, Homo sapiens
cctgtctcttccatcctttct

SEQ ID NO: 36863 - DNA, 19 bp, Homo sapiens
ctaaacctctctcccttct

SEQ ID NO: 36864 - DNA, 21 bp, Homo sapiens
tagatttttttccccctctct

SEQ ID NO: 36865 - DNA, 24 bp, Homo sapiens
tactgggacctctcggttctctct

SEQ ID NO: 36866 - DNA, 21 bp, Homo sapiens
tacctaggccctttcctctct

SEQ ID NO: 36867 - DNA, 20 bp, Homo sapiens
ccttggcctggatcctctct

SEQ ID NO: 36868 - DNA, 21 bp, Homo sapiens
ctctccctctccatcctctct

SEQ ID NO: 36869 - DNA, 24 bp, Homo sapiens
tacttggaacctcctcccttctct

SEQ ID NO: 36870 - DNA, 17 bp, Homo sapiens
ctagatgccatcctctc

SEQ ID NO: 36871 - DNA, 30 bp, Homo sapiens
tacctagactggggacctccattttctcta

SEQ ID NO: 36872 - DNA, 22 bp, Homo sapiens
cctcaggtctgcgaccctctct

SEQ ID NO: 36873 - DNA, 18 bp, Homo sapiens
tagatctgcttcctctcc

SEQ ID NO: 36874 - DNA, 21 bp, Homo sapiens
ctggacctccgggccctctct

SEQ ID NO: 36875 - DNA, 19 bp, Homo sapiens
ctagggcctttcaccctct

SEQ ID NO: 36876 - DNA, 20 bp, Homo sapiens
ccttgggccacctcctctct

SEQ ID NO: 36877 - DNA, 22 bp, Homo sapiens
cagacctctctctacattctct

SEQ ID NO: 36878 - DNA, 23 bp, Homo sapiens
cccacatcctctctattctctct

SEQ ID NO: 36879 - DNA, 16 bp, Homo sapiens
ctagattcctcctctc

SEQ ID NO: 36880 - DNA, 64 bp, Chayote mosaic tymovirus
ggaacctgctacatcttctctcgcgccctctccggacagccgattgactatgccagcctcttcc

SEQ ID NO: 36881 - DNA, 24 bp, Chayote mosaic tymovirus
agccgattgactatgccagcctct

SEQ ID NO: 36882 - DNA, 21 bp, Homo sapiens
gcccgcgccatgccagcctct

SEQ ID NO: 36883 - DNA, 18 bp, Homo sapiens
accatggtgccagcctct

SEQ ID NO: 36884 - DNA, 18 bp, Homo sapiens
ccagctatgccagtctct

SEQ ID NO: 36885 - DNA, 23 bp, Homo sapiens
gactgaacctcatgccagcctct

SEQ ID NO: 36886 - DNA, 19 bp, Homo sapiens
agcctcaatgccagcctct

SEQ ID NO: 36887 - DNA, 24 bp, Homo sapiens
agctgatgtggggactcagcctct

SEQ ID NO: 36888 - DNA, 18 bp, Homo sapiens
gattgactgtgttaacct

SEQ ID NO: 36889 - DNA, 15 bp, Homo sapiens
cgattgagcagcctc

SEQ ID NO: 36890 - DNA, 20 bp, Homo sapiens
accgattgaggtctcagcct

SEQ ID NO: 36891 - DNA, 19 bp, Homo sapiens
attggtccttgtcagcctc

SEQ ID NO: 36892 - DNA, 18 bp, Homo sapiens
accatcgtgccagcctct

SEQ ID NO: 36893 - DNA, 18 bp, Homo sapiens
agctgattattatgccaa

SEQ ID NO: 36894 - DNA, 20 bp, Homo sapiens
gattggttgcaccagcctct

SEQ ID NO: 36895 - DNA, 21 bp, Homo sapiens
gctggggagatgccagcttct

SEQ ID NO: 36896 - DNA, 24 bp, Homo sapiens
agccgattaattgcagtggcctct

SEQ ID NO: 36897 - DNA, 22 bp, Homo sapiens
agctgcttggcctccagcctct

SEQ ID NO: 36898 - DNA, 20 bp, Homo sapiens
gccactccatgccagcctct

SEQ ID NO: 36899 - DNA, 21 bp, Homo sapiens
gcatgaaaggtgccagcctct

SEQ ID NO: 36900 - DNA, 85 bp, Tick-borne encephalitis virus
gcggttcttgttctccctgagccaccatcacccagacacaggtagtctgacaaggaggtgatgtgtgactcggaaaaacacccgc

SEQ ID NO: 36901 - DNA, 85 bp, Tick-borne encephalitis virus; identical to SEQ ID NO: 36900

SEQ ID NO: 36902 - DNA, 18 bp, Homo sapiens
tgacaagggggagacagt

SEQ ID NO: 36903 - DNA, 20 bp, Homo sapiens
tgatagggaggtaatgaact

SEQ ID NO: 36904 - DNA, 19 bp, Homo sapiens
aaggaggtgccaaatgact

SEQ ID NO: 36905 - DNA, 18 bp, Homo sapiens
tgcagggaggatgtgact

SEQ ID NO: 36906 - DNA, 22 bp, Homo sapiens
tgatgaggaagtgatggtagct

SEQ ID NO: 36907 - DNA, 21 bp, Homo sapiens
tgaaggggatgatgtgtggct

SEQ ID NO: 36908 - DNA, 17 bp, Homo sapiens
ggcagtgtgtgtgactc

SEQ ID NO: 36909 - DNA, 18 bp, Homo sapiens
tgatgagaaggtgatgca

SEQ ID NO: 36910 - DNA, 18 bp, Homo sapiens
ggaggaggatgtgtggct

SEQ ID NO: 36911 - DNA, 19 bp, Homo sapiens
tgacaaggtgagtgtggct

SEQ ID NO: 36912 - DNA, 18 bp, Homo sapiens
acaaggagggaggtgact

SEQ ID NO: 36913 - DNA, 20 bp, Homo sapiens
gaaaggaggtgacgtcactc

SEQ ID NO: 36914 - DNA, 22 bp, Homo sapiens
gacagggaggtaagagtgactc

SEQ ID NO: 36915 - DNA, 22 bp, Homo sapiens
tgacaggtgggcgcagtgactc

SEQ ID NO: 36916 - DNA, 20 bp, Homo sapiens
ggtcagggaatgtgtggctc

SEQ ID NO: 36917 - DNA, 17 bp, Homo sapiens
ggaggtggctgtgactc

SEQ ID NO: 36918 - DNA, 18 bp, Homo sapiens
ggaggtgatttatcaact

SEQ ID NO: 36919 - DNA, 21 bp, Homo sapiens
tgacaaagatgacatgtgtga

SEQ ID NO: 36920 - DNA, 16 bp, Homo sapiens
tgataaggaggctgta

SEQ ID NO: 36921 - DNA, 22 bp, Homo sapiens
gacaaggagacagagtgtggct

SEQ ID NO: 36922 - DNA, 17 bp, Homo sapiens
tggcaaggaggtgtgca

SEQ ID NO: 36923 - DNA, 19 bp, Homo sapiens
tgacaaggtggtgatacat

SEQ ID NO: 36924 - DNA, 23 bp, Homo sapiens
tgacgaggagctgagacctgctc

SEQ ID NO: 36925 - DNA, 18 bp, Homo sapiens
caaggaggtgagccactc

SEQ ID NO: 36926 - DNA, 16 bp, Homo sapiens
tgaaaaggaaggtgtg

SEQ ID NO: 36927 - DNA, 21 bp, Homo sapiens
tgacaaggaggctgaaaataa

SEQ ID NO: 36928 - DNA, 21 bp, Homo sapiens
tgaaaggaggttttattggct

SEQ ID NO: 36929 - DNA, 25 bp, Homo sapiens
tggcagggtggtgatgttgtggctc

SEQ ID NO: 36930 - DNA, 19 bp, Homo sapiens
tgacgaatgaggtgtgact

SEQ ID NO: 36931 - DNA, 20 bp, Homo sapiens
ggcagggagatgtgtggctc

SEQ ID NO: 36932 - DNA, 67 bp, Chayote mosaic tymovirus
gtctcccactcctcagatgttttgatcacttctgcccaagtcttctccacacttgaggagtcccgac

SEQ ID NO: 36933 - DNA, 24 bp, Chayote mosaic tymovirus
tcagatgttttgatcacttctgcc

SEQ ID NO: 36934 - DNA, 17 bp, Homo sapiens
tcagtgtttttcttctg

SEQ ID NO: 36935 - DNA, 16 bp, Homo sapiens
gatgtcccacttctgc

SEQ ID NO: 36936 - DNA, 20 bp, Homo sapiens
caggtgttttgatacatgcc

SEQ ID NO: 36937 - DNA, 19 bp, Homo sapiens
aaatgtatcatcatttctg

SEQ ID NO: 36938 - DNA, 16 bp, Homo sapiens
agatgttttattctgc

SEQ ID NO: 36939 - DNA, 17 bp, Homo sapiens
agataaaatcacttctg

SEQ ID NO: 36940 - DNA, 21 bp, Homo sapiens
tcagtacacatgtcacttctg

SEQ ID NO: 36941 - DNA, 21 bp, Homo sapiens
tcccaatttggtcacttctgc

SEQ ID NO: 36942 - DNA, 16 bp, Homo sapiens
ccagtggtcacttctg

SEQ ID NO: 36943 - DNA, 22 bp, Homo sapiens
caggtgagggctcacttctgcc

SEQ ID NO: 36944 - DNA, 18 bp, Homo sapiens
tcagatgtttgtcatctg

SEQ ID NO: 36945 - DNA, 19 bp, Homo sapiens
aatgtcttttatttctgcc

SEQ ID NO: 36946 - DNA, 17 bp, Homo sapiens
tcagatcttaacttctg

SEQ ID NO: 36947 - DNA, 16 bp, Homo sapiens
ccagagatcacttttg

SEQ ID NO: 36948 - DNA, 21 bp, Homo sapiens
tcggatgtttgatcaagtagc

SEQ ID NO: 36949 - DNA, 19 bp, Homo sapiens
tcggatgttttgagtcacc

SEQ ID NO: 36950 - DNA, 25 bp, Homo sapiens
tcagatattaaattctacttttgcc

SEQ ID NO: 36951 - DNA, 18 bp, Homo sapiens
tcaattctgtcacttctg

SEQ ID NO: 36952 - DNA, 19 bp, Homo sapiens
gtcccagaatcacttttgc

SEQ ID NO: 36953 - DNA, 23 bp, Homo sapiens
tcagctgaggtcttgcttctgcc

SEQ ID NO: 36954 - DNA, 131 bp, Sphaeropsis sapinea RNA virus 2
aggtcaagtacctcactgaagcggggattggccttactgccgtgatggcggaggcgagttaccgtaagacgttctcgtccacgttctcccgtagtgaccgcgtgatcctcggcccagtgaggcgcagacct

SEQ ID NO: 36955 - DNA, 24 bp, Sphaeropsis sapinea RNA virus 2
tacctcactgaagcggggattggc

SEQ ID NO: 36956 - DNA, 18 bp, Homo sapiens
tcactgaagcaggtatag

SEQ ID NO: 36957 - DNA, 22 bp, Homo sapiens
cctcactgaggcagcgaggggc

SEQ ID NO: 36958 - DNA, 18 bp, Homo sapiens
acctcactgaagctctgg

SEQ ID NO: 36959 - DNA, 18 bp, Homo sapiens
taccacactgagaattgg

SEQ ID NO: 36960 - DNA, 19 bp, Homo sapiens
cctcacagaagagattggc

SEQ ID NO: 36961 - DNA, 16 bp, Homo sapiens
cctcactgaggatggc

SEQ ID NO: 36962 - DNA, 18 bp, Homo sapiens
tacctcactgggccttgg

SEQ ID NO: 36963 - DNA, 18 bp, Homo sapiens
cttactaagtgaattggc

SEQ ID NO: 36964 - DNA, 18 bp, Homo sapiens
tcactgaagaaatgttgg

SEQ ID NO: 36965 - DNA, 15 bp, Homo sapiens
tcactgaagagttgg

SEQ ID NO: 36966 - DNA, 22 bp, Homo sapiens
cctcactggtggtgattatggc

SEQ ID NO: 36967 - DNA, 21 bp, Homo sapiens
cctcactgtgacttaaattgg

SEQ ID NO: 36968 - DNA, 90 bp, Chayote mosaic tymovirus
ctgccttcgaagttcgtggccaacgactacacttcctttgaccaatctcaaaggggtgaagccgtcgtcctcgaacttcttaaaatgcag

SEQ ID NO: 36969 - DNA, 24 bp, Chayote mosaic tymovirus
tcgaagttcgtggccaacgactac

SEQ ID NO: 36970 - DNA, 18 bp, Homo sapiens
tcgaagttcgtggataac

SEQ ID NO: 36971 - DNA, 20 bp, Homo sapiens
cgaagctcgtcagcgattac

SEQ ID NO: 36972 - DNA, 18 bp, Homo sapiens
tcgaagttcatgtggact

SEQ ID NO: 36973 - DNA, 24 bp, Homo sapiens
tcaaagggaagtgttgacgactac

SEQ ID NO: 36974 - DNA, 16 bp, Homo sapiens
tcaaagtcaccaacga

SEQ ID NO: 36975 - DNA, 20 bp, Homo sapiens
tcgaaattcatggggcgact

SEQ ID NO: 36976 - DNA, 82 bp, Sphaeropsis sapinea RNA virus 2
gagtcggcgactcccacgccatcgagtacccaaccttacaagaacattgggactctcgatggctctgggcagtcaacggctc

SEQ ID NO: 36977 - DNA, 24 bp, Sphaeropsis sapinea RNA virus 2
atcgagtacccaaccttacaagaa

SEQ ID NO: 36978 - DNA, 16 bp, Homo sapiens
cggtaaccttacaaga

SEQ ID NO: 36979 - DNA, 19 bp, Homo sapiens
gagtacctgatcccacaag

SEQ ID NO: 36980 - DNA, 71 bp, Chayote mosaic tymovirus
tcttcctttccatcctgagctattcgccgagtgcatctgcgcgaacgagtatgctcagctctcttccaaga

SEQ ID NO: 36981 - DNA, 24 bp, Chayote mosaic tymovirus
gcgaacgagtatgctcagctctct

SEQ ID NO: 36982 - DNA, 20 bp, Homo sapiens
gaattgattgtcagctctct

SEQ ID NO: 36983 - DNA, 18 bp, Homo sapiens
gaacggatatgcccctct

SEQ ID NO: 36984 - DNA, 21 bp, Homo sapiens
gctggagatgctcagttctct

SEQ ID NO: 36985 - DNA, 18 bp, Homo sapiens
gagaacgttcagctctct

SEQ ID NO: 36986 - DNA, 19 bp, Homo sapiens
gaggatgggcccagctctc

SEQ ID NO: 36987 - DNA, 20 bp, Homo sapiens
gcggacgggttcagccctct

SEQ ID NO: 36988 - DNA, 19 bp, Homo sapiens
gcaggtgagtgcagctctc

SEQ ID NO: 36989 - DNA, 17 bp, Homo sapiens
gcgacatgctcagttct

SEQ ID NO: 36990 - DNA, 20 bp, Homo sapiens
gaaccacagctcagctttct

SEQ ID NO: 36991 - DNA, 24 bp, Homo sapiens
gcaatggcgcgatctcagctctct

SEQ ID NO: 36992 - DNA, 21 bp, Homo sapiens
gcaggtgagttccagctctct

SEQ ID NO: 36993 - DNA, 73 bp, Alcelaphine herpesvirus 1
gtatgtaatttaaaaatgtgtggatatttgtataaaaaagacatatacatacatttcttggtgaataacatac

SEQ ID NO: 36994 - DNA, 20 bp, Alcelaphine herpesvirus 1
tttcttggtgaataacatac

SEQ ID NO: 36995 - DNA, 19 bp, Homo sapiens
ttcttggtaacaaacatac

SEQ ID NO: 36996 - DNA, 21 bp, Homo sapiens
tttctagtgaaggtgacatac

SEQ ID NO: 36997 - DNA, 20 bp, Homo sapiens
tttcttgctgtctaacatac

SEQ ID NO: 36998 - DNA, 17 bp, Homo sapiens
tttcttggagaaccata

SEQ ID NO: 36999 - DNA, 21 bp, Homo sapiens
cttcttggatattataacata

SEQ ID NO: 37000 - DNA, 20 bp, Homo sapiens
tttcttgatgccagcacata

SEQ ID NO: 37001 - DNA, 18 bp, Homo sapiens
ttccttgaatataacata

SEQ ID NO: 37002 - DNA, 18 bp, Homo sapiens
tttcctggtgagacatac

SEQ ID NO: 37003 - DNA, 18 bp, Homo sapiens
tttcttgtgaacaaaata

SEQ ID NO: 37004 - DNA, 18 bp, Homo sapiens
tttctagtgataacatac

SEQ ID NO: 37005 - DNA, 19 bp, Homo sapiens
tttcttgatgacaacgtac

SEQ ID NO: 37006 - DNA, 18 bp, Homo sapiens
tctctgtagataacatac

SEQ ID NO: 37007 - DNA, 18 bp, Homo sapiens
tttcctactgataacata

SEQ ID NO: 37008 - DNA, 18 bp, Homo sapiens
ttcctccttaaataacat

SEQ ID NO: 37009 - DNA, 22 bp, Homo sapiens
tttcttggtgagttctccatac

SEQ ID NO: 37010 - DNA, 19 bp, Homo sapiens
tctttggcaaataacatac

SEQ ID NO: 37011 - DNA, 18 bp, Homo sapiens
ttctcaaaaaataacata

SEQ ID NO: 37012 - DNA, 20 bp, Homo sapiens
tttctagatgaataatgtac

SEQ ID NO: 37013 - DNA, 24 bp, Homo sapiens
ttccttgggctgtgaataatatac

SEQ ID NO: 37014 - DNA, 17 bp, Homo sapiens
tctcttggacaacatac

SEQ ID NO: 37015 - DNA, 18 bp, Homo sapiens
ttcccacctgaataacat

SEQ ID NO: 37016 - DNA, 22 bp, Homo sapiens
tttcttggagaaagtctgacat

SEQ ID NO: 37017 - DNA, 22 bp, Homo sapiens
tttcttgggagacctaaacata

SEQ ID NO: 37018 - DNA, 17 bp, Homo sapiens
tttcttggtaatagcac

SEQ ID NO: 37019 - DNA, 21 bp, Homo sapiens
tttcttgagtgcctactacat

SEQ ID NO: 37020 - DNA, 77 bp, Cowpox virus
tatcaagatgtgtatgtttgtgaaaattgtggagacatagcagcacaaatcaaaggtattaatacatgtcttagatg

SEQ ID NO: 37021 - DNA, 24 bp, Cowpox virus
cagcacaaatcaaaggtattaata

SEQ ID NO: 37022 - DNA, 18 bp, Homo sapiens
cagtacaaatcacaaggt

SEQ ID NO: 37023 - DNA, 18 bp, Homo sapiens
aacacaaattaaagctat

SEQ ID NO: 37024 - DNA, 19 bp, Homo sapiens
cagcgagatcaaaggaact

SEQ ID NO: 37025 - DNA, 15 bp, Homo sapiens
cagacaaatcaggta

SEQ ID NO: 37026 - DNA, 21 bp, Homo sapiens
cagcatcgatcaaaggcatca

SEQ ID NO: 37027 - DNA, 18 bp, Homo sapiens
acacaaatcaaatgggta

SEQ ID NO: 37028 - DNA, 21 bp, Homo sapiens
aacacaaatcacacaacatta

SEQ ID NO: 37029 - DNA, 17 bp, Homo sapiens
cagcacaaatgaaggca

SEQ ID NO: 37030 - DNA, 17 bp, Homo sapiens
cagcacaaatgcaggta

SEQ ID NO: 37031 - DNA, 19 bp, Homo sapiens
gcacaaataaggaaaaaat

SEQ ID NO: 37032 - DNA, 19 bp, Homo sapiens
agcaaaatcaaagggacta

SEQ ID NO: 37033 - DNA, 19 bp, Homo sapiens
cagcactgatcaaggcact

SEQ ID NO: 37034 - DNA, 20 bp, Homo sapiens
agcacaaatgaggtctaaat

SEQ ID NO: 37035 - DNA, 18 bp, Homo sapiens
agcacagaattaaagata

SEQ ID NO: 37036 - DNA, 20 bp, Homo sapiens
cagcatagatcaaagacacc

SEQ ID NO: 37037 - DNA, 64 bp, Alcelaphine herpesvirus 1
tttacaaatgaactacatgttgtattctcaaattgcccggatacttgtatagatctattgtgaa

SEQ ID NO: 37038 - DNA, 24 bp, Alcelaphine herpesvirus 1
tgaactacatgttgtattctcaaa

SEQ ID NO: 37039 - DNA, 23 bp, Homo sapiens
tgagctgcggctgctttctcaaa

SEQ ID NO: 37040 - DNA, 18 bp, Homo sapiens
tgtttatgtattctcaaa

SEQ ID NO: 37041 - DNA, 18 bp, Homo sapiens
tgacactacatgtaattc

SEQ ID NO: 37042 - DNA, 22 bp, Homo sapiens
tgagctacatattcaagtcaaa

SEQ ID NO: 37043 - DNA, 22 bp, Homo sapiens
tgaactaccatgtcaacatatt

SEQ ID NO: 37044 - DNA, 28 bp, Homo sapiens
tgaattacatgtcgataatattttcaaa

SEQ ID NO: 37045 - DNA, 21 bp, Homo sapiens
tgagcacttgttgtattctca

SEQ ID NO: 37046 - DNA, 23 bp, Homo sapiens
tgatttgatagtgtattctcaaa

SEQ ID NO: 37047 - DNA, 18 bp, Homo sapiens
tgggctacatgtgtgcac

SEQ ID NO: 37048 - DNA, 20 bp, Homo sapiens
gaattacatctgcttctcaa

SEQ ID NO: 37049 - DNA, 19 bp, Homo sapiens
tgaattacatgttcgtatt

SEQ ID NO: 37050 - DNA, 21 bp, Homo sapiens
tgagccgatggtgtattctca

SEQ ID NO: 37051 - DNA, 20 bp, Homo sapiens
tacatatttgtattttcaaa

SEQ ID NO: 37052 - DNA, 22 bp, Homo sapiens
tgaccttagatgtattctcaaa

SEQ ID NO: 37053 - DNA, 16 bp, Homo sapiens
tgaactcctattctca

SEQ ID NO: 37054 - DNA, 20 bp, Homo sapiens
gagctacagtgattctcaaa

SEQ ID NO: 37055 - DNA, 60 bp, Cowpox virus
ggccaatcgtgattagtaaggctttagaaacttcaaagattgcggctaattgcttcggcc

SEQ ID NO: 37056 - DNA, 24 bp, Cowpox virus
tgattagtaaggctttagaaactt

SEQ ID NO: 37057 - DNA, 23 bp, Homo sapiens
tgattcagtgaatccagaaactt

SEQ ID NO: 37058 - DNA, 19 bp, Homo sapiens
gtaaacactttagaaactt

SEQ ID NO: 37059 - DNA, 19 bp, Homo sapiens
tgactagtggggttttaaa

SEQ ID NO: 37060 - DNA, 27 bp, Homo sapiens
tgattggaggggctttaaccaaaactt

SEQ ID NO: 37061 - DNA, 17 bp, Homo sapiens
tgattagtaagggaaga

SEQ ID NO: 37062 - DNA, 74 bp, Avian infectious bronchitis virus
cttaccaaacaaaaacagctcagagtggttattataattttaatttttcctttctgagtagttttgtttataag

SEQ ID NO: 37063 - DNA, 20 bp, Avian infectious bronchitis virus
tgagtagttttgtttataag

SEQ ID NO: 37064 - DNA, 19 bp, Homo sapiens
tgagcaggatatttataag

SEQ ID NO: 37065 - DNA, 19 bp, Homo sapiens
tgaattgtttgtttataag

SEQ ID NO: 37066 - DNA, 17 bp, Homo sapiens
tgagcagttttgtcaca

SEQ ID NO: 37067 - DNA, 20 bp, Homo sapiens
tgaatcgagctgtttataag

SEQ ID NO: 37068 - DNA, 21 bp, Homo sapiens
taagtagttttgtgctataag

SEQ ID NO: 37069 - DNA, 20 bp, Homo sapiens
tgaatagttctgattataag

SEQ ID NO: 37070 - DNA, 20 bp, Homo sapiens
tgagaagttttgccataaag

SEQ ID NO: 37071 - DNA, 18 bp, Homo sapiens
tgagtagctgggtttata

SEQ ID NO: 37072 - DNA, 16 bp, Homo sapiens
tgagtagttttccata

SEQ ID NO: 37073 - DNA, 18 bp, Homo sapiens
tgagtaagagtttataag

SEQ ID NO: 37074 - DNA, 16 bp, Homo sapiens
tgagtagtttttacaa

SEQ ID NO: 37075 - DNA, 18 bp, Homo sapiens
tgagagctaatttataag

SEQ ID NO: 37076 - DNA, 17 bp, Homo sapiens
tgagtagttttgataag

SEQ ID NO: 37077 - DNA, 18 bp, Homo sapiens
aataagtttgtttataag

SEQ ID NO: 37078 - DNA, 19 bp, Homo sapiens
tgagtagctttattaaata

SEQ ID NO: 37079 - DNA, 17 bp, Homo sapiens
tggtaatcttgtttata

SEQ ID NO: 37080 - DNA, 17 bp, Homo sapiens
aagtagaggtttataag

SEQ ID NO: 37081 - DNA, 90 bp, Avian infectious bronchitis virus
ctttatttaatgttactgaaaatgtgctcatacctaacagtttcaacttaactgttacagatgagtacatacaaacgcgtatggataagg

SEQ ID NO: 37082 - DNA, 24 bp, Avian infectious bronchitis virus
tgagtacatacaaacgcgtatgga

SEQ ID NO: 37083 - DNA, 19 bp, Homo sapiens
cacatacgaacgcctctgg

SEQ ID NO: 37084 - DNA, 20 bp, Homo sapiens
tgagtacaaacgaataaagg

SEQ ID NO: 37085 - DNA, 24 bp, Homo sapiens
tgagtacataaaaatgttactgga

SEQ ID NO: 37086 - DNA, 22 bp, Homo sapiens
tgagtacatgtgcatgtaatgg

SEQ ID NO: 37087 - DNA, 22 bp, Homo sapiens
tgagtacataccaagaaaatgg

SEQ ID NO: 37088 - DNA, 21 bp, Homo sapiens
tgatacatacaaatttaagga

SEQ ID NO: 37089 - DNA, 24 bp, Homo sapiens
tgaggcatacaaggtagaaatgga

SEQ ID NO: 37090 - DNA, 19 bp, Homo sapiens
tgagtatcatatagacgca

SEQ ID NO: 37091 - DNA, 15 bp, Homo sapiens
tgagtacatagtagg

SEQ ID NO: 37092 - DNA, 23 bp, Homo sapiens
tgaggtatacaaacttggctgga

SEQ ID NO: 37093 - DNA, 21 bp, Homo sapiens
tgagtacataagtaatgtgga

SEQ ID NO: 37094 - DNA, 68 bp, Avian infectious bronchitis virus
attgatcgtattcaaggcgttatacagggtcttaatgactctctaatagaccttgaaaaactttcaat

SEQ ID NO: 37095 - DNA, 24 bp, Avian infectious bronchitis virus
ttcaaggcgttatacagggtctta

SEQ ID NO: 37096 - DNA, 19 bp, Homo sapiens
ttcaaggcgttggtgtgct

SEQ ID NO: 37097 - DNA, 16 bp, Homo sapiens
agacagacagggtctt

SEQ ID NO: 37098 - DNA, 20 bp, Homo sapiens
ctcaggctctgtagggtctt

SEQ ID NO: 37099 - DNA, 21 bp, Homo sapiens
caaggcgggtcaggggtctta

SEQ ID NO: 37100 - DNA, 15 bp, Homo sapiens
ttcaggcgagggtct

SEQ ID NO: 37101 - DNA, 18 bp, Homo sapiens
ttcaagagacagggtctt

SEQ ID NO: 37102 - DNA, 18 bp, Homo sapiens
ttcaagccgttatacagg

SEQ ID NO: 37103 - DNA, 19 bp, Homo sapiens
ttcaaagaggcagggtctt

SEQ ID NO: 37104 - DNA, 18 bp, Homo sapiens
ttcaaggcgtttgtggcc

SEQ ID NO: 37105 - DNA, 60 bp, Swinepox virus
gagataaataacaaaatccaaacattacatatctgtggtctgatttctttattttatctc

SEQ ID NO: 37106 - DNA, 24 bp, Swinepox virus
taaataacaaaatccaaacattac

SEQ ID NO: 37107 - DNA, 19 bp, Homo sapiens
taacaaaatcccaatttac

SEQ ID NO: 37108 - DNA, 24 bp, Homo sapiens
taagaaacagacaccaaacattac

SEQ ID NO: 37109 - DNA, 21 bp, Homo sapiens
caaataacaacttaaacatta

SEQ ID NO: 37110 - DNA, 20 bp, Homo sapiens
taaattacaaaatccaatac

SEQ ID NO: 37111 - DNA, 20 bp, Homo sapiens
caaataacaaaataaaacat

SEQ ID NO: 37112 - DNA, 66 bp, Avian infectious bronchitis virus
gacatctttgttgtacaaggtgaatatggtcttaattattataaggttaacccttgcgaagatgtc

SEQ ID NO: 37113 - DNA, 24 bp, Avian infectious bronchitis virus
tacaaggtgaatatggtcttaatt

SEQ ID NO: 37114 - DNA, 15 bp, Homo sapiens
cacaaggtgggctca

SEQ ID NO: 37115 - DNA, 23 bp, Homo sapiens
tacaagctgaagatatcttaatt

SEQ ID NO: 37116 - DNA, 21 bp, Homo sapiens
aatgaatatatggttttaatt

SEQ ID NO: 37117 - DNA, 18 bp, Homo sapiens
tacaatgtgcatggtctt

SEQ ID NO: 37118 - DNA, 17 bp, Homo sapiens
ggtggatgatcctaatt

SEQ ID NO: 37119 - DNA, 18 bp, Homo sapiens
tacagtggtgaatatgtc

SEQ ID NO: 37120 - DNA, 71 bp, Avian infectious bronchitis virus
gaaatctaccagcaatttgacgccatacaagcaaatgctcaagtggatcgtcttataactggtagattgtc

SEQ ID NO: 37121 - DNA, 24 bp, Avian infectious bronchitis virus
tctaccagcaatttgacgccatac

SEQ ID NO: 37122 - DNA, 21 bp, Homo sapiens
tctgccagcaatttacagtgc

SEQ ID NO: 37123 - DNA, 19 bp, Homo sapiens
tctaccagcgcatctgtgc

SEQ ID NO: 37124 - DNA, 20 bp, Homo sapiens
tctgcaagcaatttgccata

SEQ ID NO: 37125 - DNA, 17 bp, Homo sapiens
tctaccagcaactaaca

SEQ ID NO: 37126 - DNA, 67 bp, Avian infectious bronchitis virus
ctattaggtactccttttgtggtaatggacgacatgttctaaccataccgcaaaatgcacctaatgg

SEQ ID NO: 37127 - DNA, 24 bp, Avian infectious bronchitis virus
taaccataccgcaaaatgcaccta

SEQ ID NO: 37128 - DNA, 18 bp, Homo sapiens
gaaccttaaaatgcacct

SEQ ID NO: 37129 - DNA, 20 bp, Homo sapiens
ccacaggcctggatgcacct

SEQ ID NO: 37130 - DNA, 20 bp, Homo sapiens
acctaccacttctgcaccta

SEQ ID NO: 37131 - DNA, 19 bp, Homo sapiens
ccacgtggaaatgcaccta

SEQ ID NO: 37132 - DNA, 23 bp, Homo sapiens
ccagagtgctgtgaaatgcacct

SEQ ID NO: 37133 - DNA, 19 bp, Homo sapiens
taaccatatccgaagaaca

SEQ ID NO: 37134 - DNA, 23 bp, Homo sapiens
taacaatattgattctgcaccta

SEQ ID NO: 37135 - DNA, 21 bp, Homo sapiens
accatacccagccccacacct

SEQ ID NO: 37136 - DNA, 71 bp, Avian infectious bronchitis virus
ttttcagatggcttttatccttttactaatagtagtttagttaagcagaagtttattgtctatcgtgaaaa

SEQ ID NO: 37137 - DNA, 24 bp, Avian infectious bronchitis virus
ttaagcagaagtttattgtctatc

SEQ ID NO: 37138 - DNA, 20 bp, Homo sapiens
ttaaacagaatttgtttatc

SEQ ID NO: 37139 - DNA, 22 bp, Homo sapiens
ttaagcaaaggttttttttgtc

SEQ ID NO: 37140 - DNA, 23 bp, Homo sapiens
ttaggcaaaagtaaaaatctatc

SEQ ID NO: 37141 - DNA, 22 bp, Homo sapiens
ttaagcaggaatttaaaaagtc

SEQ ID NO: 37142 - DNA, 23 bp, Homo sapiens
tcaagcagaagttagggttttgt

SEQ ID NO: 37143 - DNA, 18 bp, Homo sapiens
ttaagcagatgtttagtc

SEQ ID NO: 37144 - DNA, 23 bp, Homo sapiens
ttaggcagaagtatatcaaatat

SEQ ID NO: 37145 - DNA, 21 bp, Homo sapiens
taagcatgtcttattgtttat

SEQ ID NO: 37146 - DNA, 20 bp, Homo sapiens
ttaagcaggagtttaatagc

SEQ ID NO: 37147 - DNA, 20 bp, Homo sapiens
agcagaagtccccaattatc

SEQ ID NO: 37148 - DNA, 22 bp, Homo sapiens
ttaagcagcggtggaatttgtc

SEQ ID NO: 37149 - DNA, 21 bp, Homo sapiens
ttaggcagaagtgaagctgtc

SEQ ID NO: 37150 - DNA, 20 bp, Homo sapiens
ttaagcaggtagacgtctat

SEQ ID NO: 37151 - DNA, 23 bp, Homo sapiens
ttaagcagaagattctttttatc

SEQ ID NO: 37152 - DNA, 19 bp, Homo sapiens
ttaagcagaagatacaagt

SEQ ID NO: 37153 - DNA, 20 bp, Homo sapiens
ttaagcaaagttttcttgtc

SEQ ID NO: 37154 - DNA, 88 bp, Human adenovirus F
caaagagaaagatggaaaacgagggggaggactttttaaaggagttaaccttgagtttaatgtctcgtcgccatcatgagtctgtttg

SEQ ID NO: 37155 - DNA, 24 bp, Human adenovirus F
tggaaaacgagggggaggactttt

SEQ ID NO: 37156 - DNA, 18 bp, Homo sapiens
tggagaacgagggaggag

SEQ ID NO: 37157 - DNA, 19 bp, Homo sapiens
tggaagagagggagacttt

SEQ ID NO: 37158 - DNA, 17 bp, Homo sapiens
tggaaggcagggggagg

SEQ ID NO: 37159 - DNA, 23 bp, Homo sapiens
tggtaagattactgaggactttt

SEQ ID NO: 37160 - DNA, 18 bp, Homo sapiens
tggaaaggaggggggcag

SEQ ID NO: 37161 - DNA, 18 bp, Homo sapiens
tggaagatgaggggaagg

SEQ ID NO: 37162 - DNA, 19 bp, Homo sapiens
tggaagagggcttgacttt

SEQ ID NO: 37163 - DNA, 19 bp, Homo sapiens
tggagaatgatggggagga

SEQ ID NO: 37164 - DNA, 25 bp, Homo sapiens
tggaaggctggggggaggggccttt

SEQ ID NO: 37165 - DNA, 23 bp, Homo sapiens
tagaaagttattaggggactttt

SEQ ID NO: 37166 - DNA, 18 bp, Homo sapiens
tggaaactggaggacttt

SEQ ID NO: 37167 - DNA, 16 bp, Homo sapiens
ggaagcgaggggggaa

SEQ ID NO: 37168 - DNA, 19 bp, Homo sapiens
ggagacggagaggattttt

SEQ ID NO: 37169 - DNA, 18 bp, Homo sapiens
gagggctggggaactttc

SEQ ID NO: 37170 - DNA, 20 bp, Homo sapiens
tggaggccgaggggggcgaa

SEQ ID NO: 37171 - DNA, 18 bp, Homo sapiens
tggaagacgagagggaga

SEQ ID NO: 37172 - DNA, 20 bp, Homo sapiens
tggagacgaggcaaactttt

SEQ ID NO: 37173 - DNA, 19 bp, Homo sapiens
tggaaggcgagggagggga

SEQ ID NO: 37174 - DNA, 23 bp, Homo sapiens
tggaaactgaggacttggctttt

SEQ ID NO: 37175 - DNA, 17 bp, Homo sapiens
tggaaagcggggggagg

SEQ ID NO: 37176 - DNA, 19 bp, Homo sapiens
ggaggtgaggggaagcact

SEQ ID NO: 37177 - DNA, 19 bp, Homo sapiens
tggagagtgagggaggctt

SEQ ID NO: 37178 - DNA, 22 bp, Homo sapiens
tggaaaactgataagggctttt

SEQ ID NO: 37179 - DNA, 22 bp, Homo sapiens
gggtgagagaagcaggactttt

SEQ ID NO: 37180 - DNA, 78 bp, Saccharomyces cerevisiae virus L-BC (La)
acttacgccacggatttgttgacaatcaacaagacgcatacacgcgcttggttgccaactactctgatacgcggaagt

SEQ ID NO: 37181 - DNA, 24 bp, Saccharomyces cerevisiae virus L-BC (La)
acggatttgttgacaatcaacaag

SEQ ID NO: 37182 - DNA, 17 bp, Homo sapiens
ggatcggacaatcagca

SEQ ID NO: 37183 - DNA, 20 bp, Homo sapiens
ggggtgacacaatcaacaag

SEQ ID NO: 37184 - DNA, 19 bp, Homo sapiens
ggatttattggagcacaag

SEQ ID NO: 37185 - DNA, 19 bp, Homo sapiens
gatttgttgtggtaacaag

SEQ ID NO: 37186 - DNA, 17 bp, Homo sapiens
ggatttataatcaacaa

SEQ ID NO: 37187 - DNA, 63 bp, Human adenovirus F
tgcagcggtatctgcgtggattcctggggtagggtgtctgccagagggtgtacgtttgttgca

SEQ ID NO: 37188 - DNA, 24 bp, Human adenovirus F
cagcggtatctgcgtggattcctg

SEQ ID NO: 37189 - DNA, 17 bp, Homo sapiens
ggtatctgtgtggccct

SEQ ID NO: 37190 - DNA, 20 bp, Homo sapiens
agtggcatctgtggccagct

SEQ ID NO: 37191 - DNA, 18 bp, Homo sapiens
cagaggccgtgggttcct

SEQ ID NO: 37192 - DNA, 19 bp, Homo sapiens
cagtggtatctgtgggacc

SEQ ID NO: 37193 - DNA, 23 bp, Homo sapiens
cagatggtattttaagattcctg

SEQ ID NO: 37194 - DNA, 19 bp, Homo sapiens
ggtatctgttacactcctg

SEQ ID NO: 37195 - DNA, 18 bp, Homo sapiens
cagggtatctgtaggttc

SEQ ID NO: 37196 - DNA, 16 bp, Homo sapiens
cagggtgagtggattc

SEQ ID NO: 37197 - DNA, 62 bp, Human adenovirus F
gtggtcactctcagctgctaacctgtgcagatggaaactgtcaggctctgagagtgtttcac

SEQ ID NO: 37198 - DNA, 21 bp, Human adenovirus F
caggctctgagagtgtttcac

SEQ ID NO: 37199 - DNA, 18 bp, Homo sapiens
ggctttgcagtgtttcac

SEQ ID NO: 37200 - DNA, 15 bp, Homo sapiens
aggcaaagtgtttca

SEQ ID NO: 37201 - DNA, 19 bp, Homo sapiens
caggctctgaggccctcac

SEQ ID NO: 37202 - DNA, 18 bp, Homo sapiens
cagactctggggagcccc

SEQ ID NO: 37203 - DNA, 15 bp, Homo sapiens
caggccctggtttca

SEQ ID NO: 37204 - DNA, 19 bp, Homo sapiens
aggcttgaaaacatttcac

SEQ ID NO: 37205 - DNA, 19 bp, Homo sapiens
cagttctggcgtatttcac

SEQ ID NO: 37206 - DNA, 17 bp, Homo sapiens
ggctctgagcggctcac

SEQ ID NO: 37207 - DNA, 15 bp, Homo sapiens
caggtctgaatgttt

SEQ ID NO: 37208 - DNA, 22 bp, Homo sapiens
ggttctgagagggaggattcac

SEQ ID NO: 37209 - DNA, 20 bp, Homo sapiens
cagtgttttgaagtgtttca

SEQ ID NO: 37210 - DNA, 19 bp, Homo sapiens
caggctctgcaggtccgac

SEQ ID NO: 37211 - DNA, 18 bp, Homo sapiens
gggtctgagagcgaccac

SEQ ID NO: 37212 - DNA, 19 bp, Homo sapiens
caggcttgtggtatttcac

SEQ ID NO: 37213 - DNA, 20 bp, Homo sapiens
cagattctgggagcaggcac

SEQ ID NO: 37214 - DNA, 17 bp, Homo sapiens
agcctggtgtgtttcac

SEQ ID NO: 37215 - DNA, 19 bp, Homo sapiens
aagttcttttaatgtttca

SEQ ID NO: 37216 - DNA, 18 bp, Homo sapiens
caggctccgggagtcctt

SEQ ID NO: 37217 - DNA, 24 bp, Homo sapiens
caggcctgagaaccatgtgaaaca

SEQ ID NO: 37218 - DNA, 15 bp, Homo sapiens
ggcaaagtgtttcac

SEQ ID NO: 37219 - DNA, 19 bp, Homo sapiens
agacaaaagagtgtttcac

SEQ ID NO: 37220 - DNA, 20 bp, Homo sapiens
cagtttctatgatgtttcac

SEQ ID NO: 37221 - DNA, 19 bp, Homo sapiens
cagttctggaaatattcac

SEQ ID NO: 37222 - DNA, 19 bp, Homo sapiens
aggctctgacctcatttca

SEQ ID NO: 37223 - DNA, 15 bp, Homo sapiens
ggctaaaatgtttca

SEQ ID NO: 37224 - DNA, 17 bp, Homo sapiens
caggctctgagaagctc

SEQ ID NO: 37225 - DNA, 18 bp, Homo sapiens
cagtgctttgatgcttca

SEQ ID NO: 37226 - DNA, 21 bp, Homo sapiens
caggctcttgggcatcttcac

SEQ ID NO: 37227 - DNA, 17 bp, Homo sapiens
ggctctaaaagtttcac

SEQ ID NO: 37228 - DNA, 18 bp, Homo sapiens
ggctttgaactatttcac

SEQ ID NO: 37229 - DNA, 20 bp, Homo sapiens
caggccctgggtagagctca

SEQ ID NO: 37230 - DNA, 15 bp, Homo sapiens
caggtctggatttca

SEQ ID NO: 37231 - DNA, 19 bp, Homo sapiens
caggctctgcggctcccac

SEQ ID NO: 37232 - DNA, 17 bp, Homo sapiens
caggctcatgaatattt

SEQ ID NO: 37233 - DNA, 19 bp, Homo sapiens
cagagctcctaatgtttca

SEQ ID NO: 37234 - DNA, 20 bp, Homo sapiens
aggatcgacatgtgtttcac

SEQ ID NO: 37235 - DNA, 19 bp, Homo sapiens
agctctgggagttccccac

SEQ ID NO: 37236 - DNA, 18 bp, Homo sapiens
ggctctaagtggcagttt

SEQ ID NO: 37237 - DNA, 23 bp, Homo sapiens
aggctctgagggagaatgtttca

SEQ ID NO: 37238 - DNA, 18 bp, Homo sapiens
agctctgacagaattcac

SEQ ID NO: 37239 - DNA, 18 bp, Homo sapiens
caggccctggggctccac

SEQ ID NO: 37240 - DNA, 16 bp, Homo sapiens
caggccctgagcctca

SEQ ID NO: 37241 - DNA, 18 bp, Homo sapiens
gggactgcagtgtttcac

SEQ ID NO: 37242 - DNA, 18 bp, Homo sapiens
caggctctgggatcccac

SEQ ID NO: 37243 - DNA, 19 bp, Homo sapiens
agactctgggagatcccac

SEQ ID NO: 37244 - DNA, 16 bp, Homo sapiens
caggctctggagctca

SEQ ID NO: 37245 - DNA, 17 bp, Homo sapiens
caggcactgaagtattt

SEQ ID NO: 37246 - DNA, 19 bp, Homo sapiens
aggccttgagtgttttcac

SEQ ID NO: 37247 - DNA, 19 bp, Homo sapiens
caggctctgggtgaagtgc

SEQ ID NO: 37248 - DNA, 17 bp, Homo sapiens
aggccctgggaatccac

SEQ ID NO: 37249 - DNA, 19 bp, Homo sapiens
caggctctgggagtggaca

SEQ ID NO: 37250 - DNA, 20 bp, Homo sapiens
cagggttttgaagtgtttca

SEQ ID NO: 37251 - DNA, 17 bp, Homo sapiens
gactctgaatgccttca

SEQ ID NO: 37252 - DNA, 19 bp, Homo sapiens
agactctggggtagctcac

SEQ ID NO: 37253 - DNA, 20 bp, Homo sapiens
caggctctggagggccctca

SEQ ID NO: 37254 - DNA, 19 bp, Homo sapiens
caggttctgagaagccttt

SEQ ID NO: 37255 - DNA, 16 bp, Homo sapiens
caggtcagaagtgttt

SEQ ID NO: 37256 - DNA, 18 bp, Homo sapiens
agctttgttgcgtttcac

SEQ ID NO: 37257 - DNA, 19 bp, Homo sapiens
caggccctgaaactttcac

SEQ ID NO: 37258 - DNA, 16 bp, Homo sapiens
caggctctggtgacac

SEQ ID NO: 37259 - DNA, 15 bp, Homo sapiens
caggctgatgtttca

SEQ ID NO: 37260 - DNA, 16 bp, Homo sapiens
caggatctgagtgctt

SEQ ID NO: 37261 - DNA, 17 bp, Homo sapiens
ggctctgagtgtgatca

SEQ ID NO: 37262 - DNA, 20 bp, Homo sapiens
caagctctgggagaaggtca

SEQ ID NO: 37263 - DNA, 18 bp, Homo sapiens
caggctattgaggcagct

SEQ ID NO: 37264 - DNA, 20 bp, Homo sapiens
caggttacaaagtgtttcac

SEQ ID NO: 37265 - DNA, 18 bp, Homo sapiens
ggctctgagagtgagcac

SEQ ID NO: 37266 - DNA, 20 bp, Homo sapiens
caggctctcaggtaagacac

SEQ ID NO: 37267 - DNA, 17 bp, Homo sapiens
ggcttctgagagaccac

SEQ ID NO: 37268 - DNA, 18 bp, Homo sapiens
ggctcagacggtgtttca

SEQ ID NO: 37269 - DNA, 21 bp, Homo sapiens
caggtgctgagaacagaccac

SEQ ID NO: 37270 - DNA, 18 bp, Homo sapiens
aggctctagtctgtttca

SEQ ID NO: 37271 - DNA, 17 bp, Homo sapiens
caggctctgtgatttca

SEQ ID NO: 37272 - DNA, 18 bp, Homo sapiens
caagcttccctgtttcac

SEQ ID NO: 37273 - DNA, 16 bp, Homo sapiens
caggctctgggctcca

SEQ ID NO: 37274 - DNA, 19 bp, Homo sapiens
aggctctgagacggtgttt

SEQ ID NO: 37275 - DNA, 17 bp, Homo sapiens
aggctctgtagattcac

SEQ ID NO: 37276 - DNA, 16 bp, Homo sapiens
ggcctctgatgtttca

SEQ ID NO: 37277 - DNA, 19 bp, Homo sapiens
gactctgagttcaggtcac

SEQ ID NO: 37278 - DNA, 18 bp, Homo sapiens
caggctttggcatcccac

SEQ ID NO: 37279 - DNA, 18 bp, Homo sapiens
agcgggaggagtgtttca

SEQ ID NO: 37280 - DNA, 17 bp, Homo sapiens
ggcctctgtcatttcac

SEQ ID NO: 37281 - DNA, 20 bp, Homo sapiens
caggctctgaagttggccac

SEQ ID NO: 37282 - DNA, 17 bp, Homo sapiens
aggctctgaggactcac

SEQ ID NO: 37283 - DNA, 17 bp, Homo sapiens
caagctctactaggttt

SEQ ID NO: 37284 - DNA, 18 bp, Homo sapiens
cagccgagggtgtttcac

SEQ ID NO: 37285 - DNA, 17 bp, Homo sapiens
ggctctcggcgcctcac

SEQ ID NO: 37286 - DNA, 21 bp, Homo sapiens
ggctctgagggtttggatcac

SEQ ID NO: 37287 - DNA, 16 bp, Homo sapiens
caggctctgactgttt

SEQ ID NO: 37288 - DNA, 18 bp, Homo sapiens
cagactctaggtgtgttt

SEQ ID NO: 37289 - DNA, 18 bp, Homo sapiens
tgagctctgagaaggtgt

SEQ ID NO: 37290 - DNA, 18 bp, Homo sapiens
caggctttgaatgttcac

SEQ ID NO: 37291 - DNA, 15 bp, Homo sapiens
caagctctgaattca

SEQ ID NO: 37292 - DNA, 18 bp, Homo sapiens
caggccctgaggcagcgc

SEQ ID NO: 37293 - DNA, 17 bp, Homo sapiens
cagactttggtgtttca

SEQ ID NO: 37294 - DNA, 20 bp, Homo sapiens
caggcctctggatgcttcac

SEQ ID NO: 37295 - DNA, 16 bp, Homo sapiens
caggctccggctttca

SEQ ID NO: 37296 - DNA, 18 bp, Homo sapiens
gctctgaggtgcactcac

SEQ ID NO: 37297 - DNA, 19 bp, Homo sapiens
cagtctttgaaatatttca

SEQ ID NO: 37298 - DNA, 18 bp, Homo sapiens
ggatctcaattgtttcac

SEQ ID NO: 37299 - DNA, 18 bp, Homo sapiens
caggtccccgtgtttcac

SEQ ID NO: 37300 - DNA, 19 bp, Homo sapiens
caggccctgaggggggtgc

SEQ ID NO: 37301 - DNA, 18 bp, Homo sapiens
caggccctgaggatcctc

SEQ ID NO: 37302 - DNA, 17 bp, Homo sapiens
aggccctggatgttcac

SEQ ID NO: 37303 - DNA, 20 bp, Homo sapiens
cagttctggtagtatttcac

SEQ ID NO: 37304 - DNA, 20 bp, Homo sapiens
caggttctgagaagcatcac

SEQ ID NO: 37305 - DNA, 18 bp, Homo sapiens
caggcctgagatgtttca

SEQ ID NO: 37306 - DNA, 18 bp, Homo sapiens
aggctctgaagggtgttt

SEQ ID NO: 37307 - DNA, 19 bp, Homo sapiens
agctctgagatatgattca

SEQ ID NO: 37308 - DNA, 19 bp, Homo sapiens
caggctcttgggacaacgc

SEQ ID NO: 37309 - DNA, 17 bp, Homo sapiens
caggctctgggaagtcc

SEQ ID NO: 37310 - DNA, 18 bp, Homo sapiens
caggctctgaagtctcac

SEQ ID NO: 37311 - DNA, 19 bp, Homo sapiens
cagttttgaagtgtttcac

SEQ ID NO: 37312 - DNA, 17 bp, Homo sapiens
cagggccgagagtgttt

SEQ ID NO: 37313 - DNA, 17 bp, Homo sapiens
caggctccgagtcctca

SEQ ID NO: 37314 - DNA, 17 bp, Homo sapiens
aagttctgagggttcac

SEQ ID NO: 37315 - DNA, 18 bp, Homo sapiens
cagtttaaaatgtttcac

SEQ ID NO: 37316 - DNA, 15 bp, Homo sapiens
cagactctagtttca

SEQ ID NO: 37317 - DNA, 20 bp, Homo sapiens
aggggtgcagggtgtttcac

SEQ ID NO: 37318 - DNA, 18 bp, Homo sapiens
aggctctgctgatttcac

SEQ ID NO: 37319 - DNA, 20 bp, Homo sapiens
caggtcttgagagtgttcac

SEQ ID NO: 37320 - DNA, 18 bp, Homo sapiens
caaggtagagtgtttcac

SEQ ID NO: 37321 - DNA, 22 bp, Homo sapiens
tgagctctgagttaacctttca

SEQ ID NO: 37322 - DNA, 17 bp, Homo sapiens
caggctccgagggctca

SEQ ID NO: 37323 - DNA, 19 bp, Homo sapiens
caggctctgttcagttcac

SEQ ID NO: 37324 - DNA, 20 bp, Homo sapiens
aggctctactgaaggtgttt

SEQ ID NO: 37325 - DNA, 18 bp, Homo sapiens
caggctctgagaacctgc

SEQ ID NO: 37326 - DNA, 17 bp, Homo sapiens
aggtctgaaatattcac

SEQ ID NO: 37327 - DNA, 19 bp, Homo sapiens
caggtgctgagtgctttca

SEQ ID NO: 37328 - DNA, 18 bp, Homo sapiens
caggctctgcagtccctc

SEQ ID NO: 37329 - DNA, 17 bp, Homo sapiens
gactctgagatgaacac

SEQ ID NO: 37330 - DNA, 18 bp, Homo sapiens
caggctctaggaatccca

SEQ ID NO: 37331 - DNA, 20 bp, Homo sapiens
caggctcttaggctgggcac

SEQ ID NO: 37332 - DNA, 18 bp, Homo sapiens
caggctctgggagcagct

SEQ ID NO: 37333 - DNA, 19 bp, Homo sapiens
caggctcctgagatctcac

SEQ ID NO: 37334 - DNA, 17 bp, Homo sapiens
caggctctggtgaccca

SEQ ID NO: 37335 - DNA, 21 bp, Homo sapiens
caggctctgggaatttaacca

SEQ ID NO: 37336 - DNA, 19 bp, Homo sapiens
caggccctgggcccttcac

SEQ ID NO: 37337 - DNA, 17 bp, Homo sapiens
caggcctgagcgccctt

SEQ ID NO: 37338 - DNA, 20 bp, Homo sapiens
caggctctgtgaatagccac

SEQ ID NO: 37339 - DNA, 16 bp, Homo sapiens
ggccctgaggcctcac

SEQ ID NO: 37340 - DNA, 16 bp, Homo sapiens
ggccctagtgtttcac

SEQ ID NO: 37341 - DNA, 17 bp, Homo sapiens
cagactctgagaagtct

SEQ ID NO: 37342 - DNA, 17 bp, Homo sapiens
aggctctggcagctcac

SEQ ID NO: 37343 - DNA, 16 bp, Homo sapiens
cagttctgaagtattt

SEQ ID NO: 37344 - DNA, 15 bp, Homo sapiens
caggctctaaattca

SEQ ID NO: 37345 - DNA, 18 bp, Homo sapiens
caggccctggggatccac

SEQ ID NO: 37346 - DNA, 19 bp, Homo sapiens
caggctctgaggacagtgt

SEQ ID NO: 37347 - DNA, 15 bp, Homo sapiens
caggctccgaattca

SEQ ID NO: 37348 - DNA, 19 bp, Homo sapiens
agcactaaagagtgtttca

SEQ ID NO: 37349 - DNA, 17 bp, Homo sapiens
ggctccgagggcctcac

SEQ ID NO: 37350 - DNA, 16 bp, Homo sapiens
gactctgagactccac

SEQ ID NO: 37351 - DNA, 20 bp, Homo sapiens
caggctctgcagggcctcac

SEQ ID NO: 37352 - DNA, 17 bp, Homo sapiens
cagacttggaagtgttt

SEQ ID NO: 37353 - DNA, 15 bp, Homo sapiens
agctctgagatctca

SEQ ID NO: 37354 - DNA, 18 bp, Homo sapiens
caagctctgagctttcac

SEQ ID NO: 37355 - DNA, 18 bp, Homo sapiens
cagtgctctgagaagtat

SEQ ID NO: 37356 - DNA, 18 bp, Homo sapiens
aagttctgagagccccac

SEQ ID NO: 37357 - DNA, 17 bp, Homo sapiens
caggctctgagggctca

SEQ ID NO: 37358 - DNA, 19 bp, Homo sapiens
gactctgaggtgcattcac

SEQ ID NO: 37359 - DNA, 16 bp, Homo sapiens
gactctgaaatttcac

SEQ ID NO: 37360 - DNA, 17 bp, Homo sapiens
caggttctaaaatattt

SEQ ID NO: 37361 - DNA, 17 bp, Homo sapiens
aggctctggtattagac

SEQ ID NO: 37362 - DNA, 17 bp, Homo sapiens
ggttcccagtgtttcac

SEQ ID NO: 37363 - DNA, 19 bp, Homo sapiens
caagctctggggagcagct

SEQ ID NO: 37364 - DNA, 16 bp, Homo sapiens
caagctctttgtttca

SEQ ID NO: 37365 - DNA, 64 bp, Saccharomyces cerevisiae virus L-BC (La)
taggaagacaaggatgatcgccaaactgattgacaagggggttggcgattatactgcattcctg

SEQ ID NO: 37366 - DNA, 24 bp, Saccharomyces cerevisiae virus L-BC (La)
acaaggatgatcgccaaactgatt

SEQ ID NO: 37367 - DNA, 20 bp, Homo sapiens
caaaaattgccaaactgatt

SEQ ID NO: 37368 - DNA, 24 bp, Homo sapiens
acaaggatagcacagtgactgatt

SEQ ID NO: 37369 - DNA, 22 bp, Homo sapiens
acagagagtagtcaaactgatt

SEQ ID NO: 37370 - DNA, 15 bp, Homo sapiens
aggaaccaaactgat

SEQ ID NO: 37371 - DNA, 19 bp, Homo sapiens
accaggacactgaactgat

SEQ ID NO: 37372 - DNA, 20 bp, Homo sapiens
caagggctggcaaactgatt

SEQ ID NO: 37373 - DNA, 18 bp, Homo sapiens
caaggataataaattgat

SEQ ID NO: 37374 - DNA, 18 bp, Homo sapiens
accaggatgatggaactg

SEQ ID NO: 37375 - DNA, 20 bp, Homo sapiens
gggggacggccaaactgatt

SEQ ID NO: 37376 - DNA, 24 bp, Homo sapiens
acaaggactgatcagtcactgatt

SEQ ID NO: 37377 - DNA, 20 bp, Homo sapiens
caaggtcggttaaactgatt

SEQ ID NO: 37378 - DNA, 128 bp, Saccharomyces cerevisiae virus L-BC (La)
ttggaaggggatgagtggactacacatagtcaacaggattcgtatgggagtgagcaacttagtaatggttgttagcaaaatcaatcctgcaaaagctaatgtgctagccaaatcaggagatcctacaa

SEQ ID NO: 37379 - DNA, 24 bp, Saccharomyces cerevisiae virus L-BC (La)
ttagcaaaatcaatcctgcaaaag

SEQ ID NO: 37380 - DNA, 16 bp, Homo sapiens
acaaaatcacccaaaa

SEQ ID NO: 37381 - DNA, 18 bp, Homo sapiens
gcaaaaacaacacaaaag

SEQ ID NO: 37382 - DNA, 17 bp, Homo sapiens
gcaaaatcagttgcaaa

SEQ ID NO: 37383 - DNA, 25 bp, Homo sapiens
ttagctgaatcaatccttttaaaag

SEQ ID NO: 37384 - DNA, 16 bp, Homo sapiens
ctagcaaaaccctgca

SEQ ID NO: 37385 - DNA, 23 bp, Homo sapiens
gcaaaatctcatcgctgcaaaag

SEQ ID NO: 37386 - DNA, 16 bp, Homo sapiens
gcaagaatctgcaaaa

SEQ ID NO: 37387 - DNA, 17 bp, Homo sapiens
tcagcaaaatctagcaa

SEQ ID NO: 37388 - DNA, 19 bp, Homo sapiens
ttagtggaatcaatcagca

SEQ ID NO: 37389 - DNA, 20 bp, Homo sapiens
cagcaaatgttttgcaaaag

SEQ ID NO: 37390 - DNA, 20 bp, Homo sapiens
agcaccaaattctgcaaaag

SEQ ID NO: 37391 - DNA, 20 bp, Homo sapiens
ttagcaagtcagcctgcaaa

SEQ ID NO: 37392 - DNA, 20 bp, Homo sapiens
ttagcaaaatgaatctgaac

SEQ ID NO: 37393 - DNA, 18 bp, Homo sapiens
ctagcaggatcaatcctg

SEQ ID NO: 37394 - DNA, 22 bp, Homo sapiens
ttagcaaagatcttggcctgca

SEQ ID NO: 37395 - DNA, 24 bp, Homo sapiens
ctagcaaagtcaaaaatacaaaag

SEQ ID NO: 37396 - DNA, 24 bp, Homo sapiens
gcaaaatcaatcttaagcttttga

SEQ ID NO: 37397 - DNA, 17 bp, Homo sapiens
ttagcaaaattacaaaa

SEQ ID NO: 37398 - DNA, 19 bp, Homo sapiens
ttagcaaaattatctaaca

SEQ ID NO: 37399 - DNA, 22 bp, Homo sapiens
ttaggagctcctcctgcaaaag

SEQ ID NO: 37400 - DNA, 17 bp, Homo sapiens
tcagcaaagccaactgc

SEQ ID NO: 37401 - DNA, 15 bp, Homo sapiens
ctagcaaaaccctgc

SEQ ID NO: 37402 - DNA, 22 bp, Homo sapiens
tcagcaaaatatgacctgcaaa

SEQ ID NO: 37403 - DNA, 20 bp, Homo sapiens
ctagcaaatgtcaagtcctg

SEQ ID NO: 37404 - DNA, 116 bp, Human herpesvirus 5
gtgtgacgtgagtctgatccaacactgaacgctttcgtcgtgtttttcatgcagcttttacagaccatgacaagcctgacgagagcgttcatcggggcatgaagtacgcattacac

SEQ ID NO: 37405 - DNA, 24 bp, Human herpesvirus 5
tgacaagcctgacgagagcgttca

SEQ ID NO: 37406 - DNA, 24 bp, Homo sapiens
tgataggcctgaatggagcattca

SEQ ID NO: 37407 - DNA, 21 bp, Homo sapiens
tgcaagcctggtgaccactca

SEQ ID NO: 37408 - DNA, 18 bp, Homo sapiens
tggcaagcctggggagag

SEQ ID NO: 37409 - DNA, 22 bp, Homo sapiens
tgatggcctgacgctctcttca

SEQ ID NO: 37410 - DNA, 20 bp, Homo sapiens
gatgagcttgacgagagggt

SEQ ID NO: 37411 - DNA, 18 bp, Homo sapiens
tggcaagcctggcagggc

SEQ ID NO: 37412 - DNA, 20 bp, Homo sapiens
gacaagcctgacaaagttca

SEQ ID NO: 37413 - DNA, 21 bp, Homo sapiens
tgacaagtctgatgaagagcg

SEQ ID NO: 37414 - DNA, 19 bp, Homo sapiens
tgacaagccagatcagttc

SEQ ID NO: 37415 - DNA, 20 bp, Homo sapiens
tgacaagttgggtgaacgtt

SEQ ID NO: 37416 - DNA, 21 bp, Homo sapiens
tggcaagcctgtgacagtctc

SEQ ID NO: 37417 - DNA, 18 bp, Homo sapiens
tgacaggcctgagggtcc

SEQ ID NO: 37418 - DNA, 81 bp, Human herpesvirus 5
ggaacggaggaggctttcgccacacctatcctgaaagcgttgcattctttatgataggtgtgacgatgtctttaccattcc

SEQ ID NO: 37419 - DNA, 23 bp, Human herpesvirus 5
tgtgacgatgtctttaccattcc

SEQ ID NO: 37420 - DNA, 18 bp, Homo sapiens
tgatgatgtctctcactc

SEQ ID NO: 37421 - DNA, 20 bp, Homo sapiens
tgtgtatttctttaccattc

SEQ ID NO: 37422 - DNA, 18 bp, Homo sapiens
tggacgatgtcttccatc

SEQ ID NO: 37423 - DNA, 18 bp, Homo sapiens
tgtgaccattaaccattc

SEQ ID NO: 37424 - DNA, 20 bp, Homo sapiens
tgaggaaatcttttaccatt

SEQ ID NO: 37425 - DNA, 17 bp, Homo sapiens
tgtgggatgtcttcttc

SEQ ID NO: 37426 - DNA, 22 bp, Homo sapiens
tgtgatatgtccctgagtcatt

SEQ ID NO: 37427 - DNA, 18 bp, Homo sapiens
gtgatgatgtctaccatt

SEQ ID NO: 37428 - DNA, 17 bp, Homo sapiens
tgtacgatccaccattc

SEQ ID NO: 37429 - DNA, 78 bp, Human herpesvirus 5
gcgtgatgatgacattcatcatgtatttccattcacacataccttttgtgcatacggtttatatatgaccatccacgc

SEQ ID NO: 37430 - DNA, 24 bp, Human herpesvirus 5
catacggtttatatatgaccatcc

SEQ ID NO: 37431 - DNA, 19 bp, Homo sapiens
cacagtgtatatgaccatc

SEQ ID NO: 37432 - DNA, 21 bp, Homo sapiens
ggtttataaataagaccgtcc

SEQ ID NO: 37433 - DNA, 18 bp, Homo sapiens
acacggtttattttgtcc

SEQ ID NO: 37434 - DNA, 18 bp, Homo sapiens
catacagtatgtgaccat

SEQ ID NO: 37435 - DNA, 20 bp, Homo sapiens
cacactaatatatatatgac

SEQ ID NO: 37436 - DNA, 22 bp, Homo sapiens
tacaacaagtatatatgaccat

SEQ ID NO: 37437 - DNA, 17 bp, Homo sapiens
atacagtttaataccat

SEQ ID NO: 37438 - DNA, 19 bp, Homo sapiens
cacatggcatgtgaccatc

SEQ ID NO: 37439 - DNA, 19 bp, Homo sapiens
acatggtttatatattaac

SEQ ID NO: 37440 - DNA, 23 bp, Homo sapiens
cataggtttatataaactaatcc

SEQ ID NO: 37441 - DNA, 21 bp, Homo sapiens
acatggtaaatgtgaccatcc

SEQ ID NO: 37442 - DNA, 16 bp, Homo sapiens
cacacggtttgtccat

SEQ ID NO: 37443 - DNA, 15 bp, Homo sapiens
ggtttatacatcatc

SEQ ID NO: 37444 - DNA, 22 bp, Homo sapiens
atacataacaatatatggccat

SEQ ID NO: 37445 - DNA, 24 bp, Homo sapiens
caagttctatatatatgatcatcc

SEQ ID NO: 37446 - DNA, 17 bp, Homo sapiens
ggtttatcaaaccatcc

SEQ ID NO: 37447 - DNA, 73 bp, Human adenovirus F
gttcgttgtcgcccctgtgagtgtggagctaatcatattaggttatatccagcaactctgaacgtgaccgagc

SEQ ID NO: 37448 - DNA, 24 bp, Human adenovirus F
tgtgagtgtggagctaatcatatt

SEQ ID NO: 37449 - DNA, 15 bp, Homo sapiens
tggagtgtggtcata

SEQ ID NO: 37450 - DNA, 15 bp, Homo sapiens
tgtgagtgtgcatat

SEQ ID NO: 37451 - DNA, 21 bp, Homo sapiens
tgtgggtatggagcgtaccat

SEQ ID NO: 37452 - DNA, 75 bp, Saccharomyces cerevisiae virus L-BC (La)
caatggctgattttggattgttacaatgcgaggatacattcccgggctttgtaccaacagggtcttacgccaatg

SEQ ID NO: 37453 - DNA, 24 bp, Saccharomyces cerevisiae virus L-BC (La)
ctttgtaccaacagggtcttacgc

SEQ ID NO: 37454 - DNA, 19 bp, Homo sapiens
tttgccaacagataaacgc

SEQ ID NO: 37455 - DNA, 23 bp, Homo sapiens
ctttgtactgtggggtgaaccgc

SEQ ID NO: 37456 - DNA, 20 bp, Homo sapiens
ctttatactgacagcactta

SEQ ID NO: 37457 - DNA, 18 bp, Homo sapiens
ctttgtattgacaggatc

SEQ ID NO: 37458 - DNA, 20 bp, Homo sapiens
ctttgcatcttaaggtctta

SEQ ID NO: 37459 - DNA, 23 bp, Homo sapiens
ctttggttgacaaagccttgtgc

SEQ ID NO: 37460 - DNA, 18 bp, Homo sapiens
ctttgtacaaacaggatc

SEQ ID NO: 37461 - DNA, 18 bp, Homo sapiens
ctttgcactgacagcagt

SEQ ID NO: 37462 - DNA, 108 bp, Saccharomyces cerevisiae virus L-BC (La)
gcgattaacaacatttttcaatacggcgttgaactattgctacctggctaatgcaggtataaactcactagtgccaacgagtctccataatggtgatgatgtttttgc

SEQ ID NO: 37463 - DNA, 24 bp, Saccharomyces cerevisiae virus L-BC (La)
tcactagtgccaacgagtctccat

SEQ ID NO: 37464 - DNA, 22 bp, Homo sapiens
tcgccagtgttactgtctccat

SEQ ID NO: 37465 - DNA, 20 bp, Homo sapiens
ctagtgcaattggtctccat

SEQ ID NO: 37466 - DNA, 21 bp, Homo sapiens
ccactagtgttagcattccat

SEQ ID NO: 37467 - DNA, 19 bp, Homo sapiens
ccattagtgccatttctcc

SEQ ID NO: 37468 - DNA, 22 bp, Homo sapiens
tcactggagctggcatctccat

SEQ ID NO: 37469 - DNA, 19 bp, Homo sapiens
tcactgatgtctgtctcca

SEQ ID NO: 37470 - DNA, 19 bp, Homo sapiens
cactggtgggaaagtctcc

SEQ ID NO: 37471 - DNA, 23 bp, Homo sapiens
ccagccatccaacgagtttccat

SEQ ID NO: 37472 - DNA, 15 bp, Homo sapiens
tagtgccaagctcca

SEQ ID NO: 37473 - DNA, 18 bp, Homo sapiens
tcactagtgtgagttctc

SEQ ID NO: 37474 - DNA, 18 bp, Homo sapiens
tcactagtggccaatgaa

SEQ ID NO: 37475 - DNA, 94 bp, Saimiriine herpesvirus 2
atcagtccgtatttttaatggctggactagagaaggtgttgctattacaaacaaatgggaactttctagagctgttccaaaatatgagatagat

SEQ ID NO: 37476 - DNA, 24 bp, Saimiriine herpesvirus 2
ttaatggctggactagagaaggtg

SEQ ID NO: 37477 - DNA, 17 bp, Homo sapiens
ggctggacgaggaggtg

SEQ ID NO: 37478 - DNA, 21 bp, Homo sapiens
ttaaggctggatgaaaaggtg

SEQ ID NO: 37479 - DNA, 19 bp, Homo sapiens
tggctggaaggggagggtg

SEQ ID NO: 37480 - DNA, 20 bp, Homo sapiens
cgagatgattagggaaggtg

SEQ ID NO: 37481 - DNA, 18 bp, Homo sapiens
tggctggatctgagggtg

SEQ ID NO: 37482 - DNA, 23 bp, Homo sapiens
ttaagggctccaaagagaaggtg

SEQ ID NO: 37483 - DNA, 20 bp, Homo sapiens
aatggctggggtcaggggtg

SEQ ID NO: 37484 - DNA, 16 bp, Homo sapiens
ttaatggctgaatagg

SEQ ID NO: 37485 - DNA, 61 bp, Saimiriine herpesvirus 2
aagtaaacggaatgttaaattcttactatgacagagatggaaataacaaaactgtagactt

SEQ ID NO: 37486 - DNA, 24 bp, Saimiriine herpesvirus 2
tggaaataacaaaactgtagactt

SEQ ID NO: 37487 - DNA, 18 bp, Homo sapiens
tggaaataataaaagtgc

SEQ ID NO: 37488 - DNA, 17 bp, Homo sapiens
tggaataacaaaagtgc

SEQ ID NO: 37489 - DNA, 21 bp, Homo sapiens
tagcaaaaacagaactgtaga

SEQ ID NO: 37490 - DNA, 21 bp, Homo sapiens
tggaaatagtgcaactggaaa

SEQ ID NO: 37491 - DNA, 25 bp, Homo sapiens
tggaaatagtgaaaattttagactt

SEQ ID NO: 37492 - DNA, 22 bp, Homo sapiens
tggggtaccaaactgtagactt

SEQ ID NO: 37493 - DNA, 18 bp, Homo sapiens
tggaaatagcagaactgc

SEQ ID NO: 37494 - DNA, 19 bp, Homo sapiens
ggaaataacaaagcaaacc

SEQ ID NO: 37495 - DNA, 18 bp, Homo sapiens
tggaaataccaacagcaa

SEQ ID NO: 37496 - DNA, 21 bp, Homo sapiens
tggatagtaacaagtagactt

SEQ ID NO: 37497 - DNA, 23 bp, Homo sapiens
ggaaataataaaattatagtctt

SEQ ID NO: 37498 - DNA, 76 bp, Saimiriine herpesvirus 2
caaatagacttaaatcacactgttgttgactatggaaatagagctacatcacagcagcataaaaaaagaatatttg

SEQ ID NO: 37499 - DNA, 24 bp, Saimiriine herpesvirus 2
catcacagcagcataaaaaaagaa

SEQ ID NO: 37500 - DNA, 22 bp, Homo sapiens
catcacagtagataagggagaa

SEQ ID NO: 37501 - DNA, 23 bp, Homo sapiens
catcacaggagtttaaggaagaa

SEQ ID NO: 37502 - DNA, 20 bp, Homo sapiens
catcacaggcgcagggaaga

SEQ ID NO: 37503 - DNA, 21 bp, Homo sapiens
catcacagtattacaaaaaga

SEQ ID NO: 37504 - DNA, 21 bp, Homo sapiens
caccacagccaagaaaaagaa

SEQ ID NO: 37505 - DNA, 19 bp, Homo sapiens
tcacagcaattagaaaaga

SEQ ID NO: 37506 - DNA, 21 bp, Homo sapiens
tcacagcaccagaaggaagaa

SEQ ID NO: 37507 - DNA, 20 bp, Homo sapiens
ccacaacagtataaagaaag

SEQ ID NO: 37508 - DNA, 18 bp, Homo sapiens
cacagcaggaaagaaaga

SEQ ID NO: 37509 - DNA, 21 bp, Homo sapiens
tcacagcaagcgggggaaaag

SEQ ID NO: 37510 - DNA, 18 bp, Homo sapiens
acagtcataaaaaaagaa

SEQ ID NO: 37511 - DNA, 20 bp, Homo sapiens
catcacgcgtttaaaaaaag

SEQ ID NO: 37512 - DNA, 18 bp, Homo sapiens
atcaaccaacataaaaaa

SEQ ID NO: 37513 - DNA, 21 bp, Homo sapiens
caccacagcactagagaaaga

SEQ ID NO: 37514 - DNA, 18 bp, Homo sapiens
catcacagtacatgaaga

SEQ ID NO: 37515 - DNA, 21 bp, Homo sapiens
tcacacaaaataagaaaagaa

SEQ ID NO: 37516 - DNA, 19 bp, Homo sapiens
acagtagccacaaaaaaag

SEQ ID NO: 37517 - DNA, 18 bp, Homo sapiens
catcaacagcagaaaaga

SEQ ID NO: 37518 - DNA, 22 bp, Homo sapiens
catcacagggtatcactcaaga

SEQ ID NO: 37519 - DNA, 23 bp, Homo sapiens
catcacagagcacattagaaaag

SEQ ID NO: 37520 - DNA, 20 bp, Homo sapiens
tcacaaaattaaaaaaagaa

SEQ ID NO: 37521 - DNA, 20 bp, Homo sapiens
cagcacagcagcagggaaga

SEQ ID NO: 37522 - DNA, 24 bp, Homo sapiens
catcacagcaggatgtgtctagaa

SEQ ID NO: 37523 - DNA, 20 bp, Homo sapiens
catggcaacacaagaaagaa

SEQ ID NO: 37524 - DNA, 18 bp, Homo sapiens
acaacattaaaaaaagaa

SEQ ID NO: 37525 - DNA, 25 bp, Homo sapiens
catcacaggccaatctggaaaagaa

SEQ ID NO: 37526 - DNA, 21 bp, Homo sapiens
cacagtcacttagaaaaagaa

SEQ ID NO: 37527 - DNA, 22 bp, Homo sapiens
cagcatggcttaaaaaaaagaa

SEQ ID NO: 37528 - DNA, 18 bp, Homo sapiens
cagcaaccataaagaaag

SEQ ID NO: 37529 - DNA, 17 bp, Homo sapiens
catcacaacattaaaag

SEQ ID NO: 37530 - DNA, 19 bp, Homo sapiens
ccacagcagtgaaaggaga

SEQ ID NO: 37531 - DNA, 24 bp, Homo sapiens
cagcacagtagcaatcagaaagaa

SEQ ID NO: 37532 - DNA, 18 bp, Homo sapiens
cacagcaatactgaaaag

SEQ ID NO: 37533 - DNA, 19 bp, Homo sapiens
catccagcagcaccccaag

SEQ ID NO: 37534 - DNA, 21 bp, Homo sapiens
cacagcagcagcattgaagaa

SEQ ID NO: 37535 - DNA, 24 bp, Homo sapiens
catcacaggtgaccccagaaagaa

SEQ ID NO: 37536 - DNA, 22 bp, Homo sapiens
atcacagctcaaaaagaaaaga

SEQ ID NO: 37537 - DNA, 20 bp, Homo sapiens
caccacagctgctggaaaag

SEQ ID NO: 37538 - DNA, 17 bp, Homo sapiens
acagcagcacagaaaga

SEQ ID NO: 37539 - DNA, 19 bp, Homo sapiens
gcaagacataaaaaaagaa

SEQ ID NO: 37540 - DNA, 21 bp, Homo sapiens
ataacagcagccctggaagaa

SEQ ID NO: 37541 - DNA, 21 bp, Homo sapiens
cagcatggaaaaaaaaaagaa

SEQ ID NO: 37542 - DNA, 20 bp, Homo sapiens
acatatgcctaaaaaaagaa

SEQ ID NO: 37543 - DNA, 18 bp, Homo sapiens
gcagccataaaaaaagaa

SEQ ID NO: 37544 - DNA, 22 bp, Homo sapiens
caccacagtgcagtgggaagaa

SEQ ID NO: 37545 - DNA, 24 bp, Homo sapiens
catcacaaatattataaagaaaga

SEQ ID NO: 37546 - DNA, 19 bp, Homo sapiens
tcacagcaataaaaaagaa

SEQ ID NO: 37547 - DNA, 19 bp, Homo sapiens
catcagcagcagcataaaa

SEQ ID NO: 37548 - DNA, 21 bp, Homo sapiens
atcaagcagcatgatgccaga

SEQ ID NO: 37549 - DNA, 21 bp, Homo sapiens
atccagtacatagaaaaagaa

SEQ ID NO: 37550 - DNA, 18 bp, Homo sapiens
atcacagcagccggaaga

SEQ ID NO: 37551 - DNA, 19 bp, Homo sapiens
caacacagcacatactaag

SEQ ID NO: 37552 - DNA, 19 bp, Homo sapiens
cacagcacattaaaaagaa

SEQ ID NO: 37553 - DNA, 19 bp, Homo sapiens
catcacaacctgaaaaaga

SEQ ID NO: 37554 - DNA, 22 bp, Homo sapiens
catcacagagcacattagaaag

SEQ ID NO: 37555 - DNA, 18 bp, Homo sapiens
gcagcgctagaaaaagaa

SEQ ID NO: 37556 - DNA, 20 bp, Homo sapiens
catcacacacgcaaaaaaag

SEQ ID NO: 37557 - DNA, 20 bp, Homo sapiens
cacagctgaagaaaaaagaa

SEQ ID NO: 37558 - DNA, 61 bp, Equine infectious anemia virus
gggtgatggtgcagtagtagttaatgatgaaggaaagggaataattgctgtaccattaacc

SEQ ID NO: 37559 - DNA, 24 bp, Equine infectious anemia virus
tgatggtgcagtagtagttaatga

SEQ ID NO: 37560 - DNA, 19 bp, Homo sapiens
tggaggtgcagtgagccaa

SEQ ID NO: 37561 - DNA, 18 bp, Homo sapiens
tggtagtgcagtaggggt

SEQ ID NO: 37562 - DNA, 25 bp, Homo sapiens
tgatggtagtaggatagagttggtg

SEQ ID NO: 37563 - DNA, 20 bp, Homo sapiens
tgactggtagtagttggtga

SEQ ID NO: 37564 - DNA, 24 bp, Homo sapiens
tgatggtgtagctgtcaggaatga

SEQ ID NO: 37565 - DNA, 21 bp, Homo sapiens
gatggtgcagctatttaatga

SEQ ID NO: 37566 - DNA, 21 bp, Homo sapiens
tgaggtgcagttatatggtga

SEQ ID NO: 37567 - DNA, 18 bp, Homo sapiens
tgatggtgtatgtgaatg

SEQ ID NO: 37568 - DNA, 16 bp, Homo sapiens
tgtggtgcagtggtgc

SEQ ID NO: 37569 - DNA, 18 bp, Homo sapiens
tgatggtggtggtagtag

SEQ ID NO: 37570 - DNA, 19 bp, Homo sapiens
tgatggtgtggtatggcag

SEQ ID NO: 37571 - DNA, 63 bp, Equine infectious anemia virus
gtctctaggaattgattacctcgatgcttcattaaggaagaagaataaacaaagactgaaggc

SEQ ID NO: 37572 - DNA, 24 bp, Equine infectious anemia virus
taggaattgattacctcgatgctt

SEQ ID NO: 37573 - DNA, 26 bp, Homo sapiens
tagggattgatcacattggcatgctt

SEQ ID NO: 37574 - DNA, 20 bp, Homo sapiens
agggggaagcctcgatgctt

SEQ ID NO: 37575 - DNA, 24 bp, Homo sapiens
aggaattggtggtgactgatgctt

SEQ ID NO: 37576 - DNA, 67 bp, Equine infectious anemia virus
ttagacatggtaaagaatccaacccttaatgatgtgcaaaaattaatggggaatataacatggatga

SEQ ID NO: 37577 - DNA, 24 bp, Equine infectious anemia virus
gacatggtaaagaatccaaccctt

SEQ ID NO: 37578 - DNA, 22 bp, Homo sapiens
atggagcccaaattcaaccctt

SEQ ID NO: 37579 - DNA, 18 bp, Homo sapiens
gacatggtaatggattcc

SEQ ID NO: 37580 - DNA, 21 bp, Homo sapiens
cacagcaagaatctgatcctt

SEQ ID NO: 37581 - DNA, 23 bp, Homo sapiens
acatggtaacaccatcaaccctt

SEQ ID NO: 37582 - DNA, 20 bp, Homo sapiens
gacatggtaagcaatacaac

SEQ ID NO: 37583 - DNA, 18 bp, Homo sapiens
aacatggtagacaggcct

SEQ ID NO: 37584 - DNA, 21 bp, Homo sapiens
atggtaaagctgtcaattctt

SEQ ID NO: 37585 - DNA, 19 bp, Homo sapiens
atggcagaatccagccctt

SEQ ID NO: 37586 - DNA, 19 bp, Homo sapiens
tggtagaacccaggccctt

SEQ ID NO: 37587 - DNA, 87 bp, Equine infectious anemia virus
tcaagttcctcctaatagctttggatgggtcactgggaaatcatcaatggcaaaacaggggttattaattaatggaggaataattga

SEQ ID NO: 37588 - DNA, 24 bp, Equine infectious anemia virus
tggcaaaacaggggttattaatta

SEQ ID NO: 37589 - DNA, 21 bp, Homo sapiens
tggaaaaacaggggggaatta

SEQ ID NO: 37590 - DNA, 19 bp, Homo sapiens
tggcaaaatagaggtaacc

SEQ ID NO: 37591 - DNA, 16 bp, Homo sapiens
tagcgaggcaattaat

SEQ ID NO: 37592 - DNA, 18 bp, Homo sapiens
cagactagttattaatta

SEQ ID NO: 37593 - DNA, 23 bp, Homo sapiens
tgccaaaaacatgttattaatta

SEQ ID NO: 37594 - DNA, 22 bp, Homo sapiens
tggcaaaaatattttattaatt

SEQ ID NO: 37595 - DNA, 21 bp, Homo sapiens
tggcaaaaggggaaaaaatta

SEQ ID NO: 37596 - DNA, 15 bp, Homo sapiens
tggaaggttattaat

SEQ ID NO: 37597 - DNA, 21 bp, Homo sapiens
tggcaaaacatgggaatatta

SEQ ID NO: 37598 - DNA, 18 bp, Homo sapiens
tgacaaaacaggtttatt

SEQ ID NO: 37599 - DNA, 70 bp, Saimiriine herpesvirus 2
gatgtgagtgcaggttcagaaaataatgtgtttctatcacaaatacaatatgcatatgataagctacgtc

SEQ ID NO: 37600 - DNA, 24 bp, Saimiriine herpesvirus 2
tacaatatgcatatgataagctac

SEQ ID NO: 37601 - DNA, 22 bp, Homo sapiens
acaatacatgaatgataagcta

SEQ ID NO: 37602 - DNA, 21 bp, Homo sapiens
atatgccctcttataagctac

SEQ ID NO: 37603 - DNA, 21 bp, Homo sapiens
tatgtatatgtgtacaagcta

SEQ ID NO: 37604 - DNA, 21 bp, Homo sapiens
aaaatgtttaagataagctac

SEQ ID NO: 37605 - DNA, 17 bp, Homo sapiens
tacaatatgctgtggct

SEQ ID NO: 37606 - DNA, 18 bp, Homo sapiens
caacatgcatgtaattgc

SEQ ID NO: 37607 - DNA, 20 bp, Homo sapiens
aatatgcatatggtctctac

SEQ ID NO: 37608 - DNA, 18 bp, Homo sapiens
tacaatgtgcatatatta

SEQ ID NO: 37609 - DNA, 18 bp, Homo sapiens
tacatatgcatatgcata

SEQ ID NO: 37610 - DNA, 19 bp, Homo sapiens
caacatgcatatgtcaact

SEQ ID NO: 37611 - DNA, 20 bp, Homo sapiens
tacaatgtgcagatgacaaa

SEQ ID NO: 37612 - DNA, 21 bp, Homo sapiens
tacaatatgtgcatggaaagc

SEQ ID NO: 37613 - DNA, 21 bp, Homo sapiens
tacaatatggatatgtcctac

SEQ ID NO: 37614 - DNA, 67 bp, Kennedya yellow mosaic virus
acagtcggagtcgagtttcttggtgacattggctctttgtcaggcaccaacaactcatccgacatgt

SEQ ID NO: 37615 - DNA, 24 bp, Kennedya yellow mosaic virus
aggcaccaacaactcatccgacat

SEQ ID NO: 37616 - DNA, 23 bp, Homo sapiens
agacaccagtggtttcagaacac

SEQ ID NO: 37617 - DNA, 18 bp, Homo sapiens
aggcaccaagttctgaca

SEQ ID NO: 37618 - DNA, 18 bp, Homo sapiens
agacaccaacagctgcat

SEQ ID NO: 37619 - DNA, 18 bp, Homo sapiens
aggcaccaatcactaaca

SEQ ID NO: 37620 - DNA, 23 bp, Homo sapiens
aagcaccaacagcttcaaaacat

SEQ ID NO: 37621 - DNA, 23 bp, Homo sapiens
aggcaccagcagccgtcagcccg

SEQ ID NO: 37622 - DNA, 24 bp, Homo sapiens
aggaccaacaaataatactgacat

SEQ ID NO: 37623 - DNA, 21 bp, Homo sapiens
aggtgtccacaactcatgcca

SEQ ID NO: 37624 - DNA, 18 bp, Homo sapiens
aggtactgacactcatcc

SEQ ID NO: 37625 - DNA, 17 bp, Homo sapiens
aggtccaacatctcgac

SEQ ID NO: 37626 - DNA, 63 bp, Rat cytomegalovirus
caggacgagacgcggttccacacggccatgaccgtctggcgaccggacgccccgctgcgcctg

SEQ ID NO: 37627 - DNA, 24 bp, Rat cytomegalovirus
cgaccggacgccccgctgcgcctg

SEQ ID NO: 37628 - DNA, 22 bp, Homo sapiens
ccgggcggctccgggagctctg

SEQ ID NO: 37629 - DNA, 24 bp, Homo sapiens
cgccctgcgaccccgctgcgcctg

SEQ ID NO: 37630 - DNA, 18 bp, Homo sapiens
cggccggggccccgctcg

SEQ ID NO: 37631 - DNA, 21 bp, Homo sapiens
ccgggccgatgcctgcgcctg

SEQ ID NO: 37632 - DNA, 18 bp, Homo sapiens
cgcctgggcgcccggcct

SEQ ID NO: 37633 - DNA, 15 bp, Homo sapiens
cgccgggcctgcgcc

SEQ ID NO: 37634 - DNA, 23 bp, Homo sapiens
ccgggcgccccgctcgctccctg

SEQ ID NO: 37635 - DNA, 20 bp, Homo sapiens
cggccgggtggctgcgcctg

SEQ ID NO: 37636 - DNA, 21 bp, Homo sapiens
ccatctcccccgctgcgcctg

SEQ ID NO: 37637 - DNA, 20 bp, Homo sapiens
gactggacgcccccatcctg

SEQ ID NO: 37638 - DNA, 20 bp, Homo sapiens
gactggccgtttcgcacctg

SEQ ID NO: 37639 - DNA, 21 bp, Homo sapiens
ggctgcctttcgctgcgcctg

SEQ ID NO: 37640 - DNA, 18 bp, Homo sapiens
cggccgggctcccgctac

SEQ ID NO: 37641 - DNA, 19 bp, Homo sapiens
cggcctgacgccccctctg

SEQ ID NO: 37642 - DNA, 22 bp, Homo sapiens
gattggattcccgctgcgcctg

SEQ ID NO: 37643 - DNA, 18 bp, Homo sapiens
cagctccccgctgcgcct

SEQ ID NO: 37644 - DNA, 19 bp, Homo sapiens
ccggacgctctgacggctg

SEQ ID NO: 37645 - DNA, 18 bp, Homo sapiens
cgactagggcctgcgcct

SEQ ID NO: 37646 - DNA, 21 bp, Homo sapiens
cagcccgccccgctgtgcctg

SEQ ID NO: 37647 - DNA, 81 bp, Kennedya yellow mosaic virus
agtcggcatgttttgactacttctgccgtcattctccccctcatgaaaaggctcttctatcatcctttgaactgcctgact

SEQ ID NO: 37648 - DNA, 24 bp, Kennedya yellow mosaic virus
tgttttgactacttctgccgtcat

SEQ ID NO: 37649 - DNA, 18 bp, Homo sapiens
tgttttgacggactgtca

SEQ ID NO: 37650 - DNA, 19 bp, Homo sapiens
tgttttgactgctgctgcc

SEQ ID NO: 37651 - DNA, 22 bp, Homo sapiens
tgttttgactgttggctttgtc

SEQ ID NO: 37652 - DNA, 16 bp, Homo sapiens
tgttttgacacttggc

SEQ ID NO: 37653 - DNA, 24 bp, Homo sapiens
tgctttgactgttggtgatgtcat

SEQ ID NO: 37654 - DNA, 21 bp, Homo sapiens
gtttctctctacttctgccgt

SEQ ID NO: 37655 - DNA, 19 bp, Homo sapiens
tgttctgactaagttgtca

SEQ ID NO: 37656 - DNA, 18 bp, Homo sapiens
gttgttgacttctgctgt

SEQ ID NO: 37657 - DNA, 18 bp, Homo sapiens
tggtttgactacttgtca

SEQ ID NO: 37658 - DNA, 85 bp, Rat cytomegalovirus
ggagtgcatgcgcgagatctgcgacaacctgacgaagtacacgaactcgatcgacttcgccacgcaggactcgcgcttccagacc

SEQ ID NO: 37659 - DNA, 24 bp, Rat cytomegalovirus
ccacgcaggactcgcgcttccaga

SEQ ID NO: 37660 - DNA, 15 bp, Homo sapiens
cacgcaggagcttcc

SEQ ID NO: 37661 - DNA, 18 bp, Homo sapiens
aggccctcgcgcttccag

SEQ ID NO: 37662 - DNA, 21 bp, Homo sapiens
ccctgcaggaccctattccag

SEQ ID NO: 37663 - DNA, 22 bp, Homo sapiens
ccacggggacatgtcttccaga

SEQ ID NO: 37664 - DNA, 17 bp, Homo sapiens
caccaggactctcggtc

SEQ ID NO: 37665 - DNA, 24 bp, Homo sapiens
ccactcagggctgccccttccaga

SEQ ID NO: 37666 - DNA, 15 bp, Homo sapiens
ccaccaggactccca

SEQ ID NO: 37667 - DNA, 18 bp, Homo sapiens
cacgcaggactcgcggcc

SEQ ID NO: 37668 - DNA, 21 bp, Homo sapiens
cgcaggactcgcgtctggccc

SEQ ID NO: 37669 - DNA, 21 bp, Homo sapiens
gcggggctggggcgcttccag

SEQ ID NO: 37670 - DNA, 18 bp, Homo sapiens
cacgcagggccagcttcc

SEQ ID NO: 37671 - DNA, 20 bp, Homo sapiens
cagcaggatagcctttcaga

SEQ ID NO: 37672 - DNA, 19 bp, Homo sapiens
ccacgcagggtcctcccag

SEQ ID NO: 37673 - DNA, 15 bp, Homo sapiens
cccgcgggcgcttcc

SEQ ID NO: 37674 - DNA, 18 bp, Homo sapiens
cgccggctctgcttccag

SEQ ID NO: 37675 - DNA, 20 bp, Homo sapiens
catgcgggacccgcgcttcc

SEQ ID NO: 37676 - DNA, 20 bp, Homo sapiens
ccacgccgggctcagagcct

SEQ ID NO: 37677 - DNA, 18 bp, Homo sapiens
ccatgctgggacttccag

SEQ ID NO: 37678 - DNA, 22 bp, Homo sapiens
ccacacaggacttgctcctgga

SEQ ID NO: 37679 - DNA, 15 bp, Homo sapiens
caggactccattcag

SEQ ID NO: 37680 - DNA, 22 bp, Homo sapiens
cgccggggctcagagcctccag

SEQ ID NO: 37681 - DNA, 17 bp, Homo sapiens
ccacgcagggctcaccc

SEQ ID NO: 37682 - DNA, 20 bp, Homo sapiens
ccatgcagaactcctttcag

SEQ ID NO: 37683 - DNA, 22 bp, Homo sapiens
ccatcaggccacagcttccaga

SEQ ID NO: 37684 - DNA, 17 bp, Homo sapiens
caccaggactctttccg

SEQ ID NO: 37685 - DNA, 19 bp, Homo sapiens
cacgcagggccgcgcgcag

SEQ ID NO: 37686 - DNA, 22 bp, Homo sapiens
catccagggctctgcttccaga

SEQ ID NO: 37687 - DNA, 17 bp, Homo sapiens
cctgcgcgagcgcttcc

SEQ ID NO: 37688 - DNA, 17 bp, Homo sapiens
caggtcaagcttccgga

SEQ ID NO: 37689 - DNA, 20 bp, Homo sapiens
ccgcgctggacttgctgact

SEQ ID NO: 37690 - DNA, 18 bp, Homo sapiens
gcaggacttatgcccaga

SEQ ID NO: 37691 - DNA, 21 bp, Homo sapiens
ccaggcaggggttcttccaga

SEQ ID NO: 37692 - DNA, 20 bp, Homo sapiens
gctaggacacttcttccaga

SEQ ID NO: 37693 - DNA, 21 bp, Homo sapiens
cacttgggacaggcttccaga

SEQ ID NO: 37694 - DNA, 20 bp, Homo sapiens
gcgggaagcacacttctgga

SEQ ID NO: 37695 - DNA, 22 bp, Homo sapiens
ccacgtgggccctgcttccaga

SEQ ID NO: 37696 - DNA, 23 bp, Homo sapiens
ccacgcagactcgctgcatgcag

SEQ ID NO: 37697 - DNA, 21 bp, Homo sapiens
ccgcgcgcccgcgcttccgga

SEQ ID NO: 37698 - DNA, 19 bp, Homo sapiens
ccacgggggtcccttccag

SEQ ID NO: 37699 - DNA, 20 bp, Homo sapiens
ccacgcagactccgcctcag

SEQ ID NO: 37700 - DNA, 20 bp, Homo sapiens
ccacgcagggctggtgtcca

SEQ ID NO: 37701 - DNA, 22 bp, Homo sapiens
ccgggcagggccaccttccaga

SEQ ID NO: 37702 - DNA, 21 bp, Homo sapiens
cgcggcggctcccgcttccag

SEQ ID NO: 37703 - DNA, 24 bp, Homo sapiens
ccacgcagggctccccagcttcag

SEQ ID NO: 37704 - DNA, 17 bp, Homo sapiens
ccacgcagggccggccc

SEQ ID NO: 37705 - DNA, 21 bp, Homo sapiens
cgcgtgggactcgcggccgga

SEQ ID NO: 37706 - DNA, 19 bp, Homo sapiens
gccaggaaaagcttccaga

SEQ ID NO: 37707 - DNA, 15 bp, Homo sapiens
gcaggaaccttccag

SEQ ID NO: 37708 - DNA, 16 bp, Homo sapiens
gcagatctgcttccag

SEQ ID NO: 37709 - DNA, 20 bp, Homo sapiens
gcaggacttgaactctcaga

SEQ ID NO: 37710 - DNA, 21 bp, Homo sapiens
cacgcagggtgctatcctaga

SEQ ID NO: 37711 - DNA, 18 bp, Homo sapiens
ccctgcagggacttccag

SEQ ID NO: 37712 - DNA, 19 bp, Homo sapiens
acgccagccctgcttccag

SEQ ID NO: 37713 - DNA, 23 bp, Homo sapiens
ccagtagggaagcagcttccaga

SEQ ID NO: 37714 - DNA, 23 bp, Homo sapiens
ccagcgctccctgcgcttccgga

SEQ ID NO: 37715 - DNA, 19 bp, Homo sapiens
catgcggggctcgcgcccc

SEQ ID NO: 37716 - DNA, 22 bp, Homo sapiens
ccatgtgggacccccagccaga

SEQ ID NO: 37717 - DNA, 16 bp, Homo sapiens
gcagccctgcttccag

SEQ ID NO: 37718 - DNA, 20 bp, Homo sapiens
ccacggctcagcgcttccag

SEQ ID NO: 37719 - DNA, 22 bp, Homo sapiens
cgctgggatccgcacttccgga

SEQ ID NO: 37720 - DNA, 67 bp, Rat cytomegalovirus
gatcatgttcgccaccaacccgacgtgccacctggcgtggccgctgggcgagagcgaacacgagatc

SEQ ID NO: 37721 - DNA, 24 bp, Rat cytomegalovirus
gccgctgggcgagagcgaacacga

SEQ ID NO: 37722 - DNA, 20 bp, Homo sapiens
gcgcgctgggcgcggacgcg

SEQ ID NO: 37723 - DNA, 20 bp, Homo sapiens
gcttctggttgcggacgcga

SEQ ID NO: 37724 - DNA, 21 bp, Homo sapiens
gccgccgggcgaggaggtgcg

SEQ ID NO: 37725 - DNA, 22 bp, Homo sapiens
gcctgctaaggagcgaacatga

SEQ ID NO: 37726 - DNA, 21 bp, Homo sapiens
gccgccgggtgggagccgcga

SEQ ID NO: 37727 - DNA, 19 bp, Homo sapiens
gccgctgggtagggaggcg

SEQ ID NO: 37728 - DNA, 18 bp, Homo sapiens
gccgctgggtcacgcacg

SEQ ID NO: 37729 - DNA, 21 bp, Homo sapiens
ccgctgaatgggcggacgcga

SEQ ID NO: 37730 - DNA, 21 bp, Homo sapiens
gccactggggcgtagtgggcg

SEQ ID NO: 37731 - DNA, 19 bp, Homo sapiens
gcgggcgagagcggacgcg

SEQ ID NO: 37732 - DNA, 21 bp, Homo sapiens
gctgctgggcaaggcgtcacg

SEQ ID NO: 37733 - DNA, 20 bp, Homo sapiens
cgctgggcgaggctgctgcg

SEQ ID NO: 37734 - DNA, 18 bp, Homo sapiens
gccgctgggcgcggaggc

SEQ ID NO: 37735 - DNA, 19 bp, Homo sapiens
gccgctgaggcgggacgcg

SEQ ID NO: 37736 - DNA, 23 bp, Homo sapiens
gccagggaccgggagcggacgcg

SEQ ID NO: 37737 - DNA, 21 bp, Homo sapiens
gctgctgggcgacgacgacga

SEQ ID NO: 37738 - DNA, 21 bp, Homo sapiens
gccgctgggatgccggatgcg

SEQ ID NO: 37739 - DNA, 23 bp, Homo sapiens
gcctctgggtaacagtgaacacg

SEQ ID NO: 37740 - DNA, 24 bp, Homo sapiens
gccgctggggtgctctccggagcg

SEQ ID NO: 37741 - DNA, 19 bp, Homo sapiens
gctgggtgagagcgagcac

SEQ ID NO: 37742 - DNA, 18 bp, Homo sapiens
gccgctgggcgggggcga

SEQ ID NO: 37743 - DNA, 21 bp, Homo sapiens
accaccttgagggcgaacacg

SEQ ID NO: 37744 - DNA, 18 bp, Homo sapiens
gccgctgggtggagggcg

SEQ ID NO: 37745 - DNA, 19 bp, Homo sapiens
gccgctgggtgatgggaca

SEQ ID NO: 37746 - DNA, 18 bp, Homo sapiens
gccgccgggcgaggagga

SEQ ID NO: 37747 - DNA, 18 bp, Homo sapiens
gctgggcggagagcacga

SEQ ID NO: 37748 - DNA, 23 bp, Homo sapiens
gccgctggagtgcagtggcgcga

SEQ ID NO: 37749 - DNA, 127 bp, Tupaia herpesvirus
aggttccgctgcgtgctgaagtgaaagagcggtagctccggctgcgtgtcggtctggtgcaggatctcgccgacggccaggtagtgagcggcgctcgacttgtagacggtcagcgcgcagtgcccct

SEQ ID NO: 37750 - DNA, 24 bp, Tupaia herpesvirus
ttccgctgcgtgctgaagtgaaag

SEQ ID NO: 37751 - DNA, 22 bp, Homo sapiens
ctgcctaagactgaagtggaag

SEQ ID NO: 37752 - DNA, 16 bp, Homo sapiens
ctcccttgaagtgaaa

SEQ ID NO: 37753 - DNA, 18 bp, Homo sapiens
ctccgccaactggagtga

SEQ ID NO: 37754 - DNA, 19 bp, Homo sapiens
ttccgctgctgctgggaaa

SEQ ID NO: 37755 - DNA, 21 bp, Homo sapiens
ttctgttgcgtgctaaccttg

SEQ ID NO: 37756 - DNA, 17 bp, Homo sapiens
ttccttgtgtgctgaag

SEQ ID NO: 37757 - DNA, 23 bp, Homo sapiens
ttccactgtgtgctcagcgtgaa

SEQ ID NO: 37758 - DNA, 19 bp, Homo sapiens
ttctgctgtgttctgagta

SEQ ID NO: 37759 - DNA, 131 bp, Tupaia herpesvirus
gcagccggatgatggtgcggttagtgagccggaagcccgttttggtgcgacgcacggagaatttgaaggtccggttgtgcaagcgcacctgcgacgggcggcggaggaggaccctttccgacagcgggtgt

SEQ ID NO: 37760 - DNA, 24 bp, Tupaia herpesvirus
tgtgcaagcgcacctgcgacgggc

SEQ ID NO: 37761 - DNA, 16 bp, Homo sapiens
tgtgaagcgcaccagg

SEQ ID NO: 37762 - DNA, 22 bp, Homo sapiens
tgtgcaaatgcatctgactggc

SEQ ID NO: 37763 - DNA, 22 bp, Homo sapiens
tgtgcaaggcacttgcctgagc

SEQ ID NO: 37764 - DNA, 18 bp, Homo sapiens
tggcgagcgggcgacggg

SEQ ID NO: 37765 - DNA, 22 bp, Homo sapiens
tgtgtaactgcacctgctccgg

SEQ ID NO: 37766 - DNA, 60 bp, Tupaia herpesvirus
ggtgcgccggcggcatcccggtgacggtggtcgacaggaccaggtcgagctcggcgggcc

SEQ ID NO: 37767 - DNA, 24 bp, Tupaia herpesvirus
tcgacaggaccaggtcgagctcgg

SEQ ID NO: 37768 - DNA, 22 bp, Homo sapiens
caggcaggaaacccgggctcgg

SEQ ID NO: 37769 - DNA, 17 bp, Homo sapiens
tcgatcaggacctccag

SEQ ID NO: 37770 - DNA, 19 bp, Homo sapiens
gaagggccgagctgctcgg

SEQ ID NO: 37771 - DNA, 18 bp, Homo sapiens
tcgagggaccaggcttcg

SEQ ID NO: 37772 - DNA, 65 bp, Ateline herpesvirus 3
gtgaatattcctgtcttatgtctgatataaattcaacactaactgataagataggaagagttaac

SEQ ID NO: 37773 - DNA, 19 bp, Ateline herpesvirus 3
taagataggaagagttaac

SEQ ID NO: 37774 - DNA, 16 bp, Homo sapiens
caagagaagagttaac

SEQ ID NO: 37775 - DNA, 17 bp, Homo sapiens
taagtatgaagagttaa

SEQ ID NO: 37776 - DNA, 16 bp, Homo sapiens
taaaatggagagttaa

SEQ ID NO: 37777 - DNA, 18 bp, Homo sapiens
taacataggtgaattaac

SEQ ID NO: 37778 - DNA, 19 bp, Homo sapiens
taaaaagaaaggagttaac

SEQ ID NO: 37779 - DNA, 18 bp, Homo sapiens
taagacaggagacttaac

SEQ ID NO: 37780 - DNA, 18 bp, Homo sapiens
taagctaggaagaggaaa

SEQ ID NO: 37781 - DNA, 18 bp, Homo sapiens
gatacggcaagagttaac

SEQ ID NO: 37782 - DNA, 20 bp, Homo sapiens
taagatagctaaacagttaa

SEQ ID NO: 37783 - DNA, 19 bp, Homo sapiens
taagatagaacattttaac

SEQ ID NO: 37784 - DNA, 18 bp, Homo sapiens
gacaacggaagagttaac

SEQ ID NO: 37785 - DNA, 16 bp, Homo sapiens
taagataggaggttaa

SEQ ID NO: 37786 - DNA, 18 bp, Homo sapiens
agagagtgaggagttaac

SEQ ID NO: 37787 - DNA, 18 bp, Homo sapiens
taagacaggatcattaac

SEQ ID NO: 37788 - DNA, 19 bp, Homo sapiens
taagataaggaaaaagagc

SEQ ID NO: 37789 - DNA, 17 bp, Homo sapiens
aagatagataggttaac

SEQ ID NO: 37790 - DNA, 17 bp, Homo sapiens
caagaaaagagagttaa

SEQ ID NO: 37791 - DNA, 19 bp, Homo sapiens
taaaataggcttagagtta

SEQ ID NO: 37792 - DNA, 21 bp, Homo sapiens
caagatggcagcagagttaac

SEQ ID NO: 37793 - DNA, 18 bp, Homo sapiens
agagagaatggagttaac

SEQ ID NO: 37794 - DNA, 19 bp, Homo sapiens
taagggaggaagaggaaac

SEQ ID NO: 37795 - DNA, 19 bp, Homo sapiens
aagagaagcaagagttaac

SEQ ID NO: 37796 - DNA, 18 bp, Homo sapiens
caagagtgaggagttaac

SEQ ID NO: 37797 - DNA, 19 bp, Homo sapiens
taacataggaacaggaaac

SEQ ID NO: 37798 - DNA, 101 bp, Amsacta moorei entomopoxvirus
ttatatgatatcttacaaaatatattaaatctttctttagttatttctgataacttataactatttgacgaaggatatgtttttttaatataattatataa

SEQ ID NO: 37799 - DNA, 24 bp, Amsacta moorei entomopoxvirus
tatgatatcttacaaaatatatta

SEQ ID NO: 37800 - DNA, 24 bp, Homo sapiens
tatgatatctttaaagatatatta

SEQ ID NO: 37801 - DNA, 18 bp, Homo sapiens
tatattacaaaatatatt

SEQ ID NO: 37802 - DNA, 22 bp, Homo sapiens
tatgatatcttatggcacaaca

SEQ ID NO: 37803 - DNA, 125 bp, Amsacta moorei entomopoxvirus
tttatattttttaattttgtatttgattctgataattcgtaatcacaaagaaaatattcatatatatcaaataatatatatattatttcttcggtatcataatctttgcatttacatactataaa

SEQ ID NO: 37804 - DNA, 24 bp, Amsacta moorei entomopoxvirus
tttcttcggtatcataatctttgc

SEQ ID NO: 37805 - DNA, 23 bp, Homo sapiens
tttccttgtcatgtaatctttgc

SEQ ID NO: 37806 - DNA, 61 bp, Amsacta moorei entomopoxvirus
ttgcataattatcattaataggaatatcattttcatatatggtaaattttttattatgcga

SEQ ID NO: 37807 - DNA, 24 bp, Amsacta moorei entomopoxvirus
tatggtaaattttttattatgcga

SEQ ID NO: 37808 - DNA, 21 bp, Homo sapiens
tggtaaattttattgatgtga

SEQ ID NO: 37809 - DNA, 21 bp, Homo sapiens
tatggtaaattttatgttatg

SEQ ID NO: 37810 - DNA, 80 bp, Amsacta moorei entomopoxvirus
tgtcttattttttattttatatggattattattaataaaacaataattagcagttcttataacatcataaaatatagata

SEQ ID NO: 37811 - DNA, 24 bp, Amsacta moorei entomopoxvirus
taattagcagttcttataacatca

SEQ ID NO: 37812 - DNA, 18 bp, Homo sapiens
attagcagcttatttcat

SEQ ID NO: 37813 - DNA, 19 bp, Homo sapiens
ttagcaacacttataacat

SEQ ID NO: 37814 - DNA, 18 bp, Homo sapiens
attagcagtttataacat

SEQ ID NO: 37815 - DNA, 22 bp, Homo sapiens
attagcaatatttttataacat

SEQ ID NO: 37816 - DNA, 19 bp, Homo sapiens
attagcagttattacatca

SEQ ID NO: 37817 - DNA, 26 bp, Homo sapiens
caattagcagttactgattaacatca

SEQ ID NO: 37818 - DNA, 20 bp, Homo sapiens
gcttgccctttataacatca

SEQ ID NO: 37819 - DNA, 101 bp, Amsacta moorei entomopoxvirus
gtaaaaggattattgcatttattaagtattaaaacattatctatatattttgaattatttactaatgtttgaatatatttaatacaattttgtccttgtac

SEQ ID NO: 37820 - DNA, 24 bp, Amsacta moorei entomopoxvirus
taagtattaaaacattatctatat

SEQ ID NO: 37821 - DNA, 22 bp, Homo sapiens
gtattaaaacatatatttatat

SEQ ID NO: 37822 - DNA, 19 bp, Homo sapiens
caagtattaacatcaatct

SEQ ID NO: 37823 - DNA, 63 bp, Amsacta moorei entomopoxvirus
ggatttttgcaataatatgatgttttatttttattatatgttttaattttttgcatattatcc

SEQ ID NO: 37824 - DNA, 24 bp, Amsacta moorei entomopoxvirus
ttatatgttttaattttttgcata

SEQ ID NO: 37825 - DNA, 25 bp, Homo sapiens
ttatatattttagttcccagacata

SEQ ID NO: 37826 - DNA, 21 bp, Homo sapiens
tatatatatattttttgcata

SEQ ID NO: 37827 - DNA, 23 bp, Homo sapiens
ttatatattttaatacacacata

SEQ ID NO: 37828 - DNA, 20 bp, Homo sapiens
ttatatgttttaattaatta

SEQ ID NO: 37829 - DNA, 18 bp, Homo sapiens
tgttttcctttttgcata

SEQ ID NO: 37830 - DNA, 18 bp, Homo sapiens
tgttttgttttttgcata

SEQ ID NO: 37831 - DNA, 81 bp, Fowlpox virus
tagaatataaaaatacattcgctatagaagatatagtatcaaaagataactacaagctatacgatattttaaaattttcta

SEQ ID NO: 37832 - DNA, 22 bp, Fowlpox virus
tacgatattttaaaattttcta

SEQ ID NO: 37833 - DNA, 19 bp, Homo sapiens
cgggttttaaaattttcta

SEQ ID NO: 37834 - DNA, 79 bp, Amsacta moorei entomopoxvirus
gagtatacaatacaaaatgtagcatatatttttctgtacaatatattgtaatatatactttatttgtatttaataactt

SEQ ID NO: 37835 - DNA, 24 bp, Amsacta moorei entomopoxvirus
tacaatacaaaatgtagcatatat

SEQ ID NO: 37836 - DNA, 23 bp, Homo sapiens
caatacaaagctataaaatatat

SEQ ID NO: 37837 - DNA, 22 bp, Homo sapiens
tacaaacaaaacacaaatatat

SEQ ID NO: 37838 - DNA, 26 bp, Homo sapiens
tacatatataaaacatatacatatat

SEQ ID NO: 37839 - DNA, 17 bp, Homo sapiens
tacaaaaacgcatatat

SEQ ID NO: 37840 - DNA, 22 bp, Homo sapiens
tacaatgaaaattaacatatat

SEQ ID NO: 37841 - DNA, 20 bp, Homo sapiens
tacaatctaaaatgtaaaca

SEQ ID NO: 37842 - DNA, 24 bp, Homo sapiens
tacaatacaacaaccaagatatat

SEQ ID NO: 37843 - DNA, 21 bp, Homo sapiens
aatacaaatgtagcatatata

SEQ ID NO: 37844 - DNA, 20 bp, Homo sapiens
caaaatgctttagcatatat

SEQ ID NO: 37845 - DNA, 22 bp, Homo sapiens
tacatatacgggcagcacatat

SEQ ID NO: 37846 - DNA, 20 bp, Homo sapiens
cactacaaaatccagaatat

SEQ ID NO: 37847 - DNA, 22 bp, Homo sapiens
tacatatacaaaaaacatatat

SEQ ID NO: 37848 - DNA, 21 bp, Homo sapiens
tacaatacaaggggtaggcac

SEQ ID NO: 37849 - DNA, 87 bp, Turnip crinkle virus
cctgtgcagaaagtgactcggctgagtgctccggtggcccttgcctaccgcgaggtttccacccagcctcgggtctctactgccagg

SEQ ID NO: 37850 - DNA, 24 bp, Turnip crinkle virus
ctaccgcgaggtttccacccagcc

SEQ ID NO: 37851 - DNA, 20 bp, Homo sapiens
ccactgtggggcccacccag

SEQ ID NO: 37852 - DNA, 15 bp, Homo sapiens
ctacccgccacccag

SEQ ID NO: 37853 - DNA, 24 bp, Homo sapiens
ctgtcgcggcgacttctgcccggc

SEQ ID NO: 37854 - DNA, 18 bp, Homo sapiens
ccactgcgagcgcccggc

SEQ ID NO: 37855 - DNA, 18 bp, Homo sapiens
tgaccgcctctgcccagc

SEQ ID NO: 37856 - DNA, 15 bp, Homo sapiens
ccaccgcctccaccc

SEQ ID NO: 37857 - DNA, 21 bp, Homo sapiens
cgtgaggtttcctaagcagcc

SEQ ID NO: 37858 - DNA, 23 bp, Homo sapiens
ccaccgcggggctgggtccggcc

SEQ ID NO: 37859 - DNA, 21 bp, Homo sapiens
ctaccgcgcaccacgcctgcc

SEQ ID NO: 37860 - DNA, 18 bp, Homo sapiens
ctgccccgaggccccggc

SEQ ID NO: 37861 - DNA, 25 bp, Homo sapiens
ctaccgctgagtccaggtacccggc

SEQ ID NO: 37862 - DNA, 18 bp, Homo sapiens
ccagcttggtttccaccc

SEQ ID NO: 37863 - DNA, 18 bp, Homo sapiens
gcgaggtccccgcccgcc

SEQ ID NO: 37864 - DNA, 18 bp, Homo sapiens
ctgccccggacacccagc

SEQ ID NO: 37865 - DNA, 20 bp, Homo sapiens
ccgcgaacccgtcacccagc

SEQ ID NO: 37866 - DNA, 23 bp, Homo sapiens
ctactgccacctcccacccggcc

SEQ ID NO: 37867 - DNA, 19 bp, Homo sapiens
ctgccgtaggtttccaagc

SEQ ID NO: 37868 - DNA, 19 bp, Homo sapiens
tactccggggtttccagcc

SEQ ID NO: 37869 - DNA, 18 bp, Homo sapiens
ccgcgaggagtcccagcc

SEQ ID NO: 37870 - DNA, 20 bp, Homo sapiens
gccagtgaccacacccagcc

SEQ ID NO: 37871 - DNA, 20 bp, Homo sapiens
ctatcgctgggtttccagcc

SEQ ID NO: 37872 - DNA, 18 bp, Homo sapiens
gcgcggaccgcacccagc

SEQ ID NO: 37873 - DNA, 19 bp, Homo sapiens
ctgccccgaggcctctagc

SEQ ID NO: 37874 - DNA, 23 bp, Homo sapiens
tactgctgaagattttgcccagc

SEQ ID NO: 37875 - DNA, 26 bp, Homo sapiens
tgaccgcgagtaacactcgcccggcc

SEQ ID NO: 37876 - DNA, 20 bp, Homo sapiens
cctgccagctccgtccagcc

SEQ ID NO: 37877 - DNA, 19 bp, Homo sapiens
ctaccccgaggcccccagc

SEQ ID NO: 37878 - DNA, 17 bp, Homo sapiens
ctatcgcaggtttcccc

SEQ ID NO: 37879 - DNA, 22 bp, Homo sapiens
ccgcgaggccacgtgctcagcc

SEQ ID NO: 37880 - DNA, 18 bp, Homo sapiens
ccgtggtgcccacccagc

SEQ ID NO: 37881 - DNA, 21 bp, Homo sapiens
ccatcgcaaaacttcatccag

SEQ ID NO: 37882 - DNA, 15 bp, Homo sapiens
ccgcgcccacccagc

SEQ ID NO: 37883 - DNA, 16 bp, Homo sapiens
gccaggtctcccagcc

SEQ ID NO: 37884 - DNA, 19 bp, Homo sapiens
ctaccggagtccacccagc

SEQ ID NO: 37885 - DNA, 19 bp, Homo sapiens
cctgtgaggacacccagcc

SEQ ID NO: 37886 - DNA, 67 bp, Equine foamy virus
catgtgagtaaatggaaatcaatagctgactgtaaaaaacataaggccgatatccacgtgatacatg

SEQ ID NO: 37887 - DNA, 24 bp, Equine foamy virus
tggaaatcaatagctgactgtaaa

SEQ ID NO: 37888 - DNA, 21 bp, Homo sapiens
tggaaagttacagactgtaaa

SEQ ID NO: 37889 - DNA, 17 bp, Homo sapiens
tggaatcaatagttaac

SEQ ID NO: 37890 - DNA, 22 bp, Homo sapiens
tggaaacagtgttgactgtaaa

SEQ ID NO: 37891 - DNA, 18 bp, Homo sapiens
tggaaatcaaggcatcta

SEQ ID NO: 37892 - DNA, 18 bp, Homo sapiens
tggaaatcagtaatgtaa

SEQ ID NO: 37893 - DNA, 18 bp, Homo sapiens
tggaattcagcactgtaa

SEQ ID NO: 37894 - DNA, 21 bp, Homo sapiens
tggaaatcatattgcttctgt

SEQ ID NO: 37895 - DNA, 24 bp, Homo sapiens
tgaaaatttcagattgactgtaaa

SEQ ID NO: 37896 - DNA, 24 bp, Homo sapiens
tgggggttaatagctgttccccaa

SEQ ID NO: 37897 - DNA, 15 bp, Homo sapiens
gaaatcaatactgta

SEQ ID NO: 37898 - DNA, 24 bp, Homo sapiens
tgaagatcaattgacaactgtaaa

SEQ ID NO: 37899 - DNA, 23 bp, Homo sapiens
tgtaaatcagggcaagactgtaa

SEQ ID NO: 37900 - DNA, 16 bp, Homo sapiens
gaaagtagctgactgt

SEQ ID NO: 37901 - DNA, 18 bp, Homo sapiens
tgggaacagctacgctgt

SEQ ID NO: 37902 - DNA, 20 bp, Homo sapiens
ggaaatgtaatgactgtaaa

SEQ ID NO: 37903 - DNA, 17 bp, Homo sapiens
ggacaggagctgactgt

SEQ ID NO: 37904 - DNA, 61 bp, Human foamy virus
gtaaacagtattgttggacacgtcttcctcaaggatttttaaatagtccagcattgtttac

SEQ ID NO: 37905 - DNA, 24 bp, Human foamy virus
acagtattgttggacacgtcttcc

SEQ ID NO: 37906 - DNA, 20 bp, Homo sapiens
gcactgtagagcatgtcttc

SEQ ID NO: 37907 - DNA, 15 bp, Homo sapiens
gtattgctgggcttc

SEQ ID NO: 37908 - DNA, 23 bp, Homo sapiens
gaagtattgttgctttagttttc

SEQ ID NO: 37909 - DNA, 20 bp, Homo sapiens
acagtattgttaggtacagc

SEQ ID NO: 37910 - DNA, 25 bp, Homo sapiens
aggattgttggccacagatgtcttc

SEQ ID NO: 37911 - DNA, 21 bp, Homo sapiens
acagtactgtctccctgtctt

SEQ ID NO: 37912 - DNA, 15 bp, Homo sapiens
gtattgctgggtctc

SEQ ID NO: 37913 - DNA, 19 bp, Homo sapiens
acagggttggaatgtcttc

SEQ ID NO: 37914 - DNA, 22 bp, Homo sapiens
cactgcagatggtgcgtcttcc

SEQ ID NO: 37915 - DNA, 21 bp, Homo sapiens
caatattcttacacgtcttcc

SEQ ID NO: 37916 - DNA, 20 bp, Homo sapiens
cagtattgttgtgtttcttc

SEQ ID NO: 37917 - DNA, 119 bp, Human foamy virus
gatcctaaagagcatgttcaacaattagaaaaagtgtttcaaattttactacaggcaggatatgtagtatctttgaaaaaatcagaaattggtcaaaaaactgtagaatttttaggatt

SEQ ID NO: 37918 - DNA, 24 bp, Human foamy virus
tttgaaaaaatcagaaattggtca

SEQ ID NO: 37919 - DNA, 19 bp, Homo sapiens
ttcgaaaaatcagaagatc

SEQ ID NO: 37920 - DNA, 19 bp, Homo sapiens
aaaaaatcagaagatatca

SEQ ID NO: 37921 - DNA, 23 bp, Homo sapiens
tttgaaaaacatttctatggtca

SEQ ID NO: 37922 - DNA, 18 bp, Homo sapiens
tttgaagaatcagaaacc

SEQ ID NO: 37923 - DNA, 18 bp, Homo sapiens
tctgaaaaggtcagaggc

SEQ ID NO: 37924 - DNA, 20 bp, Homo sapiens
tttgaaatataaaaattggt

SEQ ID NO: 37925 - DNA, 20 bp, Homo sapiens
tttgaaagaatcagaagggt

SEQ ID NO: 37926 - DNA, 20 bp, Homo sapiens
tttgaagacatcagaaaagt

SEQ ID NO: 37927 - DNA, 25 bp, Homo sapiens
tttaaaaaaatttgtgaattggtca

SEQ ID NO: 37928 - DNA, 15 bp, Homo sapiens
gaaaaaatcagaggc

SEQ ID NO: 37929 - DNA, 21 bp, Homo sapiens
tttggcaacccagattggtca

SEQ ID NO: 37930 - DNA, 18 bp, Homo sapiens
ttggagaaatcagaaatt

SEQ ID NO: 37931 - DNA, 22 bp, Homo sapiens
tttgaaaaaggcagaaagaatc

SEQ ID NO: 37932 - DNA, 21 bp, Homo sapiens
tttggaaatcaaagttggtca

SEQ ID NO: 37933 - DNA, 20 bp, Homo sapiens
tctgagaaaatcagaaaggc

SEQ ID NO: 37934 - DNA, 23 bp, Homo sapiens
tttgaaaaattgtaaattggtca

SEQ ID NO: 37935 - DNA, 20 bp, Homo sapiens
tctgaaaaataaattggtca

SEQ ID NO: 37936 - DNA, 98 bp, Alcelaphine herpesvirus 1
gagcgaaaggtgcctgtggagttttggaaaatcctctttgatggctgtgtcgccctgggagtgaaagaggacatgctcctctcagaggccgggcgctc

SEQ ID NO: 37937 - DNA, 24 bp, Alcelaphine herpesvirus 1
tgaaagaggacatgctcctctcag

SEQ ID NO: 37938 - DNA, 21 bp, Homo sapiens
tgaaggaagacattgctttct

SEQ ID NO: 37939 - DNA, 20 bp, Homo sapiens
gaggagggcgtgcccctcag

SEQ ID NO: 37940 - DNA, 19 bp, Homo sapiens
tgaaagagtacttttctca

SEQ ID NO: 37941 - DNA, 20 bp, Homo sapiens
gagagaggacaacagcttct

SEQ ID NO: 37942 - DNA, 19 bp, Homo sapiens
aaggcattgttcctctcag

SEQ ID NO: 37943 - DNA, 22 bp, Homo sapiens
tgaaagagggttgcttttttct

SEQ ID NO: 37944 - DNA, 18 bp, Homo sapiens
agactccgctcctctcag

SEQ ID NO: 37945 - DNA, 24 bp, Homo sapiens
gaaaggtattcatgcttttctcag

SEQ ID NO: 37946 - DNA, 18 bp, Homo sapiens
agtcacatgcttctctca

SEQ ID NO: 37947 - DNA, 18 bp, Homo sapiens
tgagaaggacattccctc

SEQ ID NO: 37948 - DNA, 17 bp, Homo sapiens
agggacagctcctctca

SEQ ID NO: 37949 - DNA, 18 bp, Homo sapiens
tgggaaaggacatgtcct

SEQ ID NO: 37950 - DNA, 23 bp, Homo sapiens
tgggagagaacaaacagtttcag

SEQ ID NO: 37951 - DNA, 19 bp, Homo sapiens
gagggggctttcctctcag

SEQ ID NO: 37952 - DNA, 18 bp, Homo sapiens
tgagagagacatgcatca

SEQ ID NO: 37953 - DNA, 19 bp, Homo sapiens
gaaaaaatgttcctctcag

SEQ ID NO: 37954 - DNA, 22 bp, Homo sapiens
tgaaggaggtcatccctctcag

SEQ ID NO: 37955 - DNA, 20 bp, Homo sapiens
aaagacttgatgctcctttc

SEQ ID NO: 37956 - DNA, 18 bp, Homo sapiens
gaagtaagggctcctctc

SEQ ID NO: 37957 - DNA, 21 bp, Homo sapiens
agaggcctgggttcctctcag

SEQ ID NO: 37958 - DNA, 20 bp, Homo sapiens
gagctcgatgctcctttcag

SEQ ID NO: 37959 - DNA, 18 bp, Homo sapiens
tggaagaggacttaacct

SEQ ID NO: 37960 - DNA, 23 bp, Homo sapiens
gaaagagaaaaccgtgcttctct

SEQ ID NO: 37961 - DNA, 24 bp, Homo sapiens
tggaagaggacaggagaaagtcag

SEQ ID NO: 37962 - DNA, 22 bp, Homo sapiens
tgagagggaactgtcctctcag

SEQ ID NO: 37963 - DNA, 15 bp, Homo sapiens
gaaaggggcccctct

SEQ ID NO: 37964 - DNA, 97 bp, Tobacco vein-clearing virus
aatagtaagagtcaatttttgtattataaatagcagttcaaatgtgaataaaaaacaggctgcagttttcaagcatccaacaattcctctctcttct

SEQ ID NO: 37965 - DNA, 24 bp, Tobacco vein-clearing virus
taaatagcagttcaaatgtgaata

SEQ ID NO: 37966 - DNA, 23 bp, Homo sapiens
taactatggttcaagtgtgaata

SEQ ID NO: 37967 - DNA, 20 bp, Homo sapiens
tagctctgtgttcaaatgtg

SEQ ID NO: 37968 - DNA, 19 bp, Homo sapiens
caaatagcagttcaaaatg

SEQ ID NO: 37969 - DNA, 18 bp, Homo sapiens
aatagcagttatcaaatg

SEQ ID NO: 37970 - DNA, 18 bp, Homo sapiens
agcacccttatgtgaata

SEQ ID NO: 37971 - DNA, 23 bp, Homo sapiens
caaatgcaattcaagtgtgaata

SEQ ID NO: 37972 - DNA, 18 bp, Homo sapiens
aaatggcagttcaatata

SEQ ID NO: 37973 - DNA, 20 bp, Homo sapiens
atagtcaatcaatgtgaata

SEQ ID NO: 37974 - DNA, 18 bp, Homo sapiens
taaggagcagttcaaata

SEQ ID NO: 37975 - DNA, 22 bp, Homo sapiens
taagcagcagtttatttgaata

SEQ ID NO: 37976 - DNA, 18 bp, Homo sapiens
agaaattcagatgtgaat

SEQ ID NO: 37977 - DNA, 20 bp, Homo sapiens
aaatagcagtttaaaaaatg

SEQ ID NO: 37978 - DNA, 19 bp, Homo sapiens
aacagcagttttcagaatg

SEQ ID NO: 37979 - DNA, 18 bp, Homo sapiens
agtatcacaatgtgaata

SEQ ID NO: 37980 - DNA, 130 bp, Tobacco vein-clearing virus
gataatatgctaatagtaggtaaacccagactatgccatcctaatgttgaaaccggtaggcagagaagccgtttaggggagtaaacgaagttgaaggcgctgttagggtaattgatcgaagcagaaaatc

SEQ ID NO: 37981 - DNA, 24 bp, Tobacco vein-clearing virus
taatatgctaatagtaggtaaacc

SEQ ID NO: 37982 - DNA, 21 bp, Homo sapiens
taatatgctaatagtatctaa

SEQ ID NO: 37983 - DNA, 17 bp, Homo sapiens
taatatgctaatgtgca

SEQ ID NO: 37984 - DNA, 23 bp, Homo sapiens
taatatgctaatcaaatcaaacc

SEQ ID NO: 37985 - DNA, 18 bp, Homo sapiens
aatatgctaatagacagc

SEQ ID NO: 37986 - DNA, 17 bp, Homo sapiens
taatatgcaataataaa

SEQ ID NO: 37987 - DNA, 23 bp, Homo sapiens
taatatactaataaatacataaa

SEQ ID NO: 37988 - DNA, 17 bp, Homo sapiens
taatatgctaatgaagt

SEQ ID NO: 37989 - DNA, 17 bp, Homo sapiens
taacatgctagttaagt

SEQ ID NO: 37990 - DNA, 17 bp, Homo sapiens
atgctaatggccaaacc

SEQ ID NO: 37991 - DNA, 21 bp, Homo sapiens
taatatgcttggtaagcagat

SEQ ID NO: 37992 - DNA, 18 bp, Homo sapiens
tatactaatagtgcaacc

SEQ ID NO: 37993 - DNA, 20 bp, Homo sapiens
taatctgctaatatgaaagt

SEQ ID NO: 37994 - DNA, 19 bp, Homo sapiens
taatatgctgaaagtaaac

SEQ ID NO: 37995 - DNA, 21 bp, Homo sapiens
tatgctaatgccataggtaaa

SEQ ID NO: 37996 - DNA, 18 bp, Homo sapiens
taatgtgtaacagtaggc

SEQ ID NO: 37997 - DNA, 20 bp, Homo sapiens
taatgtgctaatagttgtgt

SEQ ID NO: 37998 - DNA, 18 bp, Homo sapiens
atatgctaaacaaggggt

SEQ ID NO: 37999 - DNA, 17 bp, Homo sapiens
taatatgctatacaagt

SEQ ID NO: 38000 - DNA, 18 bp, Homo sapiens
tgttaacagtatcaaacc

SEQ ID NO: 38001 - DNA, 18 bp, Homo sapiens
taatatgctaagaaaagt

SEQ ID NO: 38002 - DNA, 19 bp, Homo sapiens
taatatgcaatagtctaac

SEQ ID NO: 38003 - DNA, 22 bp, Homo sapiens
taatattgctaattgagtgggt

SEQ ID NO: 38004 - DNA, 18 bp, Homo sapiens
tatgctaacaagcagagc

SEQ ID NO: 38005 - DNA, 18 bp, Homo sapiens
taacatgctaatgtatgg

SEQ ID NO: 38006 - DNA, 93 bp, African swine fever virus
agggaatggtccttttccgcactggttaacggtactgaggaggcgttgaaatctttaggaaaggtgctgtctagtttggaatctccaattcct

SEQ ID NO: 38007 - DNA, 24 bp, African swine fever virus
tgtctagtttggaatctccaattc

SEQ ID NO: 38008 - DNA, 23 bp, Homo sapiens
tctttatcaggaatttccaattc

SEQ ID NO: 38009 - DNA, 17 bp, Homo sapiens
tgtttatttggaatccc

SEQ ID NO: 38010 - DNA, 18 bp, Homo sapiens
gtgctggggtctccaatt

SEQ ID NO: 38011 - DNA, 21 bp, Homo sapiens
tctaaaactggatctccaatt

SEQ ID NO: 38012 - DNA, 24 bp, Homo sapiens
tgtccagttttatcttctccaatt

SEQ ID NO: 38013 - DNA, 21 bp, Homo sapiens
tctggctgacggtctccaatt

SEQ ID NO: 38014 - DNA, 20 bp, Homo sapiens
atttagtgctttctccaatt

SEQ ID NO: 38015 - DNA, 18 bp, Homo sapiens
gttgtggaatctttaatt

SEQ ID NO: 38016 - DNA, 23 bp, Homo sapiens
tctggtttgctcctttccaattc

SEQ ID NO: 38017 - DNA, 16 bp, Homo sapiens
tctagttcttccaatt

SEQ ID NO: 38018 - DNA, 19 bp, Homo sapiens
tgttgttctggaatcttca

SEQ ID NO: 38019 - DNA, 22 bp, Homo sapiens
tgtcagttggaatctctaattc

SEQ ID NO: 38020 - DNA, 83 bp, African swine fever virus
tgtaggtactggtggattttatgagttcctgctctatgttcggtttgacatgtggatttcctaaaggaatacctctacctgca

SEQ ID NO: 38021 - DNA, 24 bp, African swine fever virus
tgagttcctgctctatgttcggtt

SEQ ID NO: 38022 - DNA, 18 bp, Homo sapiens
tgagtgcctgctctgtgt

SEQ ID NO: 38023 - DNA, 19 bp, Homo sapiens
tgggtcctgctctccaggt

SEQ ID NO: 38024 - DNA, 19 bp, Homo sapiens
tggttcctgctttatcagt

SEQ ID NO: 38025 - DNA, 20 bp, Homo sapiens
tgagtatttgctctaatgtt

SEQ ID NO: 38026 - DNA, 21 bp, Homo sapiens
tgagttcctgcctgccgggtt

SEQ ID NO: 38027 - DNA, 20 bp, Homo sapiens
tgagttcctgtttataaaca

SEQ ID NO: 38028 - DNA, 17 bp, Homo sapiens
tgagttcttgtctgtgt

SEQ ID NO: 38029 - DNA, 23 bp, Homo sapiens
tgggtccccgcatgtgtttggtt

SEQ ID NO: 38030 - DNA, 61 bp, Human foamy virus
agccactcttttaaaaattgccaacctttattggtggccaaatatgagaaaggatgtggtt

SEQ ID NO: 38031 - DNA, 24 bp, Human foamy virus
tggccaaatatgagaaaggatgtg

SEQ ID NO: 38032 - DNA, 22 bp, Homo sapiens
tggcttagtgaatgaggatgtg

SEQ ID NO: 38033 - DNA, 21 bp, Homo sapiens
ggccaaatatggggggggggt

SEQ ID NO: 38034 - DNA, 21 bp, Homo sapiens
tggctaaatatgaagaacata

SEQ ID NO: 38035 - DNA, 18 bp, Homo sapiens
tggttaaaatatgagaaa

SEQ ID NO: 38036 - DNA, 24 bp, Homo sapiens
tggctgtgatgacaccaggatgtg

SEQ ID NO: 38037 - DNA, 21 bp, Homo sapiens
ggccaggagggaaaggatgtg

SEQ ID NO: 38038 - DNA, 18 bp, Homo sapiens
tggatgaaaagaggatgt

SEQ ID NO: 38039 - DNA, 18 bp, Homo sapiens
ggccaaatgtgggggaca

SEQ ID NO: 38040 - DNA, 15 bp, Homo sapiens
ggccaagagaggatg

SEQ ID NO: 38041 - DNA, 21 bp, Homo sapiens
tgactgtttgggaaggatgtg

SEQ ID NO: 38042 - DNA, 23 bp, Homo sapiens
tggccatgggaaaaaggggtgtg

SEQ ID NO: 38043 - DNA, 21 bp, Homo sapiens
tggtctgaagaaaaggatgtg

SEQ ID NO: 38044 - DNA, 19 bp, Homo sapiens
tagccaggtatggtggtgt

SEQ ID NO: 38045 - DNA, 22 bp, Homo sapiens
tagccgtttcagagaggatgtg

SEQ ID NO: 38046 - DNA, 18 bp, Homo sapiens
ggccagtggagaggatgt

SEQ ID NO: 38047 - DNA, 22 bp, Homo sapiens
tggctaatgtatgaggaagatg

SEQ ID NO: 38048 - DNA, 22 bp, Homo sapiens
ggctgaatatgaggacaaagtg

SEQ ID NO: 38049 - DNA, 16 bp, Homo sapiens
tggccaaagtgagagg

SEQ ID NO: 38050 - DNA, 19 bp, Homo sapiens
tggccaaatgtgaggggac

SEQ ID NO: 38051 - DNA, 62 bp, Human herpesvirus 5
gaggcgctgatctgcagctgcacggccgtggagtcgtgcagccgcatgagacgtgatacctc

SEQ ID NO: 38052 - DNA, 24 bp, Human herpesvirus 5
cgtgcagccgcatgagacgtgata

SEQ ID NO: 38053 - DNA, 19 bp, Homo sapiens
gtgcaactgcatggggcgc

SEQ ID NO: 38054 - DNA, 22 bp, Homo sapiens
cgtgcagctgcagatgaccatg

SEQ ID NO: 38055 - DNA, 64 bp, Human herpesvirus 6B
ttttgatcgaggcaccaagattctgccaaattccccaaggcatcgttgatataatctttcaaag

SEQ ID NO: 38056 - DNA, 24 bp, Human herpesvirus 6B
catcgttgatataatctttcaaag

SEQ ID NO: 38057 - DNA, 19 bp, Homo sapiens
cgttgatatagatacaaag

SEQ ID NO: 38058 - DNA, 18 bp, Homo sapiens
cgtcgatctcatctttca

SEQ ID NO: 38059 - DNA, 22 bp, Homo sapiens
gttgatgtaatctttatcaaag

SEQ ID NO: 38060 - DNA, 19 bp, Homo sapiens
catagttcataatctttca

SEQ ID NO: 38061 - DNA, 17 bp, Homo sapiens
gttgatataattccaaa

SEQ ID NO: 38062 - DNA, 18 bp, Homo sapiens
cattgttgatatgacctc

SEQ ID NO: 38063 - DNA, 22 bp, Homo sapiens
catttaccatagtctttcaaag

SEQ ID NO: 38064 - DNA, 18 bp, Homo sapiens
cactgttggtataatctt

SEQ ID NO: 38065 - DNA, 19 bp, Homo sapiens
ctgtaaaaatctttcaaag

SEQ ID NO: 38066 - DNA, 16 bp, Homo sapiens
catccttatctttcaa

SEQ ID NO: 38067 - DNA, 23 bp, Homo sapiens
catcttgatatgatttcccaaaa

SEQ ID NO: 38068 - DNA, 19 bp, Homo sapiens
catcgctgatgtaattctt

SEQ ID NO: 38069 - DNA, 62 bp, Human herpesvirus 6B
gataactaccgttcatgctgtatgcatcattataatctgacatatagacatctgtaattatc

SEQ ID NO: 38070 - DNA, 24 bp, Human herpesvirus 6B
taccgttcatgctgtatgcatcat

SEQ ID NO: 38071 - DNA, 18 bp, Homo sapiens
cgtttgtatacatgcatc

SEQ ID NO: 38072 - DNA, 22 bp, Homo sapiens
gctagaaaactgtatgcatcat

SEQ ID NO: 38073 - DNA, 17 bp, Homo sapiens
gttttgctttacatcat

SEQ ID NO: 38074 - DNA, 18 bp, Homo sapiens
cccttcagtatatgcatc

SEQ ID NO: 38075 - DNA, 23 bp, Homo sapiens
accgttcgtgttggctgcatcat

SEQ ID NO: 38076 - DNA, 23 bp, Homo sapiens
tactgtctatgaccttgcatcat

SEQ ID NO: 38077 - DNA, 68 bp, Saimiriine herpesvirus 2
gaaaatgagccctggattaaagacaataatggaaaaagtcttaagaggccaaagtttaaatagttttc

SEQ ID NO: 38078 - DNA, 24 bp, Saimiriine herpesvirus 2
aagaggccaaagtttaaatagttt

SEQ ID NO: 38079 - DNA, 18 bp, Homo sapiens
agggccaaagccttagtt

SEQ ID NO: 38080 - DNA, 22 bp, Homo sapiens
aagaagttgctttaaatagttt

SEQ ID NO: 38081 - DNA, 24 bp, Homo sapiens
agaggccagacagccaagtggttt

SEQ ID NO: 38082 - DNA, 19 bp, Homo sapiens
agaggctgaactttaaaca

SEQ ID NO: 38083 - DNA, 21 bp, Homo sapiens
aggagcccttctgaatagttt

SEQ ID NO: 38084 - DNA, 16 bp, Homo sapiens
gaagccaaagatagtt

SEQ ID NO: 38085 - DNA, 18 bp, Homo sapiens
agaggccaaagtgtagtt

SEQ ID NO: 38086 - DNA, 23 bp, Homo sapiens
aaaggccaaagttagtcgagttt

SEQ ID NO: 38087 - DNA, 65 bp, Human herpesvirus 5
tctggtatacacccgtctcgtggtacgaagtagagcgcggcaccaccggacggatgcagtccaga

SEQ ID NO: 38088 - DNA, 20 bp, Human herpesvirus 5
ccggacggatgcagtccaga

SEQ ID NO: 38089 - DNA, 16 bp, Homo sapiens
gaacggatgacccaga

SEQ ID NO: 38090 - DNA, 19 bp, Homo sapiens
ccggacggtgcctcccgga

SEQ ID NO: 38091 - DNA, 19 bp, Homo sapiens
ccagattctaaagtccaga

SEQ ID NO: 38092 - DNA, 17 bp, Homo sapiens
ccagaacacagtccaga

SEQ ID NO: 38093 - DNA, 19 bp, Homo sapiens
gacggatgtgcgccccaga

SEQ ID NO: 38094 - DNA, 16 bp, Homo sapiens
ggggaagcagtccaga

SEQ ID NO: 38095 - DNA, 19 bp, Homo sapiens
ccgagagaaaacagtccag

SEQ ID NO: 38096 - DNA, 17 bp, Homo sapiens
ccaggcggatgtcacag

SEQ ID NO: 38097 - DNA, 20 bp, Homo sapiens
acggatgcttttagttcaga

SEQ ID NO: 38098 - DNA, 15 bp, Homo sapiens
cagaggacagtccag

SEQ ID NO: 38099 - DNA, 18 bp, Homo sapiens
cctgagcacacagtccag

SEQ ID NO: 38100 - DNA, 17 bp, Homo sapiens
cggacagagaagtcaga

SEQ ID NO: 38101 - DNA, 20 bp, Homo sapiens
ccggacagaatggggtccag

SEQ ID NO: 38102 - DNA, 17 bp, Homo sapiens
cggacggaaagcctcag

SEQ ID NO: 38103 - DNA, 16 bp, Homo sapiens
ggggagtgagtccaga

SEQ ID NO: 38104 - DNA, 17 bp, Homo sapiens
ggacagaggagtccaga

SEQ ID NO: 38105 - DNA, 17 bp, Homo sapiens
cctgagaacagtccaga

SEQ ID NO: 38106 - DNA, 15 bp, Homo sapiens
ggcagacagtccaga

SEQ ID NO: 38107 - DNA, 15 bp, Homo sapiens
ccggcggaaccccag

SEQ ID NO: 38108 - DNA, 15 bp, Homo sapiens
ggcgcgcagtccaga

SEQ ID NO: 38109 - DNA, 17 bp, Homo sapiens
ccggacggatggacaga

SEQ ID NO: 38110 - DNA, 19 bp, Homo sapiens
cggacggagagcgttccag

SEQ ID NO: 38111 - DNA, 17 bp, Homo sapiens
ggaggtggaagtccaga

SEQ ID NO: 38112 - DNA, 17 bp, Homo sapiens
agacaaactggtccaga

SEQ ID NO: 38113 - DNA, 16 bp, Homo sapiens
ggacagatgtcctaga

SEQ ID NO: 38114 - DNA, 16 bp, Homo sapiens
ccgagaggcagtccag

SEQ ID NO: 38115 - DNA, 18 bp, Homo sapiens
cccgaccaaccagtccag

SEQ ID NO: 38116 - DNA, 19 bp, Homo sapiens
ggtacgggatgcagtctag

SEQ ID NO: 38117 - DNA, 19 bp, Homo sapiens
ccagacaggccagtccaga

SEQ ID NO: 38118 - DNA, 20 bp, Homo sapiens
ggagggatgcagttgctcag

SEQ ID NO: 38119 - DNA, 15 bp, Homo sapiens
cgggaaccagtccag

SEQ ID NO: 38120 - DNA, 19 bp, Homo sapiens
ggaaccggatgcagtccag

SEQ ID NO: 38121 - DNA, 18 bp, Homo sapiens
cagatgtacacagtccag

SEQ ID NO: 38122 - DNA, 17 bp, Homo sapiens
ccggacagatatccgga

SEQ ID NO: 38123 - DNA, 18 bp, Homo sapiens
ggcaaaactcagtccaga

SEQ ID NO: 38124 - DNA, 23 bp, Homo sapiens
cccgacggatgccctggtccaga

SEQ ID NO: 38125 - DNA, 17 bp, Homo sapiens
ccagacgggactccaga

SEQ ID NO: 38126 - DNA, 20 bp, Homo sapiens
ccagggtgccagggtccaga

SEQ ID NO: 38127 - DNA, 18 bp, Homo sapiens
ggaggatgcagtgttaga

SEQ ID NO: 38128 - DNA, 17 bp, Homo sapiens
ggactgcagagtccaga

SEQ ID NO: 38129 - DNA, 18 bp, Homo sapiens
ccggacggggccaccaga

SEQ ID NO: 38130 - DNA, 16 bp, Homo sapiens
ggaaacgcagttcaga

SEQ ID NO: 38131 - DNA, 16 bp, Homo sapiens
cagacttgagtccaga

SEQ ID NO: 38132 - DNA, 15 bp, Homo sapiens
ccagacgggctccag

SEQ ID NO: 38133 - DNA, 18 bp, Homo sapiens
ggatgagcaaaatccaga

SEQ ID NO: 38134 - DNA, 17 bp, Homo sapiens
cctgacgacagtccaga

SEQ ID NO: 38135 - DNA, 16 bp, Homo sapiens
ggaggctgagtccaga

SEQ ID NO: 38136 - DNA, 16 bp, Homo sapiens
ggatgagcagcccaga

SEQ ID NO: 38137 - DNA, 16 bp, Homo sapiens
caggggagcagtccag

SEQ ID NO: 38138 - DNA, 17 bp, Homo sapiens
cagaaaattcagtccag

SEQ ID NO: 38139 - DNA, 17 bp, Homo sapiens
ggacaataaagtccaga

SEQ ID NO: 38140 - DNA, 17 bp, Homo sapiens
ccgaacactcagtccag

SEQ ID NO: 38141 - DNA, 17 bp, Homo sapiens
ccgggccggaatccaga

SEQ ID NO: 38142 - DNA, 18 bp, Homo sapiens
ccgggccgtgcagtccag

SEQ ID NO: 38143 - DNA, 17 bp, Homo sapiens
ggaggctgcagtccaga

SEQ ID NO: 38144 - DNA, 19 bp, Homo sapiens
ggatggagcttagtccaga

SEQ ID NO: 38145 - DNA, 18 bp, Homo sapiens
cggacggagccagccaga

SEQ ID NO: 38146 - DNA, 17 bp, Homo sapiens
ccagagacacagtttag

SEQ ID NO: 38147 - DNA, 16 bp, Homo sapiens
ggacagaaaatccaga

SEQ ID NO: 38148 - DNA, 17 bp, Homo sapiens
ccgatggtgagtccaga

SEQ ID NO: 38149 - DNA, 19 bp, Homo sapiens
ccaggcccgtgagtccaga

SEQ ID NO: 38150 - DNA, 21 bp, Homo sapiens
cggatggatgggtcaaccaga

SEQ ID NO: 38151 - DNA, 18 bp, Homo sapiens
ccagacgggccagtcaga

SEQ ID NO: 38152 - DNA, 19 bp, Homo sapiens
ccggcctccgcagtccaga

SEQ ID NO: 38153 - DNA, 17 bp, Homo sapiens
ccagaatgcagtctgga

SEQ ID NO: 38154 - DNA, 17 bp, Homo sapiens
ccggacgaacagtccag

SEQ ID NO: 38155 - DNA, 17 bp, Homo sapiens
ggaaaatacagtttaga

SEQ ID NO: 38156 - DNA, 17 bp, Homo sapiens
ccagaacgcagtctgga

SEQ ID NO: 38157 - DNA, 18 bp, Homo sapiens
ggacagatggacaaacag

SEQ ID NO: 38158 - DNA, 18 bp, Homo sapiens
ccagacgggttacacaga

SEQ ID NO: 38159 - DNA, 104 bp, Human herpesvirus 6
cgtagtcttaaaaatttgataactaccattcatgctatatgtatcattataatctgacatatagacttcattaattattttttcaaattcattcttaatacacg

SEQ ID NO: 38160 - DNA, 24 bp, Human herpesvirus 6
ttaaaaatttgataactaccattc

SEQ ID NO: 38161 - DNA, 22 bp, Homo sapiens
ttaataatttgatgaccccatc

SEQ ID NO: 38162 - DNA, 20 bp, Homo sapiens
ttaaaaatagagctaccatt

SEQ ID NO: 38163 - DNA, 18 bp, Homo sapiens
ttaagaatctgataacta

SEQ ID NO: 38164 - DNA, 20 bp, Homo sapiens
aaaaaatgaagctaccattc

SEQ ID NO: 38165 - DNA, 24 bp, Homo sapiens
ttaaaaatgaggaaactgccattc

SEQ ID NO: 38166 - DNA, 21 bp, Homo sapiens
tcaaaaatgaagactaccatt

SEQ ID NO: 38167 - DNA, 21 bp, Homo sapiens
aaaacttgatccctattattc

SEQ ID NO: 38168 - DNA, 22 bp, Homo sapiens
ttaacaatttgatgaccccatc

SEQ ID NO: 38169 - DNA, 26 bp, Homo sapiens
tcaaaaatagttggtaactactattc

SEQ ID NO: 38170 - DNA, 85 bp, Yaba-like disease virus
taagttaaataatatacttttaaataaagtcatttttttatctgctaaaaacttaaaaaaagtatatatatttcttaatgactta

SEQ ID NO: 38171 - DNA, 24 bp, Yaba-like disease virus
taatatacttttaaataaagtcat

SEQ ID NO: 38172 - DNA, 26 bp, Homo sapiens
taattacttttacattaaaaagtcat

SEQ ID NO: 38173 - DNA, 21 bp, Homo sapiens
taatatactttagaataaagt

SEQ ID NO: 38174 - DNA, 19 bp, Homo sapiens
taaaatacttttaaataaa

SEQ ID NO: 38175 - DNA, 23 bp, Homo sapiens
taatacacttcctcaaaagtcat

SEQ ID NO: 38176 - DNA, 99 bp, Human herpesvirus 6
aatacctcaatgtcttctatgggcgtcgaattcgtatgcgtataatcggtatacacgtgcgcatgatttccagataaaaagatctttgtactaggtatt

SEQ ID NO: 38177 - DNA, 24 bp, Human herpesvirus 6
tacctcaatgtcttctatgggcgt

SEQ ID NO: 38178 - DNA, 22 bp, Homo sapiens
tactttcatgtcttcagagtgt

SEQ ID NO: 38179 - DNA, 21 bp, Homo sapiens
cttaatgtctcctgagagtgt

SEQ ID NO: 38180 - DNA, 22 bp, Homo sapiens
taccacagaccgctgtgggtgt

SEQ ID NO: 38181 - DNA, 18 bp, Homo sapiens
tcaatgtcttcttcatag

SEQ ID NO: 38182 - DNA, 17 bp, Homo sapiens
aatgtcttctatgatgt

SEQ ID NO: 38183 - DNA, 20 bp, Homo sapiens
ctcaatgtctttatgtgcgt

SEQ ID NO: 38184 - DNA, 18 bp, Homo sapiens
tccatgtcttctagaaac

SEQ ID NO: 38185 - DNA, 20 bp, Homo sapiens
ccttaatgtcttctccacgt

SEQ ID NO: 38186 - DNA, 19 bp, Homo sapiens
ccttagtctcccagggtgt

SEQ ID NO: 38187 - DNA, 21 bp, Homo sapiens
accttggtaatctatgggtgt

SEQ ID NO: 38188 - DNA, 21 bp, Homo sapiens
tacagacacgtctgtgggtgt

SEQ ID NO: 38189 - DNA, 21 bp, Homo sapiens
tactttgacgtcttctcctag

SEQ ID NO: 38190 - DNA, 19 bp, Homo sapiens
tacttccatgtcttctgac

SEQ ID NO: 38191 - DNA, 18 bp, Homo sapiens
ccttcaatgtcttttcgg

SEQ ID NO: 38192 - DNA, 62 bp, Melanoplus sanguinipes entomopoxvirus
attagtatttaatatttatttatttttttacaactaaaatcaacaattatattaatgctaat

SEQ ID NO: 38193 - DNA, 24 bp, Melanoplus sanguinipes entomopoxvirus
tttaatatttatttatttttttac

SEQ ID NO: 38194 - DNA, 19 bp, Homo sapiens
tttaatatttatttatttt

SEQ ID NO: 38195 - DNA, 25 bp, Homo sapiens
tttaatatttattaaaactttttta

SEQ ID NO: 38196 - DNA, 18 bp, Homo sapiens
tttaatatttatttattt

SEQ ID NO: 38197 - DNA, 90 bp, African swine fever virus
ggtttcagccgaggcaatgtttacatagtcctggtgcttaatttccattttaatgcttgtatactgtttgactgtctccagcttttcacc

SEQ ID NO: 38198 - DNA, 24 bp, African swine fever virus
cagccgaggcaatgtttacatagt

SEQ ID NO: 38199 - DNA, 16 bp, Homo sapiens
cagcctaggcaacata

SEQ ID NO: 38200 - DNA, 17 bp, Homo sapiens
gaggtgtcccacatagt

SEQ ID NO: 38201 - DNA, 20 bp, Homo sapiens
gctggcgccgtttacatggt

SEQ ID NO: 38202 - DNA, 21 bp, Homo sapiens
agctgaggcaatgtctttcac

SEQ ID NO: 38203 - DNA, 18 bp, Homo sapiens
agccgaggacggatatag

SEQ ID NO: 38204 - DNA, 82 bp, Rice tungro spherical virus
gggtaataactttcccaatcgggttgtgctcgtagatgatttgacttgtcaacgggcccccttattgtgacggtgcttaccc

SEQ ID NO: 38205 - DNA, 24 bp, Rice tungro spherical virus
tcaacgggcccccttattgtgacg

SEQ ID NO: 38206 - DNA, 19 bp, Homo sapiens
tcaacagggccttcttatt

SEQ ID NO: 38207 - DNA, 20 bp, Homo sapiens
tcaaggggcccccttttgga

SEQ ID NO: 38208 - DNA, 18 bp, Homo sapiens
caatgggcctccttactg

SEQ ID NO: 38209 - DNA, 17 bp, Homo sapiens
tcagcaggcccctttgc

SEQ ID NO: 38210 - DNA, 18 bp, Homo sapiens
tcagcaggccccctggcg

SEQ ID NO: 38211 - DNA, 20 bp, Homo sapiens
ccgacgggccccctggggcg

SEQ ID NO: 38212 - DNA, 19 bp, Homo sapiens
tcaacaggtttccttagtg

SEQ ID NO: 38213 - DNA, 21 bp, Homo sapiens
ccaacgggccttcttgcgacg

SEQ ID NO: 38214 - DNA, 18 bp, Homo sapiens
aacgggtttccactatga

SEQ ID NO: 38215 - DNA, 19 bp, Homo sapiens
tcagcaggttcccattgtg

SEQ ID NO: 38216 - DNA, 17 bp, Homo sapiens
aacaggttcccactgtg

SEQ ID NO: 38217 - DNA, 18 bp, Homo sapiens
aacgggtttccactgtga

SEQ ID NO: 38218 - DNA, 23 bp, Homo sapiens
tcagggggttccagtccgtgacg

SEQ ID NO: 38219 - DNA, 92 bp, Rice tungro spherical virus
cccacatcacacatcaggaagttgaaaccaatgacgatggtggcacaatgccaaccggttggtacttacctactgtgtatctcaagtgtggg

SEQ ID NO: 38220 - DNA, 24 bp, Rice tungro spherical virus
tcacacatcaggaagttgaaacca

SEQ ID NO: 38221 - DNA, 23 bp, Homo sapiens
tcacacatgtacacttgaaacca

SEQ ID NO: 38222 - DNA, 19 bp, Homo sapiens
tcacacatctgtgaagcca

SEQ ID NO: 38223 - DNA, 20 bp, Homo sapiens
tccacatcaggtgtgggctg

SEQ ID NO: 38224 - DNA, 18 bp, Homo sapiens
tcacacatcagtgcattg

SEQ ID NO: 38225 - DNA, 20 bp, Homo sapiens
tcacacattggtcagggccg

SEQ ID NO: 38226 - DNA, 16 bp, Homo sapiens
cacatcagagtaaaaa

SEQ ID NO: 38227 - DNA, 18 bp, Homo sapiens
ccaaagaagttgaaatca

SEQ ID NO: 38228 - DNA, 18 bp, Homo sapiens
tcacacattagaaagacc

SEQ ID NO: 38229 - DNA, 18 bp, Homo sapiens
acacatgggaagggagcc

SEQ ID NO: 38230 - DNA, 18 bp, Homo sapiens
acacacaaagttgaggcc

SEQ ID NO: 38231 - DNA, 17 bp, Homo sapiens
accatcagaactgaaac

SEQ ID NO: 38232 - DNA, 19 bp, Homo sapiens
tcactttcagagttgaaac

SEQ ID NO: 38233 - DNA, 23 bp, Homo sapiens
tcatgtatcaggaagacttgaaa

SEQ ID NO: 38234 - DNA, 15 bp, Homo sapiens
tcacacacagggctg

SEQ ID NO: 38235 - DNA, 15 bp, Homo sapiens
tccacatcagggctg

SEQ ID NO: 38236 - DNA, 23 bp, Homo sapiens
tcatgcacggggaagcaaaacca

SEQ ID NO: 38237 - DNA, 20 bp, Homo sapiens
tcctacattaggaagtcaga

SEQ ID NO: 38238 - DNA, 18 bp, Homo sapiens
tcatacatcaggatcctg

SEQ ID NO: 38239 - DNA, 16 bp, Homo sapiens
tcacacacaggggctg

SEQ ID NO: 38240 - DNA, 22 bp, Homo sapiens
tcacacattgtgaagcctgcca

SEQ ID NO: 38241 - DNA, 18 bp, Homo sapiens
tcacacctcaggaagtca

SEQ ID NO: 38242 - DNA, 23 bp, Homo sapiens
ccacacattagttttttgagacc

SEQ ID NO: 38243 - DNA, 22 bp, Homo sapiens
acacatcaggaaagtaaggcca

SEQ ID NO: 38244 - DNA, 21 bp, Homo sapiens
tcatacatcagttaaaagtca

SEQ ID NO: 38245 - DNA, 18 bp, Homo sapiens
tcccacatcaatggaacc

SEQ ID NO: 38246 - DNA, 17 bp, Homo sapiens
cacgtcgggagaaacca

SEQ ID NO: 38247 - DNA, 18 bp, Homo sapiens
tcaggcatcaggaagcca

SEQ ID NO: 38248 - DNA, 17 bp, Homo sapiens
ccacacatgttgggacc

SEQ ID NO: 38249 - DNA, 18 bp, Homo sapiens
tcaacatcaggaaagtga

SEQ ID NO: 38250 - DNA, 20 bp, Homo sapiens
tcacacactatctgaaatta

SEQ ID NO: 38251 - DNA, 17 bp, Homo sapiens
tccacatcaggaggtta

SEQ ID NO: 38252 - DNA, 18 bp, Homo sapiens
tcaacatcagaaatgaga

SEQ ID NO: 38253 - DNA, 18 bp, Homo sapiens
tcacacattgggaagccg

SEQ ID NO: 38254 - DNA, 18 bp, Homo sapiens
cacatcaggagaaacaca

SEQ ID NO: 38255 - DNA, 20 bp, Homo sapiens
acacatcagaggaaaagctg

SEQ ID NO: 38256 - DNA, 16 bp, Homo sapiens
tcaccatccttgaaac

SEQ ID NO: 38257 - DNA, 18 bp, Homo sapiens
cacatttggcttgaaacc

SEQ ID NO: 38258 - DNA, 18 bp, Homo sapiens
tcatacatcagacaattg

SEQ ID NO: 38259 - DNA, 18 bp, Homo sapiens
acatcaggactgaaacca

SEQ ID NO: 38260 - DNA, 23 bp, Homo sapiens
tcacacacagtcctgcggagctg

SEQ ID NO: 38261 - DNA, 18 bp, Homo sapiens
tcacacattttggagctg

SEQ ID NO: 38262 - DNA, 18 bp, Homo sapiens
tcacacatcagcgagact

SEQ ID NO: 38263 - DNA, 21 bp, Homo sapiens
tcacacatctgggacaactga

SEQ ID NO: 38264 - DNA, 18 bp, Homo sapiens
catcggcaagaagttgaa

SEQ ID NO: 38265 - DNA, 27 bp, Homo sapiens
tcacacactggggagtccaggaaacca

SEQ ID NO: 38266 - DNA, 20 bp, Homo sapiens
cacacaggtagttgaaacca

SEQ ID NO: 38267 - DNA, 18 bp, Homo sapiens
catgcatcaggacagcca

SEQ ID NO: 38268 - DNA, 22 bp, Homo sapiens
tcacacatcagagggagagtta

SEQ ID NO: 38269 - DNA, 19 bp, Homo sapiens
tcacacactaggggacacc

SEQ ID NO: 38270 - DNA, 19 bp, Homo sapiens
tccacatcaggctacaaac

SEQ ID NO: 38271 - DNA, 18 bp, Homo sapiens
tcacgtgtcagaaagcca

SEQ ID NO: 38272 - DNA, 17 bp, Homo sapiens
tccacatcaggaaactg

SEQ ID NO: 38273 - DNA, 23 bp, Homo sapiens
tcacacatcaagatctgagacca

SEQ ID NO: 38274 - DNA, 80 bp, Melanoplus sanguinipes entomopoxvirus
atatcagatataaaaacattgattgggtattagatattgatatttttgatacattattgatattttaacatatcagatat

SEQ ID NO: 38275 - DNA, 24 bp, Melanoplus sanguinipes entomopoxvirus
tacattattgatattttaacatat

SEQ ID NO: 38276 - DNA, 18 bp, Homo sapiens
ctattggaattttaacat

SEQ ID NO: 38277 - DNA, 21 bp, Homo sapiens
acatttttgattttaacatat

SEQ ID NO: 38278 - DNA, 18 bp, Homo sapiens
ttaccatattttaacata

SEQ ID NO: 38279 - DNA, 23 bp, Homo sapiens
tacaaaatgatattttggcatat

SEQ ID NO: 38280 - DNA, 20 bp, Homo sapiens
ctaatgatattttagcatat

SEQ ID NO: 38281 - DNA, 74 bp, African swine fever virus
taattatcatgtcaaggatgtcatagacattgtcatcgtcatagacactgtcatcgtcattgacattgtcatta

SEQ ID NO: 38282 - DNA, 24 bp, African swine fever virus
tcaaggatgtcatagacattgtca

SEQ ID NO: 38283 - DNA, 20 bp, Homo sapiens
aggtgaaactcagacattgt

SEQ ID NO: 38284 - DNA, 15 bp, Homo sapiens
tcaagaagacattgt

SEQ ID NO: 38285 - DNA, 19 bp, Homo sapiens
tcaaggatgccagtttgtc

SEQ ID NO: 38286 - DNA, 18 bp, Homo sapiens
aagggtgtcatagcctcg

SEQ ID NO: 38287 - DNA, 19 bp, Homo sapiens
tcaaggattcatagagatt

SEQ ID NO: 38288 - DNA, 18 bp, Homo sapiens
ggagtaggtagacattgt

SEQ ID NO: 38289 - DNA, 18 bp, Homo sapiens
ggatggagtagacattgt

SEQ ID NO: 38290 - DNA, 18 bp, Homo sapiens
agtggtcatagatattgt

SEQ ID NO: 38291 - DNA, 16 bp, Homo sapiens
tcaagatgtcacttgt

SEQ ID NO: 38292 - DNA, 26 bp, Homo sapiens
tcaaggatgttatggtatgacaatgt

SEQ ID NO: 38293 - DNA, 19 bp, Homo sapiens
aaggataaatggacattgt

SEQ ID NO: 38294 - DNA, 85 bp, Melanoplus sanguinipes entomopoxvirus
caatatcaatattggtataaaatatataaaacataaactagacttttatagtatgtaaatatatcatatatcaaaacatttattg

SEQ ID NO: 38295 - DNA, 24 bp, Melanoplus sanguinipes entomopoxvirus
tataaaatatataaaacataaact

SEQ ID NO: 38296 - DNA, 19 bp, Homo sapiens
tataaaatatataaaagca

SEQ ID NO: 38297 - DNA, 19 bp, Homo sapiens
tataaaatatacaaaacat

SEQ ID NO: 38298 - DNA, 24 bp, Homo sapiens
tataaaatacaataaacataaact

SEQ ID NO: 38299 - DNA, 18 bp, Homo sapiens
tattaaatatataaaaca

SEQ ID NO: 38300 - DNA, 20 bp, Homo sapiens
tataaaatatttaaaacaca

SEQ ID NO: 38301 - DNA, 71 bp, Melanoplus sanguinipes entomopoxvirus
tcctttattgaactttagatatttaataaaatgtatcgatattgatattagatataaaaacattaattgga

SEQ ID NO: 38302 - DNA, 24 bp, Melanoplus sanguinipes entomopoxvirus
ttgatattagatataaaaacatta

SEQ ID NO: 38303 - DNA, 17 bp, Homo sapiens
ttgaattagatataaaa

SEQ ID NO: 38304 - DNA, 80 bp, Melanoplus sanguinipes entomopoxvirus
atatcagatataaaaacattaattgggtattagatattgatatttttgatacattattgatattttgtgatatcagatat

SEQ ID NO: 38305 - DNA, 20 bp, Melanoplus sanguinipes entomopoxvirus
tattttgtgatatcagatat

SEQ ID NO: 38306 - DNA, 18 bp, Homo sapiens
tattctgtgttctcagat

SEQ ID NO: 38307 - DNA, 19 bp, Homo sapiens
tattttgtgataaaaacat

SEQ ID NO: 38308 - DNA, 17 bp, Homo sapiens
cttaatgtatcagatat

SEQ ID NO: 38309 - DNA, 18 bp, Homo sapiens
tatttcctgatatcagat

SEQ ID NO: 38310 - DNA, 17 bp, Homo sapiens
ttttggacctcagatat

SEQ ID NO: 38311 - DNA, 17 bp, Homo sapiens
ttttgtgaatctgatat

SEQ ID NO: 38312 - DNA, 20 bp, Homo sapiens
tattttgaacactcagatat

SEQ ID NO: 38313 - DNA, 18 bp, Homo sapiens
attttgcaatatagatat

SEQ ID NO: 38314 - DNA, 18 bp, Homo sapiens
tttgaaaacatcagatat

SEQ ID NO: 38315 - DNA, 19 bp, Homo sapiens
ttttgtgggcatcagatat

SEQ ID NO: 38316 - DNA, 19 bp, Homo sapiens
tatcttgcatttcagatat

SEQ ID NO: 38317 - DNA, 18 bp, Homo sapiens
tgtaaaaatatcagatat

SEQ ID NO: 38318 - DNA, 21 bp, Homo sapiens
tattttgcagggatcagatat

SEQ ID NO: 38319 - DNA, 20 bp, Homo sapiens
tattttatgattccacatat

SEQ ID NO: 38320 - DNA, 17 bp, Homo sapiens
tattttgtgacataaat

SEQ ID NO: 38321 - DNA, 17 bp, Homo sapiens
tactttgcaccagatat

SEQ ID NO: 38322 - DNA, 19 bp, Homo sapiens
ttttgtacctatcagatat

SEQ ID NO: 38323 - DNA, 19 bp, Homo sapiens
tatattgtgacaggcagat

SEQ ID NO: 38324 - DNA, 17 bp, Homo sapiens
cattttgtatttcagat

SEQ ID NO: 38325 - DNA, 17 bp, Homo sapiens
tttcacacatcagatat

SEQ ID NO: 38326 - DNA, 19 bp, Homo sapiens
tataatatatatcagatat

SEQ ID NO: 38327 - DNA, 62 bp, African swine fever virus
ctatgtttattgtcatggcgacagtgttgatacactttgtttcccgtgactcttaaaattag

SEQ ID NO: 38328 - DNA, 24 bp, African swine fever virus
tgtttattgtcatggcgacagtgt

SEQ ID NO: 38329 - DNA, 18 bp, Homo sapiens
tatttattgtctgtagtg

SEQ ID NO: 38330 - DNA, 25 bp, Homo sapiens
tgtttatccttgctggtggcagtgt

SEQ ID NO: 38331 - DNA, 22 bp, Homo sapiens
tgtttattatcaggactagtgt

SEQ ID NO: 38332 - DNA, 23 bp, Homo sapiens
tgtttattggtagttgtcagtgt

SEQ ID NO: 38333 - DNA, 16 bp, Homo sapiens
tatttattgttacagt

SEQ ID NO: 38334 - DNA, 95 bp, African swine fever virus
ggaagcaatgatttttacatagtgttcctgcaaattttaatacctcttcaagttcactttgttggatagtatcgcaggaactcggtgttgtttct

SEQ ID NO: 38335 - DNA, 24 bp, African swine fever virus
ttggatagtatcgcaggaactcgg

SEQ ID NO: 38336 - DNA, 17 bp, Homo sapiens
ctggagtgcaggaactg

SEQ ID NO: 38337 - DNA, 17 bp, Homo sapiens
ttggatagctgacagaa

SEQ ID NO: 38338 - DNA, 21 bp, Homo sapiens
tggatcctcgcgggaactcgg

SEQ ID NO: 38339 - DNA, 61 bp, African swine fever virus
gattattatattcatctcgcaccacgaagtgattctttaaggtttcgagagaatatttatc

SEQ ID NO: 38340 - DNA, 24 bp, African swine fever virus
tattatattcatctcgcaccacga

SEQ ID NO: 38341 - DNA, 20 bp, Homo sapiens
ttacattcatttctcatacg

SEQ ID NO: 38342 - DNA, 131 bp, Southern cowpea mosaic virus
attatgtcctgtttggtgtccaaaatggagactctccccccagagcttggctaccgcgagatatccctagaggatgtcggactccgtagttttgagtttctagaggtggagattgagaataggggcaaagt

SEQ ID NO: 38343 - DNA, 24 bp, Southern cowpea mosaic virus
tatgtcctgtttggtgtccaaaat

SEQ ID NO: 38344 - DNA, 16 bp, Homo sapiens
tatggcctggggtcca

SEQ ID NO: 38345 - DNA, 20 bp, Homo sapiens
tgttttggtttgtgtccaaa

SEQ ID NO: 38346 - DNA, 19 bp, Homo sapiens
tatgtcctgtttggacaaa

SEQ ID NO: 38347 - DNA, 19 bp, Homo sapiens
tgtcctgtttgggtggcca

SEQ ID NO: 38348 - DNA, 20 bp, Homo sapiens
tatgtcctgttagatgttca

SEQ ID NO: 38349 - DNA, 21 bp, Homo sapiens
tgtcttgtttatctccaaaat

SEQ ID NO: 38350 - DNA, 16 bp, Homo sapiens
atgtcctgctgttcaa

SEQ ID NO: 38351 - DNA, 21 bp, Homo sapiens
tgtttgtgaggggtccaaaat

SEQ ID NO: 38352 - DNA, 20 bp, Homo sapiens
tatgttttatttggttaaca

SEQ ID NO: 38353 - DNA, 16 bp, Homo sapiens
tgtctgtttgggtgca

SEQ ID NO: 38354 - DNA, 18 bp, Homo sapiens
tatgtcctgttgccaaaa

SEQ ID NO: 38355 - DNA, 18 bp, Homo sapiens
tatgttgtatgtccaaaa

SEQ ID NO: 38356 - DNA, 21 bp, Homo sapiens
tgtcttttgtttggccaaaat

SEQ ID NO: 38357 - DNA, 18 bp, Homo sapiens
tatggcctgtttgcaaaa

SEQ ID NO: 38358 - DNA, 21 bp, Homo sapiens
tccatcattggtgtctgaaat

SEQ ID NO: 38359 - DNA, 18 bp, Homo sapiens
tgtctgctggtgttcaaa

SEQ ID NO: 38360 - DNA, 16 bp, Homo sapiens
tgtcctgtttctccaa

SEQ ID NO: 38361 - DNA, 74 bp, Frog adenovirus 1
tctggcattttcccaaattttttgccatgttttttgtacaacagttgtttaaaaatggcttgggaattgcttgg

SEQ ID NO: 38362 - DNA, 19 bp, Frog adenovirus 1
tggcttgggaattgcttgg

SEQ ID NO: 38363 - DNA, 17 bp, Homo sapiens
tggctcgggagccctgg

SEQ ID NO: 38364 - DNA, 18 bp, Homo sapiens
ggttgagacattgtttgg

SEQ ID NO: 38365 - DNA, 18 bp, Homo sapiens
tggacccaggttgcttgg

SEQ ID NO: 38366 - DNA, 17 bp, Homo sapiens
tggcttggagattctgg

SEQ ID NO: 38367 - DNA, 17 bp, Homo sapiens
tggcctgggtatattgg

SEQ ID NO: 38368 - DNA, 20 bp, Homo sapiens
ggcttgggggttgtttctgg

SEQ ID NO: 38369 - DNA, 17 bp, Homo sapiens
tggcctgggcttgttgg

(The sequence listing continues in the following parts.)

The invention claimed is:

1. An isolated nucleic acid, wherein the sequence of the nucleic acid consists of:
   (a) the sequence of SEQ ID NO: 37405;
   (b) an RNA equivalent of (a); or
   (c) the complement of (a) or (b), wherein the complement is identical in length to the nucleic acid of (a) or (b).

2. A vector comprising the nucleic acid of claim 1.

3. A probe comprising the nucleic acid according to claim 1.

4. An isolated nucleic acid, wherein the sequence of the nucleic acid consists of:
   (a) the sequence of SEQ ID NO: 37404;
   (b) an RNA equivalent of (a); or
   (c) the complement of (a) or (b), wherein the complement is identical in length to the nucleic acid of (a) or (b).

5. A vector comprising the nucleic acid according to claim 4.

6. A probe comprising the nucleic acid according to claim 4.

* * * * *